United States Patent 6,812,339 (POLYMORPHISMS IN KNOWN GENES ASSOCIATED WITH HUMAN DISEASE, METHODS OF DETECTION AND USES THEREOF) - sequence listing, part 15

SEQ ID NO: 12255 - DNA, 54878 bp, Human
  misc_feature (1)...(54878): n = A,T,C or G
ccaggctggagtgcaaaggcgccatctcggctcaccgaaacgtctgcctcccaggttcaatcaattctcctgcctcagcctccggcgtagcgagtagctgggattacaggaatgctccactacgcctgggtaattttgtatttttagtagagacggcgtttctccatgttggtcaggctggtcttgaactcccgacctcaggtgatccgcccgcctcggcctcccaaagtgctgggcttacaggcgtgagccactgcgcccggcctttttttttttttttttgagactgagtttcgctctcgttgcccaggctggagtgcaatggcgcgatcttggctcactgcaacctctgcctcctgggttcaagcgattctcctgcctcagcctcccgagtagcagggattacaggcacccgccaccacgcccagctaattttttgtatttttagtagagacgcggtttcactatgttggccaggcttgtctcgtactcctgagctcagatgatccacctacctcggcctcccaaagtgctggaatttcaggcgtgagccacggcgcccggcctgcatggggatattctatggatgttcgggtcctaggttactttatgaggacccacaagacatctggaaagaggataaccaggtcattctgggggttacaaaacctgttttttttgtttgtttgttttgttttgttttgagacagtttcgctctgtcgtccaggctagagtgcagtggcgcgatctccgctcactgcaagctccgcctcccaggttcatgccattctcctgccccaggctcccgagtagcctgggactacaggcgcccgccaccacgcccggctaattttttgtatttttagtagagacggggtttcaccgtgttagccaggatggtctcgatctcctggcctcgtgatccacccgcctcggcctcccagagtgctgggattacaggcgtgagccaccgcgcccggccacaaaacctgttttaatggagttatttcatgggccatgagtttgagaggatctatctgaccgactcttaccccgaatgttttaccattcctctttatttattcattccacagataattatggagcccctactatgtacgaagtcactggaggagctggagatacaagagtgaaccaaacacagtccttgctccccagaagttttacagtctgctcagagagactggtcttcccaccagggttcatagcctacggggtactttgttaaaaacgagcagttactacgaagactacaatgggagaaatttttctgtgtatctccatgccctttggagcacagataattgacagttggaggctaaaggggttgggtcgcgggaaggttgtgataagtccctgatagcctcccgtgcccttttttgacaggtcttcactgattcatgcatcaaatatttactgaactccgtcactgtgcagtgcctaactttgtgcttgaggcaaacaaaacacagatctatttcgaatgccattccgaggaaggtaagacatgcacgcacgtttaatcaaatagtaaacaagagtagtaaaacaggaaaaagactaagaagagttcttggtggtattaaatgttttgtgatattcgacaccttaacgtctctgacttgacaccagtactcccgcagagagttctttcctgggttaggaatttcagaggacttggcggaccgactcttgtcccgagttcagatcactcgacccagtcctagcaaagaactgaacctaagaggacctgccgagccaccgtagggactgtcggccaacccgcgcgcgcacatcttccacccgtggactcgtcagggcgtgaggacccacctcacgtgaccattagcagcctcccgattggttttgctccttttttctccccaatgagtgggctgatgccccgagaaggtcgggcgcatgcgcagtgctcggattttttgcttggctacccggagtgaagcggccgggttgggcgattaacaggccgtggttaggaaggacggagaaggggcgttcgctcctttgggacttttcatgcctcgtttttttttcagatgtggcttggtctgggcgcaaggtcccagcagccagcttaagcttactcttctgtgaaaggggaaagtatcccctgtggaaagcggttaaacttgtggagggggtgcgggacgtgagttcttccccatgccaggcgaatggtgtggccttgagctggtccaggagccggctcgacgtgtctgagggaggccccggagggggcggggaggtggcccacagaacgcgggttctgtaaagagacgttgggaagattcgattccgagaagaggaagaaccggattgaaagagagccaggccgctgagggggagggggctgctaagatggcgtcggcctcctccgggccgtcgtcttcggtcggtttttcatcctttgatcccgcggtcccttcctgtaccttgtcctcaggtaagcccggcagggcgtgggtagggagctggtgaggaatatgcgatgggaggaagagcgagacctaagagggtacctgtagctgggaatgtcctacgtgttaccggtaagtgggcgcgagctgggctttcaaatagggatttatgagcgggcaggagtttgaggaaaggataagtttgattaagaagttgtcgaaaactttggttgtctttgaggaggacggatggagattgaaggtgggggtagggtggcccggcgcggtggctcacgcctgtaatctcagcactttgggaggccttggcgggcggatcatttgaggtcagaagttcgagacgagcctggccaacatagtgaaatctcgtccctactaaaaatacaaaaattatccggacagtagtggcgtgcatctgtaatcccagctacttgggaggctgaggcaggataatcccttgagcctgggaggcagagcttgcggtgagccgagattgggccactgctctccagtctgggcgagagagtgagaccctgtctcaaaaaaaaaaaaaaagaagttgcggtaggaaacaagagaaacggaagggagtagagaaactaagaaagtaaatggaggcctaagaagtagagagaactacttagtgtgagaggcaggtggaatctaagttgattgtgggctaattggatgaaaatgttgaagagaagccatgggacttaaaagatatcgaaaagttattggacgctttcgatttctggagaggtagggaatcgtgaattttgttgggtgggcgggagttgttgaagccatcttttccctcagatactcccccctaatgtgtcaccccttctcacttcgcacccccacccttagggccgcacaggcacacagacacacatacatactttctcagactaattcctttggtgattcccaactctaaactgcccaactttgggaaggaatggaaattttgaagagagtctaaggaatgtaggaaattaaggtcaaagaccttaaaaacagatgggaaagatggaatggagtcttgaattgcagtagagactgcgagaagtgatgttttggaaattaggcctgagaagaagaaagatgggtgggggggtgactgtaagtgttgtgggggagtattgcataatagaaaaatggactggaagaatgcttacgctgtatcaggagattggaatttggagaatggagccaggttaatgtagagagctcagcgtattaatagttaaaaacgaatgaagattgagggagggctgaggaggctcacaagaaaagcagtagattgtgtgtaggggagaaagtgtgtgtatgtgtgtcgggtgggggggcgggaggtgagtcagaaactgagcgcttccatcagaagtgtctggtgtttcacagtaactgctgcttctacactggaatagacgctgccagatgttggatgctttgcttgagattttggtatttcctcaggcctggtgttgcgtttttgctgtttagaatttgctgaatagggttccttccacctttcacattccagctcagatgctgaaatatctagtcacacatatcttcttaataagctgcagttttatttatttttaataaatctctatttttagtttgttgagaggggattttttacctttcctataaaagtattaggggaccagaacaactcatgctgcattataagcatgaaataggataaagtaaaagtgacagggtatttatttatttatttatttatttatttatttatttttgagacggagtctcgctctgtcgcccaggctggagtgcagtggggccatctcggctcactgcaagctctgcctcccgggttcacgccattcttttgcctcagcctcccgagtagctgggactacaggcgcccaccaccacgcctggctaattttgttttttgtatttttagtagagacggggtttcaccgtgttagccaggatggtctcgatctcctgaccctgtgatccgcccgccttggcttcccaaagtgctgggattataggcgtgagccaccgtgccccacctgggtttttatttttaatagagtagctccttaatttgaaacctgcttcccctctaatccccaacccagaaagaagaagggttgtgtatggtccataaacaaacttctcaactattaagtcaggtgtttgctttgtactctttggtatttttgtaggtctttatgttttctgtcagatcctctcactaacagttaataatacagattgtataaatgtttttgtggttttttttttgagacagagtatcattctgtcacccaggctggagtgcagtggtgccatcttggcttactgcaacctctgcctcccagcttcgaatgagtctcctgactcagtctcccaagtagctgggaatacaggcatgtgccatcatgcctggctattttatttttttgtgtttttagtagtgatggggtttcatcatgtcagccagactagtcttgaactcctgacctcaagtaatccgcccacttcggcctccaaaaatgctgggattacaggcatatcgcaaggtcaggagttcgagaccagcctggccgacatggtgaaaccccatctctactaaaaaatacaaaaaaattagccaggcatgttggcgcaggcctgtaatcccagctacttaggaggctgagtcaggagaattgcttgaacccgggaggcagaggttgcagtgagccgagatcacaccactgcactcccagtctgggtgacagagcaagactctgtctcaaaacaaaaaaaagggggcaaaaagtggctaaatttcaagctcttgatggactatggaaagattataatggcctccaccaaatccaaacatggtaattgctccaatagcaaaagtagttaaacatctcttagagcttatggtttgctttactctgtgtatttcacttgtcaacagtgtaaaagctgacagcttaatggtgaaactatctttaatattggcagggaacaaactctcctaaataacctctccttcccaatttaaatgccagaagattgggagtgcctagaagttgtgagtggcttatcaaaaactgtcaatatgtccttggctatgacatttttgttttatatccattttcagcattgtcagagaacattgtcctttaggatttcagagtttcaccaaaacttaagtggagttcagctaaacagctgagaacagtaaatggttttagggtggttgacacgcacacttcttgaatttctacagggccagccttctagcctttaacaattcaggaaatcataaaccatcacttgttcctgccaacttcctaattcctctggtaccatgcagacaaagaaacactctcttccaatcgcaaataaaatcttttttctctttttttaggtggactcttgctcttgtcacccaggctggagtgcagtggggtgatcttggctcattgcagcctcagcctcccgggttcaagcgagttgcctgctcagcctcccaagtaacagattacaggcacctgcccaccacatctgactaatttttgtattttagtagagacagggtttcaccatgttggccaggctggtctcaaactcctgacctcaggtgatccacccatctcgggctcccatagtgctgggattacaggcgtgagccaccatgccctgccagtaaagtctttttttttttttgagagggagtctctctctgtcgcccaggctggagtgcggtggagcaatcttggctcactgcagcctcagcctctagagttcaagcgattctcctgcttcagcttcccaagtaactgagattacaggcacctgccacgtctggctaatttttgtattttagtagagatcagatttcaccatgttagtcaggctggtctcaaactcctgactcaggtgatnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaaaaagaaaagggaacaagaaaacttatcagtttatttttctttcttctttttactgggtttccttgatcaaggacaaaagtgtacttcaagaatatactctttcctgatggccaggtagagagggaatctttgtttttctgtgctccatacccagcccagagagactgaatgaaacaccgatggtgtttcctagaggaaaccctaagaagcccgtttcccctattgcacctcacttctctgccctttcccatctaaacagagaatttaatttcgacatatgtttatcctgttttgttcatatctcctacaagcttttattcttttactgttttctatttgaagtgaacttttttccctcaacccctccatctttttaaactgtctccatttttctttattctcctgtgaaatttcagtctgtttatttgtaatggttgtattcagtatgtattaatttacaaatatctaattcctggaaaatctctcttgttggaatctgaggaagacattggcaaaaagagaggaaggtaggtctgttgtagggagttcagcatattcttattatttaccttgtatacttaactgagcaatatggaagtaatccagaataagctgtccaaaaagattagagatattggttgggggtgggcaaaggggaggtgagcaaaggaagttggcgagagggaatgagaagagggttttttgttcttgtttgtttgtttttaggatatttaattagagtatattaatactttttttgttttgttttgttttgttttttgaggcggagtttcactcttttgcccaggctggagtgcagtggtgggatctcagctctctgcaacctccacctcccgggttgaagcgattcaccagcctcagcctcccaagaagctgggactacaggcacgtgccaccacatccggctaatttttgtactttcagtagagacagggtttcaccatgctggccaggctggtctctaacccctgacctcaggtgatctgcccacctcagcctcccaaagtgctgggattataggcgtgagccaccttcccggctatttttgtatttttagtagagacggggtttcgccatgttcgccaggctggtctcgaacttctgacctcaggcgaccctcactgcaaccttcgcctgctgggttcaagcgattctcctgtcttagcctccctagtagctgggattacaggtacacaccaacatgcctagctaatttttgtatttttagtagagatgaggtttcaccatgttggccaggctgatcttgaactcctgacctcaagtgatctgcccgccttggcctcccaaagtgctgggattacaggcgtgagccaccgcgcctggtctgaaatatgttcattttaatccagcagaattcattgctgtttcaagatagaaccagatttggaaataaaattggaaggtggctatctgccaaaaatttcaagtgcctcttggccatgggtagcttattcaggaaacccaagtcttttaaggaaggacttggatttttttcttaatttcaaagaacgtttttgtgccaagggatacatatttgaggtctgagaaccatgaaacttgtttgtaggattagaagcaaaagttgactagagggaaatgtagagttattttaatttaactccctcattttccaaattaggaaactgaggtaaagatgttgcataaaggctgtatgttaccaagattaatctttttttttttttttgagatggagtctcgctctgtccctcaggctggagtgcagtggcgtgatctcggctcactgtgacctctgtcttccaggttcaagtgattctgcttcctcagcctcccaagtagctgggattacaggcgcacgccaccacgcctggctaatttttgtatttttagcagagtcagggtttcaccatgctggccaggctggtcttgaactcctgacctcgtgatctgcctgcatcggcctcccaaagtgctgggatgattacgggcatgaggcaccacacctggccatcaagattaatcttaataaatatgttgctccttcttttttttttttttgagacagagtttcgctcttgctgcccagtctggagtgcagtggtgcgatcttggctcactgcatcctcctcctcctgagttcaagtgattcccctgcttccctagtagctgggattacaggcacatgccaccacgcctggctaatttttgtatttttagtagaaatggggtttctccatgttgggtcaggctgttctcgaactcctaacttcagctgatccacctgccttggcctcccaaagtgctgggattacaggtgtgagccaccgggcccagctggctcattctttgatatactgcttttaattggctattagctgaggtgaccccaggactggtagatcaaattgctttcaagcttttgtttctagggacatccttgcacttctgactgtttcctagaagagcgttaggaaaaatttacaccagctaagaaacaaaatttagcttttctctgaaatgtggcttggttttcttttcttttttttttttttttggagatggagtctcactctgtcgcctaggctggagtgcagtggtgcaatcttgggtcactgcaagctccacttcccgctttcaagcgattcccctgcctcagcctcctgagtatctgggattacaggcgcacaccaccacgcccagctaatttttgtatttttagtagagacggggtttcaccatgttggtcaggctggtctcgaactcctgactttggcatccacctgcctcagcctcccaaagtgctgggattacaagtgtgagccactgcgtccggccgtggcttggttttcttaatttgcttgatccagtcattattaaggatgttgtaatggtacgcttttttttttttttttttttttttttttggagacggagtcttgctctgttgcccaggctggggtgcactggtgcaatctcggctgactgcaagctccgcctcctgggttcacgccattctcttgcctcagcctcccgagtagctgggactacaggcgcctgctaccacgcccggctaactttttgtattttttttggtgggggtgtttcaccgtgttagccaggatggtctcgatcttctgacctggtgatctgcctgcctcggcctcccaaggtgctgggattacaggcgtgagccactgcgcctggccgctttttttttttttgaacacacttccttagagctatgtgttcagcagtacttctcaggaggcaggttgacatttcaagagtattttcagttgaagaacaatttgtgtctcccacctgcaggcgtatagagtgtctttcagtattccaagttaactaggaccagagagattgcctcagataatccagcaaataactgggtagattttgtttttgttctattatattgtaagggatcttgctttttttctttcccccgcccaagacagagtcttgctctgtcgcccaggctggagtgcagtggcacgatgccatctcactgcaacctccgcctcctgggttcaagcaattctgccttagcctctctagtagctgggattacaggcgcgtgccaccatgcctggctaatttttttttttttttttttgagatggagttttgctcttgtcgcccaggctggagtgcaatggcatgatctctgctcaccgcaacctctgcctcccaggttcaagcaattctcctgtctcagcctcctgagtagctgggattacaggtatgcgccaccatacctggctaattttgtatttttggtagagatggggtttctccatgttggtcaggctggtcttgaactcctgacctcaggtgatccgcccacctcagcctcccaaagtgctgggattacaggtgtgagccaccgtgccccgcctgtattgttagtagagacggggtttcaccatgttggccaggctggtcttgaactcctaatcctaacctcgtgatctgcccacctcagccttccaaaatgctggagttacaggcgtgagtcaccacgactagcctgcattttttttttctttcttttttctgagatggagtcttgctctgttgcccaggctgattgatgtgcagtggtgcaatcttagctcactgcaatctctgcctcctgggttcaagagattcttgtgcctctgcctctcgagtagctgggattataggtgcccgccaccgtgtctggctaatttttgtattttcagtagagacggggttttgccatgttagccaggttggtctcgaactcctgacctcaggtgatctgcctgcttccgcctcccaaagtgctgggattacaggtgtgagccactgcgcccgccctccccggcccccccacttttttttttcctcgagactggatctcactctgtcatccagggtggtgtgcaatggcatgatgatagctcactgtagcctcaaactcctgggctgaagtgatcctcccacctcagcctactcaggattacaggcatgggccaccacactgctgtttttttttttttcttaagtagagacagtctcatcatattgctcagtcgatctcaaactcctggcctaaagcgatcctcctgtctcagcctctcaaagtgctggaattacaggcatgagccaccctgcttggtgtggcgctccatctttatcaaccaaaagtccactgagagttagcattttaattccaaaaaagctgcttatctctttgtgctctatgtaggaactattgacatacatatatattttttgagatggagtctcgctctgttgcccaggctggagtgtagtggcatgatctgggctcactgcagcctcccgtctcctgggttcaagtgattctcctgcctcagcctcccgagtagtcgggattacaggtgtgcgccaccatgcccggctaatttttttgtatttttagtagagacgggttttgccatgttgaccaggctggttttgatctcctgacctcaggtgatctacctgcctcagcctcccaaagtgctgggattacagtcatgagccattgtgcccgggcttattgacatatttatgtagtagtgttggtaggcaattaaattggacctcagggattgtttccctatgacctgtttgggcaaaactccagttgtctgaggaatgcatatctggctagcctttagtgtccccaaattatatgtttatttcaaacattagagtcagtcacacactgcttcttggtttctcatcagtagatgatgtcattgcatctctgacagaaatgcttctgctctgaaagtgcagggagaggctgtgnnnnnnnnnnnnnnnnnnnnnnnnnnnnnnnnnnnnnnnnnnnnnnnnnnnnnnnnnnnnnnnnnnnnnnnnnnnnnnnnnnnnnnnntttccacctgtagtcccagcactttggggggctgaggcaggcagattgcttgagctcaggagtttgaaaccagcctgggtaacatagtgaaaccctgtctctacaaaaaatataaaaattagctgggcatggcgatgtgtgcctgtagtcccagctactctggagtctgaggggagaatcacttgaacctgagaggttgaggctgcagtaagctgtgttcctgccactgccctccagcctgggtgacagagtgagaccttgtctcaagaccaaaaaacttaaaagatattttgttggccaggcgtggtggctcatgcctgtaatcccagcactttgggaggctgaggcgggcagatcacaaggtcaggagatcgagaccatcctggctaacatggtgaaaccccgtctctactaaaaatacaaaaaattagccgggcgttgtggcgggcgcgtgtagtcccagctactcccagctgctcgggaggctgaggcgggagaatggcatgaacccgggaggcggagcttgcagtgagccaagatcgtgccactgcactccagcctgggcgacagagcaagagtctgtctcaaaaaagaaaaaaaaaggccgggtgcggtggctcacgcctgtaattccagcactttgggagaacgaggcgggcggatcacgaggtcaggagatcgagaccatcctggctaacgtggtgaaaccccgtctctactaaaaacaaaaaataaaaaaaaaattagctgggtgtggtggcaggtgcctgtagtcctagctattcgggaggctgaggtaggagaatggcgtgaatccgcaaggcagagcttgcagtgagccaagatcacgacgctgcactccatcctgggtgacagtgtgagactccgtctcaaaaaaaaaaaaagattttgtttacattatctcttcaagttatctcttaaacatctttgtggctggtgcggtagcttaacgcctgtaatcccagcacttcgggaggccaaagtgggtggatcagttgaagccaggagttcaaaaccatcttaaagttcagctcatttctcattctgaagtttccttttttcacacttctcagattatactgatggattttcacttcctttacattttctccttcctctcaatagtgaatattagtctccagtggctgggtagtagcaagtaaatttatgaagaatcatagttgtgtttgccaagtgactggaaatcagcttccccagtacctcttcaccacaaacacaattaaaggtggggccgaggatcaaaatggaatgcttccttaggactggtacagagttactcagaaaaattttctgtgacatggtgtgatgattcgactttgcctttttttttttgagacggagtctcgctctgtcgccaggctggagtacagtggcatgatctctgcttactgcaatctctgcctcccaggttcaagccattctcctgcctcagcttctcgagtagctgggactacaggcgcacgccaccacgcctagccaatttctgtatttttagtagagacggggttttaccatgttggccaggatggtcttgatctcttgacctcgtgatctgcctgcctcggcctcacaaagtgctgggattatacgcgtgagccaccgtgcctggctgactttgccttttttttttttttttttcttttttttgagacagagtctcgctctgtcgcccaggctggagtgcagtggcgtgatctcggctcactgcaaagttcgcctcctgggttcatgccattctcctgcctcagcctctggagtagctgggactacaggcgcccgccaccacgcccggctattttattttttatttttagtagagacggggtttcactgtgttagccaggatggtctcgatctgaccttgtgattcccccgccttggcctcccaaagtgctgggattacaggtgtgagcaaccgcgcccggcctgcctttttttaaaaaataaaatttgtatttttttggggtactgctccttgtggagcagggctaccttataggcagtgtgtccagagtaggcttgacattgtatttagcaaaaattgactgggttgttttcactttggcatttgacttgactggttctgctgttctggaattattttagtaacattaatgatttcctagcttattttcataatttagaagctagttctttaatatttttgaagtcttggcatccaggaattatgctgaaattgggtatccctgttttataggagagtgttgatttctgaggggtatggttccctttttaagagagaatctcttatatgtgctgatacaggtatgtttcaggttttatagtcatctgaaagtaatatgtagttgagaaagagggtatgagaacataagacttatacttatttttagcttaggatcatcagcagcatttctggcattttcttttcatattttttcttgttccttatctttgcaatagcataacgtggttgtaatgagcttgagttaatgtgtgtgtggggagtgtggtggtttgtatgtgtgggactgttgagtagtggtttactgggaaaaatgggttattaagcaaagaaaatgacagtaaagccattcctttaattgttaaattatgtaacatacacattaaaatatttgtatagtttatataggtaaggaaaaatagaaatttaaagttacaaaataagcctactcccactatcaggaaatggtcatcttttaacattttggtatataatcttgtgcaccttttctatgtgtataagttcatgtgaatttatagataaagtttttataaaaaattgtattatataattttttgacctttttccactcaatatattgacatccataaatatacataaaaataatggttatatagtgtttgattttatgactgcgccatgatgtatattatcagttccctattgttcacttagattctttccaataatgggatctatgcaattatagttatatatacactgctgtaatccttgtatatccttgtaatgtataaccttgtatatacaactttgtttgcttcactaagataacttagtacttcttggtcagattgtacataatgatttttaaggctttttgctttgtttttttctgtttttttgtttttgtttttgtttttgtttttgttttgagatagagtttcgctctgttgcccaggctggatttcagtgaccccatctcggctcactgctgcctctgccacccattatcaagcgattctcgtgcctcagcatccctagtagctgggattacaggtgatcgccaccatgtccagctaatttttgtgtttttagtagagatggggttttgccatgttggtcaggctggtctcgaactcctgacctcaagtgatccgcttgcctcagcctcccaaagggctgggattacaggcgtgagccacagcacctggccggctttttgcaagttagtaccaaattgccctcaaggagcggaagagcctcaaacaaaatctaccttgtgactgtcgcccaggttggagcgcaatggtgtgatcttggctcactgcaacctctgcctcttgggctcaggtcatcctcccacctcagccttctgagtagctgggactacaggcttgcgccaccacacctggctaaatttttgtatttttagtggagaccagttttcaccatgttgcccaggctggtctcgaactcctggcctcaagtgatccacctgatttagcctcccaaagtgctgggattacaggcatgagccaccatgcccagcctgtgcattctttttttttttttttttttttgagatggagttttgctctcgttgcccaggctggagtgcaatggcgcgatctcagctcactgtatcctccgcctcccgggttcaagcgattctcctgcctcagcctcccgagtagctgggattacaggcaggtgccaccatgccatgctaattggttttttttgtatttttagtaaagacggggtttctccatgttggtcatgttggtctcgagctctcgacctcaggtgatcctcccgccttggcctcccaaagtgttgggattacaggcgtgagccaccgcacccggccttttttttttttttgaaaaggagtctcattgtgtcatccagcctggagtgcaaaggcaatcttggctcacttccagctctgcctcctgggttcaagcgattctcctgcctcagcctcctgagaagctgggattacaggtgcctgccactgcgccggctaatttttgtatttttagtagagacgggttttcaccatgttggccaggaggctggtcttgtgaactcttgacctcaggtgatcacgcctcccaaagtgctgggattacaagtttgagcctctgcgcccggcattcttttttaaaagataaaaaagtctggctgcagaggaaccttatacctgaaatgttttgctgtctgaattcactccagagtgaaatgacttgaagtacaagttttgtgactgctccgagaatttttgtgtcagaggcttctccttctgccattttttgaacatttacctagaattacaaaaaaatcattccacatttcacagtatggtgctaggaatctgaccaggtccagttcataattttaaactttagagttttaaaaacatgtatgcttatcatgctgtaagcaaatgggaccccaggagtaaggggtaactttctgtttttcctcattaggtttcaactttctgtgctgtggggtcagtggtaagagaggtagatctgatgtgtatctgtgctaaagaagcatgagctccttacagtaactagcagccaattcctcttccccataacagttgcagacttctaatcccagcaccttgggaggccgaggcgggcggatcacgaggtcaggagatcgagaccatcctggctaacacagtgaaaccccgtctctactaaaaatacaaaaaaattagctgggcatggtggcgggtgcctgtagtcccagctactcgggaggctgagacaggagaatggcgtgaacccgggaggcagagcttgcagtgagccgagatcgtgccactgcactccagcctgggcaacagagcaagactccgtctcaaaaaaaaaaaaaaaaaacagttgcagacttcttggagtggtagttcatggtcttcttctaagaaggctgtggatgccttaaaagcattatttgacgctggctcccatatctcactgccctctccaaaaaatgtgttaccctaacatagaagtatcttttctcagaattcttcagtatattatgaatcagtgactaccttttctctcccttgaaattttcctgtaacttaatgttcatttccttttgtttcagtaaaccagtctcaactcttttccttttctctttctgttgtacctctcatttccccgacccttcctgtcctgtagatggcatttcataattcacattgataataattgctagaatttataggcatttattgtagattaagtagagcatttattatagattaagcctatacgtaacttgttgaattctcataacaaccttaggaagtacatgttgttacttccacattttatagataaggtagccagtctgctctagagaaattttaaccaacctacccaaggttacctacttagtaaatgttttttttttagacaacgttttgctttgtcacccaggctagagtgcagtgctgtgatctcagcttactgcaacctctgcctcctgggttcaagcaattctcgtgccttagcctccagagtagctgtgactacaggtgcgtgccactacacccagctaatttttgtatttttagtagagacagggtttttccacgttggccaggctggtcttgaactcttggcctcaagtgacccacccactaggcctcccaaagtgctgggattacaggcttgagccattgtgcctagctgtaaatgttaaatctagtattcaaacctagcaaacctaggtgttctgatttctttttctgtttttggttttgttttccctgggatatagattttcaggtgttctgatttcagaacctgcattcctacccactgctgctgctcccctcactaatttgaaattctgtgtgtgaactaactttacttaaaaccgggttaaatgtttgttactgtctgaaccaagagtccttggggtgaaggagagagtagtacagaaggaaacttctccttctgactttagccttcctaaatcaacaaaattctgagctcctttatnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntacaggtggtgtcatcatgcttggctacttttttgtatttttagtagagacggggtttcaccttgctagccaggatgatctcgatctcctgaccctgtgatatgcccaccttggcctccccaagtgctgggattacaggcatgagccaccgcacccggcttgcctgtctctattttaaaaaagccaactcagatcaagcaattttgattatccagtacttgctttattttcttctgtggtatttttttcctttacttacattataaaattcctcaaatgcatgtgaagtagagagaatagtataatgaacctccatatacttaccacctaagcttttttttttttaagacaggatttcactctttcgcccaggcaggagtgcgatggtgcgatctcagcttactgcaacctctgctccccgggttcaaccgattctcctgcctcagcctccaagtatttgggattacaggcgcccaccaccttgcccagctaatttttgtgtttttagtagagatggggtttcgccatgttggcaaggctggtctcgaactcctgacctcacgtgatccacctgccttggccttccaaagtgctgggattacaggcgtgagccactttacctggcctatcacctagctttgataacagcattttgccaatcttgcatctatacttctccatttttctacctctacctccctggaatattttaaagcaagcccagtcctcatgggatttcactcctaaatacttaagaacgtattaatacactcagggaatcttttagaggtgaggatgggagagtataatataactacagtggtattgtcacatctataaaattaataattgtttaactttgcttctcaaggctcttttctcagaaatgtctttttatggtttctttttttctaatcaacacccaaacaggtttcacatattccatttggttatttctctcttaaatccttaattaaaatagtttccaaaccctgtagtattttttgagggccaaatgagatatatttgtaggcttccaaagtgtttatacaaacataagttgtttggtcataggagagaaataacctttctaaaaatatatcagcattgcagtttagtgttaataacattaaagagaaatgagagaatgtagagatgcctgagtgatggagaaaaaagcaggaataatttggcattaaactaaggctgagatgtattaaaattgagccagtgtggagaagctggcctaggaccttctctgtagcatttatagccaagcaattaacctatatacccacccttgggtaataggttctcctctcttatagtacgtgccacacttccaagtgtagactgatgataatgaagacattggaataatgccctttgagagttttgccttagattgggaaatgcaggtctcaagattctcagacaaaatattttcttctagggaagagtacattttaatgttgtttccctgcccaaaaagataatgatatatataaatcatgggtatggattacaaaacgataatgtattcctacagtatttttcacaaagacactagaaaacattttctgttgaacagtattctggttttatccatagggatgaatctcattctctttaaaaattgtctggctaacagccaggtgcagtggtgcagtctgatagtcccagtgactcaggaggctgaggtgggaggatcacttgaatccaggagtttgagaccagcctgggcaacatagtgagacctcatatctacaaaaaagaataatagcaaaaaaagcaaaatcagctgggcatggtggtacacacctgtagtcccaactactcaggtggctgaggtgggagcatcatttgagcctgggaggaaggggctgcagtgagcagagattgcaccactgcactccagccagggtgacattgtgagaccatgtctcaaagggaaaaaaaattacatatattttttcctttttttgatatagatacgatatttttctcttctgttcattggtaggttggatctctgatgtgtgccataggggcaaaactttaggcaaggaagagagaaggttttgtgtcctgattctgctcctctctttgtcacttggtctgagtgttattacttagaccctaatagcatcatcaccctgcgtgctcttggaattagtcccagttttgcagtcacagatagctaagcagttggcaccaaaattccatggagcgacatcgtctcatctttattctaggtattttgcaagagtgtagcagccctagagctacatgtttgtgtgataaaactaggaaaggtagcaaggtagaactttttagggagtagaaagtttcagagccactctgcattgaaattacttacctgctttttttctcttgtttaactttattcagtgactttttgcatacagaggagcttactttctaggtggtaactaccagactagaagcagatgctggcttttggttctgcctggtctcttctaaaccgtttcctctgggtaaaagaggagaggataggccaggcactgaccaaagagtctagaatcagcatttttattttcaactgaaagcatacagagtacctcattgagaatcagattccatagttgctagtgttgcacaagcatgtgggtatgttgggggatggggcagctgagggttttgacaggaaccgtgttctttgagatggtaatttgaatttcatgaaggtctaggtaaattgaaaattaaaccttgctgtgagcctaactttgctcttgcgtcacacgtaatggccaggcatggtggctcatgcctgtaatcccatcactttgggaggccaaggcaggtggatcacgaggtcaggagttaagaccagcccagccaagatggtgaaaccctctctcttctaaaaaaaatacaaaaattagccaggcgcagtggctcacccctgtgatcccagcactttgggaggccgcggtgggtggatcacctgaggtcaggaattcaagaccaccctggccgacatgatgaaaccccatctctgctaaaaatacaaaaatcagccaggcatggtggcgggcacctgtaatcccagctactcgggaggttgaggcaggagaatctcttgaactgggagaaggacgtcgcagggagccaagatggcgctgttgcactccagcctcggtgaccagcaaaactccgtctcaaaaaaaaaaaaaaaggccgggtgtggtggctcacgcctgtaatcccagcactttgggaggccgaggcaggcggatcatgaggtcaggagattgagaccatcctggctaacacggtgaaaccctgtctctactaaaaatacaaaaaattagccaggcgtgatggcacacacctgtaatcccagctactcgggaggctgaggcaggagaattgcttgaacccaggaggtggaggttgcagtgagccgagatcgtgccattgcactccaacctgggcaacagagcgagactctgtctcaaaaaaaaaaaaaaagcgacagagcgagactccatctaaaaaataaaaattaaaaaaaaagggacaggtgcggtggctcttgcttgtaatcctagcactttgggaggcttgaggtggatggatcatttgaggtcaggagttcaagaccagcccagccatcatggtgaaatcccgcctccactaaaaacacaaaaattagctgaatgtggtaggaggcgcctgtaatccctgctactcaggaggctgagcaggagaatcacttgcagtgagctgaggtcatgccactgcactccagcctgggcgatagagtgagactccatctcaaaaaaaaagaaaaagttatatttcccagagaaaatatggatatttgaataagaaaggggtctagaataaaaatggaatatgcacgaggcctatgtgagtatggagaaggagagagggacatacacagttgctatccaaaaggatctggtattactgagcaagaggcaggagtttatactatgtttannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncctcagcctcccaagcagctgggattacaggtgcacgccaccatgcccgcctaatttttgtatttttagtagaggcagggtttcaccctgttgaccagactggttttgaactcctgacctcaggtgatccacccgccttggcctcccaatgtgctgggattacaggtgtgagccactgcgcctggcctcttttcttttttctttttttttttgagacagagtcacgctctgtcgcccaggctggagtgcagtggcatgatcttggctcactgcaacctctgcctcctggattcaagtgattctcccgcctcagcctcctgagtagctgggattagagatgcacgccaccacgccaggcaaattttttgtatttttagttggagatggagatttgccatgttgcccagtctggtctcaaactcctaggctcaagtgatcttccccacttggccttctgagtagctgagattacaggtgcatgccacaccacccagctatgtttcttttctttttttttttttttgagacagagtcttgctctgtcacccaggctggagtgcagtggtgcgatctcggctcactgcaacctccacctcccagtttcaagcaattctctgcctcagcctcccgagtagctgggattacaggtgcctactaccacgcctgggtaatttttgtgtttttagtagagacagggtttcaacatcttggccaggctggtcttgaactcctgacctcgtgatccacttgcctccacctcccaaagtgctagtattacaggtgtgagccaccgcacccggccatcgccgagctgtgtttctactactgtttaaaaatactcacctttggttgggtgcagtgcctcacacctataatcccagcactttgggaggccaaggcggtggatcacctgaggtcaggagttcgagactagcctggtcaacatggtgaaaccccatctctactaataatacaaaaaattagctgggcgtggtggtgcattcctgtaatcccagctactcaggaggctgaggcaggagaatcgcttgaacccgggaggtggaggttgcagtgagccgagatcgtggcattgcactccagcccaggcgacacaagcgaaactctgtctcaaaaaaaaaaaaaaaagtactcttattttctggccgggcatggtggctcacacctgtaatcccagcactttgggaggctgaggcaggtggatcacttgaggtcagcaatttgagatcagcctggccaacatggtgaaacctcatctctactaaaaatacaaaaattagtcaggtgtggtggtgtgcacctataatcccagctgctcgggaggctgaggcgagagaattgcttgaaccgaggaggtggaggttgcagtgagctgagattgtgccaccgcactccagcctgggcaacaagagcgagactctgtttcaaaaaaataaagagtaaaaatactcacttttattttctgtgtcttctttctgaggaccaaagggaaaatatgtgtcccttggagttttcttctgtgatcttttagccacttaattcattgggaaccaacattatagctgtatatttgcatgggatagatctgaagattttgtaaaatgtttttaatctagaaagaatatgttgtttcagtttattttgttttgatgtaccattgtggtagctatttggtgtcttacatgggaattgtattataatcttgactcttcttctaggtgccttatgcctctggcatgcccatcaagaaaataggccatagaagtgttgattcctcaggagagacaacatataaaaaggtgtgtctggatgaaaccgtctcatcttactccaggagctcagcagcttactctgggaactcagtctccttgaaattactctccatgtactgtcctgtttcttgatctcctaagcttttgcacataatacagcttagactttagatttatttctcaaagggtaaattgtctcctttttgtatatgaatgtttaaatgagattttttttggctgggcacagtgccccaggcctgtaatcccagcactttgggaagccgaggcaggcagatcattttaggccaggagttcaagaccaacctggccaacatgatgaaactctgtctctactaaaaatacaaaaattagctgggtggcacacgcttgtggtcccagctactcgggatgttgaggcacgagaatcgcttgaacctgagaggtggaggttgcagtgaggtcaaattgtgccacttggtggcactagccttggtgacagaacaagactccatctcaaaagaaaaaaaaattagtgaacaaatctggcattggttgctattttactgagctgaagaaactgggtttccctgttaggtataaatatgtaacaaggccatgaaagccattcttatcttaccacagggaaccatgtctctcgcagtctttctgtctttttgtccattgctgggtatatatcaatagagggccaggtcccagcccagcctgttgatacaaatatacacaataggtcagacttttttttctcttccattttttttttagagccagggtgtcaatctgtcacccaggctggattgcagtggcatgatcattggccggtagcaggaggctattgtaacctccgactcctgggctcaagtgatcttcctgcctcaacctcctgagtagctgggactacaggtgcacaccaccacacatggataataataaattagttttatgacatgatctcgctgtgtcgcacaggctggtctcaaactcctgccctcaagcattcctcctacctaaaccttccaaagtgctggagttacaggggtgattgaccgtgtctcacccccttttcctccacaaagacagtcatttagctggcgaatagtacctaggacatctgcttttttgagctctgaatatcaaatggactggaaaggagcagtaatagtgaaaaagtggaaattgggctggtgaagggaaaacagaagcatcctggatccttgagggatccaaattcttgagttctggactggttttcagatggtttaggcttcctgagggacagtgttcagtctcccatttagcatctgtggtttgtctaatatgggatgtgaagatttcttggagttctaggtttctggcctatgtaaattttgtgttcattctctatttcattgtcccaagtagcagaggtggactgactcattctcagtcaaggacctgacagtccccagaatggactctgtggctcatgtcaattacttttactgagctcttcatttttaaattttttttttttaagaaatgggatcttgcatttgggaagctgaggcgggtggatcacctgaggtcaggagtcggagaccaacctgaccaacatggcaaagccccatctttactaaaaatacaaaaattagctgggcgcggtggtgggcatctgtaatcccagctactcaggaggctgagacatgagaatagcttgaacctgggaggcgaaggttgcagtgagccgaggtcgcgccattgcactccagcctgggcaacagagcgagaccccgttctcaaaaaaaaaaaaaaaaaaaaaaaaaaacaggaaagaaagaaataggatcttgctctgttgcccagactggaatgcagtgggtgcgttgatggcacactgcagccttgaactcctgggctcaagccatcctcctacctcagcctccaaagtaactgggactacaggcctcagccaccacacctggcttatttagctttttttttttttttttcctgagggagttttactcttgttgcccaggctggagtgcaatggcgtgatctccactcaccaaaacctctgccttgcgggttcaagcgattctcctgcctcagtctcccaagtagctgggattacaggcatgcaccaccatgcctggataattttgtatttttagtagagatagggtttctccatgttggtcaggctggtcttgaactcctgacctcaggtaatctgcctgtctcggcctcccaaagtgctgggataacaggcannnnnnnnnnnnnnnnnnnnnnnnnnnnnnnnnnnnnnnnnnnnnnnnnnnnnnnnnnnnnnnnnnnnnnnnnntttctattataactggggaggcaggtacttaaaaaaaaaaagaaactaataatttattttcctttgacctatttgtacatgaaaaaaactagttgtaggctgggcatggtggctcatgcctgtaatcccagcactttgggaggccgaggcaggtggataacgaggtcaggagatcgagatcatcctggctaacacggtgaaaccccatctctactaaaaaaaaaatacaaaaaattagtcgggtgtggtggcttgcgcctgtagtcccagctactcaggaggctgaggcaggagaatggtgtcaaccagggaggcggagcttgcagtgagccaagatcacgccactgcactccagcctgggcgacagagcgagactccgtctcaagaaaaaaaaaacaaaaaactagttgtaatttattgcccattgaggaccaagtagaaatataagtaatgcctggccgaggttggggatgaggcaaatggagcaaagctatctaatcaaagtttctgcagtgattgaaatgtgctgtatctgtgctatccaatatggtagctagtagccacacttgaactgtaagtagtaagactgagaaaatgaagttttaaatttgagttaacttaaatttaaatagccatgtgtacctagtggctactgttatcagacagcaaagatctagatgatgcgatactttcccacgggcttggaatcctggattgtaagagtggggctcttgtatttgtgttttgaccaagtttgataattctaagtctgaatactgctctcagaaataatttgagtctttcatgctttcttcttcagttaggagctcttttaccacactgttgcccttttttttgagacagtctggctgtgttacccaggctggaatgcagtggtgtgatcttggctcactgcagcctccgcctcccagcttcaagcaattctcctgtctcagccttctgagtagctgggactacaggtgcacaccacctcatccagctaatttttgtgtttttagtagagacggtttcaccacattggccaggctggtctcgaactcttggcctaaagtggtctgcccacctcagtctcccaaagtgcttggattagaggcgtgagcctccgcccgcgcccaccccaccctgttggccttgagacacactagtcaggcccttccttagaggactgaagtttctgccgccaggcagtcagatcagaatattggttaattttagggctgggcatggtggctcatgcccgtaatcccagagctttgggagttctgaggttaggagcttgagaccagcctgaccaacatagtgaaaccccatctgtactaaaaatataaagaataagcaaggtgtcgtggtgcatgcctgtaatctcagctactcgggaggctgaggcatgagaatcgcttgaaccggggaggcaaagtttgcagtgagccgagatcatgctgctgtactccattccagcctgggtgacagagtgagacttagtctcaaaaaaaaaaaaaaaaaaggaatattggttaattttagttacattcgatatcagatgaaggaaatgtttagagggctccagatacactctgggggcagaaaccttaggagtgagaactaagaacgttgtgtcaatacaatgtatcttccaaatacaaatatggaactcttgtttaggcaggccaacaggagggagcaccttgcctagctgaggctggctcagagagtcccagctttgctactctgtatcctcactgtccttccaatctttactaagcttaattgcagagtacagcatagggatggggaaactggattgtcccagttttatctgaactattgctcagactaaaggatgtttgttttaaagtgttccttctagcttcccctttctgaatttttattgttatgatcctacttatactaggaattttcttctcatttctcttgtttctcagacaacctcatcagccttgaaaggtgccatccagttaggcattacccacactgtggggagcctgagtaccaaaccagagcgtgatgtcctcatgcaagatttctacgtggttgagagtatcttctttcccaggtacagagtttaatgttcaggagcatgtcctggaaatgtggccttttcaaatcagcccagggcagttttaggggttcaggtcggacaatttagacatgtgtccatttcttaacctggttacaatcagggcgatgtgggactagagagttcggagagcagatactgtcctctagatgcttccattagcctctgtcctatggattgacccgtaaaaaacaacctaatgcattggataggaggcagtgtgatttcttcttcttcttatgtcttgctgtccatgctgtgccattgtctcactaactcatctaagaagggctgtgattatcttaggaggaatgtattcccccactccccccaccatgaggtgactctgagtgtcttcgcaaggtagattctctggatgatagggactggcaagttatggctacctctgtttaaccccacagtgaagggagcaacctgacccctgctcatcactacaatgactttcgtttcaagacctatgcacctgttgccttccgctacttccgggagctatttggtatccggcccgatgattacttggtaagcatctggatatcaggacactgtgactccagtatcagagggatattcccaaaggaaggccccttttctccacagtctcgctctggtttttatttagaaaagaattgcatctgtagttgatttttgtgttgggcaaggccctgatgtgtctaaatctcttagttcttctctgtttgccccagtattccctctgcagtgagccgctgattgaactctgtagctctggagctagtggttccctattctatgtgtccagcgacgatgagttcattattaagacagtccaacataaagaggcggaatttctgcagaagctgcttccaggatactacatggtaagggagagagaagcactgtccacctgtgctgctcacttctgggcaaggctggggaggctgtcttcagcagggtaaaacagtgtcagcacttctatcttaagagtgtagttcaggccaggcacggtggctcatgcctgtaatcccaggactttgggaggccgaggcaagaggatcacaagatcaggagatcaagaccatcctggccaacatggtgaaacctcgtctttactaaaaatacaaaaaattagccaggcgtggtagcgggcgcctgtagtcccagctactcaggaggctgagacaggagaatggcgtgaatctgggaggcgaagtttgcagtgagccgagatcctgccactgcactccagcctgggtaacagagcaagactccgtctcaaaaaaaaaaaaaaaaaaatgttgttcagttttgtgcttttcaccccatttcttttgcctctctatggtaaaaggggttttgtttatctgttctgttttaagtgttgttgatctcccaggctcaagtgatcctcccacctcagcctctcacgtagttgggactaaaggcacgcaccaccacacctggctaatttttataaacttattttcttttattttttcgtgacggagtctcgctttgttgtccaagctggagtacagttgcacaatctcggctcactgcaacctccgcctcccaggttcaagcaattctcctgcctcagcctcctgagtagctgggattacaggcatgcgccaccatgccaagctaattttttattttttagtagagatggagtttcaccatgttggtcaggctggtcttgaactcctgacctcatgatccgcctgccttggcctcccaaagtgctgggattacaggcgtgagccaccgtgcccggcctaatttttataaatttttagtagagatgaggtcttgctatgttacccaggctggtctcaaattcctgagctcaagtgatcctcctgtttggcctcccaaagtgctggggttacaggcatgagccactgcacctggctattttcgtcttctgttcttagttcagcttctagtttggggaatgaggtaggttatttcccttggtaatactctctgcagccttactctgattgctatggaggttctggagaagttaggtaactctccttacctgccttaccatccccaagaatatactatacccagggcagagagtgtcgtcttctnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntttgctgcctaaattctatggactgtactgtgtgcaggcaggtggcaagaacattcggattgtggtgatgaacaatcttttaccaagatcggtaaaaatgcatatcaaatatgacctcaaaggctcaacctacaaacggcgggcttcccagaaagagcgagagaagcctcttcccacatttaaagacctagacttcttacaagacatccctgatggtctttttttggatgctgacatgtacaacgctctctgtaagaccctgcagcgtgactgtttggtgagtttgttacttagacatcaaaaatctcagttactaaaacagcttgattgttcttaggcattaagtttgtgggagatggaactctgttccttagcactgtatgtcctgggctgtatttaaaataagtcttaattagttcattgccattcctttacatttttactttctccccgtttatcctcccacaatgggatttatttccttctctagctagcctgggcctcacagtcaaatgttctgcttattttcataccaacatcatccttcctcagattttggtcctggctgccaaatccaaatttatattttggaagctgagtgctgctgaagaatattacacaaccgtgtatactggcatttacagaattatgatatccaaccccacttgggctttcaatatcgatcttcagtccatttgctgttgctctcaatagggatttcagatgtttggcattctaatcaaaccattttctgactctcatctccctagctttgtttctcaacaagctaccttaactttttatcctatttcatcctctcatgctgcccctgtcaccaatggataaatgtatctacattttactttattttttattttttgagatggagtttcactcttgtcacccaggctggagtgcaatggcacgatctcgggctcactgcaatttccacctcccagattcaagcgattctcctgcctcagcctcccaagtagctgggattacaggcgcccatcaccacgcctgggtcgtttttgtatttttagtagtgacagggtttcaccacgttggtcccgctggtttcaaactcctgacctcaaatgatctgcctgccttggcctcccaaagtgctaggattacaggtgtgagccaccgcacccggcctagatatcactcttgacctctgtactcttctgtcatgtgaacacttcccactgttgcacatattaaactgtattgtgtttattttacatttgtatccctttctaaatgtataatgtccttgaagacagaaactctctctttaatatctttatatctctgtaaggaggcacagtgcctacatggtggagattcagtaaatgtttaactgaattgaagctagtcatacaaggtcctaccacagatctgttctgtcacaaagtgtactttaccagaacctcattgtggaatcttcacagcacaaatatgtattccttgttcttttgagaaggtagtgttctcttcatggagacatacatggaaagaacaaagatggtcttgtgggctaggcagtgggacttggaaaaattatattaactcaaatgagagaaagctaagggtatgtaaataaagactaaccaggccgggcgtggtggctcacgcctgtaatcccagcactttgggaggctgaggcaggcagatcaccaggtcaggcgttcgagaccagcctggccaacatggtgaaaccccaactctactaaaaatacaaaaattagctgggtgtggtggcacgtgcctgtaatcccagctacttgggaggctgaggcaggaaaatcgcttgaaccagggagttggaggttgcagtgagccaagatcgcgccactgtactccagcctggcgacaaagcaagactccgtctcaaaaaaaaaaaaaaaaaaatttagccttacaggttcactgtaaggctaaattaaataattacatcatgaaagctgtcaagccaggcgtggtggctcataccaatagtcccagcactttggaagactgagataggcagatcccttgagcccagaaattagagaccagctgggcagcatggtgaaaccgtctctatgaaaaataaaaaattaggcaggtgtagtggtgtgtgcctgtagtcccagctacttcggaggctgaagtaggtggatattttgagcctgggaggttgcagctacagtgagccgagatcacaccactgcactctagcctgggttacagattgataccctttctcaaaaaaacaaaaaaattgtgagatcctgaaaaatatttttatttcttccaaggctcagatcatgtttttttccttccattaggtgctgcagagcttcaagataatggattacagcctcttgatgtcaatccataatatagatcatgcacaacgagagcccttaagcagtgaaacacagtactcagttgatactcgaagaccggccccccaaaaggctctgtattccacagccatggaatccatccagggagaggctcgacggggtggtaccatggagactgatgaccagtaagtgggctcagggccactaggggggagaacataggcccacagcacttttcttttcttttttttttttttttttttttagtttcactcttgttgcccaggctgatgtgctgatgtgcaatggcacgatctcagcctactactacctccacctcctgggttcaagcgattctcctgcttcagcctcctgagtagctgtgactacaggcacctgccaccacacccagctaattttttgtatttttagtagagaaggggtttcatcatgttgggcaaactagtctacgaactcctgacctcaggtgatccacccgccttggcctcccgtagtgcagggattacaggcgtgagccaccgtgcccggccacagcactttttctttaggaagggacccagcttctggaaaggagtagccttgactcagcagttggatcagtaacattattgttgacagaagtatagaatgagcttgaacgagctttcttaatacaaaatgaaaagaagattaatttcgggtttatagtatatgtgggaaggagagctgttcaagagttaaagacttaaaaaattatagtcttaaatgcatgtctgcaaattatattagaactttattagggctgggcacagtggctcatgccagtaatcccaacactttggaaggctgaggcaggcggatcacttgagtccaggagtttgagatcagcctgagcatcatgatgagacctcatcactacaaaaactcaaaaattacctgagtgtgatggtgagcacctgtggtcccagctactcaggaggctgatgaggcagaattgcttgagcccaggaggtcaaggctgcagtgagccactgtacatgccactgcactccagcttgggcaaaaagaatgagaccctgtgtcaaaaaaaaaaaaattgttatagacttctttgtggaaggcatccttcttcatcatgcctagtaagtgtaattactgaagtgtcacaaatatcttagattgtttcatttttttaaggtatcctgtaatatgactctcaagaagagtgtcttagtgggcataaattaagatagcaaaagtactgaagaagttgagttaattagagcattcccaaaattgctgagtagtggcaattttagattctctttggtggaatcagagtggaagaggtaggcaagaagatttggagaaaactagattataatacatactgtagagagttcctggggttagaggaaggatctcattttctcctgtttttttaatgtatttttttctctttttgttttcttgatcacttattatctgaccttctggtttatggaggatgaggcagttatgtgtaggtttcacttccccatcctgatctgactaaactagccaacagattttctcaccctttcctttttgccttttccagtatgggtggcatccctgcccggaatagtaaaggggaaaggcttctgctttatattggcatcattgacattctacagtcttacaggtgaggagcatatggatcccaaattaagagagggtggatacagataaccagtcacgtttctcttttagataggtttgttaccaagttcttccggaagcaagaacagtgagttgcagtctggctacttacttcattagttttcagatggtttatttccttgattttgcctctttccccggcctttataacccttcctcccccatctccccagacataatgtataccttctgtggaaagctgagtcagtccttggaagcaccagggtagaatatgccatctgtctggctctttgcaaaaacctatgagatgagtcatgttccacatggggatacaactggaaacgttacccttttccaaggaggaaaaacaggagggtcactgtgttctgtaaaatgtattagactgtggaactaagaggcaatggagtgatcatcagggaggagctggaattgttagaccccagttttgttcctgtaaggttttaaatactaatgaggactggacggtacttgatttgttggttcagtattatcatccagttttaactaccctttccagtcttgcccatctgttccttcagctctccttttataataaatattcatgttcctgatttgtcagggacataaattgcccttttcccatggggggaataattgacttacctagaaacaacattggtctctgtgatgaaccagcactgccatgcctgttcttgggaaaaccagtgtaccagtagatgtgctttctcagcttctgtcttttcaagattttctattacccctttaaccccctaaaatataaagttattaaggtcatttatttaaaaatgacgtgagtaggtgatgtacatttttcttgcaggtttgttaagaagttggagcactcttggaaagccctggtacatgacggagtaagtagtaatactagaggctctcttaccgtacacttctgcctccatcacttctgattggcctcagtttcttgcaattttttcttttttcttttttcttttttttttttttgagacagggtctcactctgtcacccaggctggagtgcagtggcgtgatctcggctcgctgcaacctccgtctcgcagtttcaagtgattctcctgcctcagcttcccgagtaggtgggaccacaggcgcgtgccaccacgcccagctaatttttgtatttttagtagagatgggtttcaccatgttggccaggctggtctcaaactcctgacctcaaagtgatccgcctaccttggcctcccaaagtgctgagttgagatggagtctcgctctgtcactcaggctggagtacagtggcacaatctcagctcacttcaacctccatctcccaggttcaagcaattctcatgcctcagcctcccatgtagctgggattacaggtgcccaccaccatgcatggctaagttttgtatttttagtagagatgaggttttgccatgttgaacaggctggtgtcgaactcctgacctcaggtgatccgcccacctcagcttcccaaaatgctaggattacaggtgtgagccactacgtctggccccttccgtttatttcatctgtaggttttacccttctgctaggggctcagtctgggggaagatggcccttggactagagttcctcttgccgggcctcctaactctatagcatttcttctgctctgcaggacactgtctcagtgcatcgcccaggcttctacgctgaacggttccagcgcttcatgtgcaacacagtatttaagaagattccctgtaagtggtttctaccaattgactgcctactcctgcccagtggctcccttaccccaagagaacagagggcaggacacctctggtagggagctgccaatgccagaggcctctccttccacctacatcccatgagagccatttcttgtcctttgtgttagtctgtcatagtcatttccaagttgctgtttcccccttggctcttcctgcatatgtcaatgaggtgaggaccatttctggggaattgggatttgcaaaaaaataaataaataaataatgtgtagttgtggatgtaggatccatgccacagagataggcagagcctatgtacagagatacgcagtgaggttaatggtgttctgttttgtcttctagactatctcaggtggttacagaagcatttactgatttctgcttagcacatgtttttagtctcttttctcaactttcttgtttaggaagtgccaatatttttttgcaaatcttccatgctgctgccatagcaaattctagcttctctttcccttcttctcatattaggcatcattattcccatagcgagggagaggggacctaggcatgccagtcttaagggatatggaaaaaccaggctgggtgcagtatctcacacctataatcccagcactttgggagaccaaggcaggaggatcggttaagcccgatagtttggaaccagcctgggcaacatcatgagaccttgtctctacaacaaattttaaaaagataaaaaaatctttacaaagtgataaaaattacaagtatcaattatttagtgctgggcacatacatgctaagaaaatgtagagtgaaagagttatctttcttggcccggcacggtggctcacacctgtaatcccagcactttgggaggccgaagcaggtggatcacctgaggtcaggagttcgagaccagtctaaccaacgtgttgaaaccctgtctctactaaaaatactaaaattagccgggtggtggtgagcacctgtaatctcagctactcaggaggctgaggcaggagaatcacttgaacacggtaggcagaggttgcagtgaactgagatagtgccattgcactccagcctggggtgacaagagaggaaacttcatctcaaaaaaagttatctttctcaggttttactataggatactattaaagaaaaaggggggccaagcgcagtgtctcacaccagtaatcccagcattttaggaggccgaggagggcagatcacaaggtccggagattgagaccatcctggctaacacggtgaaaccccgtctctactaaaaatacaaaaaaaaattagccgggcatggtggtgggctcctgtagtcccagctacttgggaggctgaggcaggagaatggcatgaacccgggaggcggagcttgcagtgagccaagatggcaccactgcactccagcctgggcgacagagcaagactctcgtcaaagaaaaagaaaaagggggcagggcagtggctcatacgtataatcccagcactttgggaggcctaggtgggcggaccacctgaggtcaagagttcgagaccagcctgaccaacatggtgaaaccccgtctctactaaaaatataaaattagctgggtgtagtggcgcatgcctgtaatcctagctacccaggaggctgaggcatgggaatcacttgaactctggaggtggaggttgcagtgagccaagatcgcgccattgcacttcagcctgggcaacaagagcgaaactccatctcaaaaaaaaaaaaaaaaaggaattatgcaatagggtacatttcatctgatggaagtaaagcagtcatcaaggctccatgttggggggttaggtgtggatatgtttcctttcttctaggttttcatgcctcttggaaagtgaagtgagctaacaccttgttctctgaatagtaattcataggcctgtctttgttgacattagccttttcacttttcagaccaactttgggtgtgtgttggggatactagcaattatttgtatctatgtcttggtaatagttgctaaggtagttgctaagtaggctctctctttcccttttgaagtgaagccttctccttccaaaaagtttcggtctggctcatctttctctcggcgagcaggctccagtggcaactcctgcattacttaccagccatcggtctctggggaacacaaggcacaagtgacaacaaaggcagaagtggagccaggtcagcgctagggctggggtccccatgtgattgggtactccctcccttccttctgagcctttatcttgtctggccaggacctctgctcccatttctatccaggaagcctagctgctacatatttttccttgtatttactgtaccccatcttctctatcttttttccaggcgttcaccttggtcgtcctgatgttttacctcagactccacctttggaggaaatcagtgagggctcgcctattcctgaccccagtttctcacctctagttggagagactttgcaaatgctaactacaaggttggtttattggcccctttctccatataatcttatctctcttttcaagtccttggaaacctctataatttgattgcatcataataaattaccccaaagattagtggcttaaaataacaaacatatatcatactttctgtgggtcaggaatccaggcccagcttagctgggtcctctggctcaagatttctcatgaggtggcatttaagctgttggccagggctggggtctcatctgaaggctcaaacaggaagatctgcttttaagcttatttatgtggttactggtaggattctgttccttgtgggttgctgaactgagggccttagttccttgctggctgttgtctgggggcttccctcagttctttgctacatggacttctccataggacagctcagaacatggcacctgggctatctgacaagtgaacaagagagcatgtgcctatgcagaaaccatggcctcttataacttaatctcagaattgacattctacttgtgctacattctgttcactaaatgcagcccacactcaagaggaaggaattacccatgggtgtgaataccaggaggtgcagggatcattgtgagccatcttagaaactgcctgtcatagtctgctctctggtctccagtaatttacatacctccatgtcgaaaatacactgaccccctcccagggtctcatcccattgtagcgttagctcagagtccagagttttattacctaaattaggtccggttggatgagccccccaggtatagttccttaagcacagctcctcaagtacagttcttctcaatctgtgaacttgtggaaccaaagagacaagttatcctttccccatgtacctagcatacaatggtgagacaggcattagataaccaatatacacatttctgtacataaaaggggagaatgggaggcacaaaaaggagtcattgattttatttgctgttccaaaatccaggaaatgttggagtttcttttatcaggcctcaaagcagaagaataattctccgtggttcttggctctaccctctagactcttggttttgtcttctgagtcttcctttttcatcaaagctagagtgtgtttttacctgagttcttttctcaggctgcttctttccagtagaattttaggggaactagtggtctctattttgtactgtttctgtcctttttgatccaagatggcagtgtttctactgatacagaagattttgtgggcctcctgtgattctccttgggatttactccattagacaaaagccacactcataaatatcttctttatgagacctaagcttcttacagactctgtttttcggttgaaaggatctgtgaaacataatcttctgaacagccttttgtatgactgaatagcacaatcagccctccgtatccacaggttccacatcccagattcaaccaactgtggactgaaaatacttgagagcctggtgtggtggctcatgcctgtaatcccaccactttgggaggctgaggtgggaggattgcttgaggcagtttgagaccagcctggtcaatataacgagaccccatccctttgaaaaaaaaaaagaaagaaacgaaaaaatactgaaaaaaaaaaaaaaagtcgtgaaaatgttatgttgttgctgatatgtactgtacagttaggcctgtacttaacatgtacagacttttcttgtcattattccctgaacaatatagtataacaactatttacatagcatttacattgtattagttatcataaataatctaggaatgatttaaagtatatggagggccaggcgtgatggctcacgcctgtaatcccaacacttgtgagaggtagaggcggccagattacttgagcctaggagtttaagatcagcctgagcaacatggcgaaaccccatctctaccaaaaatacaaaaaaattagccaggcgtggtggtatgttcctgtagtccaagttactcaggaggctgaggcaggaggatcgctcgaaccccggaggcagtggttgcagtgagccgaaatcgcgccactggactctagcctgggtgacagagcgagaccctgtctcaaaagaaaaataaataaaaataaagtatatggaggatgtgtgtgagttatatgcaaataccatagcattgtatataagggacttgtgcattgtggattttgatattcaaggaggggtcctggaaccagtcccccacagatattgagggatgactatactctgaaccaataccttttgtttttctgaggtcttaataagatgtttcacagtcatatgtttgccttcatctttagaccacattttcttggcagtgctctggagcttatccttgctcaaaagcctttttttttttttttttggtagagatgtctcattgtgttaaccaggctggtcttaaacaatcctcctccctctgcctcctgaagtgagccaccgtatgtggcctgccatttcttaattttagcatcgtttgctctctggagaggcttagaattttcaaaacttatcaagttctggcatttttgtttaatagtccttcccataatttctttatcttctcctatattttattataagcatcaagagaaaaccaggtggcaccttcaggactttgcttggaaatctccgtagctagattgtccaattcattaggcacatattctacttctcacataatcacaaatcacattgttgctaaactttgtgctgctgccttactaggatctcctttccttcaagttccaataaaatttttctcactttaagccctcactggtaaccccctttaagtccaaaattctataaacagcatattcaggacactaccttttcactaaaatgctcctccaagccacccccaatgttttgttttgttttgattttgtttttcgagatggagtctcactctgttgcccaggctggagtacagtggcacgatcttggttcactgcagtctctgccaacagggtctccctctgtcacccaggctagaatggtagtggcactatcttggttcattgcaacttccgcctcccaggttcaagcgattctcctacctcagcctcccgaggagctgggattacaagcgtgcaccatcacgcctggctaatttttgtatttttggtagagacgtggttttgccatgttgctgaggctggtcttgaactcctggcttcagatgatctgcctgcctcaggctcccaaagtgctgggattataggcatgagccactgcaccaggccaccacccccaaattttagatttttgttatagcagcacctcaattccaggtacaaaagtctgtattatctattattgtgtaacaaattacccccaaacttagctgttgaaaacaaacatttgttatctcagtctgggtgtggtggctcacacctataatcctggcactttgggaggccgaggagggcggatcacctgaggccagaagttcgagaccagcctggccaacatgatgaaaccccatctgtactaaaaatagaaaaattagccaggtgtggtgatttgtgcctataatcccaggtactcaggaggccgaggcgagagaattgcttgaacccgggaggcagaggttgcagtgagccaagatagtgccactgcacttcagcctgggcgacagagcgagatctgtctcaaaaagaaaacaaaaatttgttatcccagtttctgtaccttagctggatgcctttggctcgggttctctcgagattacagtcaagctattagtccaaaagcttatctgagggaagatcagcttctcagctcacttatatggttgttggcagtattcggttccttgtcacatcgccctatccatagccagctcatagcataggagctggctttcctcagagcaggcaagcaggggctagagcatgagtccaagaagaagatacagtatttttgtaatctaatctcagaatggacattccatctcctgtgctgcattctgttcatgagaagagaatcactaaatgcagcccacacttgagagagaattacacaatggcatggatctcaggaggcagggattattgggggcaatcttagagggtacctacgacacctggagattgaaacagaagagggcagggtactgggaaatattttatagtattcaagaagctaaatatggttaattaaaacagtgtgcttctaaatctagtagcttctcagcctcttctttccaaattctaaattgattccaaagtgaaaattagagaagcagtatgagatttaaaaggagagtcctttgttgttgtcttctaattctttttctctctgcttccattttttttctcctgttagtacaaccttggaaaagcttgaagttgcagagtcagagttcacccatgtgagtatctgggatgtgtgggaggtgaacgttttgcaaggtataaagaggatcactgatggcctggagcaggaagttaattgtcaagattagaggatctgggtacctcctaaatcttgttttttattttttattatttttttattttgtacttatttatttatttatttatttatttttgagatggcgtctcactctgttgcccaggctggagtgcagtggtgcaatctcagctcacctgcaacctctgcctcctgggttcaagcagttctcctgtctcagcctctggagtagctgggactacaggtgcgtgccaccacgcccggctaattttttattttttagtaggcgcagggtttcatcatattggacaggctggtcttgaactcctgacgtcgtgatctgcccaccttggcctctcaaagtgctgggattacagccgtgagccattgcacccagccatcgtgtttgtgtttttgagacggagtcttgctctgtcacccaggctggagtgcagtggcgcgatctcggctcactgcaagctacgcctcccaggttcacgccattctgctgcctcagccccttgagtagttgggactacaggcgcccaccaccatgcccggctaattttttgtatttttagtagagcagggtttcaccgtgttagccaggatggcctcgatctcctgacctcgtgatccacctgcctgggcctcccaaagtgctgggattacaggtgtgagccaccatgcgcggccgccatcttgttttttaaaaaatatttttggtacctcatacttggaggctgaggctgaaatagaaatttcttaacgcttgaattccatttctgcttaatctcatactccacatccttaactttacactctcccttttcagtaagcgcaaagcctcagaagacctggaacaagattctgccatctctgtgatcccaagatgtcagcccttgccccagcaatgctgaattttcttctacttggtcatcaaaaaaggagtgtaatagaagtgaggggagctgctcctccatcttcttcctgaagaagaaccttctctccttcctcttcctcatgaatgggccttagtgcctcagagagttgaggaccgcagcatcccctccactccagagttgggtggtacggattttcaactggccaaccctttgcctccactattgaatttttttcagacccccattcttcatgctggaaatgggattgctggacttggcagctttctttcccctcgtctttgactaggaaccggactcttaatttcctcaggacagactagctggcacattatccctaccttagttctttctctctgactcctggaagaatactcctgtaatctctgtaaaggtttttgggggataagggtgtttaaccacctcccagctttcttcttctttttttttttctgaaaaaaggaaaaagcacacagcacacaatttcaagccattttcagatcagaactccagaagtgttgacaagatgcctattcgtagagttccctcagaagagccatggtgtttatgaagagaagagtagtgattgctctgccagaagcagctcctctttaaactcctcctctcttgatgaatttcttaaggctgaaggaatgaagagagtgggacatggggtaatctttatcccttttgttaaaacaggaggcagccatgggctgggagatcatagcccttcctaggcagaatcctgttcactgccaggctatagtaattattactattttgcaatttgaaatatattctggttgtttttctaaatgtgaagacttaccaaatgaattttagatcattctccagaggagattttttttgctcttctcatcttttccaacagtgttctcctgtttgtggagctaaggtaaagaggggacacttctgtctgtttaacagacagtccatatctgtgaggccagcaaatattttcttaaactcatggggagacagcagattcttgccttggtgaggtcattgctgtgccatatgtcctacccccctgtcttcatgcagggaagttggaaatgggggctacatatgccctctcctccccgtctacaagagttgtggttttccatctgatccttccactcttgtcaggggaagaagggggcctggtatctcaggcagattgttgaattcctgttctatcccttctctatcccaccctgccttgataatatgttagcccataccccaaataactgtctatattagacacccccagccagtttctggctgcctgtctttgctgccatgttttttacaagaaggaaagaattcttgctatttttttttcataatttactatttatgatgtatttaagtgttttattaaggacagagttctgttaggggtgggagggaatatttgagggagggctgggtcttagggaaaggaatggggaagcaacatttttattaagtgttactatttgcctctactttgtattgttcagaaatggcaaatacaatataaaagtgatatatggttttaatgtaataaactttaatgagttatttagacctcttattttttctgattctttttcatataccatctgctcaccctcctactccaccacccaggctcagttttgttcatgttgccctaaacaaaggctgcatactttccagcttgcaacactccagcttcactcttaaggctttatgtccttatatcctcttcctcagcaaccccattatcttcacgaggaaaagcagtgaatgaatatgaggggagttactgtaggtctcttgcctaggttgcaacccaatttaacagggatttgaggttcaaaactcactttactcagttaagtgaggaaaggagagggacagtgggaaaagtaagtttgaggttagctggccctagtgattccctccctttcgttctcttgacctggccctagggcgtcactcttagaagatcatagagattgctttctttagctgttttcttttgtgaggttgagctaaggctcctttgataggaaactagacaaaaaagtaggggcgggccaggcgcggtggctcacacctgtaatcccagcactttgggaggtggaggcaggtggatcacctgaggtcaggagttcgagaccagcccagccaacatggcaaaaccccgtttattgaaaattagcaggggatggtggcatgcgcctgtagtcccagctactttggaggtcaaggctggagaattgcttgaacctgggaagcagaggttgcagtgagcgaagattgcgccagtgcactccagcctaggcgactgagactgtctaaaaaaaaaaaaaaaaaaaaggagcggtgaggttcattctgaggcatgaagatagggaacctttggagagaagcagttaagcaaacagctgcttttcataccactattccctatcttgttaagggcactccaaatatttatatagcagctaatgagcaatgcatggagtagatggagatcaaagaaataattgtccttcaaaagtttctagtttccaggaggaacacaaatcacaaaaacaatatgttatatgtgagacagctacttaagctctctgaaggtggcacagaacataaaagggggaaaaattagcagttacgtgcgaaagaagtgttaagagaatgtttcacttcagcacaaggacctagatgcatgagaatggtctgtttttgagaacaaggaagagatcatgatgagaatattggaataagtatagttagaggcaatattgggaaccctgaaatattttttgccccaataggatgtgatacaaaataattgagagactaacaaagttccatcagaattaaacagaggattggccaagtccagtggctcacacctgtaatcccagcactttgggaggccaagatgggtggatcacttgaggccaggagttcaagagcagcctggccaacaatgcgaaacaccatctctactaaaaatacaaaaattaggccaggcgcggtggctcacgctcgtaatcccggcactttgggatgacgaggcgagcagatcatctgaggttgggagttcgaccaacagggagaaccagcatgaccaacatggagaaaacccatctttactaaaaatacaaaaaattagctgggcgtggtgggcgcacgcctgtaatcccagctacttgggatgctgaggcaagacaatcgcttgaacctgagaggcagaggttgcggtgagccaagatcgagcccttgcactccagcctgggcagcaagagtgaaactccttctcaaaaaaaaaaaaaaaaaaaaaaaattaaccgggcatggtggcgggcgcctgtaatcccagctactcgggaggctgagacaggagaatcgcttgaacccaggaggcagaggttgcagtgagctgagattgcaccattcattgcactccaccctggcaacagagtgacactccatctcaaaaaaaaaaaaaaaaaaaaaaagaagaaagaaaaagcaagtactggattggaagaggaatgggggattctcaaagtttcttttcatttttct

SEQ ID NO: 12256 - DNA, 36228 bp, Human
gacactcagtaactttgggttttgactctttaacgggtgggcactggaccatctcggtgggagtgcttgtgccactctggaaggctgttccctggggttgtgatgtttatcatgccacttccttcttacctgtgccaacagacctatttcactgcctcagcgtacaccagacccttcagaaacctctctggtgtcacccagatagattgtgcttactgagacaaatgaacgtttacttgatttagaagataatgtgacagaatgatgtcaggttaggtcaaagccaagggagtgacagaatctggaaaatcaaacaatacaaaaagccctaaatgaactgttaactatttgatctttggatgtaaaattgtaatgcgtatatgtacaaatgtacaatttttacatgcttttaaaaaaggttagctttgtgaaaataccttgtttggtcaatgactttactgggtaatagaaccacattgaaccttgatggcaagtaatacaataaggcaggccagctcgtttttctctctgaatctggctggtttaggaggagcctgggtttatcgacgagatctggagtatctattcttttccactgcttgcagtctccaatgtaggcagtgtaaaggtatagtaaaatgattttaggagtcagaaccaaattgccaatatgctccatggctcctaaaggaaaataaaatggaagtttttattttgcggcttcacttcttaccgtgtagtaaccttactacaattacagattttcaggagttgtttgctagtctctttcagtcaggtactaaaaaaaaaacaaaaaacaggctgggcgcggtggctcacacctgtaatctcagcactttgggaggctgaggtgggcggatcacgaggtcaggagatcgagaccatcctggcgaacacggtgaaaccccgtctctactaaaaaaaatacaaaaaattagccgggcgtggtggcgggcgcctgtagtcccagctactcgggaggctgaggcaggagaatggcgtgaacccaggaggcggagcttgcagtgagccgagattgtgccaccgcactccagcctgggtgacagagcgagattccgtctcaaaaaacaacagcaacaaaacaaaaccctcgaggggccactctcctgtctttactccttttcccttctctattctttcaccagaagccctcatttgaccagtgaactcctaggccctcttgacccgcacattagctgggcgatttccttgttctgctaattcctaattctgcttaaaatgtatttggatttctgtttttgaacacttatgatgccaggcactgtaatgcttgaaacccgatctttccctagagaatgtaacatacgtttttattcatttaatcacttcattatgccggggttaattatgtttattttataattggtaataaaggccacatttatttttgtaactgtttaaagagcgaccacctgtggagtaccgtgtttacgaatttccatgcagaaagaacaacgttgacctgtaatttgtgtcgaatatatggagatccctcatctgagaattatgtaacaaagcgtggggcagtttactcaaagattttacgaaatgagccagagtaagacgattagtgggataggtgtctgaaggtgctggcggcctctgagctctgaccctttgcggggagaacaggcagcaggtgggtgggcgcggggcccattcataaaaaccagtgttcctggcctgcttctctcattggccctgggggcaaggggcgtgccccgcgggtggagcgcgcccggggcccagcagagtgggcagatccacgcttaggtggagcgagggggcgttccttggctttctaggctggactttctcttccccttgctgcgtccctcctctcccccggggtgggcatggtacgtcccgccctcctcgcattcccgtccctccttcccttccggagcggtggcatcgccgccatcttggcattcgggttgcgggaaagagccaaaccctggcgttggggggcccgggcggggagcccctcccgcggtccacagcgacgcctgcccagccctcctccccttccggctccggcacggggccccgaggcgttcggaggccaggcgggtttctgtcaggcccggggaggaggggcgggcggggcggccgctgcctccccgggacgggccgtaccacgcggacggggaggacggggccaggggactgcagggcggctgcaccgcccgggggcggggtgcggagcgggccggcgggctccccggggcggggcgggagggcggggcgtggggcggacggaaccaccggggcggggtgggaggtaacgggacgggcgcgaccatggcgcggtgagggagcgggggtggggatcggtccgggggaggcctgaggccgctggcttgtgcgctgtctccgccgcccccctctttcgccgccgccgccgccgccccgggcatgtcgtccaactgcaccagcaccacggcggtggcggtggcgccgctcagcgccagcaagaccaagaccaagaagaagcatttcgtgtgccagaaagtgaagctattccgggccagcgagccgatcctcagcgtcctgatgtggggggtgaaccacacggtaaccagctcctgcgcgcccctctgagcgcggccccgcgcgctcccacgccccctgcagccctgggcccttgccccgcaggccctgccggtgacgcctgccacccctcgccaagccacttgcacgcccaccccacccttgcacgcctttcggccccgtgtgcactccccgcacgccacgcgaggcctggtgtctctgtggtctgccgtcgccacctccccttccctccagcccttctggcttcctgcgtgtggcgtgctcgcttggggcagcccatggagcgcaaaggcaaggcctcagtgcagtggagtcgctttcatccctgcttctcctcctcccccctcatcctgtttgtgagggtgtatattcccccttgttccttacagccggctgccagctctgtcaagtagcagtggtctgcccaaatagtcctctctttctgatcgtttggttgttgtggctgctcaaattctcccatcctccaggcctccttacctttgaatgtagaactccaccctgggtttccttttttttccctcttgaacaagatgtatcaactggagaagcacaggcttccttgaaccagacacttcacctgggtctctctgggttagggagaagaaagaatggctattaaccatttgagagaagaggatgcctggttataaggagggactattcatagtagaaataatatgtcttcccatagtttttgaaggtgatcattttaaagatgttgacttatctgttgtgtggctgcaatgttgtgatgatgcatagtgattatggtcctagataggagagataggtcccctgggtccttagggtgctttgagattgttcaacagcccctgccaggaagttggatcctgacagtttaagctggaagactgtttatgtggtgtttgttcagggtctttattctccctcttccaaccacttgctctttgccttctgaccatttctttatgaatccccacactaggaatgagcagaggaagtaaaaggacccgaaacaccaacttcactaactagaattttggaataaggaggatcaagcttgggtttcctgtggatttcagttctttaggttcacttgtgagtgcttgaaattgctcacaagaccaagcgatgacaaagagggccagcaagactttgcattgctttggcagaggagctgaaggtgcctttgggtggagatcgatgaaccgtaatctgagctagggttttagatcttgacctgtcatttaggaaagtgcatgtgtaaattgaggtctctgtggtttcttggtcttgggcaggttactgttttcactgtcatcactggtgttagtgagggtcctgccaggatagcgagtaccagtggtataatgcccagacctctaggagctgcttcgggccaacaatccagcccagtttgttactcggtcttcctgctgtcccaggggtcatctgacaacatttctagggaaactgggtgatcagaatatgaaccccatgtccctttctggaagtcagtccttgattttgttctgcatcctgcttctcactctaccaggcctctctctgctggttctgtttctcacagaaagcaacctgtctgtagagaactggtagaggcctgagagtcaggagtattacagctagctgcaatgaaccttgggtcccttattttacacatgaagaaaaggaggcctcaggtggaggattagcttgcctgtggttacagcaagagatgtcgcttattgtctagcaccatgggactgtatcggccaagggtggtgcctgagtggctggtcttgttttctttgcctcctgtttcttttcctctccctcagccaagtctcaggatagatgcgaagtatagtccggttagagaaggtgaatatatgctctgggttatacgcctatgcatgtcaggtcctgggagtgtgtgtgatgcatggtgttccgataggcaggcatgagtctgtccatatgtggttatgaagtttctcaatagctgatggttaggtatcacgagtcaggagtcctgtgagtcctactctgttggacaaagtggtcatcttttttctttgctaactttaagttgaaagtttgtttgaggggctagttggaaaggcattgactttaagcaagatccgtgcctctggacataatgaacaggcatctcatgggaacttcccaccactgccctggacaggctaagcttcagaggccagttagtcgtaagttttattgcttcatcctggtctgcagtaaggtctgatacttcagtgtccccatttgggaactgagacatctgcctagaagaagagtgtaatcttgcactcgtctaagggatcaggaccacattgccctcggtggactgctgcacttttttggagatttcctcccttcaaaaaaagcctactttgtaacattttgtcatctgagatttcagataccaccttttctttagtttctcacctgtttaggcatttaggcatgctggtctgtggctaatggtgtttcagataggaaggatggatatgtctttatctacagcagaagttagttaccctttcatgaggtgattagtttacttctaggtggaaaaagagaggactttgaacttggtgttgtcacaggagctgctctcatggacaagagcccatggattttgtggaggaagaatgtgtaggaaacaaggagaaaaatcagaagactttgcacctgtcagggaagaactagtgaagagcaaaaaccagtgttttagtggatgaaatacagttccgagggtttggaattagggaagagatggcctcagagaggagcatggagaccatgggaggtagacctgacttgatacttgttggccattttaagaaccaggtatgtgtgaagccttaccacagggatcagaggagcaggagcagttgatggtgactctgtatttaaccatttgagaaactgccaaactgttctctaaagtggctgtaccattttacatgtctaccagcagtgtataagagttccagtatctgcatccttgtcaacacttgttattgtctttttaaagttattaaagccattctgttgggtgtgaattcgtatctcattgtgattttgtttgtttgtttgtttttgtgatggagtctcactccgtcacccaggctggagtgcagtggtgcaatctcggctcaccgcaacctccacctcccgggttcaagcaattctcctgcttcagcctcctcagtagctgggattacagatgcctgccaccacacgtggctaatttttttattttagtagagacaaggtttcaccatgtcggccaggcttgtctcaaactcctgacctcaggtgatccacctgcctcggcctcccaaagtgctgggattacaggcatgagccatcgcacccggcctcattgtgactttgattggcatttctgtgataactaatgatgttgagcattttttcatgtacttactggccatttgtacatattcttttctttttttttttttcttgagacagagtcttgctctgtcgcccaggctggagtttagtgccacaatctcagttcactgtaacctccgcctccttggttcaagcgattctcctgcctcagcctcccaagtacctcggattacaggtgcctgccaccacacccagctaacttttgtattcttagtagatatggagttttaccatgttgtccaggctgatctcaaactcctaacctcaggtgatccacctgccttggcttcccagagtgctgggattacaggtgtgagccactgtgcctggcctgtacattttctttttgttgttgttgtagagacagggtctcgctttgttgccgaggctggtcctgaactcctggcctcaagtggtcctcccgccttggcctcccaaaggactgggattgcaggcatgagccacatccccagccttcattggtatcttttctttggagaatgtctattaaattttttgcccatttacaaagatctttttgcccattattaaattgggttatcttcttattattgagttacaagaattctttttatattctagatacaggtcccttatcagatatatgatttgcaaatattttatcctattcattgagttgtctttttcatttttcttttttttttttttttttttttttgagatggagttttgctctgtcgccctggctggagtgcaacggcgtgatcttggctcactgcaacctctgcctcccgggttcaagcgattctcctgcctcagcctcctgagtaactgggattacaggtgcccgccaccacaccaggctaatttttgtatttttagtagagacagggttttgccatgttggccagactggtctcgaactcctggcctcaagcaatccccccgcctcggcctcccaaagtggtgggattacaggcgtgagccactgcacctggcctgcctttttcatttttcttatggtatcttttgaagttcaagtttttaactttaataaagtccagtttatcttttttgttgttgttgtgtgtgcttttggtgttatatctaagaagacattgcctaacccaaggtcatgaagatttactcctttgttttcttctaaaagttttatagttctagctcttttttttttttttttttttttaatgaattggggtttctctgtattgcccaggatgttctcaaacttctggcctgaagcaatcctcccaactagagttttagctctttctttcttcttcttctttttttttttttaattgtattgtggtcagaacatttaacataagatgtactctcatgacaaaattttaagtgtacgattatgttattgatgaccatgggaacagtgtcatagtgcagctctgtagagcgtattcatctcgcttgaatgaaactttatgcctaccaattaactccccatttcccccgcccccagcccctggcaaccaccattctactctttgtttctatgaattggactgttttgaaaccttatataaggagaatcatgcaatatatgtttttctgcgactagctgatctcagcgtaaggtgctcaaggttcatccatgttgcacatagcagaatttccttcttttattaaggctgaatagtattctgttgtatatgtataccacattttctttatcatctgttgatggatttgttttcacaccttagctcttgtgaatagtgctggagtatgtatagttttagttcttacatttaagtctgtaatccattttgaattcacttttgggtatggtgtgagggacagatttattctttagtctgctcaatttctctcctacattccaccccagttctgttctgtccatacattttctttctttcttgtttttttttttgtttgtttttttgaggcagggtctcgcgctcttgcacaggctgaagtgcagtggcacaatcacggctcaatgaagcccctacctccccatgctcaggtgattctcctgccttagccacccgagtagctgggactacaggcacatgccaccacacccgactaacacttgtattttttgaagagtcggggttttgccatgttgcccaggctggtctcgaaatcctgggctcaagcgatttgcccacctcggtcttccaaagtgctaggattacaggcgtgagccactgacctcctttacctgtctttttatcttgccctactgctttaaaaatcttcagaggggcctggcatggtggctcacgcctgtaatcccagcagttagggaggccaaggtgggcggatcacctgaggtcaggagttcaagaccagcctggccaacatggtgaaaccccgtctctactaaaaatacaaaaattagtcgggcatggtggcgcatgcctgtaatcccagctactcgggaggctgaggcaggagaatcacttgaacctgggagacggcggttgcattgagccaagatggcggcattgcactccagcctgggtgacgagcaaaactccgtctcaaaaaaaaaaaaaaaagaaaaaatcttcagagatggctgggagcagtggcttacgcctgtgatcccagcactttgggaggccgaggcaggtggatcacttgaggtcaggagtttgacaccagcctggccaacatggcgaaaccctgtctctactaaaaatacaaaaatttgccgggtgtggtggcatgcgcctgtaatcccatctacccaagaggctgaggcaggagaatggcttgaatccgggaggcggaggttgcagtgagcagagatcgcgccattgcactccagcctgggcgacagagtgagactccgtttcaaaaaaaaaaaaatctttagagaacattcctactcaggcctttgaatgaagtttcttttagcaggccttcccacctcacagggagcagtgggactcaaacagcaggagaaggagaaagcaagatatggaaaggaggagtaaacaccagtagatttattggctcctgtggccctctcttcctctctggagttgcagttcttgctttggacctcctcggtcctgtgagtgtatttctagcatgtcatgttttctgatggtggcaggtaacaagtgattgctggtggtggccagcccactgctgaaccgacagcagaggactggaacatgtcaggaaacctgcatgcctagtccaggcatcctaggtaacaattcctatgaaggtcgcacagggaagtggaggcttctggacacacaagttcaccagactagaactagctgctgaattttcatctccatgttgcatattgcagaattttcttcttttttttaaaggctgaatagtattctgttgtatatgtacaacagaatcatacctctcactttgagagactgaggtggatggattgcttgagcccagggctttgaaaccagcctgggcaacatggcgaaaacttgtctctactagaaataaaattagctgggcatgatggcacacctgtagtcccatctactagggaggctgagatgggagaatcacctgagctcaggaagttgaggctgcagtgagctgagatcataccactgcactctagcctggcctatggaagtgagaccctgtctcaatcaatcaatcaaggaattttcatctccagtagatcagcatagagtgaactcattgcttttttttttttgagacggagtctggttctgtcacccaggctggagcacagtggcatgaactcggctcactgcaagctccgccttgtgggttcacgccattctcctgcctcagcctcccgagtagctgggactacaggtgcccgccatcatgctccgttaatttttttttgtatttttttttagtagagacggggtttcactgtgttagccaggatggtcttgatctcctgacctcatgatccgcccgcctcggcctcccaaagtgctggaattacaggcgtgagccactacgcccagctctgcagatgtctttttggttttgtatccccagctcctagcatatagtaaggcccttaatacactgagtagaagtaaattgaatagaaatttggcagtctggctgggcgcggtggctcacgcctgtaatcctagcactttgggaggccgaggcaggtggatctcctaaggtcgggagttcgagaccagcctggccaacatggagaaaccccatctctactaaaaatacaaaattagccgggcatggtggtgcatgcctataatccgagctactcaggaggctgaggcaggagaattgcttgaacccgggaggcggaagttgcggtgagcacgccattgcactccagcctgggaaaccagagcaaagctctatctcaaaaaaaaaaaaaaaaaaaaaaaaaaattggcagtctgagccagattaggaaaggccttgaatgccaggctaagcagttaaaactttaccctgaggttgagaggagcagccatggaagatttctaagcaggagtgtagcatgatcttgtagattctcctaatgtcaagtgctcttggtgcaataccaggagaggcattaggtgccttgtttctggcctgatgtatgaggactgggagcctgaccctctggccatgctagcctcatccttctctgagcctctgctgttcttgatgtctgtatccctggattctcacttaattgcatactgctttgactttgagtgtgtcagggttttttttcatctccctgatgagattataagcctcctgtttcttttgcatgtacaacactttctccccttgtgttctcctcctcccacacacctacctaacagaatgaagcacgtagcagatatttcaataggaacagttcaattgaaatggaatagaactctctgggatataaaatttcacacaactaaaaaaataataataatagggctaatccctacagtgaatcatctacatgtggcctagtagaaatgaggggtaagtctcccctagttgagatatggattgttcaccaatgttagctgagttaaaaatttcctaggctgggccaggtgcagtagctcacatctgtaatcccagcattttgggaggctgaggcaggcagatcacgaggtcaggagttcgagaccagcctgaccaacatggtgaaaccccatctttactaaaaatacaaaaattagcagggcatggtgacatgcgcctgtaatcccagctactcaggagactgaggcaggagaatcgcttgaacccaggaggcagaggttgcagtgagcggagattctgccactgcactccagcctgggcaacagagcaagactcgatcttctgacctcgtgatccgtccccttcggcctcccaaagtgttgggattataggcgtgagccactgcgcccagccgagccctgaactctttgtctctgttttccctttaagtctcggagccaggcttgatatgccaggaaaaaggaaatgggacagccaccacgaattgtttctgttggcagaaaaacaaagaagtggaatggtttcctctgtaggcacagatttgacagtcacattctcttgtgagcaccccctggaataggaactggcatgactcttctggggttttttttggctattgggagggtttagccaatgaagggtatcacagagcttgatgctgggaatttaaaaatcaactttattgaggaataatttatgtatattaagtgtgcgtattttaagtatacaatttgatgaatttcagcaaatgtatttgctcatgtaaccatcaccccaagcaacatataaaacatttctgtcaccgtagaatcacacttctcatgtccctttacactcagcaccccccgccccctggccaggcaactcatctcatttctctcattatagatgcctgctgtagaatttcatataaatggaattatacaggatacactcttgtgtctatgccagtttttgccagcagtttacctagtgtctgctccactgccaacttataaactaccctgcccccagcatccctctcaaagcacgtgcattcctatggcttccttcatttctccatgagtaaattgggttttttcccaactctaggaagatatggttccccagcccagttactgcattaacttgaacttcctccattctctgacatttctaaataaaaaaggtttgtaacataaaaggagcagcaaattaaatgccatttcccccatttatgctcctggaggagttctaatgactctaggttatcccctcactgccacctggggcctcattgagataacaggatttgcaaggaaagtgggagacacaaggctgtgccccctccccccagtccattaagtcaggactaaggtttcctctgtaaatcctgaatgcattagtggcaactgggttgagggtcaaatgtcaaatactctgctgtgatgggagaggacatctgtggttaattagaccactaactggctaaactcgaggtggggaagggcaggatctgccctcatctctgcaccaatggaaagctagctctctgtctaggatccagctccctgaagggatgaaagtcagaaggtttgtttgcagtagaggcaaggcatcctgccccatctcccttagtttagtgtatggcaggacttgacatcaggaactggccctgctttattttattttcttttttgagacaagatctcactcttgcccaggctagagtgcagtgcagtggtgcagtcagctcactgtaacctcaaactcctggcctcaagcaatcctcccacctcagcctcctgagtagctaggatgataggtgtacacgactatgcctggctaatgtgtttaatttttttttttttttgagacagagtctcactcttgttgcccaggcagtggcgcgatctcggcccactataccttatgcctcctgggttcaaacgattctcctgcctcagcctcccgagtagctggaattacaggtggcttccaccacacccagctaatttttttgtatttttagtagagatagggtttcaccatattggccaggctggtcttgaactccttacctcaggtgatctgcctgcctcagcttcacatttaattattttttttagagatagggtcttgctgtgttgcccagggtggtatagaactcctggcctcaagtgatcctcctgccttggccttccaaagtactgggattacaggcatgagccactgtgccaggcctggccctgcttttatcaggagggtccaagtggggcagtggccagacatttactactgctcactttaatctattacagccgggcgcagtggctcacgcctgtaatcccagcactttgggaggccgaggtgggtggatcacgagctcaggagatcgagactatccaggctaacatggtgaaaccctgtctctactaaaaatacaaaaaattagccaggtgtggtgtcgggcacctgtagtcccagctactctggaggctgaggcaggagaatggtgtgaacccaggaggcggagcttgcagtgagctgagatcgcaccactgtactccagtctgggcgacacagtgagactctgtctataaataaataaataaataaataaataaataaataaataaatttaatctattaccttggggatatgagttacaagtccacacaaacccatccagctttttttcttccttgagctaatttcttgagtgacccacaatttgtatgaagatattcaaaggccttaattaatacccacttaggttgggagacatttatctattgatcatttattattgcatatgacaaatatttattgagtatctgccatatatgctagtaatggtgccaagcactgtggtgccccaaagattagtaggatgctctttgcttagaaatataattaaagccgagcgtggtggctcacgcctgtaatcccaacactttgggaggccagggcaggtggatcacctgaggtcaagagttcaagaccagcctgaccaacatgatgaaaccctgtctctactaaaaatacaaaaaaaaattagctggacatggtggtgcatgcctgtaatcccagctacttgggaggctgaggcaggagaatcacttgaggccaggaggtggagattgcagtgagctgagatcgtgccattgcactccagcctgggcaacaacagcaaaactccgtctcaaagaaaaagaaaaagaaagataaataatatagtattgcctagcttaactctagcaggtgaggtttataggcattaactacaatatgagagactgtgagatggccagaagacagatacaaagaaaacttcaggaattccaagatgggaaagggtattgatggtctagagaatcttggaaaacttcatggaggaggtgccttttgagctggcccttatcaggtggagagtttcaataggtaaaataggacaaggttgggaacttacttgaagagaagaacagaaataaaggcagggaggggccaggtgtggtggctgacacctgtaatcccaataatttgggaggccaagtctggaggattgcttgagctcaggacagtgagaacttgtctctacacaatacaaaaaaattagctgggcgtggtgatgtgcacctgtagtcccagctacttggggggctggtgtgggcagattgcttgagtccaggaggtgaaggctgcaatgagccattgtcatgccactgcacttcagcctgggtgacagaatgagaccctgtctcaaaaaaacaaaaaaagacagagagggaaacttggacatgcttttagcaagattgtggcatccacattgtagcttagtgtctctgaggcaggtggcctcctggctgagagccttacgttctccttgcttttcagatcaatgagctgagcaatgttcctgttcctgtcatgctaatgccagatgacttcaaagcctacagcaagatcaaggtggacaatcatctcttcaataagtaagttgtctactgagtggactcaggttttgtgggcagtcctttccctcaagtcagaggcttctgaagcctcatgcatggtgggagccaaggcagcacctggcagggtgtgacagcagcacctggatctcagagcggacaaactggctaggaaaatgcattcgttatgtgcctctcatcctagtattgtcgtctcactctattatcagcctacctccggtggcccttggggcatgtggctgggcccagggtgattcatctagagccagctcaggtggcagtgagctgctctggagctgaggtattcagtgtgaggctgtagcagtggccccatcttggtcttagtctgaggcaggaggttgccaggcatgttcttggtctgggatgccgccaggctcttttctgtctggctggtgtatgagcaacaggcagagcatggggctcgagggcactatccagagtagcacttcccatttttgtctgctgtcgcttcttggattagcaccagtgtctgaaggttgtctcagatattgttggaaacactagcggccgccacacctggcacaattttgggcctgctttaagccctttggggcctggattttccatccctctgtggaccaccccaggactatttgctgcttacactttctcctttctgcatgtgaatcctggttctattcttcattgtctcacagtccccaccacctcactagctgggttctgtcaccccaccattcccagactgttagtccagaggagaagattgacttgagaacatcccttagtgacctccctctgccatagtaagtaataccatcttgttctagaagccgtctgtctccatagctgccacctgttaagtggccacctaaggagggagaggcagccctcaactcagagaccagaaagaaggttgttctgacccagaagaaagaaggttgttctgactcagaggtccgggttctcgaagtgggcattgcaccactacccccttcagggtccatggcctctggtgaggtgctacctccttgatatcttggcctaaagcagagaacccaatctcttattttcttctatctttattccttttgtccttccaacaactgtgtatgtgtttttgttgttgttattggtgttgttttgagacagtttcactcttgttgcccaggctgtagtgcagtggcgcgatcttggctcactgcaacctctgcctcccgggttcaagtgattctgctgcctcaggctcctgagtagctgggattacaggcacccaccaccacgcccggctaatttttttgtatttttagtagagatggggtttcaccatgttggccaggctggtctcgaactcctgacctcagtcagggtgatccacctgcctcggcctcccaaagtactgggattacaggcaggagccaccgtgcccagccctgtatgtgctatttattagattctagcactgtttactagaagacggggtagataaggcagataggccacttcctttccaagaagacattccttttgatttccttaaagcctgtcatcctggagtagtcactgggacatatttctgaaagggggtccctaaacaggatagctgttgtaaagatggaggattggtaagagtcatcatttcaaggtgattctctttcctcctgggagtctgtattgatgagggagtgggagggtggagattggtgccagcagccagcagacagggctctgtggtcccactcagttgactgaagacctctttaactcaggcactcttttcctacgtcccagtggaagcccagggcagggcttcctgtaagtgaccatcttcaggatgcttccacaggaatatggccagaggagaggggccctctgatgagagaggtttttccttgtagcattcaggctgatttcacctcacagcagatgttcacatgcaggttcccactgtagtaagcacagtgcttgtgaggtggagcctgcactcaggcttatggcccagcgggtgagagtttttttctttaatgtatgttttattgaagggcagcacacacatagaaaatcgcacaaataccagttatactgctggattacttttacaaagtgaatacaagatgtaaagtttttaaacttttacatgctcagaatcacctggagtgtttgtttttcgactcaactccagaattcctaagagcctagaaacctacatgttaagtatggcagatgttcagatccaggcaatctgtggaccacactttgaagagttctgaagtcagaatatagatgaggctgggtgtggtggctcatgcccgtaatcccagcactttgggaggctgaggtgggaggatcgcttgaagccaggagttcaagaccagtctgggcaacatagcaagactctgtctctattacaaaaaataataataataatagaattaagatgagcaaggggcagttcacaaagacatatctctgcttttccctagggagaacctgcccagccgctttaagtttaaggagtattgccccatggtgttccgaaaccttcgggagaggtttggaattgatgatcaggattaccaggtatggaggctcctggcaacatcagtggattagggaatggaatggggtcaggaagccacaggacaggtagagaatcaaaacgtgttggctgtttttgtgctgtgtctccctgtcatgccttgctccagcccaggcggtctctcccccagcactgggggccccttgcagggcgagggccttagaaatgcttctgaggatgctgcacacactcaggttcctctccctcagagggagggcagcaggagggagaggggtctgcggaagcacctttattttagtctgacattcccagtctaggctgaagaacccttctcattcgtagtttgacttcaaagagaactgggtggggcatggtggcttatgcctgtaatcccagcactttgggaggccaaggcaggtaggtcacctgaggtcaggagttcgagaccagcctggccaacatggtgaaaccctgtctctactaaaaaatacaaaattagatgggcatggtgatgtgcgcctatagtcccacctactctggaggctgaggcaggagaatcgcttgaacctgggaggcggaggttgcagcgagctgagatcacgccattgcactccagcctgggcgacaagagtgaaactcagtctcaaaaaaaaaaaagagagagagaattgttgttagcgagagatgaggcctcttaaagcagatgaaatagattagaaaaggaagacttcaagggtagtgtaacctcttgccaggtatgagtgtcacctcctaaacttgtgccctatcctggtggtgggagtggggagttggtctgccagggcaactgcccccttcagggcgtgacagtgttgtagaggccattggcctgttgggaggaatcaatcccagtgtcagggacattagaatctgactcagtccatggtttctgtcacttctcctcttagcacatctccttggatcttcttccttggcagacagccttgtggtgaaggtgggcgaattttccacttcacctttacagctgtaagaaatatagctgactttttttttttttttttttttttttgagatggagtttcactcctgtcgtccaggctggagtgcaatggcgcgatctcggctcactgcaacctctgcctcccaggttcaagtgattctcctgcctcagcctcccgagtagctgggattacaggcgcccaccaccacacccggctaattttttgcatttctttttttttagtagagacggggtttcaccatgttgaccaggatggtttcgatctcctgaccttgtgatctgcctgcctcggcctcccaaagtgctgggattacaggcgtgagccaccgcacctggcctgaaatatagctgactttcattcatctgtggagaaaacttttccccatagcacagtgaaacctagtgtatagcacagtgaaacctagaatggatgcccaaatcttttctaacactgtagttcctcccaccccacccctttgatagagtagttcacagcagcagaaggggccttgggttagagtctcctcccctctctcctcctctctggagggcttgcatgcaaagaaaagtatctcgaagaagagggtgagggtttgtgagaggaggaggagatgccttgggcttgaatgcccaggagtgcctacacctaagaggtactgggaggttcctccagcctgctgttaggattgaaccctgaactcaatcatgacttgactggggctggaggttttctggaaacttcttgccactattgcaaccccaagttgctcagacagattccctccattgttccttggtgaggggttgcaagtgaggggttcctttccctcccctgggctgtctaaccacatcctctcagtgtctgcattttgcccctagtagccttgtgggcgcatgcccgtgctcaagactgaaatgagggcagggaggatggtgctcagggaggggaccctatattcttggactaccagccacttagagagtcaggggatgctgcctctacctcccaactaggcttgcagcctgtaagtcttatggtagagaggccaggctgggaggaagaggcgctcagtcacagagtctactcaacctttctgtaacgggaacagcctgttttttggggtgctactttagcacctttgctgaggaactcccagagctgcttaccacctctgactttagttttccccatgaaggtggtcctcacttctccaccagggttttctgaggaggtattaggggaaagtaaagagtaggatcctgatcagccgggaatggtggtgcatgcctatagtcccagctgctcaggaggccgaggcgagaggatcccttgagcccaggagttcaaggctgcagtgagctatgatcgcaccactatactccagtttgggtgacagcaaaacaccatctttaaaagaaaaaaaaaaggctgggcacagtagctcacacctgtaatcctagcactttgggaggctgaggcaggaggattgcttgatctcaggagttctagaccagcctgggaaacatggcgaaactacatctctacaaaagctacaaaaataagccaggcatgttggtgcacacctgtagtcccagctacttggtaggctgaggcgggaggatcacttgagcccaggaggtagaggctgcagtgagctgagatctcaccactgtactccagcttgggtgacagagtgagaccctgtctctacaaaaataataacaggatcctcattaagagatggggaaacatcttggagaggagacatttctgtgacatgatccccatgtatgttttcttgggaacagggacacttgggatctcccctcaccgttgcttcccagaggtcccttggcatctgcttggtgaacatatccctttggttgactcacgccttcccacaccctccctcttaaggcttctactgctctctgatcctaatgggagtaggaccttgaggaggagcagggatacagccaggaaagctccccaaaactgcctcccagccttgcatagacaagcaggaggttgaggcaaggggaaaggtgtcaggctcagagatgaggatcagcttcctgctttggggaaggtttttcagcattagggtagatccagggacaagagacgaatgggcattgcttctttgtgctagaccccttgaagacagtattttctaagcttcatctttgctacccccaagagactgggagaatcagctcagtctgcatctttgtgttcctgatgaggaaatgcaggggtagagaagttaaatggctcacccaaggtcatagtgcgtgtgagagtccagattagactcagccccctccatcagaggcagaattttagttggtaggatagctatctgggatcaggatggaaactttcacagtcagtcctcttcccatcctagactgggatgaagagcaggtggtaaggaacaattcttgtcactttggaggaagacttagggagggatgtgaacaccctgtgagaaaaggggagggtaaactcccatctgggagtccctctatctcagtgttgttggctttcaagcagtccagcccctgagggaagactcagcgaaagtcagaattctgttcccctgccaagcccagccttcttttgtctcgattatcagaattcagtgacgcgcagcgcccccatcaacagtgacagccagggtcggtgtggcacgcgtttcctcaccacctacgaccggcgctttgtcatcaagactgtgtccagcgaggacgtggcggagatgcacaacatcttaaagaaataccaccaggtatggtgagtcccaagcctgggctgcagaggatgggttggaagagggagaagagagccctgggggagcttcttagggaggggttggtcctctctggtaatggcagctgcttctgatcaccaagcagtgggactctcctgcaaccgtatttctgtgagctgaaatgcctactttaaaaaagaaaaaaggagccatgaaggctcatcgctgactgactcccagttggaaagtgttcacgcactggcatccgccccgtttcttctgaaagaggccccctcagctcggcaggcttgtttcttttcccgtcccatctctccactcatctggaacctgtccatgaggaaggcagggagccccgtggcaccatctgtgtgtctgtcctcagcctacttgggtcttcatttctggggcacctgagaagggccgaagggagcttctggtctttcaggagttatggcagaaaccctggggcatggcatggataagagctttggatatggagctgttctcttctcccagatggctggatccctggcctgcctctgcatcctgtctcttccctgcggcattcccatatcaggctggcagaagagatgcaaggtgtggatcagggattttcctgtggtagaatcctactttaaacaaaatcttaggtgagatactaataatatgaacccacaggggctctgagccacctgctcagcttgcctctccctctgccatgccaacaggaggctggaggtggctgttgcccattttaagcctgagaaacccctattacttcatagaacccagctggagaactactggtctagaggttagaatcccagggagccagggagcattttagtctggggtgagccccatccatccctggcactgcctgttccttagtcctctctcttcttcctttccattctagtttatagtggagtgtcatggcaacacgcttttgccacagttcctgggcatgtaccgcctgaccgtggatggtgtggaaacctacatggtggttaccaggaacgtgttcagccatcggctcactgtgcatcgcaagtatgacctcaaggtaaagggctctgtgtttgccggagctgtgcctcccctctatctgagccccgaaggggccactactccaacttccatgtaattgggaagctggagcctatgtgttggcatggacagggaactctggagtggatatgcctgattcttgtggaccaaaggcagtttgaagtccaggtgacagtaacaggagattatttaagccctaaatgtgccatatttatgcagcagttgatgttcctgtctgtggaatgtgcacagtgagggaggccgtgctgacgcatgcactttagcatccatcaggcccccatggactgccagcacaagtgcatctctagactctgagaaggacacacttgtggctgtgaactagggtgctccgtgttcttgaacctggcttctgacttctgtcaccttatgccgccatcccttccctctgtgctgcaactgggctggtttcctctgtgttcctgcagtgcctgtgctcctcttcccaggatttcacatctgctgtctggaatagtctccttctctctctccacccactccttcccccacctaattgcttcctccttacccttctgagctcagcccaaatactacttccaggaagtaggtaggccctggccactgtccctccccaggccgggcccgtgtggtttgtgctttcagagtgtcctgtctcctccctgtaccactgagcaccgtggtagtgaatgaactaatgacttgtggaaccactgctgaatatctgtctcccctgttagaaggaaagtagctcaagggcagggactgagcttctccagtgcagtcctgtttgctgagcacctaaaaagtgtcttgcacatagagctctataagtgggcttgacacagtaaatgaacaaggtgctgcctcctggcccctctaggactctaacaagcctacttgagttcacctgctggctctcccatgtttgctcatgcagtcgactttgcctcagcttgacttcccctgatggctcttatcctttcagggttctacggttgccagagaagcgagcgacaaggagaaggtatgctggtgctgagcaggaatggaagggtcgcttggagtcagaaacaactcctgtcggccatcctgtccctcgcccaccccagcccctagcccagctcccagacatgccgtctgtcaacatgaaatgccgtgtgtcatgaatcacctgtctgtccttgtgctaggcctagaccttggtctctggtcttttacctctgccctcactacgttcttcatagtcctgctgggatggcagacatttctatctcatagtccagcctgagtcagtcagtggctgcctgagccctgagctggtccaggctcaacaggaaagaatcctttagtcattcctcatctttcatgtgtttgccctccctgcccacccaaagcctgggactagaggctcctgcactgctgatttagcaggttgagggtcggtacactgacaacccctccttcccctttctgtatagttgctcccagcagaacagttgggtgtccctggggtgaattaatcaggcttacccagcctaactgctgttgctctcctaggccaaggacttgccaacattcaaagacaatgacttcctcaatgaagggcagaagctgcatgtgggagaggagagtaaaaagaacttcctggagaaactgaagcgggacgttgaggtacttactaaccttcattttcacctgcaaggctccttctgtacctagagtaggcgcctcttaaaccttaagaagaatggaattcagtactttccaggagtatggacaaaagggtggtgatttgagcagcgtgggcacttatgggcacctaaagcaagtgcaaatgatcattccacctgacggagcatagttggcgccagtaggacctttgtaatttagtttagaatgcttttcccttttcactaattcattccaacacctttttcaaactcccttctgctgttgtccctacaatggagagggcatctggccatcagagctgtaggaacccagctattaaggtcctgtaaccccaacattttgggaggctgaggtgggaggatcgcttgagctcagcagttcaataccagcctaggcaacatagcaagacctcatctctactaaaaattaaaaaatttagccaggcgtaggggcacacacctgtagtcccagctacttgggaggctgaggcgaaaggattgtttgagcccgggagatgaggctgcagtgagctgtggtctcaccactacactccagcctgggcaacagagcaagacattgtctcaaaacaaaaaccgaaaaagttggctaagcatggtggcttactcttgtaatcccagcaccttggaagggtgaggcaggaggatcactggagcctggcagatcaaggcaacatgagctgtgatcatgccactgtgctccagcctgggtgacagagcaagaccctgtctcaaaaaacaaaaatccactaatcaggttcttctctggctctggctctgattctccacttacctagcaaacttctgtttgtaatctggggaggacaggtgctaaatagtgaaaatgttatctggaccacttgataactcagcgtctccttctcttttaataaattgagaggctgctcgttaaaaccaaatcctacaaacaaacttgggaaaaaaaattttttttaattgtggtaaaatacatataataataggtgttttttttgtttgtttgtttgttttgtttttttttaggagattctcgttctgtccccaggctggagtgcagtgcagtggcacgatctcggctcactgcaacctccgcctcctgggttcaagtgattctcctacctcagcctcccaagtagctgggactataggcacgcaccttaaccattttgatatatagttgagtggcattaagtatattcacattgttatgcaaccagcactaccattcatctctgaacttttatctttcccagctgaaactctatacccattaaatactaattcccaattccccctccctaacccctggcaatcagtgttcaattttctgcccctatgaagttgactactctaggaacttcacataagaggaagcaaacagccaagcgaggtggctcatgcctgtaatcccagcactttgggaggctgaggtgggcggatcttctgaggtcaggagtttgagaccagcctgaccaacatggagaaacccagtctctactgaaaatacaaaattagccgggcatggtggtgcacgcctgtaatcccagctacttgggaggctgaggcaagagaatcgcttgaacccaggaggcggaggttgcggtgaccctccagcttgggcaacatgttatgaatgaaactccatctcaaaaaataaaaaaaaaaaaaggaagcaaacagcagttgtccttttgtgactctgttattttgcttagcataatgtcttcagggttcatccatactgtatcatgtgtcagaatttttttctttttattatttatttatttgttttgagacagagtctcgctctgttgccaggctggagtgcagtggtgcgatctcggctcactgcaacctccgcctcccgggttcaagcgattctcctgcttcagcctcccaagtagctgggactacaggcgcgtgctgccacgcccagctaatttttgtatttttttagtggagacggggtttcaccatgttgaccaggatggtttcgatctcctgacctcgtgatctgcctgcctcggcctcccagagtgctgggattacaggcgtgagccaccacacctggccagaatttctttctttttaaagctgaataaggctgagcatggtggctaacacctgtaatcccagcagctcaggaggctgaggcagaaggactgcttgaggccagaagttggagacctgggcaatttactgagatcctgtctctacaaaaaattaaaaactagctgggtgtggtgacatgtgcctgtagtcctagctattcaggaggctgggtgggaggatcccttgtgcctaggagttcacggttgtggtgagctatgatcatgccactgtgcatcagcctgaactagagggtaagaccccatctctttaaaaaacaaaacaaaagctaggcgcggtggctcacgcttgtaatcccagcactttgggaggccaaggcaggcggatcacgaggtcaggagatcgagaccatcctggctaacacggtgaaaccccgtctctactaaaaatgcaaaaacaaaattagccaggtgtggtggtgggcgcctgtagtcccagctactcgggaggctgaggcaggagaatggcatgaacccgggagacggagcttgcagggagccgagatcgtgccactgcactccagcctgggcgacagaacgagacctcatctcaaaaacacacacacacacacacacacaaaaactgattaatattccattgtatggatgtattacattttgtttattcatcagttaatggacacttgttatatcagttggggttctccagagaaacaaaacctataggatgttttgtaaatctctttataccaagatatttattttttattttatttatttattttttttgagacagagtcttgctctgtcacccaggctggagtacagtggcgcgatcttggctcactgcaagctccgcctcccgggttcacgccattctcctgcctcagcctcccgagtagctgggactacaggcgcccaccaccatgcccagctagttttttttgtatttttagtagagatggggtttcaccatgttagccaggatggtcttgatctcctgacctcatgatctgcctgcctcggcctcccaaagtgctgggattacaggtgtgagccaccacgcccggccctaagagatttattttaaggaattgtttcatgggattatggataccaacgagatctgcagtcagcaagccggaggcccaggagagctggtggtgtggttttattctacaggccatcaggccaccaggcagaaggagttccctcttcctcaccggagggtcaccctttttcttctcttcaggccttctgctgattggatgatgcccatccacactggggagggccatctgctttactcagtccaccagttcaatgctcatttcacccagaaaccctcacagacacacccagaataatgcttgaccaagtgtctgggcactcaggcccagtccagctggcatatacaattagccatcacacttaggttgcttccaccttgtagctgttgggaataatgctactgtgaacatgggtgtcataaacttcgttttgctaggaagcgtttccttagtcacccccaactatgttctttccttattctgcctttcatcatctgacattatttgtcctgagtctttgtccttctcccttttctaccctctccccctactgtggttctgagaagaatttaatgcagtttactcagtgcatttgttttcaatgcatgttgctttataaatgttctcaggtgggtggagggcatggtgcatggaccttctttttcctgggaccctagccccttctccctgggccttgagaaggctttgtctggaagtgctcagagtggcatccctccctcccttcctcttccaaggagatcctgctgggctcccatctttagggctccttgtccttagttgtgttctgggctcgtgcatagagctgctctgcttccatgatgattctcctcctagttctctgttaggacctaacatggtggtcagtctaacagtctcctagtgaccactgtatgatggtgactgcactcttgcctcattattagctaaactggaatgctagctggccatttccatcctgtatcattccatactttgtcttgaaatcctagataaaagacttgaaccaccaccctgctcacagcacccattatacagatgagaaaactaaggcttggcaaggggagtcacatgatgctaggggaggactttcccccagcaccacacagcctcttttgaccttcagggaatgggttgagaatattagttggttctggctgccattcttgtatggttttgtgttcccttttccttttttttctatttttacctgggctgaaaagtcgatgacatagttttttcagactttgtctctgaggccagttagaagtatattttaccttgcaacccaatggatacacacaactgaaacactgtctacccttattttctgtcatgtattctgatattttctattctattttattatacagtagtccccccttatcagcaggggacatgttccaagatccccagtggacgcctgaagccacagatagtactgaaccctgtatatactatgcgtgaattttttttccttcttcacaatttcacggatagaagatttgttcttacaggagatcttagcaacctcagcatgcaatttattttctttgtaagtcaagagctttcaccttttcacttaaagctggccaggtgcagtggctcacacctgtaatcccagcacttttgggaggctgaggcaggtggatcacttgaggtcaggagctcgagaccagcctggccaacatgatgaaactgtctctactaaaaatacaaaaattagctgagtgtggtggtgcatgcctgaagtcccagctacttgggaggctgagacaggagaatcacttgaacctgggaggtggaggttgcagtgagccgagattgcaccagtgcactctagcctggtgacagagcaagactctgtctcaaaaaaagaaagcactttatggcttctctttggcatatctgaattgccaacatcactactcttgctctgtggagtcataatgaagtcaaatatgggttacttgaatacaagcactgtgatacaactatagtgaactgataaccaagacagctacggacagctactgaaagactaatgggacgttagtgcatacagtgtggatatactgcacaaagggataatctgcatcctgggcagcactgaatgggacatagcaagattttatcatgctactcggaatggtacactatttaaaaacttatgaattatttctggaattttccatttaatatttttggactgtagttgaccacaggtaactgaaaccattgtggataagggtggactactgcatttaatttaaagaaatcctagttccagcccactacattgggtttaggactcataatgggttgaaattttgatctgaaatatattgttgtgtcatatccatcgctccatcctcttccatagtatatcatttcattatttctttcctcaaacttggccatggcctctttttttaaaacaagagacagggtctcactctgttccccaggcttgagtgcaatagtgccgtcatagcttactgcagcctcaaattcctgggctcacgcgatcctcccacttgagcctcccaagtaggtaggactacaggtgtgcactgccacgcccagccaatttttaaatttttttgtagagatggggtctcatcacgttgctgaggctggtctcaaactcctggcctcaagtgatcctccttaattggcctcccaaagttctgggattacaggcatgagccaccgtgcccagccaccatggcctctcttgatcccaaaccgtcatgggctgttccctcttcctgcagtgctcgttctatctttaacctgcagtacttgcctcactgactcctcttcatccttggcctcaactcctttcttcagggagggtcttgctcacccctcactgtaaactcccacagctccttgctttttttttttttttttttttttttgagaccatctccctctgttacccagctagagtgcagtggtgtgatcacagctcactgcagcctcgacctcctgcctttcccctgctgaatgactgtcttccccattagacttagagagctcgcgagggcgggtgctctgatgccttactctctgttgaatttcaaaactgtttgtagaattgagttgaaaggaatgcctttcccccctttctggatgtcactgggatgtcctgtgtaacctcttcttccttccatctttccatccttgcccttcctagttcttggcacagctgaagatcatggactacagcctgctggtgggcatccacgacgtggaccgggcagagcaggaggagatggaggtggaggagcgggcagaggacgaggagtgtgagaatgatggggtgggtggcaacctactctgctcctatggcacacctccggacagccctggcaacctcctcagctttcctcggttctttggtcctggggaattcgacccctctgttgacgtctatgccatgaaaagccatgaaagtaagtcagagcctgcgcctgctctgcacagccctgccctcatcctaccccctcagctcattgtttagatccttctaggggcatctggacctccacctcattcattgctgcctttgacctctttctgcctccagattcccatccagggtcaccacctgaacctggggctcctcctctgccaggctttcctatacttccctgcttgtcctggctgactgaagagtggttctgctctggttcatgagatgaaccaaactttattcatactgtcctgtcagccccacagagtgactgtgaagatccaataagataagagctatgacagctggaaaggactccactggtccttttctcagccccaacatgataaggatggagctgagccttgtgtctgggggttgtagcagtgcccagctgctgtctgcccttctcctgccccctcttccttcttccctgctctccttgtccctccaggttcccccaagaaggaggtgtatttcatggccatcattgatatcctcacgccatacgatacaaagaagaaagctgcacatgctgccaaaacggtgaaacacggggtgagtcctctccatcttcatccagggcccagctgggtcggtgcatctgtgcttaccctcagaccccagggagggcagtctcaggcctcctgctccaaggaacacactcctgtctccttcttcccaggagagcagactggaagagcagcctgcctgccttgccatgttccctgccttcacccacctgctccctgccaggctgggcccaatttgtttatcccccagttctccagccctcggggccaagcctgccagtgtctttccccagggcctgctgggcctgttgtgcatcttgttgaagggcgagtaatagctttgtttccatgcccatactgctccccacaggcctgtttccctgtgggcctgaagccctgttctccatgtagtggcccccacagagatccagagccgcgttgccacctccccactgcctttcttctacttcggtgcaggcctggggttataaatcacaggagtggggccaggacagttcaggacttgtatgccacttcctgaggtggtctgctcagtcttggtggggttgggggtggtattcagctctgatactgagtaagaggcttctgaataccctggctccccccatgtgcagcctcctgattggggcacaggaactcaacctgaatcagcctcttgtgtattacaggcaggggccgagatctcgactgtgaaccctgagcagtactccaaacgcttcaacgagtttatgtccaacatcctgacgtagttctcttctaccttcagccagagccagagagctggatatggggtcggggatcgggagttagggagaagggtgtatttgggctagatgggagggtgggagcagagtcgggtttgggagggctttagcaatgagactgcagcctgtgacaccgaaagagactttagctgaagaggagggggatgtgctgtgtgtgcacctgctcacaggatgtaaccccaccttctgcttacccttgattttttctccccatttgacacccaggttaaaaaggggttccctttttggtaccttgtaaccttttaagataccttggggctagagatgacttcgtgggtttatttgggttttgtttctgaaatttcattgctccaggtttgctatttataatcatatttcatcagcctacccaccctccccatctttgctgagctctcagttcccttcaattaaagagatacccggtagacccagcacaagggtccttccagaaccaagtgctatggatgccagattggagaggtcagacacctcgccctgctgcatttgctcttgtctggattaactttgtaatttatggagtattgtgcacaacttcctccacctttcccttggattcaagtgaaaactgttgcattattcctccatcctgtctggaatacaccaggtcaacaccagagatctcagatcagaatcagagatctcagaggggaataagttcatcctcatgggatggtgaggggcaggaaagcggctgggctcttggacacctggttctcagagaaccctgtgatgatcacccaagccccaggctgtcttagcccctggagttcagaagtcctctctgtaaagcctgcctcccactaggtcaagaggaactagagtacctttggatttatcaggaccctcatgtttaaatggttatttccctttgggaaaacttcagaaactgatgtatcaaatgaggccctgtgccctcgatctatttccttcttccttctgacctcctcccaggcactcttacttctagccgaactcttagctctgggcagatctccaagcgcctggagtgctttttagcagagacacctcgttaagctccgggatgaccttgtaggagatctgtctccctgtgcctggagagttacagccagcaaggtgcccccatcttagagtgtggtgtccaaacgtgaggtggcttcctagttacatgaggatgtgatccaggaaatccagtttggaggcttgatgtgggttttgacctggcctcagccttggggctgtttttccttgttgccccgctctagacttttagcagatctgcagcccacaggcttttttggaaggagtggcttcctgcaggtgttccacctgccttcggagcctgccacccaggccctcagaactgagccacaggctgctctggccaggagagaaacagctctgttgttctgcattgggggaggtacattcctgcatcttctcaccccctcaaccaggaactggggatttgggatgagatatggtcagacttgtagataaccccaaagatgtgaagatcgcttgtgaaaccattttgaatgaatagattggtttcctgtggctccctccaaacctggccaagcccagcttccgaagcaggaaccagcactgtctctgtgcctgactcacagcatataggtcaggaaagaatggagacggcattcttggacttcactggggctgctggattggatgggaaaccttctggaagaggcagatgggggtcaaaccactgccttggccccaggaaggggccataggtaggtctgaacaactgccgcaagaccactacatgacttagggaacttgaaaccaactggctcatggagaaaacaaatttgacttgggaaagggattatgtaggaataatgtttggacttgatttccccacgtcataatgaagaatggaagtttggatctgctcctcgtcaggcgcagcatctctgaagcttggaaagctgtcttccagcagcctccgtggcctcgggttcctaccggcttctctgcatttggtctgctgatcatgttgccataatgtgtatggaaagtgtaacacattcttactggttaaagacgactaccaggtatctaacttgtttaacattgagtttgtgtgtgtgtgtgtatgtttgtgtgttttgtatattgtttacattttgagaggtagcattctgtttcaaatgctttttgtttttctgacagtattgttgactgggtcataacattttgagctgtggtttggtggattttcaatttttttttttaaaggtcattcgctgtgctatcttcaaaaccttgagtttggcccccaatttttggcattcaaatgtttaaaagctatttatcttggtttatacaagtttcctttctcttctttttgtcatggtattctatttggtctgcagtttgaatgtagagaaagtggactgatcccccaagcgttgtctgcccccactctttcctccttgggtcccgccattcttttactgggcagtcgagggcattggaggggaagtgactgccctcagcctcactccctggggccatgaagaaaagctaaacagtctcatggcatctcagaataatgttgggtctcccaagaagaaaggtgtaagaataacgacatggctgattaggcgaggccaggatagggctaaggccaggattcctggctggcatccagtcaccccttctcccatccttccccctcttcttccacaagtccgcagccgagacactgtagtctcccagccacagtgatgagtgccctggagactccactgacctctagatgaaggcccctggccctggttcctgttaattaacctctgggtctttgagtcccccagcacaaacttctttcctgtaccctgcggcttggggtcacagggcatgccgggaagccacagctgaggggcgcagactgaagcagtgctccacctctccttctttagctcaggggttgctggtctgtggcaggcgccacgagtggcccctgtggctgttctcagtggcagtctcttaagttcccaccacaggcagctctttatcccctctccctacttgactctttctcttgcctgtgcttttggcctcaaacaggcctgctggtagcgctcagggcgtgaggctacactcctgccctgcctttcctgtcttcatggtctgccagggcataccttggggaggtggaccaaagacccaggactttttgcagtagccagtcctaccccccagttgtctttttaccaattcagggtgggagagaaaactgcagcaccccagcatgtgagttactcaggtgttgggggctagaagggacagtgcgtttaaacaacactcagagctctggccttaaacctgtggccccccaagtctaggagcctcatctcttcctggcagtcatgcgggcaggaggtcctgaaagggaaaacccattcagacaactgttccccaatctaccagccatctgcaggggtcagtgaccgtggccctctccctcctctagaatgtgccacttatgaagagtgccccatggggaaaaggagactcagctgtcccttggcagcttgtgccagtatcccagggcagaagtttccacaggagcctcttgcccttgcgcagagccactgtgagaggcggtgggagccaacacccttgggggagggggcagtactgctcggcacatcccagcatcaggtcagatcactgaaattaaaaaatgtgaattaagttcatatccaccttttggggaagcaggacaaaccaccaccccaccaagtgtgtgacttctccatatcccactgcagtttccattttttaaatgggaattttcaatcccctgtgcttgtctaacgtctgctttaaaaagtttgagaccctgttactgtttgaaaatgcatgcatgttacgatgaatctccaacctgaggaaaaaaataaaactcaaaaagctttgtgtacatctgtt

SEQ ID NO: 12257 - DNA, 129327 bp, Human
  misc_feature (1)...(129327): n = A,T,C or G
gttcgcctctttaggtaccatattttttaggtgtacaaaatttatacacctgattttaagttcctgggtatcagggttcatacttctcttaattttgtatttccttgcagtcctacttacgggtggcagggctcctcaagggatgggtgtaccaatgacaaccatgaaagtattctaaggtattccctaggactccgagaaaaaacatgcatctttccaaagggaaagaagggattagatgttagcatcctactccatgtcagatccagagcacccgggggaactgaagttcgtggatggaatacaatgacacctcagaaaagaaatactcctttggtggaggcctttaaacttttgggggctcattttgtctgcctaactcgcccagccagggcgcaaaatggccacttaggagcatgagtgaggtgccagcgtccctacaatctaaggagcagggagtcatcactggggtggctgccgctctacctgtttgcgactgtaataaaacaccttctggaggccgagggacccgcttcatcctgacttttcccctcagtagctagagagaaggcggctgaaaagaggagacagaactggtgctgagtgggcctggagcttccgaggcaagggaaagagggagagggctgcagttcaaagtccagacgcgctttccttccattctcttcccttcctccctgccctctgcgccccattttccccttatcgtgggtgggggcttctgatttgctgcggatcccagagatggtggggttcagcctccgcactgcttagctaagttcccagcccagcagtcccagccgggctgttttcggtaaccaaagcactaggaattaacctctctctcggcctcttccctttcggtttccttcttgggttggctggaaacttcacccagacaccgaagcagctctgcccggccttttggcacaggccaccggccgaggccccacggggcgctctccttccccaggtgcccccgactccgatcctgccctcaggggctcgcccgggacgcgttttcccagaggccgccggggcggggtgggctggctggcgggaagagggggccgcggcccaggctcgccccggcgccggcccggtgggcacgcggccagccnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncccagcagctcctccctggcgccgtgcatggagacgcggcccgccacccgccgctgagcccccgccgcccggccgggacccgccagggctggggtggcctcgggctccggccggccccgccgcccgagggctgcgcgcggcccgcgggcctcgccgccccgcgcggatcgtcgcggcccggccgtcccgtcccaggaagtggccgtcctgagcgccatggctcactccccggtgcagtcgggcctgcccggcatgcaggtaggcgggcgcgggccgcggggccgggatgcgcgaccggggcggaagcagcaacttggcggtatccacacggcgtccccctacgctcagccggccggggtcgcgccggagcctggctccccgcgcgcccggctcggccgggggtccgagtccgagtccctgggcgtccctcacggctccggcggccgaggtctccggcgtgtgcgtgcaggagccgtagtaaccgcggcctgggtccggatgtgggggtgcgggcgcctagtcctccgcgctcccctcgccccaacactcttccggagctgcaggccctgggtggccctgtccccgggagaagtgaggtggagtcatgcccttggaggcccccgccgggtcccggggccctgcgtggtggccgggttggcggagggccccaggacgcgtcccccaggctcgtcccccacccccgggcaggcgggcgggagacctgggcagggcggggacggggagcgcgcctggactcgtccgggcccgagcggagtaggcagggtggagtggaggaaggtaaccgcgagttccacttgcagtggctttgcccggagcccccgtgcacctgcggaccgggggaaagtgcgagttgcaaaccttctggaaggaggaatccctcggacagccgcgcaccagggtcccgggcccggccccgggaccctggactttcactttgagacttggttgcatttacaggaattcttcgcccagtaaacctctctttcggtacttggtgacaccttggcctaccagtgactttttggggagtgggagaggagttgaatttcaaatttacatgtataagttaaaggttttttgttgttgttgttttcgttgtcgttgcttttagccctttgaaaaacaaagctaccgtccttggctaactcttgtaaactttgtaggcgcagaaatggtggcaaaatgcttaggatggaaatcttaggatgcagttaggatatgtcatgaaagtttgctctgccagtttagctgagtgaacgttaagtgtttgaagaaaaccaaaagcatccaagtagattactggttgatttacaggtaccaacaggctccttccctgtgtcttgagggctgagaagcacagagcccagacctgggactgcctctggggtctgctcgcctcttccagtgagatcatccctctcccttctttttttgaaaccgtaaaaagaaaactggatttcactgttcaggtttgaattctggaaaaataggaactcaaagttaccactttaatggcagctagaattttagtccaagtgtgtgtgtgtgtatatgtgtgtgtgtgtgtgtgtgtgtatatataagcagtatatatatgtgtgtatatatgtttaagcagtaaataaatatacatttaagcagcaacagttaagttattatcttaagagtgactgggaagatgcttgaagaatattcttttgtcgactctcatttaaggagcgttgaatttagcatgcattcaaaacctaaacttctgctgactgctgggtaacaatcagatgtggtttcttggtattttctaaagccgctttggtatgaatttagaggtgtgtaggtcagagtgaactgggtgaaaaaagtaatttcttaccagtcgagcaagaaaggactcttgtaatgatttaaaaaaaaagttttatcaatatttcctttaggttgatatttataccgtgttcatcaggttggaatctagcacaaatgcctcacttactaggttaattggcctttgtggatagcgaatcagtttgaaaaggtactaaagcccctttggctggtgccgtgaagtcagtatcagatggttaccaggtgatatctagtatctcaccttttcatttttatcctcacttttttttttgagtgggtcagaattcttaaaccttgggaaaagaagatacatttccttaataactttgcctctcaactattatgtatctgttaggttgtgttacatgggaactgtttttattttgttttctcagtatgaaagatcttaagtgtttctcagtggaaaagatgatcagattttcagctgttacagttttacagttttagaggtaggtaagttggcttctgccagtcattcctgtacctaagtacatctacagactgtatggtaacagtgtatcatttggggaagaacattcttttctcctcccccaccccacaaaagaaaaacaacagcacatttattttctacttcaaattagcagttgctactgccctgggaggcttccctaagagttgttgctgaagattcaattaaaaacacacctgctttcgactgttgtctgctaaatgggaggagagaagtccgtatctcttctatggcttgctctgataggcctcatagccctccctttttcttgtctcctgaccagggcttataaggagttggcttagaaagacagcagagtctgtaatctcagcagtttgagaggccgaagtgggcggatcatgaggtcaggagatcgagaccatcctggctaacatggtgaaaccctgtttctactaaaaatccaaaaaattagctgggcgtggtggcacacgcctgtaatcccagctactcgggaggctgaggcaggagaatcacttgaacccgggaggcggaggttgcgttgagctgagattgtgccgttgcaccccagcctgggcgacagaggcagactccgtctcaaaaaaaaaaataaaataaaaaaataaagcagagtgaattcaggtggcctaggcaaggatgcttgaaaaataacaaccatgttagtataaacaccatttttcaatgttttgcaaatcatttttatgcctcttgattcttaccggtaccgtttgagatgtagatgatattataccattttgtagatgtggagaccaaggaagacttaactgaccaaggtgagatcatatattatgtggcaaatttgtgattggaaactactactcctcctactcccactcatcatgcagtgttactgttttatggttacttttgcaaacattaaagtttatctcattgctagttagattggctaaagaaattagaaataggaggctgattttttaatttattcaatcagcaacccttattgaactttcatgtgccaggtcctaggggaggggttgaaagtggtagatctgaatgaggttaccatttaaagtaaatgtttaatgaaagttgctgaagcctttgctttttttctcttaaaccccagttttatatttcagtaggggaaaaaaatagacatcagaaactgaatgaatatagtgacgaataaacataaagaaatcaggctgatctgtggctataagtactccgtctttcattgagcatttgttgtttcactcaattgagattaaaagaaaagcttcagatggaggcaggaacaccaatcggctttgagtttgcagaaatgtgatttaaaaatgagattttggtttgcacatttctgttacaaaattttatcagtcacttttcaacttttctgaaccgtgacccatgtaagaaatatattttacatcaggatcaaaaacaagtttcaggagaccgtactaatccttactacgggttgagtatccctcatccaaaatgcttgggaccacaagtgtttcgaattttggaatatttgcattatatgcttgttgaacatccgaaatcagaagtgctcccaatgagcatttcctttgagtgtcatgttggcgctgaaaagtttcatattttggagcattttggatcagggatgctcagcctgtgcttgtgatgtgctgttgtggtatatttaaaaaaggagctggttgcaacactagattgatttcacagcccactgattcctgacccacagtttgaaaaatactgaattatatacgtcacatgtattgcatattgcagggcctggttaatttaccatgttttgaagttgtaagtttaacatagtttcatatttgaaaatacagataatttagaggaatagcttaaaaacctgaagtttgtcttgttaacatcatcctgtccccctcgttccccttctgtttttcttgctgcttggataaatagacctttgctgagaatgccccttgcatcaggatagtgagactggtgtctaatggccagtctgggaacatggggagcttttctcaagtgctctgctccaccctagggaagcctgtgcactctgggagtctgggaaatgaaggcaaacacaggacagctgcatttaattgtggcttaagtgctcttgtacttttttttcttgttagtgtcacatttccacgggttcttttccgttccttccttgggaggtgcctgcccagttaccctgttaccatctgcaccctgggggaaggttggtgtgtcactgggtgtggacagtcaggacatccgagacgtgggttcggagagcaccttggggacttgctgaactgtggagtgtgctctggtgactgacagcattggactgcacaggggagcctgcagagtatagtgcccggagtcgttggaggcagagttcagagcctcagtccatcctgtcctcaagaggtcggctgcctgctttggggcatgtgctctaagaaggttgcagtgactgaggacacagtgagcaaaggcacatggttggaaagcggtgacacagcttctggtgggctagatctagatcggtcctggagctgaagaggcagtggggtgcctgtgggcctgggggaggccttgcatctgtagacagccggaagtatggcacatttttgagcagatgatctcctgttctttggggctcctgctttctcaggtgtggggagtgctgggtgcccctttagaaggcattgcagcacttcagggaagaggaagcccagggatgcgagtggggagcccaggtgtcagtaggacagcctaagtggatttttttagcattcactcagcttcgtggcttgaactctcagtgaacattttatagtatctcattactcctcttgctttatgatcctttttgctgatcagtgctaaagagtaataagtactcagttactgttagttactgttttgttagttagttgcctatgtaagtgtcaaaaaaacaaaaaacctattttgaatactccgtgttccaaaatgtaacaatggtaagaatttgttttgcttgaaagtgttcttttttgagggggaggatggtcacaaggtttttttaaattagaaaaacccaaacttttggaggagtccagtctcagatctgggagtattcttgatagcatgtcacataaaagcaagtgaccttcaagtaggaattggtcagatgagattttctagcttgctaactgtgctgagcagttatgggcaggtggcggctggcatcattgctttcccaccctctttctgactttgatgctcttcttggagctacggtctgatgcgtagagctgagctgcctaatgtggtgcaggttgagtttcattttcagttcagtatttttccaggaccctggtgcaagatgcagggtgagcagttactgaagggaggagcctgtcgatggtcactgctactttctgctgtgcttgtgcggttacacacactctaaagccgcagtccaggcgtccgatggtctcctgagaaacgggccccttagctctttatttgggcgattactcccgatgattcagagctgcccttgtggaagctccttacctgcaggaagtggaccacacccaagccacctttctgtgccttttaatgccttagctcagctgattatcattaatggaatcttgtgggtggtgtgagtgcaggaaatagaagttgcactctattatccatgtctcatcgcgtagaatcagccactgtcgtcggagtagtttgtagcagtcatttcccataattcatgtttttgcagtggaaattataaaaaatataagtgccaaatgctttgggaaaaataacctgcctcctgagggtgactatggagtttcttaatcctaaatggctccctggtttgcaaggtttaaattaggggaaataaactgagatatgcctttgcttggtacaaactgtgaaacatcccaaattggtggttaccagtcactttatgcgcacccagggaacaacattgttgactctagagaccttccattgtgtttcttgagggttcttcgtcagcaaaagaaaccttttctgttctgcgctctgttggtatctgaatacattgtgggaacatttcaagttttaaattaatgcttaccaagtacgtagctggggtttatcttcctattattttaagtctcttcctgttttttaagagaattttaggccgtaaggtttgaaagaactgttacaggtccacatcctttgttttatttgtaattacttaggattttgtttagtttctatttagaaatgtctaatgggtagttttgtaaggttggttgggaaagatagcagctgcttccacctcccgccatttcttattccccgagggcagcccctttgatctctcctggttgatttttgtttttgttactccttagtttatgaggaacattaaaaaattgaccgggggcggtggctcacgcctgtaatcccagcacgttgggaggctgaggcaggtggatcacttgaagtcaggagttcaagaccagcctggccaacatggtgaaactctgtctctactaaaaatacaaaaaaaacagctgggcgtggtggtgggcgcatgtattcccagctacttgggaggctgaggcaggagaattctttgaacctgggaggcggaggttgcagtgagctgagatggtgccactgcactccagcctaggtgacagagtgaaactccatctcaaaaaaaaaaaaaaaaatttctgcctgtgtttttttttttttcctggtttcaggcattgtctatagactttggaccctgcggatgaggatttacttctcttccgcttgcctcttttcctcacatgggctccccgctctcccccagcagagagatgttgtaatgtcagtgaggtcagaatgcggtgtgtacattaatggactgcagacggatctgcagcccagccattattactcaaccatagttactgatcagatttcttttcttttggtaatgcttctcattcatcccagcactctgtagttgttgcaaccttgtcttaggaagttcgggtggcacctgtgcctttcgtcacctgcgtatcttctatgcttcttgtgccacccccatcctctggtcttcctttgctctcatcctctgggttccttctgctgctctcttgtgttgaatatctgttttgtttttttttgtttttttttttttgtctctgctgtcattttctttcttggtttatgccatgatgttggttgggcatatagtgcgccattttctgtgaataggcagcgtgggagacaggcttttcaaaaattttttttcttctccctcagttgatattttagcatggtgtaaaattgcagggtggacattcatttcctccagaattttaaaggtgtttctccactgtgttttagcttccagtgttgctgttgaagatggaggccctgccagcaccggcttctgtgtgtgcaggctgtgctgttcttcctggacctaatgggatctgaactttttccttgagttctgaagtttcacaatgatgtggcttggagtggggctgttttcgtttctcgtgacagatacttggttaggccttttctgtgaagcgactcagatcttttcattgacttttttctttgattcccctccccccttccattttctgtgttctttctttctgaaactttattacttggatggtgaaccttctgcatcggccctcaaatattcttttatcttttttgtttttcgagatggagtctcgctctgtcacccaggctggagtgcaatggcgtgatcttcattcactgcaacatctgcccccccaggttccagtgattctcctgcctcagcctcccgagtagctgggattacaggcgcccaccaccatgcccggctaatttttgtattttttagtagagatgaggtttcaccatgtggagcaggcaggtctcgaactcctgacctcaggtgatccacatgcctcggcctcccaaagtggtgggattacaggtgtgagccaccatccccggccttcattccccatttttaagtatgctgcctctgcttccggctgtgtctgctgcagcctggtccatatatcctcaatttttccttcctttgcagataatatattttcatcatttccttgactttgggagcctggctgtgagatgtggggcaagctgtctggctgtctacccacttctgtggctgactttgaggctctgcctggttcactcattcccccggcagagggactggtgccgtcagttcctgagagctgggggtccagcactgtgagttaagttagttctctgctggcccggcgcgatggctcatgcctgtaatctcagcactttgggaggccgaagcgggtggatcatttgaggtcaggatttcgagaccagcctgaccaacatggtgaaaccccttctctaccaaaaacacaaaaattagccaggcgtgatgatacacgcctgtaatcccagctacttggcaggctgaggcagaattgcttgaacccaggagacggaagttgcagggagccgagatcgcgccattgcactccagcctgggcgacagagcgagactgtgcctccaaaaaaaaaaaaagttctctgttttctgcacctccggtttagcgttgtcttcctctactccccaccccccccctttttttttttaaaccactacctactttccagcttctgagatttcattgcagttgtcttctctctgtttcaggtatgtggtggtttttagatttatgattttagtgggatttcaggattgacccaattagatgctgctgtctgtgtgacccctctacctccaagttgctattcttcagtttataggtgaataaagacagggccaggcaggtgaggaaattccaagagctaggactgactgctgggccagggcggcgggcaagaactcggagcctccgttctcttcatcatgagattgtgcctcttattttctccctgtaaataaacagcagtatacatgtctgcttatttttccatctctctactggtcggtggcctccacctccccaacttgaactgagaacctgctcttcttgcttctctcatttttttggtcccaagatcctgtggacacagaacgatgtccgggagcctcataggatctctctggagaaacgcttgcttaagtttatgatgctttggggttccaaccccctggtccagaattgagtatgtgcttcttggcagggcggaggtggcatcagtctggtcgtatgttccgtggtggtcggtgcaggactggggcacacgtgtgccacagatgccgaatagcccgtcagagggcctgggtgttatgtggctgtcccagtggccatgtgttagcagattgcatgttgcagagtcagtggtgtctgcgcgctgggggcactgcacagcgctggccataaatccatagcatgttaatggatggaggacttgaagggtgcgtatctaaacagcgaaagctcttctttggggtatggccttcaagtgatttcttgcttaaggacagagtactttcttgggtagaattttacagcaacgaaccattgagtagaaatgaaaaacagtctggaacttgggactgagccttagcccgcagttattttaggtatagtttcgtcgaactttggaagcgtgttcaatgtggtgacttcaaagttattaaactgccacttgaactccagatgaagaaaggtattgcttgaggagcgttcctgtggtatgtgtgatggatgcagtttcctggtaccaaatatttcttgagaggtaattcacacagaaaaagctggtagcacaaagcctcacttcttcagcagttctgcagcagagctttcttctcccacctgcttccctgttgcttgctgtgggtaggtggaaggactgagcctgtggcatggctggatttatgtcagtctagaaaataaacatctttggaatttgttgcccttcatgggaagccttgtcggaaggggactgctttgattgagttttcttcagtgagggccaggcctcttggtgaaccctcagggtctctgctgagggaatggctgtcagactaattttacagatgagaaaaccgaggcttatgaaacctgcccaaggcctcggctagaaaacagcatcactggggcggaagccctgactgggaggccagcatgtgtgttcttttccttcctcccgactgcctgctccctggcgtgtcagattccctgcaccacatccccaacacagctctgccctcctgaccgtcacattgtccctccagcctccatgaaacagctgagttcagggctgtgaacagagggtgttttgggcgtttttatttccttgtttttaacctttaaagaagagtgtgttcatgtttcattgttattcattttttttgaggaaaagaaaaatctccatttcattgagggcaggtccttcccccatagcctggcgtgcttctggctggcagcgtgcctggcacagcaaggtgggcagctggcggtgtgggtccttgtggtcctgtgccggaggggctgggccttcttggtggcggttgtctgcgtgagaggaggtagctgaccttggctgccacccccatgcctaccgcctggtgctggagcagagggagccctgggccttcagcccaccgggctggcactgcgctgtctgtgcactcctcctgatcgggaaacttgttcctggattatttttaactggcttcctggaatttaggattgtgggtgtggggggcggtgacttggactttcagatgttttccttgttcctttatctccattctctgtagtgagctctgagccccacctccttagggtgggcatggagctgctgactggctcctgttcattgcctttcaggtgttgcccagactgtgttgttttggatggtgaagaaataactgaaaaagtaccctctaatcgaatataattttttttttttttttttgagatggagtctcattctcgtgcccagactggagtgcaatggcacgatctcggctcactgcaacctctgcctcccgggttcaagcaattctcctgcctcagcctcccaagtagctgggattacaggcacccgcgaccacaccaggctaatttttgtatttttagtagagacaaggttttgtttgccctgttggccaggctggtctcaagctcctgacctcaagtgatcctctcgccttcgccttccagagtgctggggttacaggtgtgagccaccgcgcccagccctctaatagaatataaggccactcagtgtcacctggaggggttggtaaaatgcagactacaggctctgccctgctgccctggagtttctgattctgggcgtctcggagggagtttgtgttctgagcaagtgtcctggtgtattgccgcctcgaggatgacactttgagaaccactgcgctggagaatcaaaaaagaatcctgaatcctcattgctccccactctagtgaagcacacagtagccttgcccatttgaaaagcagagcaagctacaatcagtgcttgcagcctatggcttgtatttccaaagactgactttggaaccgctgacctaactttgggaattgaataggcctgtaattataagactcattagagcctttgcgattttagcatgtatttataaacctgttgggggcagaggatgtgtgttccatgtctttttgaccttggaaccttatttttatttttagaaatgggaatctcgctatgttgccaaggctggacttgaactcttggcctcaagcagtcctcctgcttctgcctcttaagtagctgagattacaggcttatgctactgcgtgccacttggaaccttatttcataaggagtgcatctctcaagatctagggtgcagtagtctttttggaaaaccccgaactagaacaaatgctctgaacctgataattctcaaatttgtcaggataacttttcttaactgtggtattgcctgctgctcctgacttcctgatcagatgtagacgccagcctaaaactcagggccttttttagtacccagcttcctcctctctgctcttcagctcctctgccctgggtgggctcagctccctgtgctcctccaaagctcagtgcctgttcctgggcctttgaacctacccctccccatgctcagccactgcaggattctcagactcagtaccgcttgccttcctctgcctagggagccctcgtaaggggaagcccccgagcaagctctgtatcatctgtccagctcctcttagctccaggtgctgggatgccgcaggggagagaagggcatacccgccggtgtttttcccactgatgaaatgaccgtctttggttagaattgattttcttttctcggtagctgttgtatttaacacttaactaaatgtaatactatacatatatttcagaatgggaaaaagtatttcatatcagtagagttttcaatgtttgggatgttggcttttatgtatagttgatttgacttttgattcagaagtgatctctatttctctgttatctctcccccccatttattttaataatgtcgtctgttattagggtgtactggatttagttacactttgattttaccaggctttcttatttgagggttttggggttgttggctttgcttttggttttaagtgcattgtagtttttctgaggcttgttacaattcattacatgaggaattggaaacttttttttttttttttgagacggagtctcgctccttcacccaggctggagtgcagtggcgcgatctcagctcactacaagctccgcctcccaggttcatgccattctcctgcctcagcctcccgagtagctgggactataggcacccgccaccacgcccggctaattttttttttatttttagtagagatggggtttcaccatgttagccaggatggtctcgatctcctgacctcgtgatccgcccacctcagcctcccaaaatgttgggattacaggcgtgagccaccacgcccagcctggaaatgtgttttatacggcattttaaaatacaagggtaaacagcacattatacagacttaggggattgaccacatcaggaagaggagttacagagatttgcgctcttttttccctttgttatcgaagaatctgaagtctttctaaaacaacttgtgtcattcagaatgccttcccctgctttgtcttctgcaagaaaagacgagcttctgtgaagtgaaactacttgcatttcctggcctcggtcccccaactgcctgtgtttatctctgaagaataaaggcagaggatgcgattgaagtgtgccatctaatagcatcggtattctgggtacacactcccaaaattgacctggggccatcggtgctagccttggatgttgtgggatgggatttcatttccctggaggcataaagtgatcacatagtttaaacaacttcagttgaaaactagttctccaagtggcatccctggttccttcctctgggatgcattactgtgtatgttgtggagcaaatcgtttcttgggaggcctgagaaggcttgagaagcttcccaacccccaaatatacagacgtttctgtgcatgcaggtacgttcatataaaatatgttattttctatttttaattttttttacctttttttttttttttttttaagagagggagtctcactctgttgcccagactggagtgtagtggtgtgatcttggctcactgcaacttctgcctcctgggttcatgtggttctcctgcctcagcctcccgagtagctgggactgcaggcgcccgccaccacgtccggctaatttttttgtatttttagtagagacggggtttcaccgcgctagccaggatggtctggatctcttgacctcgtgatctgcccaccttggcctcccaaagtgctgggactacaggcgtgagccactgcacccagcctggaacccttttaaagtgataaacacctcagtactttttacatggcctgttgcatagatgatttcttaatattagctatagcaatcaaatgagagtgtttttgaaattccccgaaaataattcttcttgagtttgtcattttatgtcagagtagtagtaattccgttcctttctgctggaggacttgtgatagtaagggcctttggaaaccagcagaacagccagttgcttatcggctgtggtgtgcgagtcccgtttcctaccctggccccgttatgcgtacatggtctataaaagaatcatgtgaagtggggggttgaggattgtacagaaatgggaaccttcacccagaaaaatatcttcactccatctccgttaaagtatttttaaagcaaaagcatctagaatcccagtacttgagtatgtagttcttcctattttatttgccagttgtctgcgtacacacatttccttaagtaattgcagtcataatgtaggtacacgttgatattgttcctcattcagcattgtgtcataaatatcatcccacatttccatatggttttcatgatgattgttttactgtcttaactgacttctgtgcctcctttaatacaaggcgtgtcacatcttttttttttttttttttttttttgagacggagtctcactctgttgacccaggctggagtgcaatggtgggatctcggctcactgcaacctccacctcccgggttcaagcgattcccatgcctcagcctctggagcagctgggattacaggcacgtgccaccacacctagctaatttttgtatttttagtagagatggggtttcagcatgttggccgggctggttggtcctgaactcttgacctcaggtgatctgcctgcctcccccaaagtgctaggattagtggcaagagccactgcacccgaccagccctgccccatctttaggacagaggagtaccagccagagatacatacttgtttggctctggccaaacaagttagaaagaataaccttgctgctttctttctttctttctttttgagacagtctcactctgttgccctagctggagtacagtgacgtgatcttcgctcattgcaacctctgcctcccggcttcaagtgattctcgcgcctcagcctccccagtagctaggattacaggtgtgtgcctcacgaccggctaatgcttgtatttttggtagagagggagtttcaccgtgttggccaggctggtcttgaactcctgacctcaagtgatctgcctgcctcagcctcccaaagtgttgggattacaggcatgagccaccgtgcccgacctccttgctgctttcttttgcctttggagaaagaaaaaatgactctcctcctctcatccctggcagtgctgttggaaagcagtgtgttatttaatgagttttatgtagttaattgctttgcctaggttgctaagtgagaatacccacacggtggtgttacacttacactcctgctgggcaccttaccccttgcccagttgtattcgaaacaaggatcactgcctgcagactggggtccacacatatactccttgagagtgtgagcattcactcaagacagcagaaccactgtcctggctgtgtctaggctctggctaactttgaagtggctgtgggagcctgaggaggacaaacagttagaattctgcctgactgaattatggttttttttttttttcttttttttgagacggagtcttgccctgtctcccaggctggagtgcagtggagtggagtgcagtggcgtgatctcggctcactgcaacctctgtctcctgggttcaagcagttttcgtgcctcagcctcctgagtggctgggactacaggcatgtgccaccatgcccacctaatttttttgtatttttactagagacggggtttcaccatgttggttaggctggtctcgaactcctgacctcaaatgatccacccacgtcggctttccaaagtgctgggattacaggtgtgagccaccgcgcctggccagaattatgtttttgattgtcttttagatgaatcttttataaatatatggtaaatagtctggtttaaaatagctcttatatcttgtgtttcttttcagcctgttgatttagttaaaagtctcagatgagaaggagatttgcaggataagtgccaatattatgacttaaaattactgctctgaatgaacattcaccccaaaataggaccagtctgcttttcagcataatcatactgtatgcattttgagtggcagggcagtagtcattgaaataatacattccttgtataaagttttcatcccgtacaaggtgcataagtgggtcaggggcaatattgagccatagcgttgagcagcgttgagtggatgcttggctgtgcccagtgacccacgaggactggagcgtcgaggggaggtgtctgcctgttggcactgagactgtgagtagctgcacatcatttcagggtttgctgtcaaccggcttcagatcagtttagatctcacctccagaggagttggaaaaactgctggttttcggagacttttggattttgaaagtttggataagggacctggacctttactactacacttctattattactgtttttttaagagatgggagttcactatgttgcccagtctggacttgaactcctgggtcaagtgatctctcctgcctcagcctcgagtggctgcaaaagcagggactacaggtgcatgccacagtgcctggcttttttttttttcctttcagtgatatgagatatgagaagttagtgctcctgaattttgctggaactcatttgctttttctctttgttcagattttcaaatttttgttttggtatgattggttgtctttagtgatttaacttttgtgagaaatggaaactatttggatagaagtacactttaagaaaaagagggagtgttgtcaggctttgttgtaaagatctttgctattttacgaaaaatggtacgtaagtgtagactttgtggccatttaatcgcatgacaaaaactaggaagggattgtatgagtccattttcatactgctatgaagaaatacccgagactgggtatttataaagaaaaagatttaatggactcatagttccacatggttggggaggcctcacagtcatggcggaaggcaaaagaagagcaaagtcacgtctcacatgtcggcaggcaagagagcgtgtgcaggggaactgccctttataaaaccatcagatcttgtgagacttagtgtcatgcgaagaggatgggaaaaaccctcctgtgattcggttacctcccactgggtccctcccacaatgcatagggattatgggagctacaattcaggatgaggtttgggtggggacacagccaaaccatatcagggatatattaatacacttttttctttttttttgagacggagttcgctcttgttgcccaggctggagtgcaatggtgcaacctccacctcctgagttcaagagattgttctgccctcagcctcctgaatagctgggattacaggcatgtgcctccatgcctggctaattttggattttttttttttttttttttttttttttttagtagagacagggtttctccacgttggtcaggctggtctcgaacccccaacctcaggtgatccgcctgcctcagcctcctaaagtgctgggattacaggcgtgagccaccgtgcccagcctagggatatattaatatttttattgtaatttacttctgtggtcaccattgtttgatgcaaaaagaagcacagtttttcaattgtaagaaataaagtttaaaatatgtggactgttcccaaatacattcccgatttcacttgtaactttgttggttagtcgcctgcatattttcgtatagaaaggagtttggaaatagcagttaagttgtgaggctaggctagaaaagccttttactccaaagtctatgtaaactataatcttaagagttaagttcctggttctgaaggcaggaagctagttggcataagagagttggaggaggaggaggagttttctttatgtttctgggtgcaggtttctgagttagtttaggttggtctttggggctgtgccaggcctggctgtgccctgcagtacccccttctccattgtagtgccctcctggtgttgtaccgctctggtgtttactgcattcctctttgctgcaccccctctagtgggttcagtagttcccatgaaaacaggattcctcctgtcaaaattgctcagctggatgctgggaaagtattcctaatagttcataaaaccggtaggccttcttaattatgggaagaaagatgtgtgttgatctgaatagatatctaataggtggtatatcagccaatgtgtaaggcataggagatggtgtttagagttgaagagggatctgtcatacgtctggtgcagtgctggcattgggattagatgactaacagctccgtcttcaaggagcttatggcccagtagcagaggcacatgtgtcgcatacatttcaatgggaaaaaatgcatttatggaagtataaggctcagaagtagcgcagaggagggggtaattaagtatctagacctagccggctgaagattaataaaggaaacaatggctgagctctgttctagaagaatttcttttaaaggcagagggcatccagacagattagaatgttcaaaagcatggtgtctttaaatggcacagagtgtttggaaaaatacaaggaatccaattctgccggacttaaggggaaaggaaagagaacaagacacatatgttgaagaaggtagtccaggaccagatcatatcaggtcctaaaataagtgctcccagactaccttgtcattatcacccatgggaccatgctgagtggtttgggctttagcctattaggtgatgtgacatttctgggaaatttgaattggcagaatgagacccattttgggcgttgacagtttggtggttagactggaaaggaaggaggctggtcccccagctaggtctcattgcggtttcccaggtaaaagctgatgccagatcgaactgtgccaccagtgggtggggaggaggagggatttgagggagggagctgtgggggtgagcggggcaggcttcagtgatgatggtgatggagggagggaggtgccctggggcgaatgaacgcacccacgcacccaagtccttggggctgatgactagcatggaagatgaagatcctatgtagataaggaattctgtttcagatgagtggattgtgggcagaggaaatgaacaggcagttagaaatatgggtctggagctggtggaagagttcaggctagagactgagtctggtgactgattaattaggtcatttgtgctagcaacatgggacggctgttatcactatacagagggtgattgaagagggagtagcccgtgtttcagatcccagacttcatcacacttggctactccacctagctttacctgctaggcaaagcaggttctgctctgaatgtgagccccagagtgtccacacggcagcagcattggctcaggtggatggatggggtgcgaggtgctgtgggtggctgatcaccagtgggaacagtgtgtcagctggtcgtaagtcaagagtagcttgtaatttcttagacgacaggagttccttttaacaaatttattagacaaatcatgtgtctgagctccacatacctaatatatacatcattttgaccctgcatctcttgtccagtttagtggtggtcacttccgaagtgggtcctaaagtagttttccagtgagttgcatagcagaatttaaggctgtttaaacagcctcagtcttggttgcacctgcaaaaatcgggtagaagcctctaggtgagttaaacccagcagactttcattttaacccaggtgggtgattctgggcttccagtggtgctgcttttaccatccctggtttgatgtggcccagggtggctggcatgaccctggctggtgttgttactcaccattggggcacatactcattgtgttacagtgatttttttgttgttgttgtttttcagttgtaggcaaaagaacaacaacctcaactagtttaagcaaaaagaagaaggggagattcatctgctcacagcactgaaagggctgcagtgggcttgacttccagtacagtggaacgtgagggcttacttcttaggcaggtgtgccccagccgatgataaaggcggctgcccgcagcacccagccttaatgatgtgatcctgggggacaaagagcacctctttttcagtagctctagcacaagttcttaggcaatgctgagcgtcctagcatagtccttaaccctggactgatccctgtggcaagaggagtggggctctggccaatccatgccccctgccagccctgttggggaatccaggccatgcgactgacaattccccggggaaggaggagaagtcaggaaagatagagttcttcctgaagtgggtcctgagtatgggaccgaatttcttatccgggcatttcgtcaggtatatgctgataaaagaccttatctagagaaaggaagacatttacataagacagggaggctggtagcccgcacggtggctcacgcgtgtaatcccagcactttgagaggccgaggcgggtggatcacaaggtcaggagattgagaccatcctggctaacatggtgaaaccccatctttactaaaaatacaaaaaaaattaaccgggcgtggtggcgggcacctgtagtcccagctactcgggaggctgaggcaggagaatggcgtgaacccaggaggcggagcttgcagtgagcggagattgcgccactgcactccagtctgggtgactgagcaagactccatctcaaaaaaaaaaaaaaaaagacagggaggctgatatgtgtaggacgtttttaattggttaaaaccaatcaggagttttctgttgagagtgaggtttttatttatttatatattttttttattgagacggagtctcactctgtcgcccaggctggagtgcagtggtgcgatctcggctcactgcaagctccgcctcccgggttcatgccgttctgctgcctcagcctcccgagtagctgggactacaggcgcccgccaccatgcctggctaattttttgtttttagtagagatggggtttcaccgtattagccaggatggtctcagtctcctgacctcgtgatctgcctgcctcggcctcccaaagagctgggattacaggcgtgagccactgtgcctggccgagagtgagtttaaacatggttatccaacaatagggttgtgtgtgctgcctggaaggcagggcatattgtgccagttatacatgaggggaaaagggatggcatgagctcagcgttcactctgtaaagagcaggtcatgattatagtcagctatgatggtggctaggttataagatacacactagaccaatcaagtgtaataagaaaagataaaagcagtgttaggatattttgggtgatcatgttcttaaactattttttctttcttttttttttttttttttttgagttggagtctcgctctgcctcccaggctggagtgcagtagcactatctcagctcactgcaacctccatctccctggttcaagtgattctcgtgcctcagcctcctgagtagctgagattacaggtgtgtgccaccatgcctggctaatttttgcatttttagtacagactgggtttcaccatgttggtcaagctagtctcgaactcctgacctcaggtgatctgcctgccttggcctcccaaagtgctgggattataggtgtgagccaccgcgcctggcctaacaattttctttaatatttgaatgacttaagcattctaaaaatgccaggtttttagtttgttttttatttttgtagaggtggagtcttaccttgctcaggctggtcttcaccttttggcctcaagcaatcttcccaccttggctcccagagtgctcagataacaaggatgagccactggcagctggcctaaaatgccaggtttaatggggaaagggattttggagttttatctaggtgatttgcttttagttgatttaatctgtgagaggtgcagtgttttagataacctggaggtctggaatgaccatgagtacaacttggcaggttacattggagcgcctgtgttgttgctgttttagtcagaggtaattttagtaattaaagtgaaatgtcctgttttaaaggaagttctgttctgtaaagagcagtaggtattaaatgtctttgggaagtatggactctttggggggtttcctggaataatgaggacgtttgttgttattttttcacagccttgtatttcagtttttttctttaaagggagtaagttgcatatggggggcttaaatgctttattgacaagaaaaaaaactgcaccaggaccaattcatcatcatcatcagcttcctcccccttctttccttcctttttttttttttttgagactgagtcttgctccatcgcccatcacccaggctggagtgcagtggcgtgatctcggctcactgcagcctccacctcctgggttcaagcagttctcctgcctcagcctctggagtagctgagataacaggcacctgccaccacacctggctaatttttgtatttttagtagaggtgaggttttaccatgttggccaggttggtctcgaattcctgacctcagacgatccccccactttggcctcctaaagtgctgggattacaggtgtgagccactgcgccaagcctcctgttcctcctttttcttgctttttttcagcctgagcaactctctttgtacttcatcgggcattccttcagcccagcctgcagcaggatccttctcatgctgcgcctccttttcctaggctactgggcatctgcagcagtgttgtctctcccatccctcccagtctctgtgcagcatcacccacggataggccgggatgttttctttgaattttgggtgatgctcagaacagaactggaaaaaggccaaaggaggcctcttgggtgcctggaatccttgagctactttttcgttccttggtggagggatgtaggtttcatttctcttcctgacaggcctggcccgccttgtctgcgtcttcacctttcctttctctttggcggatgtggccttccacctctgccagcacctctgagaaaactcggaggagctcccgaagcctctgggcactgctgcttgtgctccccaccggcaggtttgcacactaacgcatgtgatgacattggcccctcggcttctggggacctccttcaccctttcctcagcaaggcccagagttgctgagtgcccgtccggctctcacgcaccccacagggactctggagcttagcctaccgtggtggctgtcattattttttaaataaatttttttttagagcagttttggagcacaacaaaattgagtgtaaggtgcagagatttcccatccccttggctcccacacccacggggtctcccctggtgtcagcatcctgtgccagagtggtacgtttgtcacagctgatgagcctgcgttgacatgttgtcatcacctgaatccatcgctgacggtggagctcactcttggtggtgtatgttcagtgggttttgacaaacgtatagtgacatgcatccaccactggagcgtcctacaggatagttccactgcctggaaatcagtgagggtatcctgaaaacgtgtccttttggccctactcaagtggttttctgcagatgccatcttccccttgttggcgtcttcggtttctgactagaccgaaggcagtttctctggagtggcagatcctgggtccccgtggctggtctgccactcagaaagctgcctgcccttggggttctcaaggcgccctcggtagccaccctggacctccacaaggtcagattctaatgggcagttctcatagctctttttggtgctctgctccccaattcacttcgaggccaggtttaaaagctgagtgcatgtccttctctaaggaggacctcctgctttgttttctctgcctcaaatttcccttagtcttttcccagctgggttgagtggaagaagacctccgccggcttagctgcagatggtttgcctctctgctgtcccgtagccacttgtgtccccagctggcctgtccccaccttgctgaccacaccttctcccatgtttctgatcaatttggtacccagcgtccagggtctgcgtcccttcccatcatccttgttcctgtgggtggtcgttgtagggaggggaaaataccccatagtgcctctccctactgatgtaaagattccttttaataaaaatcaagctattataaagtttaatttattcaaaatatagaatcaatacatgactaattgtttaaaaattagacaatacagaagcatgattttattccccaggggtaactaatgtggagaggaaggattctgtggttcccttaactgcaaaggattgttcactatcgtacatttagagctgaagagaaggcttgcgaaggccatttgacttttttttccttccttatcgcagcaggtccatcagcaatgtcacgaacctctaaccaagacccctcaagcaatccaatttctgcagcacttaagtgcttttcatactcctgatgagacatgatgctcatttctcaacaaagatttattgaatgtctgctatgtttaatgcaccatggtggagcctggggaagatgcctacgccatacctgctgtccttaatgaactcacaggccagcttcgggcagacattccagcaagcattggagtccaggctaatagtaaccagagagaggtacaaactgggtgaaagaaaggaacccttcctggaggagtcagcatttgagcagttcctgaaggtgctggtgggtagagggcattccaggcaggtgggtctcttcacagagtggactgcagtttgggttgcctgacaaagatgagaagggttaggtttttccttcctccctcctgcatgaaataatgggaaagaagccgtgatagaaagatttagtttggagtaggataaaggtgctaagaaaaaaaaaaaaagagaaagtatgacgggggttccaagtctccttaatggattagataactcagaatagccttgaagaaggcttggtggcctcgtagcttatttctgattttgcttgagggacagaaaacaaggagaaatgggaaacgtagataagtcttgatttttttttttttttgagacagagtctcactctgtcgcccaggctagagtgcagtggcaagatctcggctcactgcaagctccgcctcccgggttcacgccattctcctgcctcagcctcccgagtagctgggactacaggcgcccgccaccatgcccggctaattttttgtatttttagtaaagacggggtttcaccatgttagccaggatggtctcgatctcctgaccttgtgatccacccacctcggcctcccaaagtgctgggattacaggcgtgagccaccacgcccggccaagtgttgatttttataggctggtcacaatatatatgcatgtatttttttttttaagttgaacttaatcttcaacttaattcagaagttgattaaggaacttaattcagaaattgattcagaaggttttctttttgcttttattgttaaagcattgaattgaaaacactggaagcagtaagctgtataaatgatttcattttattttgcatacttagaattgggcatctggaactaaacaagagagtttatgcaaaattacatgcaaatgagtatttttttacctttgagcccagagctttaggcttctaccctgctgggaaaaggatgctgtgtccctgagctttcatgggaccaccagtataagtattagaaaggacaactggacttgagtgataaatactgatggtttgtctttagagagagaagacaaaactacaagaaagaggccattcctttttgttgttgttgtttttggagagagggtctcgcttcctcacccaggctggagtgcagtggtgtgatcatggctcactgtagcctctacctcccaggcgcaggcgatcctcctgcctcaccttcgaagtagcagggactacaggtgtgcaccaccatgcccaactattttttgtagggacaggttccccctatgttgctcaggctggtctcaaactcctgggctcacgcgatcttccccccttgacctcccaaagtgctgggattatgggcatgagccactgtgcttggcctgttcctatgtaaaatgaaaaagaagaaacaagaaagcttttactgcttctagagaattccctcagttgtaaatgactaacagtgttaatgacgtttcatgaactaggatgaaaatctttgtggagtattgaattgagtcatcaaagggaagcctgcagtgttacaaccctagccactataaataaagtgtattaatgagctagtagtatgctgcagacgacccacctgtggaagtgagattcttgtggaaaagtcaagatcattgaagagatgtgagaccacctaactgtgaggttacaccaggcatagtcaggaggcaaggaaataggtagctactgtggtctgaatgcttatggctctccacagtcatgttgtgaatcttagtgcaattgtgtttcgaggtggggcctttaggaggtgattaggtgattagctgatgagggttctgccttcatgaatggaattagtgcctgtctcaggctgttcttctgttgctataaagcaatttataaaggaaagaggtttagttggcttatggttctgcaggctgtacaggaagcatggtacaggcttctctttggctgctggggaggcctcagggagctttgactcatggccgaaggtgaagtgggaacaggcagtcacatggcgagagtgggagcagtggagagagatggaaggtgccacacacttttaaacaaccagatcttgctggaactcactattatgaggacagcaccaagccgcgagggatccacccccatgatccaaacacctcccagcaggccccacctccaacactggggattgcatttcatcatgcagtttgaaggggacctccaaccatatcagtgccctcacaaaagaggtccgagggagcttctttgtcccttctgctatgtgaggacagagctaggaggtgccatccatgaggaatggcactcagtacacaccgaatctgccagtgccttgaccttggacttcccaacctccagaactgtaagcaatgaatcgatgttgtttataaaagttgcacagtctgagctgactaagacagaagtatttaggctaatggaggaagttgcacaagcattgttggtggttagctgcatatgtttcagatggtcagaagaaaaaaattctcttcactgaaattgtgtttcacagcatgtgttatctacatggtctcaggatagtgtctccattggggcttgtattagcaacagcctaattgcaggaggcctcatgaccattgtcctaccccggggcactgatcggggtcttctctatttgttattactaaagggcataccttgggagagccacatgtgtattgaaggtcatatggtagatctagtcatttactctatttttttttttttttttttttttttgagacagagtctcactctgtcgcctgggctggagtgcagtggtatgatcttgggtcactgcaacctccacctctcaagttcaagtgattctcctgcctcagcctcccgagtagctgggattacaggtgcctgccaccatgcctggctaatttttgtaattttagtagagacaaagtttcgccatgttggccagggtggtctcgaactcctgacctcaggtaatccacccacctcagcctcccacagtgctgggattacaggtgtgagccaccgtgcccagccatttgttctattttcatgtagaaagatgtgacacgagggagaataatagtgaagtgtacgcatcatcagctgtgtgatttgagggtaaacccttgagatgagacagtttcttgtcacttgatgatttattttcctatctcagcctttagttggaatttactgggtgtgcctgtcacttgtgattcagctgcttctttatgtagcattggcagttgtggcttagaaaggacaacacagctgaggctgcaggtcacaccataatgggaacaggggagcacttactatgtccagttttaaaaaaaactttgtttttgccccaggaaaataaaaaattgtcttattttagccccaggagaataagaaaacatcttatttttagccccaggaactataatatgtatgcatttttctgtattttttacaggtgagtaaactaaggcctagagaggcaaataacttgtaagaggtggaggtggatttgaagccacatgcacctggccgtagactccacgttcttctcttcatgtggtgtcagctcctccagtagatttgctgctggagcgggaagttagagtctctctgagttcttaagggagagaggggagggcttggtggcccagctgcataaatagcctcatctaccatgagggtttagcagtagtttgctctgtgtggataagaactacagtgtgggatcagtttactggagatgagaaggtgaatgaggctgtgatattgaagtataggaaaggtgcttgcacatcatgtattttctcagtttgctcctttggtcacaaagagttggtaataaggcgaagtttactaaattgatggctgaatacaactgggagccttgcagagaaaaccatttcacagctattgattttactcctaatcttgcctccccagcccatggcgtgtcattacaggaatcctggacaagaggtgtctcagtacaaatactggaaaaccagctgactgcaaacaacctattgactttttatcatagttgatcattaattttgttttaaagaaatagggtctcattctgtcgcttaggctggagtgcagcgatgtggtaatggctaactatagcctcgaactggtgggctcaagcagtcctcacgccacagcctcccgagtagctgggactataggcgtgtgccaccgtgcccggctcattgtttaaatttttggtggagatggggtctcattatgtttcccagactggtctctaactcctggcctcaaacgattctcccaccttggcctcccaaagtgcttaggttgacaggtgtgagccactgggcctggccacaattttaatataaattttaacataaaagttaccccttaaaacaattagatagctgggcgcggtggctcacgcctgtaatcccagcactttgggaggccgaggcgggtggatcacgaggtcaggagatcgagaccatcctggctaacatggtgaaaccctgtctctactaaaaatacaaaaaaattagctgagtgtggtggcacatgcctgtaatcccagctactcgggaggctgaggcaggagaattgcttgaacctgggaagcggaggttgcggtgagccgagatggtgccattgcactccatcctgggcaacaagagtgaaactccatctcaaaaacaaacaaacaaacaaaaaaaaacaacaattagatatggaaggaagggggaacacagatgttcagggcctcagagattcaggtgtgagtaactggagtccacatgacaaacacaaggagttcatgtgttctggcctttttttagttgagaaagtcaattttcttggctcttcctgagcctgttgcttggttcttgacatctcattggaaactgaaaatgggaatttgactttccgtgataggggctgccccacctgcgtttgtagggttgaagctcaggcctgttgtgggcgatgtttggaggataagctggcctgcttatctctgggttggttgactgcgagaccaggtggaaggacacgcagcccatctggtggtgagtgaggccacttgtggccaggggactgaaggaagtccctgttcaccatattcttggcaaaatctggtctccttctggcatagattcagcttttgacaggtctggggatttcattttttttttaaagcaaaattataaaaaaggcttttaaagtgatttactcgtgtgtgtttttgtaagagttggtagatagaaggcttttgaaagtaagggctttctcagatggaccaggccatttgagatctgcctgaactgctcaccagatcatctgggatagcactgcctttgggataaggtgccatgctgtgtgctagtggccctttcacagctgtctcttgtgaacaggggttgggggacagtgggggtggcactaggcatcaggtggaccccagcaccctgcccagcctttgccgcagcggtcatctgtgcattgtcttttaaactgaacaatttcatgtatcagaagttaatcctgtactcttagccttcatcagtgaaacccagaatgacaaggactttaagactggtgttgaattatattcagatcttaagcaattcctgtgatctcccaatttctttaaactttcatgttttttttagcttcagaagaagagttttaaggtaacatttttttcttgaatgatttctctttttttgtattttcattttgtcggttttccctatggaaagaattgtttaaaagtcatgcagtaattacagtgtttggtgtaatataattcaggatgtttcatctaatatagaaagacatttgccgcttttagcttctttattattatccatattgatttagggtaatggatttgagttgtctaatcactgactgagcagccaggaataaacttaaaatcttcttcctgaagccaagtctggcactttttttttttttttttttgagatggagttttgctctgtcacccaggctggagtgcagtggcgtaatctcggctcactgcaagctctgcctcccgggttcacgccattctcctgcctcagcctcccgagtagctggaactacaggcgcccgccaccaagcctggctaattttttgtatttttagtggagacggggtttcaccgtgatctggatctcctgacctcgtgatccacccgcctcggcctcccaaagtgccgggattacaggcatgagccactgcgcccggcctagtctggcactttttgatctgcacgtgtgtacgttaaaaattgagatgttgccctgcttttcccgaaatatgcctgtgtgaaataggctcattgctaacaactgggacagtgcagaaaaacagagagaacatactgttaacatctcagtgtacctcattccacatgttttctttgaatgtgtgcaggagtacgcctgtccctcaaccaaaagggcaccaattcctgtcattaattttacattgatgtctacctaggtagtttgcagctttaaaaacatttttggaaaactttggacatatgaatcttttcacttgtctatttccctaggataaactaactggaagtggggtttttgccttttgcttattttcattttcaggtatggaacatcttttctgatcacttttccatctttttagcgcttccattcttcagatgatatgcttttttgtcattgttttctactttttgctgcttttaatgtgatgtttattttgataatgatttttattaccttcatctctagctgtgttaatgctttttggagacttaaaaggtgctccgaattgtctgtaatttctttgagagttgagagtatttttctgaaatgtttcccctctcccttgggaattcggaaatattttccttttgcttgttttctttttcaccactgtctttccttgtagaggcgtctccgcatgcctcggtgtggattctttggcttaggaggggacctgccatgtaccctggcctcaggtcggcttggagggtggggagcattgcctcctggggcgggcggctctgtcctctcctctccggcctgccctgccttctgccggctggctgtgcctctgcctgctctacccggcgggatgagatactccaggggggctgcgccactcccagtagggcccttgcttcccagatgcagggtcagggcccagttgcctggggcccacagtgcaaagctggcctctcttccaggaaaccttcctggttagggaagtggagatgccctcgtgggccaggcctgctggggacttatgtgtctgcagttgggccacgggaacgtacctgccacctcagtttcagagcctcctgcccctgtgctggcctaaggtcctgctgtgttctcagttgtcgcctcagcctggggcagaggtcattgtgcccggcaggtagtctttgtcatctgtgggttcaggtgagagtagttcctagttttattgcagatggacttttcttctcactctccttcctttattaacttcagcgtgggccacagcagcctaacgtaaatgcacctttcatttaatggcttttactagaagcctcttcatagctatttttaaacctgaggtccactaacatgactccaaattagagccaggatactcacacttgccaatttacattgtgtgctgttcttatgaagcctaggatcaaaaaagacccagaagtaaaatcaagtttcttttgtatagcatgtggtttatgcgtgtgggtgaccgagtctgccggatactgagtcgtggatggcagcttctggcggtgatccgttcaatagaagccattgatgaccggcaccgcatctgcaggcttcaccctcggggcggctggcagctcctctcttgcagtcgaggggtgtcctgcgtcctaccatagttcagcaccatccttgggggccacttgggagtagagggcttccgggccccagtgcggggtctcctgttgctgcctcccctctctctgtattctctgtctctctgcagcgatcagacccgcgtcttcgggtccgcgcccaccctggcctcacctgctgcttctcagctgctgttgatggagaccagctgtttgacctttcgtagtgtgtgcctttattacgcaccagaatgttctgagagcaggactgaggccccactctgagaggtgcagtttgggcagaccgggaatttggggcagctgtgtttgtgcttggagaccttttttgcttggtgcttctggagggtcgaggtttctcaaatctgagtgccgaatcaaagttgagttgtactgagagagccgcagttaagtaaatgtatgcagacttcctgtcaggtccagccgcgggagcacattggttgaattattcatttggtttgcccttcaagtgtttagttctctttttttggggaaaaaaacaactctgtggggacacttggatagagaggattttcccgaagctgtaaactttggaggatggcatgactggtctcctcccagccggagcggagctgcggcctctcccccctcccttggcctttgctggcacctgtaagcccccggaggcttcagtctttgggccttccaggtccacgctagctggctgctgttttctgctacaggaagtggtggatctgagacttggtactccgtcccatcgtctccacaaatacacccgttcctgtcaggccgcgtgttctggtgttgtttggaaatgagggggtctagatttcaactgacctcttacggacatacagggtaagcgttggtacttggacgtgtagatggagaaagtagagtaaaagacaaacgcatagaaagtagattgcaccatcagcctttctagggctgtgggctgctttgcttcccgtcactttcactccaggaacaagggactaatatggaaaggaacctaggaaccgggaaacccgagcatttattaggctcagctgtatgatttttaatgtgtgtttctttatctgaagtgcatgaactaccttgtaggctgtttcttgggtctaggaagccatttatatttatatgctggtttcctgaaaaacacagagtgctctgtgagtatgaggggttactgtgttgtcacttgagttgaccctggagtttgaggctggccctgttctggttaccatcagtaaaaggcagagctgggaggaagttggaacctaccaattggccgttttttttgttgttgttgttgttgtttgtgcataggatgaatgtattgtttttgtcagtcctttttaccttaacagacgagagagttggctggaatggtccctactcagcaatatttatttaggtttgcacaccttccaaaacgttgcttatttaagtcccatttacaatgctttaaaatggctgacatatcagtcagcgctagggtcggtggagtgtgatgtcaagaaagtattaaatcatgagagctgattaccatgtccagaaaataacgcagtcttgtaaataacctttgtcttcaggtcgggataagaaatgagttataaacggcccatggttaaagtcctagtggacccttggagaacagcgggtggagatggaacgagctttgactcacttgtgttctgtgtcctttgatctgtgccaaggaagagattgctttgaaatgcacgattttattttctcaactaaatattgtagcagcagtaatggagtagtgagtggaaaagtattgctcactctattccacatttcccggaatttatgtgatacaccctgctaacccccgggcttcagtaataccagtgcgtgctgtttagatgtgcagataaaatacacttcctcatggtaaaagggtaaagtgtcatggatgagggcacaggctgttgagacaaactggttcaaatctttcctacagttcatctcacctttgtgttctggtttccttatctttgaagagatggggattacatgatttaattctgtagggacagcatctggtacatttattacattggcagcttctaagtcaaaaataagaaatatctcttgaaagaatttaaaagtttattgtaaattaggttataattttcctgaaccctcccactttctggctctgatgctgacatcatggtctctttgctcacaacctcaaaagttttcataatactgccattaggaaaacactgtttcctttgaacatctgaacaaactgcccttcatagttggtcgggatgcagctgaaagtgttgggtcctgattttgatcagcttgaagctgttcccagaccaaactgagggtcaggctgctatttctcgggcccaataatgagatgcagatgaactggagaggaagagcgtttttatttcctgcagccggttacagggagaaggcctggaaattatccccggaccaactcaaaattacaaagttttccagagcttatataccttctaagctatatattcttgtatgtaagtgtgcagctaaagacattagtgagcaacttctcttagtctataactaaggtctgagtcctgaagaccttcctctggagcctcagtagatttacttaatctaaatgcgtccaggtgctggggtagataacccttattttgtctcctgctaaatcacagaggtttggggagttccttcagatgcccaataaccttgtctgtggaggcctggggagcttcttcagactcctagtaaaacttatttaatcttaaatgggtcctgttaagaattctttggttattttgtcatgctttaaggcccaggaaaggcctaggcaaaactcttggtgggcttttgttatattccagctttgtataagggcaatggcttttttttttttttttttttgcttttaatatttagcttaaccactcagtactgaaacagttgttatagaggcctgtgtgagagagacttggcctgccaccaagcttcatggacacgttgtcagctttgtggcctgcactggtcattggttttggggatcagttaggtggaggagtagacaggaatgtgaagtttaggtaaatcatgaaactgtgaacaatacttagctttttttggttttgttttcaaaagtccttcatccactgggcatttcagctctcacttgtgccaggcattttactagatgctggggcaagatgaactgaaggaagtctttgcccttaaggatctcacagtcatttgtgagagacagaagtctaaaggtatgtaatgtgtagtttttctttgaaacagctttattgatacatattttacataccataaaattcatttcaggtgtaaaatgcagtgagttttagtaattttactgaatggtgcagctagcatcaatcagagcagaacatttcatccccagtaagattcctcatcgtcattcacaggtgatctctgttcccaccctagccttggacaattctgcatctactttgtagctctataaatttgccttttctggacatttcatgtaagtcgatcacacagtatgtgttcctttgtgactggctgcttttgcttagcatgacgttcttggggctcgcaacgcagcttgtgtctgttgttcattccttttgcagcagaatcgtattctgttgtttggatgggccacctgtttgttgtctgtttactctccagctggtggacatttaggccgtttgcactggcggttactgtgaatcatgtcgctgtgaacatctgtgtgtgtgtctgcgtggacttgtgtgtcctgttctcttgggaatggagttgctgggttagagggtaggttttttgtttccccttggagactctctggtttccacatatggtagttttatgcttaaccttttgagaaattgccaaatggctttctgaagtggccacgtcattttgctccctccagccgtttgtaatgttcccatttctcctatgtgtaattttaatacaaagcagtaaaaagttgccattatggacctagtaaattctgaggtaacataagagagaaataatgatgcagccgtcattactgtgctggtaatgtaagtttccttttttttttgtttttaaatggagctttgcagagatcaagtcgagagaagaacactgggccagcctgactccaaagcctactctcttaagcactttgctttgctgacttgtgatgttttaaaatctagcattattttcaaatgctgtgagagcactgaagataaaggatttgattctttttttcaggcatccaaggatggttcatcatcaagaatcattttaatataggaaggggacgacagattatggtgccaatagatgtactcctacttccattgcaacattaatattgttatataaatatggcaaaatggagaaaagcagccgaatcacaaaaagagttgcattatagtatttgctctcttggaggatgttagtattgtagcaggctgaacccacccatggaagaggtgtgtgcttcagggcggcacagctggagtgagccgaatggaaatggaaaattgtgtacaaagtgcgcagcaggctgagcctttgatggaaacagcgggtgctctgctgtgtacagctggatgtcaggtctggggagtgactgtgtgtgagtcttggctgtcgccctttcctttctgtgtccccctccccaccagccctgactcctgtgtctccttcgaatgccttccagaaattgtgacaggtggcgagggcagaacaaagtattatcttttctgtggttttctcagtaattatgaaattttcacctgtttgggcctcaccgaggagcaagaaagaagggacaccagggcctgagtgtgggaaggaggcagtggcagtgatgaacctaggaggtcaggcggcaggtgggctgctctggaagctccctccaggaggtagggtttagcacaaggcatggttttgtaggcaggtgtgtgcatgcatgtgtgtgaatgtgtatgtgtgtaccagaatagaggactaggagaaagaagtggcaagagactgggcagagaatgaataagatgagctcacaaactccccttggagcagaagatcagttgaaggtgcagtaagctactgcttgaggaagggattaaaaataggcaccaagccgcggtggctcatgcctgtaatcccagcactttgggaggccaaggcgggaggatcacctgaggtcaggagtttgagaccggcttgaccaacatggtgaaaccccatctctactaaaaatacagaaattagctgtgtgtggtggtgggcacctgtaaccccagctaccagggaagctgaggcaggagaattgcttgaacctgggaggcggaggtttcagtgatcgagatcatgccaccgtactcaagcctggtcaacagagcgagactccatctcaaaaaaaaaaaaaaaaaaaaagcaagcaccaaagcagtgattgacctagccgatggagaataccctttccttcactaaaacctgaagcttagcatggttcttgggaaggaagttctggaagtgatgaggatttgttgacatccctgtggattagtgacattgatgggcaccagaaagcaggtgtctgttgtgacagaaaaccagggtggaagctacaagtgacatctacaaggtaggccctgcccactctgacctccagctgcaccccgagcggagcagctggggcatcatggaagtggttgggccatgcagcggagccctgagcccctcagcaggttcatcccacagccctgtgttgtgggtactcttgttatccccatctatagaagaggcagctgaggcacagggcgtttaagtgactttgtcagtcacttaaatcgaatccctcatcagagctggggattcgattcaggcagcctggctccaggagctgagccctcagcccctgcactacactgagggggcagcagaaaggaacccaggtgaagactataaagatcgccacctcctcttgcttctgtctcacattctgtacttacgggtgcacgtctccacctgcttgctgcttcctgggctgttggcatgcacctgggtggagctggggcccctgtcctgctgtgggtagtgaggccggcaccctggccagtgcgtggcccggtccttagtctggaaggtctgtctgcctctcgtgccacagctggcggctggggcctcagctcctcagctgcactcgcctcacttgtttattcagctgatggggttgaggtctcccgtgtgccgggcactgtgctgttgtgaatgagcccgctgctgttcaaagcagacatcacagcggccatagggtaacgccatccagggggaaggccccactccagatgaggtgtgtgtgtttgtgagaggccccacgaagacaggtgtccttagccatcccagcagcctcacccaggaggactgcctgatgggagccctctgagggccactgtctagagaggtggcactgcacaggtagcctgctccttcagaggtaggtcttgagggggtcacagtgtaggctgaagaacgctggcttgaggactcaaggagctgaaggccaccatcctggctctctccctgggtgagtgacttacttgccaagcctccccttctcatctttggaggcggctgcttcaaggggtttgggggaggtaaggagatgagccgggaggggcgggctccggccagtgtcgggggcacacaagggcctgcttccccctccctttcactgggcgactggaggacaggcggaggagtgtggctgggcggctggaggacaggcggaggagtgtggcagccggacagctggaggacaggcggaggagtgtggtggctggcagggtatgtgtttctggttctgttgagtgatgcttggaagatcgttctgagaggtcagggcagctcccgggaccccagagcactgggctcctgcaggggactaggaggccggcttttatcagctcatgagcttttaaaaatggagagaagggcaggtgtggtggctcatccctataatcccagcactttgggaggtcggggtgagaggatcatttgagccctggagttagagaccatcctgggcaacatagaccccgtctctacaaaaagtaaaataacagtcagccaggcatggtggcacacatctgtagtctcagctacttgggaggctgaggtgagaggatcacttgaacccaggagtttgaggctgcaatgagccatgattgtgccactgcactcctgtctgggtgacagggagagatcccttctcttggaagagaaaaaaaaaaaaagatagaagaagaatatgcaacagagacaatttagtccccaaagcctaaggcatttgttttctggcccctactgaagtgtgttggcctggagcttgcagggtttctgtgagatgtaggatttggctcacagattgtatcttgattgctcacgttccctcttgcccttgctgccccacctagggagaaaagaacactcagtgacatttttccccccggtgggcaggatacgtgtgttcctatttgtgacaaatcaaccttgtctatgaccttcgcacctccattccaggaatttccccttcgaggcctctaaaagctaaaagattttcaggtaaaggaaatgcgttattaattgaaatctgcatacaccaaaacgatttggtctggcttctagaatagtcagtttcctgatactcatcattgcttccatcagttcttgtaaaatacaggaaggtgagttcacctgtagggaatgggaagtggtatcacattttactcctggcattctagtgtgatgacaggatgagccttgccacttaggtgcctctggagtcaggcaccctgtgaagcttgcagctcatgagcactttgcagtccagagaatgacccatgatccttaaaccccgcttccgagctgtgggggatcttgtgtaagatctgtgcccgaattgtctcagctgtgtaatgaggacagtgttctctttctcatggggtggttgtgaggtctagaaaccgtatttgtgaacgctgcccagcacaaggccttcccgtgggaggagcttcagcagtgggagctgccactgtttgttactgtttatttgtacactgggtatgttttccatggcttttgtttgcattttgattttaataaaggaggtgccagtttcactttccaaggaactatatactttatttggaatgcattgcgtgtgtgtgtgtgtgtgtgtgtgtgtgtgtgtgtgtgtatacacacatatatatatatatatatattttttttttgtttgtttgtttgtttgtttgtttgagacagagtttcgctcttgttgcccaggctggagtgcaatggcgtgatcttggctcactgcagcctccgtctcccagattcaagtgattctcctgcctcagcctcccaggtagttgggattacagacacgtgccaccacgcccagctaattttgtatttttagtaaatacacgctggtcaggctggtcttgaactcctgacctcaggtgatccgcctgccccagcctctcaaaatgttgggattacaggcgtgagccaccacgcctggcccgttgcatattttttatcaaattcttgcctgatgaaactcctggttatgctgtcagggcctgtttgttgggactgcccagtgggttctccttgcctgctgcccaaacagctgatttatcaagacaggggaattgcaatagacaaagagtttaattcacatagtgctggctatacaggagaccagagttttattgttactcaaatcagcctctctgaaaatttggagattgggatttttaaggataatttggtgggtaggggttcaggaagtggggaatgctgattggttgggtcggagatggaatcataggagattgaagtgggttttttgctgttttcggttcctgggtgggatcccagaactggttgagccagattaccggtctgggtggcactagctggtgcatcagaacactgggtctgcaaaatattccaagcactgatcttagtttttacaacagtgatcttatccccaggagcagttttgggaggttcagaatcttgtagcctccggcctgcgtgacccctaaaccataatttctaatcttgtagctaatttgttagccttacaaaggtagtatagtccccaggcaagaagggggtttgttttgggaaagggctattaccatttttgtttcaaagttaaactataaactaagttcctcccgaagttagttcagcccatgcccaggaatgaaaaggacagcttggagggtagaagcaagatggagtcggttaggtcagatctctttcactgtcatcattttctcactgttagaatttttgcagaggcagtttcattgtcatctcaaaccgcaggcctcgtctttgagccagggagccttctgttgaagaaaagtaccccacacaaccactgagagatcctggggcagggctgaggttccctggtggggactccgggggtgctggagctttgtgaccatgggccttgcctcctcggctgcctctgctatgaagcctcatgcggttggaggaggatgtggatgagatgaccaagcggggtgcccgctagcaccaggtggtgggtaggcgtcggcagactaggagagcctcagagcctttgtttaacttgtgctgagaaggagtgtgactccaggagagttgggtggagagcctcaccttggcacacactatgctgtgtccagactggaccccatggtgtctgagcattattctctctagggtcaccttcccctgcactgtgaccttgcggagcttcaaacagtggtttcctaaggtaacagagcaggtggtggtgtggtgcgtgtgcgtgtgtgtgtgtgtgttgggtactgaggccacaggcgataaactgatctaggtggtatagtagtgtttttctcatttttaatacttttcaaaaatcgaatttatatttttcttttttatttttagagatgggggttctcattttgtcacccaggctggagtgcagtggctcaatcataactcattgcagcctcaaactcctgggctcaagtgattctcccacctcagccttccaagtagctgggattacaggcttgagtcacgaagccctgctatatttttaacttagctagagcatttctatcttaagtatttttttatagatagtagatgctagcactagggttttccttaattaaaatattaagtattccttaatctttaggagatttaggaaatattaaggaatttaggaaaactgagatagtctcgctctgtcacccaggctggagtgcagtggtgcaatttcagctcactgcaacctccacctcccaggttcaagtgattctcatgctttagtctcctgagtagctggtagcctggctaatttttatattttttgtagagatggggtttcaccatgttggctaggttagtcttgaactcctggcctcaagtgatccacccacctcagcctcccaaagtgctgggattataggcgtgagccaccacacccggcctgaaaactaattgattgtgtagacctagactttgcaattcatagaatttaatttctctttgtgccaattttctgttttgtcaaatactgtaggatatttattcagcttgtcctctagatgatgtgattattgtagggataaaataaagtgtatactatgggagaaatgagtttactaaaccagatggtgggggcatttgtaacgcattaatacagctcaggtagataaactgagtagtgccacttacagaagtaaattatctgttcatggacacagactaggaagaacttacattgtagtaattagtagatttattgtaatgtgtagaaaagcatgttactgtataaaaatgatttgttatcagtaggctagaaataacacttttcttcgaaagaatatttgaggactagaaaaatctgtcaattctttgagcttcttggagccatttgctaaagataggtatttgataaatactgatttttattttggagaccttagattaaccaactagttcaccgtacacgaagcaccctttggggctcacctccagagaggttagaatgggtatgggatgtgtgtgtgggatgggtgtgtggtgggtatgggatgtgtgtgtgtgggatgggtgtgtggtgggtgtgggatgggatgtgtgtgggatgggtgtgtggtgggtgtgggatgggtctttggtggatgtgggatgggcatgcaccatcaattactagtcactgaagtcatctggcaaggtggtggggaggggttgccctctccttctctcatggagaagagaggtgggagaggtaaaagatgaaaaaggtgaggtgccgggaggtgcctcctcccctgcactgatgtgattttttcccaggtgtagaaaggtgagtgtgacccaggataaaaagagttttccaggcatcactactggcattgtgacttctgcagagcctggggcaatctcctagactagaccggtggtcctcaaccttggccgcgtgtgagagtttctggttagcttaactaagctgatggggggtggggcccttccccaaagattctggtttaatcggtccaggctgaagctgggacatcgagctgtttagggagctacccacatgcagcccaggttgagaatccctagccacatgcagcagggagggtcggccctgggagggtgctgacctcaggatcacagagcaaatagttcccacgagcgtctttctcctgatgcactgtcctgcgtctatgcagttccagctcacctctaacagagcagaggccattgtggggacgataggcatcgttgggtagttagtgatgtctagccaaaaacccattaataccatctgcaccttcaaagggtgaaggtcgagtgagggggagaacagggattcaaatttgttccttggcttcaagaggagccctgatgtcctgagtcagcactggtatgaaggctagtcctgaccttaaacttcttattaagtcaaaatcaggagcttgatgtttctccggttctgttcatatcaaaaggtgtctagggttggctggtgtgtggagccccaggatctgactgggggagtccctaaggtgtgatgctgtcctgatagtggaaatgccctgggcgcttcccagggcaatggaggaggccagggatatgcagtcccagattgggtttcgaccatgacaggtttttgatgacaacttctggcgggaaaactgcccacaaaagagcacttggtttttatttggtctttttcatttggtttataaactttccattggccttttctgtacatatccctgcatgtgtagatattttataaaaaggacagcttgattttcagattttgggagggcgtattggaaagactgataaagagtgagctttaaacttattagaatgaaagaagacctttatggatgaataggcttgctttagacaaattgttcactattccttccagcacagaatgcctcttcacatttaatggccagtttaattagatgacatggctttccagggtattttatttgtttgcagtcagctttaggatttcttacttaggggaagaataatctgtattaaaaaataggagattggcctaaagttcagccatactaaaaatctactctcatttttactctttggagaccctgtcgcattgtgttgtacctcgtatattctcagttaagagttatggccagcgagttagtgatttccaaaaatgtctccaaaattgagtgctgttttaaagatggcttcccatgttcttcagtgtgcttgctgaagattctatgccaactctggtgaaggtggtggcagttcaccacgttgccggcaggtttgatcccggaacagacctgtgagctcattgtccatttgactgagaagctaagaacttgctggaggtcttgcagcagcgcaccacagcttttcattccagggctttgggttcttcttttgtgcccttgtgttgtatgttgctgtcagagctccggagacagtgatggacctgctcagtgtttggagtcggatggccataggttcctgttcaggctctgtgcctgaagacaagtcacataatcgtcagaaaatggagctcgtgcctcctccgtagagggcacccgggcatgacagtagctttgcttatggtgtcattctgcccagaccacatccaagaccatatccaagagaagagtgtcattacctctgactgcagctgtcacctaatctgtgacactgagaaggccaggagctctggcaatctagttcctttatgggggtaaaaacggagctgccttaagtattccaggtgttttacaagacattctcttagattcaattaagtttctcctcagaaattgttaggagttctctttacacaaactttctggaagtatttgtgtgtgtttctgtctgggggccacagacagaaactgtcatgtctggtcctcttgacagctctgtgtgtgtgtgtgcgtgtgtgtgtgtatatctgtgtgtgtttgcacccacatacagggccagtgccttttgccttctttctttgccgtcatttttcctgcaattggccttttgtctaacatcggcttccttctccagcagtgccagtggagtagagccttctttcctgggccctgcaggtagaccctttctattttaagaggtttaatggttacctttataaggcaattttaaaggtccgtggatttctgcaaattctggtagccatgatcttgcctctgtagttcccagcatcatttcttagacctaggagccttttaagttgggtagagtcattgcatttgatggctgaatgctcgttctggaagcctcgtgttaggaccccaaccacacccatccctggacctacaggggcctctggacccccctgtttggtggtttgtttgtcttttcctcaccccagcctcagcaaccaaggatctattctccaccagtcaaattttgtcaccttgagaattttctataaagggactcatactgtatatgacctttggcgcttgtagacagtattaagaagttggatgacaagagggtaagtgaggggattagaaaggagctttggggtttagattcacaagctgagtgtgacctcagtgtgaagggcagtgggtcgtccccagttgttttaagcagtgaaggaaaccgtgagcttttaggaagatcaactctgacagcaggtcacaggcaggtcttgaagtggatcagttggaggctgctgctgtgggggagggagggccaggcagtgacctggaaggggctggatggagagacgcttcggaagaaccatgacgcggtttgcatgttggggtgagagaggaatgggggtgcagaggtttccagctttagaaatggtaggtagcaacactgttaacgatgaaacacgtggtggggggcctggggagagggagacggcgggtatggaagggtgagctggaatggtagccaccagcatgggtctgtgggtggtagcgccagacaggccaacaggtaggtttccacctgcgtgcccagttggccaaatcggtggtgactggctggggtgagtagattctgaggctcggttcagctctaggagagtgtttgtgattcattagagatgcttgccaaggccagagtggtgagagtccgtgcctgcagccaactccccttccctgctccaggctcagcttccttccagcatcctcccgcccgctccagtagggatagtggtgtgagaagtaccgggtattagagcacgtcaccctcagtttctttttgttttcatggaaaagcgtagagaagcttggtttcaaccagagtagttgagtgtggtttgactgtgcaagtggtacatttggagctgagtaacactgaaagttgattggtaatgccacatgcatttttcattgccagaaatgatcaaaagaagatgatgacagctattcaggtttaaaaatataaaatacttcagtcatcatagaacaattttaaagaattctttcaagggattatggaatataataaagtgttgtgttgtattgtggaatggccctgcttctgagctgcagaagggcagagcttcggaattgtctttgtaactcttgggtgggtaataggatacttcgcacttgggttttctcctcaaaggagccggaaccctggaggcctggctggagttgctggttttgccccccacctagactgggctgaggggaccatgttttgtgagatgagagggagcaggaaaacacccaccttctggcgttctcattgagcgcagaatcagtctgtaaatcagaagatacctccatctgtctttctcattcatttaggttttcgccttgcaaggtaggtgtggtcatgacattggccaggcaaacccccaggtcatggccgttctgtgtagtctgtgaagggagcccgagactgatgggcccgggtctgtcctggacctcccgccctgggccaacctgcatatcctcatgaatgagagtccggtggcccagtgggaacccaggggtcagcctgatggagacggctctctccagctttgcggaggcctgattattagcctagggagctgtggctgaggagaccatcgcccccagagctctccttttgctttctgccgttgagtcaggcccagagaggtacaggagctggcggggctgcaagacgccagcatgaactggggctgcagtcacagcaggggacatttgttccaataaagcaggtgatgactgtccctccccttgttttgggattttcgacggtgtgcctctgaacccctctggtctcccgtggccgctggctctgcgtctgtggctgggtggtgctggtgaggcagtgctgggccccccacctcccttgtggctcacccggtcctggtcccgtgtcctctgcatccaggagcctccccgctcaggtttgcctgcggggcctgtgtgccctccccagtcgttcaaggcacaggggcacatggaggtgggttcagagaagagtggggaagggggtgccggtggcccgtgggagagttgcccaggtgtgggcacagcctctgtgtcagggctccctcggatgctcttgactctgatctggcctttgaggtcttaactttcgtcctcactggtggcccgcggagcatgattcccggcaccttgcccctttgcaggccacatgttcccaccgctctaattggggtggggtcttggccactggaatcagatgtcatctccatctctgggctttttagatgaagtggagggagaagggcagacttttttttggtatagctgaggtctcactttgttgcctaggctggtcccaaactccttatctcaagtgatctgtgggcctcccaaggtgctgggattacaggtgtgagccaccacgcccagctctgctgtgtgcacacatacatgggccctctgatttttcagttattctcagtggctggccattccctgtgaagagtgataggcccacatctacacaaaatggaaataaactccaaaaggatgccgatgagaattacaaaacaaatttctacttccgagtgtgtatcgatatatgtcactgcctcttctcagggaatctgacacatacacagagtgaccatatgggcgtgttatcctcacatggggtcggtatcagcaggccgatttccacctggcaagcgtctcatgaaaacgcgcctgtggacagtggtcctgcatatctgaataacgtgttctacacccgcactactgggatgggccatgaagctgatgagcaaattccaggaagccatttgtggtcctttccaatcacgtttcccaagtcttggccaggagctgacaagcggtcactcactcactcctccccacagcagaaatgcacaacccaagtttcttgaaaaacagaataaaatttaaaaagaagtaaaggctacctaattaagcagcagaagacagttaaataaacttgaatgcagccatgtaatggaatatttgcttttttgtttctaatgacatggtcccaagcctagtacagtgaggagacaggagcttgctggctaggttcaaacccctccaccgccctctgccagctctgggaccaagggcaagatactcaatatctcttctgctcagtttgctcatctgtaaaatgaggtagacagaagtactttcctcttagctttgtcatgagaatgtgctgagacagttcatgtaaagctcctgacccagagcctggaacaagtacaccctcaataaatccactcctattaggctggctacacgctgtgtgcactgcagggggaaaatgcctgagtcatattgggacactgagacaacaattttgcatccacgaaaaaaattatacatacagcttgacaaaggacaaagcatctgttcacagaaagaagactgagagaaaacaggacaaaaattgtttaaaaaccagaaaaagcaaagacggacctgtttcgaaagcccctttcaccccagcatactgccaatgctcctccctccaccgcactccagccaccatccctcacccgctcagctttccagctgaccaaccctgacttacccaaccaaagcctgtccttcaggtcgggcgggcgtggtggctcttaaccccgaggtcccccagaaggggaagttgggctgttaaaattcttggggggattttagggaattggaaagttgtgagtagagaaatcagtattcgagtgccttctattcagaccctgcatgggatgtgtcagacacctccacaggtgctggatcctcactctcagttgcccttaatgcagagatagatactattatttatcattgtctttttatccctgaaccctttcctcagaggagcaagccccagggctcatcagtgtgaggcagcttgtggggctcgaggctcggtgagctcgggaaggggaagtcactcccttgtgcttcccttggtcatagagaagccgatcctcctgcctataccggggtggcgagcccggctccactgtagggacaaggcatctaattgatatttttgagtgctgagtccagggcctggggagggggtgctgtgtgcaggctgctcccatccccgcccccatcccctagtcttcttgccctaggggaggtgactttggaggggaatgttggggagcgggggttgtccatgtgtcctgacctcccactgcttcagaaaaggcggagcccttgggcgtcctgattctcctgccttgccctggcttaggctttgcttcctttcaggcacgggctgtggggttgaggggccccaggcctttccaatctgaggccatagccggtgcttagttcagcccaaacccttctaaaaaggaaattatcaagaaggctggcagaattgtgccttttttgccaaggaaatctactttcctcggtgagcaaattctggcagcagaatctcaaggttcttatttgaaagagggcctctttggcattgatttttcttctggccatgggggacacagtatggtaatgaacccgtgcaagaattgccaaagggcagggctgcccgcgcagggaaccctgctttattgagtgccccattgccccggcctcagcagatggctgccttcttgccaggggtaatttttagcctggcctacagctgctgacacagaggccaggggttctgaaagtcgccgtgcttgagcagattgagacaatgcagtgaccctttattgtacaggtgccgtacgcctggaaacgtcttttgggacaatagtaaaagagtgaaaattgctgttttctaagccgtcttggtccaggcaaaaggaaaacaggcaggttactaaaacattccagaatctggaacatctgtctacccctgacaccccatagacacttttctcccgcagtggtttctgttgaattctattatctgttgttgtataagaaaccaagaaaccgctatatcacttagcaacctaaaacaataacgatttagcatttctcaccattccttggggtgaatgggtggtttttccacccgcctggctgaggtgcattcgtgtggctgtggccagctggagagtgtctggggcctgggttcagcagaggcagcgaggaaggctgcgtgtctcgccccaggtctagcagttggctgcatgtttatccggtgccgtgctctcttccacgtggcctctccagtgtctagaacaggcctctccacatgctgctgatggaggccttccaggaggcagagcgaacactgcggggtcccttgaggcttgaccttggagagggtacaccagcacaggaaccacaggccaggtggttcaaggtgtgggctgctcttatgggagcagcaggcaaagtctcggggggtgggggtgtagacacaagggatgggttattagtgccattattgtaacaatccacagggttgccttccggtccccagggttcatgcccctcacacatgcaagagatgctcttccatccagcatctcctcacttccctcctggcacagcgtctgactcaagggtctgcgtgccctgcctgctttggggctgggtgtggacgggctgccagctcttgattcagagagcctcagctcaacaagaattgtgggacaggaagagtggggcggccacagagactcctcttcaaagagggcagggatggaggcatctcacaacagatgggctgcagcagttctgacctagagtcaagcatgggccgtcggggcctccgctggggcagtgcccagcttctagcatcagtttctgtattagttgcctattgttgagtagcaagccaaccaaaaccgagtggccaaaacagcaggctcacgatttctcgtgattctgtggattgagcagttttgctggccttttctgggctctctgcagtcagctaatggcatggttgaggccaggtggcccaggatgacttgaggcacatcctgggagctcagctggcgtcgaggaagtgggcggatgtcattgtctttctgaccacaccattttcgattgccagctctccactgcctcatggtcacgtccctctggagggagctctgcaagtcctcttggggccttgcttagattatgttcatcagaacacagagcaagactagcccaggttcaagggccagggcggcagccactgtctcttgctgggaggagtgcccaagtcacattcataggggtgtggacccagagaggtgggatttatgggtggttatttttgtaacagtctcccacagggtcctcaacaatgtggtaagggtttggataaattcttgtcgcctgtttttaaaattaagtctcagaaaggaaaggccactcttagtatgggagcgggacagtttactggagggggtgatgagttgacctaacatgatggtgttttagtggcatgttggggctgcttggcctcctgtcccagcctgtgccgagtggtggttctccaggtgtggtccctggaccagcagcatctccctcaccccgggattccaattcttgggcccacccccggttgactgaatcagaaattcttcgtaggatggggctctgtggcctaacaagccttccaggggagtgtgaggctcacccaggtctgagaatcactgctcccgggaatgacagtgctaaccggctctcctgacctcaggaaggcaggctgttagcacccctctcgcccttgtcagcaggaagggctttccccttccctccaggaccccctgtctgtgtgtaggataggctttgaggtgtctgacctgggtcctgttcgagccagggtgagtctggggttttcttattgctcaggggatgtttactgaccacagtcccatgccacttatcatacctgggcacaggggtgtagaggtgcgtgagacacagcccctgactcttcagcttgcagctgagcaaaggagacagcgcagagcagagggctactgtgggaggacagtccagcaggggaagtggcaaattccgtgcacacatgttgagctagagatgtctgggtagaaagagagaatgcttgggaagcagctggtctggggggttcctgttcagaaggaaggcctgagctagcgctttgaaagctgtcatgtacgtgagtctttaacacagcctttccttcaaggtggcaattgatcagaatccattggggtgttttaaaaacatggattattcacctcctcttctgaactcccatatatttctgcaagaatgtcagatgtcctaggtggttctgttcgggcaggtttgggaaacaagggccccagaccctgaaactaccgggcacccctggggagaaggagtagaggcccaggctgggacctagagtaagggccagccaaggtggagtctgcgtgaagatccttctggaactagagggactggaagaagccagcgggagtggggctgtggatgctaaaggactggaaagttacccagaggagggggagggcgtggttgacaaggctcagacacgacattgcagcactggtgaccggatccagagcggagccaggctgcagtggtggggaggaccgggcaggtccagatgactttgaagggactccagaggaaggagagagtggaggaggagggctttgggttagggagagtgctttcgtttgttttaaatgggagaaactggagcatgttgccaagggcagagagccagcagagaggggtgaatggaagaaggagcgagaagggggttactgacgaagccttatcctggaggagagaaggatggactccagagcccagctttggggactggccttgaataaaaggagggccactctacctcatcctggagggagcacggtaagggagagggcatgaaagcagcgaggatagtagctgctgaaaacggggtatgtttcattatagctaaaaaaggatgcgctgcttcccccgcatccccgaaagctgctcatcctagcagcttgtgttagaggaggtggaggtgcaggttcaaggccgcgtgtagggggagtcaggtgggaggtacccacccgggcattctgtggcattcccaaaagtgactggtgatactcagcctggggtattgataagcttgaaaataggaagaggaggatgttgtagggctgctcacgagctccaaaaacagtcttcacttgaaaaaattatcctgggctttgattgtgggtcattgactatcttggtaaacccaggagtcttggactgtgttttttaaaacctgtaaacacacagccaggcttcctcctaagtatgaccgtcataagacatttgaaatgtagtgccgtgactgaaaacaattgagcaattgttcaggaaaaaaattaaatgcctctcgattaatcacccaattgatatgtttagtgcagtactttaagtggaagttggatagataggttgatttttaacacagtggatgtttgtgtagcgttttaggagccaagggggatcatggctaaaactgtagtccttgtaatccctggccgctcgttagacctcggattacgctggccatgaccttccggtgtgggctgagcactcagtgtctggcctctggcctgtcctgctctcttggtaaccccaggacgcatttcccgttgggtatatgtccaccacgcaagccttggttcattttgtactaagatggttggtgggttttgtgagcttttgcattgtttgatgtgcagcctcaaacaaacatggggcaggggctctgcgcccctgtgtgcaggaggtcactgtggctatctgctcgtgtgtcattgtggcgatatgtgcgttgttgccatggtggacacgctgtagcactgtaaggcctgcaaaccagaaatgggctgactggctttcaacagttctcttggagagcagctgctcggaactcagtgtgtctcaccttggagagctgtggctgggtggcccctgatgggccctgaggctcacgtcactcatgaggcaccgccgttgctgcagtgttgtgtgtgtgacccacctcacatgcaccactctggataccctcttctgtgtcatctttcttctcctcattctctttctttacctccttttcaggcctccctctcctccctgtgcttgttccttttcctagtagttcagcttcttcaaaggactcatagatttggagggttggcctggcgttctgttccttctatggaccatttctgagggaagatgtgtctgcagcagtggtgtctcttagagtccttccttgctctgtggggttccaggctagtgcttgtcaccggggtgccattggcattttgagctgggcagttatttgtggggagatatgcagcgtccctgtcttgccttgctaaacatcgggattgcttctcagtttcctgacaaacaggccctgtggatgacaggttactgccccctttgagaactcagctgttcacacgactctgtactgtgtagctgttaggatgagagcttgagctctgacagctagccttcttagaaatgtatactatatatgtatgtgtaactaatcaggtggttaagagcttttagaggctatttccagggtacagcatgtatgtgacaaaacaggctgcttattgttttctggaatctggttagattgttattgttttggtgaaggcagtactattcatgaagatgcatagttacggtatacgtttttttttctgttctgtgatatagctggttaacattttagtaaaaattcatttgaattcaggaacttttggggattgggtatggagaaaagtgaatttttgcttagacaaaagtgatttttcgataagtctgtgtatcctaacattccaataagtgcttagattttaatttaccctcattatacaaaagttggcattttttccatgttttctaatctagctgggtgattgttcttattgtacgcttgctgcctttcatagtctgatgcgcatgtgtaggtgagacctaggaatcttatgtcctgaacctgcagagctgtggtcaccaccagcctgatgctggacacagaaaatagatgagtccctggaagacagtgtggtctataacattacacataaaattgacaaaggagttgtggtgctatgagggactaaagtttcccttttctcttccttctctctacagaacctaaaggcagacccagaagagctttttacaaaactagagaaaattgggaagggctcctttggagaggtgttcaaaggcattgacaatcggactcagaaagtggttgccataaagatcattgatctggaagaagctgaagatgagatagaggacattcaacaagaaatcacagtgctgagtcagtgtgacagtccatatgtaaccaaatattatggatcctatctgaaggtaaggcttaaaataacgtgcttctccgttctgcagcacttggctgaggtgccagcagggaatgggaaggactctgataggacaaagcacagcaggtttcagagcaaggagagatgttttgaccttcgtgatcaaaagaacctggctttgatagttccatcatctcaaatgtctcctatagaaatatttgtggtgaaagtgtttgatgttctaattctcttttgaataaggaagagtatttctggtgggactttgtcattaaaactgtttcttattaagttattataacagttattcacctaattttaggactgcttatgattagtattaaaaactcataccaacttaagaatgttaatcttttgatattctcacttaccagctgtggtttaatttaatgctgttaaaaactgctgatgagaattgataatgttggttagttagctagcttatctacgcttgacttttaagaatgctaggcaaattggtaattacttaaataaaacggtagttataataatatgacacaaaaattgtcctgcactgccactctgttctttaagtgggaaagaatagtattaaaaatgtttttctgatcctgcatggaaccattttaccattttagacatcgtagaacaatcctgttacaacactaagaaggcttatgaccgttcttgtgtttcaagttcctcaaaatatacctgtttcactgaacttaaaaatgttgtaacctttaaaatggggttttagaaatcataagaattggtggggaaaaaaacgctctgaaataattattgtggaatacagaactatgaagaaagaaatgatgattttccaggggaggcagcgataaacctggataatttgggccaggcctcttcctcccctggccttaccctctaaagtctctaagttacaacttgtaagctgctctgatgtgagaagggagcgtgtaggttttgcttttgtagaaatacagtaaggtgtaagtcagaggatggacattttgagaaccattgattaactaaaatggatatttaaaggaaatcaaaattgagcagtgatcccttttttatcccttgtgtaaaggacagcagtgtgtcataggtcaaatgtagcattttgaaatggaaagagtgagttttggagtcaggtgtcacaggacttgaatcttgtcatttactttgatgtgtggccttgagtgagttttcattattttttataacttctccactttctcatttgcaaaatggaaaattatggtatatatcatatgttacaaagattaaatggaattaagtatgtgaaagtacttgacatgtagtaggtacttaatgcgtattttccttccttggtagcatttattcatacctcatctcttaaattaccctgcaatgaatatgcaatgaaggtagtttgcagttaaggtatccattgaggtcaaaccaaggaaaccagggttaaagaatggaggaagaatgccaacaagaagagcaaatgttgctgtgtggtgcacccagtttgggtcttgacacagcaaaaacgaaagcactacacatgtgacttccgtgggggaatgccagcatcttgatgttaaatttcttttttttaatgagatggagtcgtgctgtgtaacccagactggagtgtagtggggcgatctcagttcactgccccctccgcctcccgggttcaagcgattttcctgcctcagcctcctgagtagctgggattacagtcgctcaccaaccaccgtgcccggctaatttttgtatttttagtagagatggggtttcaccatgttgtccaggctggtctcgaacttgtgacctcaggtgatccacctgcctcagcctgccaaagtgctgggattataggcatgagccactgtgcctggcctcgatgttaaatttcgattgaaaacaaacagctaaagaaactcagtttggattctgtccactgtactgcgtactattccctgtgaaattacttcagcagtagtgttctagttaattcagagttggatttcgtgtggtttgctgatgttgtattttaatatgaattattatgatggttttggcaaaggaagtgtggaggatcctgacaaatatttggtgatttataccagctaatatttaactatggaaattaaggatcagtggttcaaaacatcttgttcaacctcagctccttagcacgatctttactgcatgctggaatgggctgctttattgtggccaaatatagcggccacagtacatatctgcatgtatctagagattccatccaaacaggtcctgttcttgcctgagctgctaatgctagaacgttaggtttcagatcagcctaaccttgatctaaggttgccccggtattttgtttagttattgtaacgtcaactgccgtagtaaactccttaaatgtgtaacgactcatacatgttagaaatgtatctcttcctcactggttgccctgatccgtgggctgttttccttcagacactgattcaggaacctgagttccttttatcttattgttccttcatcttgacaagtggctgtgctcagctgccataagtcagcgttgggggagaaatggaggctcacgtgtgggaagtttttatgtgcccaggcctggacgtagggcacattgtttctgttcatgttctcctggtcagaactcagccacatgacccacacctgacccaggagaggctaagaaatgtcattgaatagtgtgcttcgtgggaagaggacacaggctgtgtgcacagtaggctggccttttcaaagtcacttcatctctgtaggaagtggaatagctcagggagtggtcttcaggtgctgatggcctccaggcaggttgaaaagtgttgatactttatccagtgcgctctctgtattttactaagcagattgtcctttagggagtatctgccacaagaatgcctggaagaacgtggccattgtggaaagttggcccggattttaaagccatgtgaaggacaattgtcttatttggctacatacatcatgaactgctcttctaaaacaataattaactattataattgagcaggagaagaatccagacctgtaattctgtctgcccattcttgtgtaatggagtgtcatgaaattctttggcccagaaggggaccctcctgagtcagaggccattcttccatcatcttggtaggtttagaaagtgtggtcctaatgtcaaggaggatacagattaaatggatttgtaagacaaatgggtctttggcacagagctggaaatagtgctctatgtggttttcactgtcattttaaaacactccctgtagcgttcagagctactgttcttagttctttaagggtgattggagagagggccttaggatttcaccctgtgttaagggacttttatatagcaggccaggacaaagaagagattaccagaaatgggtttcttcattgttggggtagctagcattcacaggtctcataattatgttttggttcattcttttagtctagaaaaaaggatttaaaacaatagagaagtggtctaaatattctgaatgttactaaggatctggtgagtggtgttaattttgacagtagcagtgatgaagtcacaaaattgctttgtagcattttttttcccctaaagattgaaaacaagggctagaatttagggaggagaaggaacaatacaacagtgaatccccccacccccccaatatttatggatctgaggcctggaaaggtcttgaggatgatcacagaccatggaaaaaacttcacccgttgtagtttcagtgtttactttttgggaaattaaaccagctaggatacttaaccagaatcctccatgtcccagccattatacccctggagttttctgccactgaggtaccatccacgaagtcaaaatgaaactgcctgtgtgtggggttgggtaggggatatggggtagtgtgcaggaggggagagagaattttttggttttgtattttaattaggcagtgaagacatataattgtaacgagaacaggatggtgtagtacgggatgctgacctgttttttctctgtgcaccatttgcaaatgtgcattcccttcagcacttacaaatcttttttttttttttttcagggggtttgttttgaggagcttgctattctatcagagtgtccatattgagattcacttttagttatagccaagattttagtctcagattctagtacaggtactcaactggtcgctgtttgggctgctgattttcttgaggaaacgcagatatacttccatgattactataaagatgagatcatgtatgtaaagtgctggcatgtagtagatttttagtaaatgatgattttcccttattaaaaaaattttaagttatctgcgccaaacagactcaaaattcacaagtcttaaaatagattgttagcatgctaaaaataaggtttatcattttcttttatgataaattatttattcctctcaaacatcaagccagtttaaccaaagcaaatcaggtgcgaggtcttaaaagctgtgcttttcaaatttcttccttgccatagtagtttttgttgtagtgtcattattaaagaaacatgccctgttgtctcattgcggattcagatccctgacttacaagttttcatcagttcctaaaaacttttctgagtagtttgacccatcagattcaccagaagactaatatgggaaagtcccttggtgagttttagaaaactaagtactctatgaaagtacaggttattctgggaaaggattgattgtgggtagttacaggttcataatctcacttcacagtcatctttccaagttatattcttgggacttctattgttttttctgcggtccccaaaggggaaatagtttctgatgaaacagaaaaaccagtcattttatccttggggaaaagagtaaaaaatactgatagaagtggccagcgtctccatgaacgaggctgctgtgcaggtcagtgtccatctgcagtcttggatgcttctcccccgcataactaataactggcctattgactttcagatgcaccctagtttggacaatagaaaataatcagcctacttactatgcctatctgcagaaaaacaccgtgattctcagccttgcccatattgtatgataacttcacattgcagagaagaaataccagtctagctacatgatgatgaatgtatcctgttaggacacctgtgaattttatctttactcacacctttctttaagctagttcatagcaaatcatgctcttgtattggcccttggcttcaggcatacttaggaattcagatgggttattatgttagtttctgaaagcattttagttcagatatatgcttggtgtgggtgaactctcctatgcctcagaaattctcatcaaagcacacagtgtctttctcattcatgtctttgctccttcaaaggcagagtcccagccgcgctttcattgagatggtgaaaatgagatactattttagtacatatggagagatgatttgcagtttatttgaattagataacaaatgaaattgaaagggcccagaagaaagttgagactccaccatatggagaaactcttgtgcagtctgaagggcttctgtgatcttaacagagaagagaaccgagccacctagatctggcactgtgtacctctctgttcctcctgccactgccccatatggacctttcctcactgaaggcacaggtgacagtgtctgcagatgtttcggctgccactacttgggggtgtgggtggaggccagggatgcttatcacgtccacaggatggctccacacagggactcacccagcccgaatgtccacagtgccactgttgaaaaactgctgcgtggaatgaaccttttgtcccagaaaataggtttaagtaatggtgtttctagggctgacatttgggactcttggaatatcccaaagggcattttggatggagggtctcggagcccatggctgtgcccaccatgatgtccgtggcaggacccagtgcaggctttgccagcatcatgagaagggcgtgtccatactcggggcagtgtgtccaccctgcgtgggctggccagcctctgttctcgaggctgtgaatgctcacacagcgcctgggaaggcggataactcagagatgcttttctgggttacttttgttctgaggtaagagagggcagcaagtggaccccgatgggctgcagaagccggttcgcagcagggactgattacataagtgttggcagtgaccccggtaagtctggtgttccttataaaccctgctttccacagttgagcagaagacaccacagatgagagggagcccctccctcactgagtggagtcttaatgggacgtttgtgactctcccttggacacttgtactctttctacaaaagttaatattccctgagacattatttacatccggaatggggctgtgtgactggaggtcctcacctgcccatgttttttgcatgttttgtagcaaactgataatgaccaatgtcagaattatctggctttatattttgaccttgttcattagagtagtgttaatgaaggagaaagcaagttaggggctggtaccttgctttccctttttaaaaaaaaaaaaaaaaaacttactttgtgtgtgtttagggtttttgttttgtttttgtttctcggtagacatgatgtgtatttttagtgctaaagcagggctcttcccagtagcctctttgagctttggactcctttctagccaataaaatgacctgtttcgctctaagtcaattgctgctcattttctggttgcatttctttctctctgttctatttatggacctcaggtaagagttgagtttttcatattttgcagttcatggcaccatcatcatcgacctatgtaagatccttttctgttttaatctgtgtgtcttcaatagagaaaacatggttttgtgtatggtgtatgtatgggtttgtttttccccataacatttttaaaaatttatgtactgtaggctgggcacagtggctcacgcctgtaatcccagcactttgtgaggctgaggcgattggatcacttgaggtcagaagttcgaaaccagcctggccaacatggggaaaccctgtctctactaaaaatacaaaaataattagccaggcatggtggcacgcacctgtagtcacagctaattgggaggccgaggcacgagaatcgcttgaacctgggaggctgagatcacaccactgcactccagcctgggtgacacagcgagactctgtctcaaaaaaaaaaaaaaaaattactgtaaaactcactcttggatgtatagtcctatgtgttgtaacatatgtatagattcttataagtaccaccacacatgggaccagaacaatgccaacgttccaaagaattcctgaaccatcccccgcccatggcagtcactgatcagtccttagcattttggcttttccggagcaccgtagatggaatcacacatctgttgttagtggcttttgttagtggcgtttttcagttattgtcatgcctgaggaatccttccgtgttcatgcatgtgtcacttgtttgttcctttttactgttaagtagggcaccagggtgtgtataaccaggtttacctatcgaaggacatgtgggtgtttccagaatttggtgattatgaacagtgttgctatgaatattgatgcacttttttggtatgaacataagtttttcatttttctagagcaaatacttatgagtaggataggtatttaatttctatttaatgtctgtttaattttccagagtgcctgtataattttgcatccccaccagcatttggggtactgtcagtaattttcatgtttgccattttagtaggtgtggaatggtatttcattgtagttttaatttgcatttccctaatgacttatgatttttgagtatcttgtcctaagacgcttactatttcccgtcagtactctagagtttggagtaggatattcattttaggtaaatgctaccatgtgggaatatggggccgggcacagtggctcaccctgtaattccaacactttggaaagccgaggtgggaggatcacttgagcccaggtgttcgaggctgcagtgagctatgattgtgccattgtaccccagcctgggtaacagagtgagacactgtctatctcttttattagtaaggaaaaaatactaccgtgtggttgttcggaatagccttaccagctaaatgcctggtttagctgtgggtttttgtttctgtgtttaagtaaaaaaataaaaacctttaccgatctacaattcacccacttaaaatatacaattcaagagtttctggtatatcacagagcggtgcagccatcaccacaattttagaacatttcatcccctcgaaagatactctacccatcatcattcacttcccatttcttcccagattcccgagtctcctttctgtctctatagatttgcgtattctggacacctcatataagtgtaattatagaacatgtgtcctgttgtgtctggtttgtttcacgcggcatgttttcaagggctctgttgcagcatgtgtcaatagctctttttattgctgaataatgttccattctgtggatagaccacactttgttatctatttatcagttggtggatatttgggtttttattttttggctgttgtgaatactgttcccatgaacattcgtgtacaagtttttgtgtggatatgttttcctttcttttggatgtattacttgggagtggggttattgggtcaaatgtgttttgggagcccccatctgaattgggttccagtatcagagtagctagcgacccttccctaaggggaactgaaaggcagctggatgtgggtgatgaccgtgtgcctttcacaggatgcttcttttacctggtggatgggctcacgcataatggtctgagccccgactcgggaaacttgtttatactgacggacacccctgtgggtcttgtctgactacctggccatcattctggtgctgggagtccaaccttgtttgctcccacacgtcctggggtaatgtggttggttcttcggatggagggtacagagtccgtacaccatcacaacaggaagcaagttcaaacatatattttagaagatgcttttgaaaaatggctacataatgattgtacagatatctgaggtacatgtgatattttgatattacatataatatgtcgtggtcaaatccaagttcaaagacttattacttacatatcctgggcaggaggcagtcctctgtcctgggttacacaaggcaagaatgaagagtcaggcagagagagagagcgacagagagagtgtgcacaactggcagtatacattatataagagggaacagggcgtggggctctgtaagttctcgggcaggcctgagtgttctgtttaaaggaagcagatggaacatggggagctcagtctgctgggtgtaggagatgcctctaagttcttatcttggccagcgagctgggccttttgggtgtggtctagaactggagaccgtgtcaagggtgactaagccctgcttctggtatgagaaagttaaacttgtattcaaaatggatgccaaggcaacataaaatttgaagagtttactgtaatatacaaattttatgtttaaccttttgaggaactggtttttttttttgtttttgaggaactgttgagactgttttcagtagtggcttatgttctcatggtagtgaatgaaggtttcaatttccccttgtttgtttttttaaaattgtgttaagcagtatctcatggttttcacatgcatttccctcatgactaatcatggctaattgtgttgagcatggtttgtctacgttcttggcaacattgatactataaaactttctttcaccaatctcttagctataacagtattttatgtttatttccatttctattaatcataactttgagcatctatgtatgttcttaaccattaggattattctgttgaattcatatctcctaggaagttttctatagtttaatgtgtttattacatgtgattatcaaattccctttcaattttctagtcaggaaataattgtctgataattaggcttatgaagtattgtgaaactaaaaaagggtgcccaaaactatatgttttggcctggtagccacattacaaattaattcattacaaattatttctagtctgtgaacaggagctcttgtgagtctcaccagcgctagtcacattcctcaagcttgaccatccctttgagaactgatgaaacagctttgaaattggcaaagctgaagaatggacttcaaagcagagaaggtgtgaattgttttaagtgggagcttcatgggaataaaatatgaggcgtggccctgaaggttagtttgtggtatgttacaaagttaactcattctgatttaagaccaccttttctgagagttaggggaaagtgctttttctctctgccatagctcgtatggcatggaaccagacactgtgtacacagacatgcccctggcccctttaaaataccccctgttcctcccaccctcactttcccggacaatagcaataagtttaccaagaaagatctcatcttctgtcccaacagaaattctaagtagcatttctgctctccagtggggcttgtggtgtaagttgcatttaaattggcattcttttctgctgaccctgaaaggctagtggtttacttgtaggcaaatactcttgctgtttattaacatacattcttctgtgaaatttcctactatgtttcttgtctcttagtgttggtttttgataccacaggtgtgttctctgactttatcacactagttttaactttgaagcgtcctctgttggggaaaaaaatccttgattttaatgtagttaatccatcagtttttcaccttatatgatttctgcttttgggatcctgtatacgaaatacatcagcttctcataggttacaaatatatttattttttttcttctattagctttataattagcctttcatattttagtatttgaagtagcaagaagcggtggggagcaggaagaattctgggtagctgggaccgtcattgcaggctacgtgtttctttatatttttgagtttattgtaatgtcaaacacttgttatgcattggtgtttgaattctcctttggtactttccctgttgcattttgggccatgtgggtttatgggataacaccacttgagcttgacttggtggaatagaggttttagggttgggggaagagatctgcaatgggcttttgggaagtgtcataaaagaagctagagacaagacctagttagaggggaggctgcctttaccatcacatttctgtttgtctcccgccttcctgactctgtgctctggagatctggagacctggagacctgcctcaggatatcccgtcctggctgggaatgaagccagggagtgtggtagtctaattttgggctctgtttcctcatctgcagacactgggcatacttgtcttttaagttatttgcagtctgtaattgatttggctcagctggccctaagatacggtattccttgtgtaaagtcagagaaatcagagccaaagataattagagctggaaaggccttcagaggtggctagcccttatctttctttctctaggctagaaaaccatggcccagagaagctgagtgatttccttttcttctactatcaacactaggacaaatactcagattccaggcaagtgtgaagcgttggccctgtgccaggagcccgcaggcctgtcttgctaatttgctcaggctttcaaagcttttgcagccctttggctgttgagctgggatttagggccagagtttcctcattcctggtctaccgttagcttccctgcacctgacggttgtcctcttaagtacttctcccccattttcttaccggattccctctctccagtggtgtgttctccttctacagagggtatttcagatatttattcaatagttcagccattttacaaagttgaggagggagaatcgggtggagcagacacagtggcactgccttgctggaggcatcctcgctggctctcccgcccagctgcacatttacagaggcctagtgtcggccagcaccgtcctttgcactcaggcctctgctcacaggtcagcacgccctttgcatgtgtccagtgaggttcccctgaaagcctgagcaaattagcaagacgggcctgcgggctcctggcccagggtcaccgtttcacacttgcctggaatctgagagtattaggtcacatcttcaaaagactgtatttgtcctagcattgaattcttactcacggccaccgtatttattgggtagttcagcaggagaaattcttgcctaacacgtgtccgtggttttagtgcatttttagtgcttcgccgatgctcacctctgtactcatatgtattaaatgattgaatttgaattggtgccggtagctgtgccccactttgacatagatccggaagcttagccagggtccacaagtctgtcctttgtgtttgagtgggaaattgcactgtgtgattgataacggaggagctgcttcggctacgggagacattgccctgtgagctcggcagggcagtccttgtcctcccctcctgtgctcgcatcagctgctgccaggagcctcgttttggttttgtggtcctgcaccttccttcgttagcactgctgtgttcctcacctgtggatgttcacggttgcctatgaatctgggcggtgattccatttgttctcattgcagccgttccagttattaggaatccagctgtctgaaaagctgtatccttcctgacgacctgtattttatttccttgtcacctttgcatcctagcacagggtccgtgagaacgttgctctttttgtctgacagttcagacccgtcgggctctagagaattgactgatgtgtttggagttagttcctagtcgtttctggagtggtgactggtttagatttttgccttttgaaaagctactagacgtaaaacttaattggtgttttggcgagtccttttgtctgtggcagttcatctttagagaagtaaattaatttgtaggtaagctttttctccttttttgattggctatctaaaacatatatttgaatcaaacttttaaaacagagatacagaaaactcttcatgaaaagatttttttgtcttcctttctttgtatgtttgatatacagataactgttaacagtattctgatttccattattcacatttctgtagtgacaaggatcaagtatctgcaggcatttctttgtcccgggaaaagcagattttttcaaggaaatgatgtgttgatatataatagaacatacataaatacttttgctagctgtgcagttagttagaaagtgttgatgttttgacattgggtggctgttggtcactgcagatggaattgctgaaagaaatttacataacctgttaagagaccaatcattgttgcactagattaggtactcaagttagtttacagaattttgattatttttggttggcttggtatgagattggctttcgattatatgcttcaattgggtctaatgactcttccctgtcattgtaaatggaatcagtggagataggtcaatgacaaggttgattatagaccagggcttacagaagctaatcatctgcagtcttcatttacatacatgcttctgctgttggcttccagccaaggctggtgtagtatagtacatgaattttggagtcattattgatcatatatttccaacaagtgtgatgaggtggagttggcttaagttgaaatgtttagtggaaaacattggttcgttaaaagtagcagtggatctacagctcttttttgagaatgaattgctattatgtttgctgtctacactgaggtgtggcatgaagcctttctctcgtctcctttataccttggtggatctgtgtttccggacacttttccttttgaaagttgagatcccgttcagaggctgacagacttgtccctagaagaaagggggcataaatatgccaaatgcaaaaccacaatgatttctttgattacagggaccttggggccagcttgcggtaagaacttgcctttagaagatcctttggttcccatcagtgtctccctctcctcaaagggatggcagcccagtggacagtgggcacatgaccctgacatcgacagactcccacggaggtaagctgctctgtcagcgtcgcccagacagacgtgcaccttcctcatcagcccgaacctgcctccatccacaccttgtgcacatgtggatggagtactggaggctgttgtttctctgcttccagccaagggtagggatcagcgacctcaggtgaaaaatagcccttcctctcctgggcttagaaatgaatggagagaaagcaagctctagcagcttcctcctggttgaggacagggagttcccctgagatagtgctgtgtagatagtcaccgacgactccacagctttgtgtctgcccctcaccacacagtaggcttcattctcaccatgaaccactgttgtcatttggggacaagttgaaagagtctatttcccttcttgcattaaaggagaaactgtcagcgggattgctgttaaccactgtggtggtcaccacgacctgagtctcgtgctagtgtttgagagactaagctctgacttttctagaaggtattattccagatcctgacccagggaagaggcatggtggaccagaaatctgcattttcccagagcaaagctacagactggaaaatggattgcaaccttgcacaggcttgactgttgttgacagaagctctactttctcctgctctgttctcttattattaaagggatggatatatcagaacaagtgtgtgtttgttgttttaaagtttgttttttttttgtcttcagttaagttaggctgcagggttgagagaagagaaattttcatttgtgtgcttgggaaaatcaactaggaatgaactttcacttttactgtttaaaagtaaaaatatctttggaagctgaggaatggctgctgggagaagtcgattttaacccaaatgtgatctttctgtcttctccatagacttcacatctccctctgggacagtaatgaggagagagtgtttggccatcgcaggtgtaggaggtggaggcagattctgcgtgggtggcttctgtcaacagacgctggactgtgcagggcagctgcagtggttctggctggttgctgtggtcagtgggagtcgtggcatgttcctgggggcagtcacatctctgaacatttcctttatgacagttagtgcagttttaaaaaaggaaaaatcttcaatgttaaccttttttctgtctcttatttctaccctttaagattatctttatgacttctaaggatattttaagctcacagtcacacttggaagcagtgcccttgtaaggctctgcctagtgtggctgtattagaaaggtcattcctggttcttacatgtgcttctcctttccacgtctcccactggcgtgctgactttccaaggggaacgtgaagctgtccgcagtccttgcccttgccctttcttttggagactgtgtgaatgagcagcagccactttaatgtgaggcagccatataaacaatgaactttcacttgctgccaggaggtcataaactcaaggtcaccaaatgaattctagcttcagctcttggtttagtaatgtaccaagtttggtattactttttgtttgttttaatcaggtttctgccctcatcttctatttgggaaattaaaactggtctgttggcatggctggtgactgagcggcaggcacattcttagtctctgactttctgcagccatctttgagtgcatataagtgttgggtaacagtctactgaatgtgctacaagtgtgcggagttgtgttcatctttaacttgttttttttaaaaaacactctcttggtaaattgggatctcctgttgaaaactgtatttgtttggcagttgagtttatgcctggagcccctagagcacatttaactggttggtggtcagttgtaccatactgaaaaaaaaaaaaaaaaacacatggaaagtatttctaatatattcattatgggatgtgtgagcccttaattacctgaaaatctgaattgtctttcctcacaggtagtagtcctctcaggtgtttcctttttaaaattgtaaatggaatttcacatatccaaagaaattaggattcccagtgctgtcttctccctctagtagcatattttgtgtcttagctttctgttgttataacagaaagactgggtagttaccatagactgggtgatttataaggaaatgtatttttcacagttctggaggctgaaaaggccaagaacatggtactggcatctggcgagggctttcttgctgtgtcatgacgtggtgggaagagcaagcaagctcgtgcgaaggagaaaggcaccagggacaggacttgctgtataacgacccactctcacgataacaaacctgttcctgaagtcaccacattaatacattcatgagggctccgtccttatgacccaagtacctcttataaggccccacctcctaaccctgtggcattggagattaagtttccaacccatgaattttgggggacacattcaaatcgtagcattatgactgtggaagtcattttgtttctaaaggtctttgttcccacttgatcctaagaccctgtttctagggctttaagacctagagtaaggtgtcagtcttttcctcctgccccatcttttatcaactcattgattcctatgtttactggacccagctgctctgcttcgggccaggaacgcagataggaacatagcagatgtggccctgcacccagaacttctttggtgtagtgagggagagagacaaataaccaggcagatgtcaccctgagtaagtgcttggatgatcagggcagggttgtcctttgggaacacaggacagggaaccattcaggacaagaggccaagaggccagggttggggcagagtaagacggggcaatagcttcctggattagtttttagagttttctgctggcttagggttggagagctggggcagcagcttaaagaggggaccctccaatggcataggggactctgcaagaacctccggcagcagcactctgggtcagagggcgaggaattgggggaaatttaagaaggagatattaggaaaacttcttaataaaggcaccaaactgatagggcaacaggggaaagccaaatggggaccttgggccgtgtcggagagcagacagggctaggggagcagcttatcgtgcttatctcaccgtagagatgatacatgaggattggccagtgtcagataactgactttattttgtaaaattttttattgtttttaaattttttacttaagctttatttttaatttttgtgggtacacagtaggtgtatatatttatgggatacatgagctgttttgatacagataacctatcttgaattgtattctgccaatcgattctatcatgtacctaatttttgtagtttattattcagataaggtggttttctgctcttaaactgggggggctggggaaataagaattttcacttgaaaaattcatgttctaaaactttgacataggtaggttgcagcctcctcagttcctggggctctcttctggagtctctctcgctgcccctgccctcctggcccccgccccacccctggctagccgaggaagaggaggattgggccttgcacagttgcacagtgcctgtctggagcacaccacagctctgtgaggagggagtgtgcaggttcagggcgattcccctcctggggtttctcagctccacaggccacttctgtgactccgcggtgaggctgtgcaagcgaacccgacttcagttcctgaaaactgaattgtttttagtcactttgcttaattatagactaaagagtttgaaactacacataagaggtgtaaataatgtgatataaatattgttggaaccctctgttgtggtttccctttttttcccccttatattctcatttcatttcaagttttaaacagtaacttgaatgtgtattggccagtgtgacatggacgcgcatgttttactcatcagatgtagtaagaaaagatgtggctacttaagaacattgaggtgtgtgactttaaaagtctaggtgtgtcattaaaaagtgtgagcatcccagtgttctcctgggtctctggaatcatgaaatttgccactaacatcacttacactgtattttattaagttgggcctacccagcacttgcctgtgtgctaaatctaattattgtcatagttgggcttgtggacgggttgggggaggatgggaggggaaggaaggggcgaggtgtgggaggaggcatggcagaagggtctcagactgactggcgagccgatggtcacgggagtggtggggggtgggggtgggaaggtttgacctaaggtagcgtttccataggagtcccattctttgagatgttagtaggtgccacctggtctcatgagtttggacgcatcaggtttagcaggtttctgttacagtattctcagagcttttgggactctctaagggaggtttaatatgcagcatttcctgacagtatttaattgtgggacacccctcccctctctgaatggtaaatttcaattccatatcaagacatggcagagccttcttaaatagcttctccagccaacacacttgggaagatgaggccttaggaaacgtggtgaagaactaagtccagagatgctaagtgcagtcagtaatagctttctgtgggcctcctgctcatttgctgtggttgaaatgcatttcttaaaatgtttgtttttaaaactagatgaagtgacaaaggaccatgaagcattaaataaaaggcaattcctgaaatagcatattaatgttttaaatggttttgttttccagtaaatagctctctgagtgatgcagtgggatttgagagaaaagaagctgcaaggtatttgtgaatgtcctgttccttaggaaacacaaagtaacactagcacgcacatcacaggagctgaaccctgcagtaggttaaaatcttcagcaacagattgagagattgaggggattaaagggttctgattaacactgtgttatcctgaaatctttttgtctcaatttttcgtgttctctgcctcaggtgggtatggctcacgctcctgcatttagtcctttcagttaagaagtcagtcaccgttgggagtgtggaatgcagctgtgggcaggctagtgacctctgccctcagctttgggcagcaagaccttgtctttgctgatcagggcttccagtgcttccgctggtccttccttacctcggctactgatcactgctccctgcttactcttggaacactcttctagtccaagcctgggtttccagtctctgcacctggcctgccccctctccttctcagatccacacagggaagcgatgacgcaccccacccctgaaatgccccatggaaacatgacattccacctgccccatcagtgagttctttcagctgatgagccaggactcagtgaattagtcagaagttaccttttccaagggattgatgagagggtgcttctttccatacgcaatcactccaagtgggaacacaccaggagggtgtgaaaatgcaggtgccgcatccccacccgactgacctgatttaaattcccaaggtgcgggattccctctgccgtgcgtctgggaaatgtgttcatgccttgcaagtgtgaatgtgtggagaacattaggcccttacttgaagctggtttttttttttgagatagagtcttgctttgttgcccaggttggagtgcagtggtacaatctcggctccctgcaacgtccgcctcctgggttcaagtgattctgctgccccagcctcccgagtagctgggattgcaccactatgctggctaatttttgtatttttagtaaagacagggattcgccatgttggccaggctggtctcaagcgcctgacctcaagtgatccacccgcttcagcctcccaaagtgctgattataggcatgagccaccgtgcctgcctgaagctgttttcaaaggaaccgttgaggatggaatcatgaatggtttcttggagacagaaaatctggagacagagttaccagaacatttttccccagtggcggtctgggatgcctcagcctggctctgtcctgttttcccttccctttctgtcccactggctcctgctgtgtctgccatgggtctgcagacaggaggacatgggcaggtaatgcctcctggattcttgtgcagggtgtacagtggggagacggcaggggaggagggacaaagaaaccattctctcatgtccatctaacctgatagccaggtgttcagttccaggccttgggcagccaggtccagccctagaggtcctcacacaccactctttcacttgcagagaagactcaccagaatttaggggctcatcccaagttacaggatcccattctttcccaaccaatgccctcattttaccagcagacaccccatgagtctgggaggtcaacttgtaacttgtcattcaaccaatcacaggatgaggtcctggctttgcttttcagcaatctcagcccagtgactgtaggaggagagactttccctccagccacacctagctgctcttagatgatttgatgcagtgcttgagctgagcatttgaattccttagttcatcctagtctttcaccactttgtccagtgacattaggagcaaccaaccaacatcatattctcagtttttcaaagatgttggaagggatcatacacagagttaacttagacccttcttgtaagtctttcgagtatccagtgcagacgtctatcatatctctatcaacagttcaaacaatagaccatcagtgctcagctaactggacacaacatcattagcatcttaagatccaatcagatgagagagccaattccagaaactccaaaaccaattcagaaaatgcatccataagactttgttcctctagaaccactcttggtaccaaaataggtgtagtggggtgtgggcttgggactccctgaagtgagttggtggctcagttgctgagtgcagccagtcccacttggtctttcttggtgaattgagggtagattcctttagagagttagtgttacagttcacagcatctgtccccaggacgctgtaccctgttgtttttccattgctgtgccagttttctctgtacatcctggtatccacccagctctgcgccagggatgggaggaaggtgccgtcttcttttatctaaatgagagacaagccaatgggcaagtccagagccagggtgtgggtggtccacagaatttgtgttagtggctggagctgccctcctgagctttgccagcagggcccaggtctcctgagccacctctgttttgggagctcttgaattcctcaaagagcatgacaggtcatttgaggtaagcagtgtgagattgggacaagaggttctgacctctctttcatggcgtcctggttttcactagggcatcgtcactgtatctgtgacatggaaggcaaaacaagggaacagaaacattggtgtcttactctttttgatctggcaggcagggaaaaagaaatgtgccttataaattttgttcatagtctgcctggagtttgtggtgagagaccataaaccaattcctaacatacgtggttagtcctaccttcataagtgctgcggagaaaactggggcacagggaggcttgggtggggcttctggagccctcagtggaggggtcagggagcagctcacagggagggtggctttgaggcagaccccagaggaaggcggtgaggaaagcaggactgtgccgcgggcagggaggtggccagagaagaggtgtgccgaagagtgggcctggcagctgaggggtgcctgtccctggggctgctgggcacctagcctctgccagaatcggaaatgggtttcttgctcctagaaatgcgggtcccaacactgtcctactctaatctcagcatgttaaaacttggagggggagagtaggatgtgtacccgcagatgatgtggcttgcgcatttcactgtctgttttgtgacttctctgcgttgttttcttaggtttttggctggtgattttaaacaaaattgatttaagagttacttgcaaatgtctgtcctgtttctgtgccacttctgttttcaccatttgttggctccgattaatcaactctgccctctaaaggaatgggttttgggtttgtgattctctttaagtggtgcaaatataataagcagagtctgcaacattttataaacaggatcacatgtgcagctcattttagtggcaatttccccagaggtttgtaagttggatttttattgcattgaagagggggcacagtgttctttgagaacagccaaatcgttgatctcgtgtggggacacacccagaggagcccttactgggacatggagggtttttgtctggtggccattgagttaccctagtcattggtttctggttgcgcagccacagcccaccggggcccagtgacgctggggacttctgtttctttgctcagtagcctcacgccctcctttgatgtggtagggcagtcagagttgacttcttttttccatgagaattcccttcctctaagcaataaacaaaatctttatccttgtgacttcagtttggattgtggcaattctcccttccacttttgctgcctcgccaagggttggaaatctgacttgtttattccaaacatgaggattctctggttcttacgagcatgcttgccacctcttgacacagtcctcacttccctgcatcagtgtctgctcatctgcttaaatcatcccacccatggctccccacagggaagctggagacctttgtcccctcccgcatgagtgtagggcagccatgcaccaaggcttcctttgccatttggaagtcatcggctgcctccctgatcagtctggcacagctgcaacttctgggagagggagaagcacatctgttttctctgagaaaaatctttagtgtgcagggatctgcccttgagcttttgtggaatattgaaatggtccatggagcccgtggtatcagactgtagtgggtaaaagcaaagctgtttgcttttgggtggactaaacacatcagcaaggacgaaacaaatcagcaaggaaatcttgctgtgaaatcacaagggcgtacatttcatttcgcaatcaattatggggtaaaaattgtaggcttagtgccgaagataatataaaagatctgctttgaaatgtgtccgaggacaaggactatgatccctttctctctgctgaacacactgtcctagtgtaactgaagaaagcccccgaagacatttggcagcttcattttatgtttttctctgtccagaaagttgaatggaattaaaattccaattaggctaaatattttacttctccaaaaagaaattcagctctgttttctggctaatgttacctataatttaaaataagtattaatggcatttttagttctttttgtctcaatatgcacattctgcaaatttaaacctcttgtctggggtatctaaacacatctgatatatttcaataaaataattatgccatatgctttcttttctaaaacttctatattcctgagtaaatttctacaatgtggcatgatacaagagatcacaaatgttaattagattatggaataaaggactgcaggtaagtaataaaaggagatttatttccagggaggcaaatcaattctccttcagcagttcttgtaggacagcatgacttccaggcatttgagtaagtaaagacacctgcttcaaaataaggaaagtgggctgcgggaaccaggcccctttcttgaatcttgtctggtagtaacaagttgtcgtggttgttgctgacatcggacctggtttgctgggtgctagacggagctgggaggctgtttcttggagcccgccatcctgttgcctgggttttatgtgctgccacagggtcatcttcaccgaggcgttggtggtggttccttctgtgctggatgcggcgaggagcagctgtctctgcatccctccatgggtcgcagacccttctcctgggcctttagctgggtgtttgtgccccggggtgcctcagtgcgggtgcccttggatttgcatgtctgaccctagtgcagtgtgactgtttcagtagctctcggctaacaaacttattataaatcaagaacacattgatttacataactgacagttccttctggaatagaattgtgcagaaaataaaaatgaagtagcaaaaggtaggagggaagagaaccagagggttccaacactagaaaaaaaatgcctcaggacaatcaagcgttgaacagacaaccacagtgaacagtcccttcctttggaagctgtttagcttggggttaaaccccatacatggcagtggaaatataaatatgaatttgtcacccatgcatttgaaatacagcatttgctgtttgtgaaccagctcattccataatttttccttataatactgttagaggcacttttttttttttttttttttgagacgagtctggctctgtcacccaggctggagtgcagtggtgcaatctcggctcactgcaagctctgcctcccgggtccacgccattctcctgcctcactcagcctcctgagtagctggaaaaacaggtgcccgccactacgcccggctaatttttgtatttttagtaaagacggggtttcaccgtgttagccaggatgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnccgtctgtactaaaaatacaaaaaattacccgggcatggtggcgggcacctgtattcccagctactcaggaggctgaggcaggataatggtgtgaacccgggcaggcggagcttgcagtgagccaagatcgcaccactgcactccactccagcctgggcaacacagtgagactccctctcaaaaaaaaaaaaaaaattttttttttgcagaataccgttaagtctttattctttctcagacatactttctgacttggtcttgtttggtctctttcggctgggtcttgaaagaattaatgctaagtcataaaaaatcactttttttggttttcattgatatttgtaacatgttacatattgacattaagattgtcatctagcagaacaatattgtaattattagaaatactccacttttgcagaaagaacacgtgttactagcttcatagcaagatgatggcatggaacttatctgacttggcagttgatgatcatttactgtgatgtttgctctttaatgaagatggatggggaggaaagaaaaaatctctctcttgcctcccagggtactttttcctgcttctctttgttgtttcttttcttttccctcagatttaggttatttgtagttgtatttccctgattgctttgtaagcatccttaagtttaagcagaatgtttttattcctcttagtatctgctagaatttaagcacagaaacttcccattagcagatttaatgtgtcaagtttgtgtttatggaaaagaggaacatctctgtacatattggacgcgagcacacgcacacacgcaaccctttccaaaagagatggtctgtgacataaatcccaagaagaatgttttagggaatgcccagtgttctttccagtttattaaaggggatcaggagttcttaaaccttgcatgatggaatgaggcacgtaaacctttcaaattacaggcaattgttttcataaattgatgtactttttggacagtcagattagagttcattggcttctaaaaggaaatcagttaaaaattaaatgttaagaacagtcaaagtatttttcttactggaatcctttagaaattaatagtctgtgaatttttttttcttgtggttcttatttaggcatctgatgcaatgtcaggaaatctggatttgagtcccagtttctctccttccttgccatgtgcaggcatcttaatctgtaaaatgggaagaggctgattacctaaggggagacaggatgattgggagaatccagtggagttctcttcatgaagtatttagtacagtatgagttgctgccccatggtactaatataagatggtggtatggatcctcccttcttgaccagggagagaaaaattgtggggttgttttcttcctaaggaagcctgtggccaccctgtgtgaaggagaatgaggctttcctgctttcccagctcaagcctcttgaaaagcctgcatcctgcccacctgggggtgggctgtgcggagcaaatcctgaggattgctaggggtgggccggtggtattcgagaaaaagagctgaaaaagatttaaatacccggagactctcatacatcacatactcatttccaaaagcacccttttttcctcccctagaaagggccctctttgggccagcccctctcactagactacagcttcctatcgcagaaagggcttcgctcttcacacatagaactgcaccctcccactttctaggagttctcatccttccttaataggaacctcttcctcctcctcttcctccttgattttggcattatgttgtgatgcccttaaaaaatactgtgccctgaaggagttgctaaaattaccagttccttcacgttttggaattattcaagggcaaaaccatttgagcctcttgcgatctgttgatttgtttacacacacacacacacacacacacacacacacacacacgcgcacgcactttaaaggaggtgaattgatctatttcttcacccacccttttctgcctatagtttttattctttcttgagtaaattttattaataaattattgaaattgtctaattctgtatgttcaaatttactattgtaaaattttgccatgtgttttatttgcattaaaaattttttcctgtccttttattgctctattgcaaatggatatgtgatctattttttccttggttatagtaactggaagttatctattttaaaaatgattggattcatttctcatcccaatatttttgattatttatgcatgtatctttattctattctttgctttccttcttagacttttggattgaacacttagtattttttttttttttttggcttagtaatgaatgtttgtaatgctgtgggtttccttgaaataaatctttggctggattgtatagcttttggtgttgcagtgtttccagtattatttgtagctaacttgtagtgatggtttagatttttttctttgatgtgaggatgtgatccagtaattttcagttgcttcgttttgttcctctttgtgttatttcaggttttatcgtgcacccctatgtttaagttgatgttgatgttacagcggcctttctcccagtgaacgtttgttgccagcacaagaaaacgttccttgctttgaagcacttcttcctgcatttggggccctctggaagagcgaagcctggggtctccctccccgctccttttcctaatcagcagtgatctccccctaccccatgctcatacctaaaaatagtgactaagccacctgttgggaacttggacattagtttagggtcagcagagaaggcattgctcgcagggagatgagaaggggtgtaggtccggtgggcttctgcattcttctgtaagggggctagctgtacccccagctcacgggaacgtggtgaggactggtgacatgatgtacgccagaaacccagcgcagtgcctggcatctgaaagggaaggacaaccagtgcttccctctccaccctagcctgacagctcccccggctttctgtgctgggctggtccccatgcatctttgcagctctctctcgttttctccagagaacacttctcattctccatctagcctctccttcactgtgggaagcctcctcaggttagtaggcaatcagtagtgacatgatttgctacagaaactccagtgttctgttttttttttttttttaatgtaggctgccttccctatgggagtgggttggagacgttgagctgctgtgtgcctaagttggacgtttttgtttgcgaacacaagggaggatgaggccttccttccacattgtccaatccgggttttctccaacactggaagctgtcactgctggctggttcttttctaataatgatcacctgggagaatggaaggccggcgcctttactccacattcatcacgtggaagctttgaccctggacgttagtccaacttagtattgtatgtcctgcccccacccctttaattgtgttgctgagataatgtaagagttcaaaatgcagtttggaactagggtagtacatgggaagagtgacccacaggatgtaatgttttccggtgaatatagggtcctcttattaactaaagataataagtgatagggctggactttatttacctagggtggcttgcatatgatcaacatgccctttgagttaaaaatttggcaatagttcacttgtcaggaaggaaaaactctttttctctaggttaggttcagcatttggggcctgcagattaaactgataagtgacatattaatgagagaaaaaggtttatatctgtgcacacaggagccagcaaaggaagcagctggcttgctgaatatcccaccagagtgtttcctcaatgtcacagaaatgcaggcacccatctccactccctcccctacctacctgctgttgctgtttgtcctggcagagctggctgtcttgggtgcagaggaggacaccatcttggcttctggcttctcttctttccatgcctgtccactgtgggtgctcatcagtgccacttctagaaccgttttgggcctttccctgaccttctgctttgattttctcattgcttttactttgcttttctcctcgctcttactttccttttctcctcatgtatttgttgttgtaggcagtggctggtcatttgttctattagcacaagtttcgctgacttcccattgcttattaaattaactttgaacaccatcagctggcttcaagggtgtccctctcattcctagctgccctctgcgaacaggatttttcctcctcttctccacctgagcctgtgagaaacacaccccctgccccaggctggcaggtcacagcccttcagggagcagctcaggtgccgcctccctcctggaggttagacggaccttcgtgagcaaccaggtgttccctgtcttttgtggcatctgccactggctgtctgatgctaattatttgcccacttttctgtcattagaagttcctgaaagccagagccagggtgttactcactctgcgttccccctcagccaccctgggtacctagtaggtatgttatgtgttagatgaatcagttaagaaatcctagcgtctgtgagcctgaggaacaaccacataagcttttccagctcaggaatggttcctgcactttgaagatggtcaggggctgctctgaaggtaaaataggcaacaggcttggatttcttccgggttcgcaagcctgcagttcagacagaggacactgtggagttaacacagtaatagtggttcaagttgatgagtcttgctgtgtacacggcctcacttcatcatcatcgaagcccctctgaggagcatgcacattagtcccgggggcaatgggaagtggaggctcataggcgaggccttgttgtagttgccatcagagctggcctgagcctggatgcaaaccaggccttaaggctttgaggccacatgcgtcatctgcgcggaaaggtaccttttacaaaaactcacactcttaaggaagtctgtgaccccgtgtgattttaataaagcccgctgcattgtttatacctctcggtcttggcctttggttacagctggtgaaatgtggaggctgccaagggcatttcaggtgcagagcagagttgcagtttcgaattcctgttttaaaatcttcactgttagctgtgtagcatctgccctttctcgtttgtctttttttttaaccttggtgggttcgtgtgacctctgccaagctcctgtgagagttgttaatgtgggggccctggttccggtcaatgattccgggttcttaggaggcacttccaaatactttggggcaagtttgcctggaagtgctatggttattgatagtatgtctatattaaattaatttctgtaagcaaaaattaccagaagcaaaagctagtgtttgcagctcctattacagaaggcgaactttcccaatatgttaaaaactcctactttaaaaaaaaggtcagtaacccaatagaaaaatggacaaaggatatacacagctcacaggaaagaaaatatgcatgactcttcaatatataaagatgttcagccttacaataggagaaagataaataaaactcccctgaagcatcctttgtgtatgaatgaataactggcttaatttgctggggctgccagaacgaagtagcgcagactgggagccttcagcaggaattcgtttgctaataaacctggaaagatgttggtagggtggtttcttgggaggcctctccccttggcttgtggatgaccgtcttctccctgtgtgctcatgtggtcttcccgtgtgtgtgtgtgtgtgtgtgtgtgtgtgtgtgtgtgtgtgtgtgtcttcatctctttttatgacaccagccgtattggatcagggcccaccctaatgagctcattgcaactcagtcacctctttaaagagtcacattctgcagtgttgggaattgggactccaacatgtgaatcgtgggtgtgtgggagagggaagcacaattcagtccataaaaatgaccaaaaaataataataaaataaaacttgatgacactgtggcatgggaaagggggaaattagcaccctcagacactgctgaggccatatatgggacagcctctttggagggtcacttgtcagtatctgttaaaaattcagatggagtcccttcacccagcaggtctgcttccaggacccagcaaaactgacaaatgtacagctcttccttgacacctgggccgtcagagcgaaaaatggaaacaatgtgagctcaataaggcatgggctaattatggttaaaaaaatgaggaagtcctttacatatggactgctctttaagaaactttaggtaaaaagcaaggtaaacaacagtgtgtgtagaatgccaccgtttgggtaaaaggggggtaaagttttgtaggtatttgctcgtatgtgcataactatttttctctgaggttacattagatgtcgtgatgacttgctggggcagggacggttggtttgctgggtaatgggggcccagggtgggagggagacttctcactgtatatactttggcaccttttaaattttcactccagaatttattaattaaatgaatacttttatttccctgatgagaaaattgtatcacgaggtcattcataacttaggttatttgaggttgttgaaaaaacatgaaattatttcgattaaagtcatcattgtgttgagaagcctgctggtttatttttcttggggaatgagtgcctcagaagtcatggtttggaaggttttatgaggacagtggttccacatctgcaggacagagctgggtccttcccggagaacaggctgccactcagacgctcctgccatgaggcctctggtgcagaatacgtgaatcattgtaccaggcttcattttgcttagaaactacttagaattgttaattgggcccttttggttttaccaggttattcagaggcatttctgggtgatgatgttgataaagctgatagcactttgcatctgttgagcaccatgaattttgccaagtgctttcccactcatgatctcatttaattgtcacttggaactgtgaggttggaagcaccgatctgattcccatcttgttgtggatgaagaatttagagggtttaaatgacttgcctgatgtctcctggtaagagctggtcttcctgctgcaggagtttcagtgtgtaagccaagacgaggaagaatggctgaacggtgcttctggtcaggaaccatgtcagatttgtcagcgtccatcgtgggtgtagttcagcggttctctgttgggtgattttgccctctgggggacactgacgatgtttggagacattttcagttatcagaacctggggtgtgtcaccggcatctagtggacagagccaggggtgctgctgaacaccctgcagtgcatgggggaggcctgcagcagagctgagcagctccaaaagtcagtgctggggtggaggatccctggtgtggctgtgaaggagagccttgcctgcagcccccaaagcttgtctcttgctttcccaagcttatccgtgtgttcacctttgaaggtttcttccttaggattggtagtggtagaaacgattctttgggatctcattggaggcacatttcagggccctcttctggcgcccatgttgactgtctgttgtcctaccttcccagtgcagtgctgcaggggtgtggcgcgagtgcggcccacatgtatgggcaccagaagactgagacccggccttcactctgtcccctttttctttcttttttttttttttaatacttttaagttctggggtacatgtgcagaacgtgcaggtttattacataggtatagatgtgccatggtggtttgccgcacccatcaaaccgtcatctacattgggtatttctcctaatgctgtccctcccctagcccaccaccctccgacaggccccagtgtgtgatgttcccctccccgagtccatgtgttcctgtccctgctcctcttccgcttcctcccatttctgtgggaaggaggggaaagctgctgtcttagtggctggcgttgggtgttagggtcctcctccattaatggctggtgcatagagcacaggaagagagccccagaagtgccaggcggtggtgcagctgctgcctgtgtctagcgggctccatccggtcccccgggccgaccttcagcggctggaatgcttgcaaacctgaaaccgccttcgcaaaatgatgactgagactaaagagatcgaacttaactgactccatctttctaacctccaagctgtccttgttcattcctgggcacaggctgacttaactttgggagaaacttacagtttaaacaaaggcggtaacagccctttgccaaagcagacctccttcttgcctggggactagattgcttttgtaggactaacattagccacaagattagaaattatggcttaggagtcaggcagcttggggctacaagattctgagcctctctaaactgctcctaagatcagtgcctgagatattttgcaggccctgcacttgatggatcagctggccccactcagatcaataaactggttcatctgatcttgtggcccccacccaggaactgactgagcacaagaagacagctttgattccccgtgatttcatctcttaccaatcagcacttctggctcactggcttcccctaccccaccagcttatccttaaaaattctccccgaatgctcggagagactgatttcagtaataataaaactctggtctcctgcacagctggctctgcgtgaattactctttctcaactgcagttcccctgtcttgatgagtcggctctgtctaggcagcgggcaaggtgaacccactgggcggtgacacacccaatgaggttgaaaagcaggttccacccagagtggagcttttcctgatgcaatatcccaccccctggttgttggtgctggtgtgtgagtcacaggcccagcccgggtatttgagacgcagtgacctcaataaggacttgagctggtttcctgagtgccctctggtgagccttgtgtctgggtagccttgccacccagcgcgtctgctaccaggaatgagttggagggaagcgggaaggctgtgttatttctccatcttcctctccaggaaggaggcggccttggtcctgaggcggggtttgctctgggtagagagctctggatgttctgttgttgcttgcacgtccccagaaggatcagggcgacacagaaaacttggttgaggtgtcttgctagggctccttaaaaggagaaggtagccaggtgaaacttatcttgtttgcttggcaagtggtgacgtaccttcgtggtcagattgagagagcagcgaactgaggagggcggagctttggaagtgcagaaggacgagggggtggtcacttgtgccttgctgctccaggaagctgcctggtgaccctcagtcccctaagtcagcaaaagattgtttcccagggtgtcatattgcacagctggctacagtgggagaagaggcggggagattacctccctgctgggagctccccttgctgtgagcagacttaatgcccagaaaatagaagggatgggagccagtgaaaccagttaaacagcagctgttaaaaagggagtgggagtagaaacgtcagagttcccagctctcttagggaaaagcgatttagatttcctttgccatctagaaagatactggtgttttcctggaagagcttactgtggcatacccattccccaggagcaagcattgtggaagcctgcaggcgagcgtgtgtgtgagatgaaggtgtgctgaaggacactcttgatgatggaagcttccctgaaatcagaacctgggatcaccaagcctcctcaaggcaggtgcccgtgactggatggttattgaatgagcgacatgcctgtccctctgagttgggtgtcagacacatcattcgaggtttccgcacttgtccggtcaagactgaagttgtctttattatcttagcagtcaagggcatttaaacgcttgaaaagcattcaacatacattaaaacttgggctgtttatttggactgtcttagaatcaactccagatggcaggatttagtttgaattgtgagaggaatgtattttataaatgcagtgcatcttaccgttagcgcctccctagagtcaacacgagttactcttccttggtcacagggtccacagttaacatttactgagctcgagcacaccagcgctgtccctgagcacttgagtttgctgttaagtggaaaatgcagagaagtaaacctgaaatgaaaatcagagcaatagataataaaagtaaagtttgcccagggcgtggggagggaagacaagtgaagcattttcctgacttgcggaacctccaaaagcaaaaaggcctgggaagttggggcgtgttctcaaagggtgagctcacttggagtcagcgcagtgagacctggagtcaggggcgaactgaggggtcttccttgggtgttctaagagccggactcagtgctctcccaaagggaccaaagagccttaaaaaaggtttcttctttttttttcctccatgtgtgcaaaagccaccaccgagtcctgagtcagcagcggagcaggctgacgtctgaaccccgtgaacccactgtgaacccaaactctggcggtggcgtcccgtgccagccatgggttcttggctgctcgccgtggccaggctcttggccaaggcctcgtgcagaagctcaggagacagctgcccgggcccctaggtcgtgaagtgggagtcgggatccagaccctgcccaggctgccccgtgccctgcactgcctggctccccaaggagggcggacaggtttgcgggcttgttttccagggagtagcactttgggatttgtggttttaaaaagagaactctgcaagtcatgagggctgagtagcttgaagagagaccacagggaaggcaggcgcagagctggggactgtgagagccggggccttgagaggacacagacatgcatgttaggacagacctgcttttctggaaagctccctgaggggagactgtggcagctttgggaggtgctagaattggctgcccttctgccaaacaggcaagtgagtcggaggccacgctaggcggcccctccactcacagggacctggagacacacggtagggggtggggggcgcaggggaggctcagtgctgcaggagggaggaagaggagagggtcttgccttggcactgctctcccgatgtgtgtgacaccactgcctcaagtggctgcaagttctcagctctcactgtgcctgaggatcccccagtgaagtggcctaaaaatggaaacacccagtctgctttctgagatcctggggcagtcggtggaacgcatgccctggagccctggggagtcaggtgcgggcccccgagcacaccccacagctccctcccagagcatgatgggggtgtccctgcactctggaggtccctgcacagctctcactttgacacacttcccgtgctggtacatgtttgtaaaactttctagttccaatataattgtgaaaaataccctttgattattaaaaaaaattttcctggattcattttgaaaatgattctcttcttttttttgttttataggatacaaaattatggataataatggaatatcttggtggaggctccgcactagatctagtaagtattatgttggatgcagaatacgtatcaaagctttttctcaggaaacctgggttttaaagaatccattgcatgtatccatttctttttctttctttcaagttgcattaaaaaaggaaccaaactattccttacgtgtttttttgcttcttatatatcactaaaaattattggtttacctttttttttttttttgagatagagtcttgccctgttacccaggctgaagtgcagtggcgcaatctcagctcactgctacctctacttcctgggtacaagcgatttttgtgcctcagccttccaagtaactgggactacaggtgcatgccaccacacctggccaattttgtggttgttgttgttgttgttgtttttgggtagaaatagggttttgccatgttggccaagctggtctcaaactcctgacctcgagtgatccccgctctcagcctcccaaagtgctgggattataggccaggtgcggtggctcatgcctgtctgtctgcttttgaaaccagctgttttgtttcatgggaaaccaataaatgtattcatagaaggaagcaaggaaggatcatgcctggaattatctcaactgagaacagctgggtagcttattttctgaaacaggttctatttacttttgtagggctgttatctcatcgtttcatatttcacatgacaacttagtttccaaaataagcatgtaatattgtaattttggaagtaaggggcagggtgtgattatgaaggtcggatgtcggatgtgggagcagtggtcatgcctaaggggaacacacacttccctgcttgccagcgctcccagggtgtggaggtggggctggcccgcaccagatgtctcctctgaactctccctcaagtgccttctgtggcctccagtccacatgtaaggtagtggaagccaggtggagggtggctgtaccgtcctggtctgtgatttgcttgtgtaaaacatggcttcctattgggttttgatgcagtgcttacagataaccagcatatgtcatgagcacagctgaagtcatccttgaaacatagtaaatgcaaacgaattcgtgcagctgtttagcacttgctgtctcatccccgctgtggctgtgcagcgaagtcactgtgatcactctttccccaccccttctgtaagtgcaggtcatttaggtgagtggtgattttcaagataggccagatctgtcattgcagtgttagaggttgggtcctggatgataggcggccatcaggatgacagggctgtggttgcagggagagctgaagttagctgtgttactttagcatagtctacacgggtattactcattaaggaaaggaaacccctttgagaggaaacttcttaggcctggtacagtggttcacgcttacagtctgttcacttttgggagactgaagtgggaggatcacttgagcccagaagttcaggactggcctgggccacatagcaaaatcctatctctgtaaaaaatttaattctagaataaaatgaaacttttttctcacagtaataatagcaattgatagtttgttttgggaagataaacttctgaaactatatgtatctgcagaaggctaacgtacccaatttacataatcaaatattattataaaccataaaaataattgataaaaatggtattaaaaagggagatttcaagaaaaattaatatggtataaaattatattaaaaagggaaaaacagcaatgtagtgggattacttttacaacttattttggttcctttccataaatgtacacataaagagcttttcattttttcaccctgttgggaaatactacagaaatgtagaaaattacctcattttatgtaattagatttactattatctaagtgaatttcatttgtagcatatacgaagttgtttacagggattctttttccaacattaagtccttcagaagagcaattccaggaatgctttagcgtgttcatatttaatgatataataatttatttggtgataaccttcagatttctttgaattgcagtctgtgaaattttagatattacagttggaaggaagggtaaaactctccacttaaaaaatcccacatagtgtgagacttccagcaaactgtttttcacttctgcttaaggagtgctggtgacaagggacagacattcctttttgaatgcccctaatcgtctcatttaattggtgcaggaatggagaccctcacgggtgaggggtctcagctaggagaccttcagggttgaagggtcccagctagcagatagggctgggccttgacccttgctctgccagctcagagcctgtggcctcccttgaccccgcagtgtcctctaccaacctctgatgttgttgtctttctccatctttacccttttctgttggcctgctctcagcccctcaaagaggccacactttcttgggaaggggtgttttggaggtaggctgggagctgttgcagtctttgcttctttcccacatccacagcaccgggccccctcgaggtgcaagggtctcccggagctgaggggaactggaagtccatctggaaatttacagatgcctggggcaccctagagaggggaagtgactttgccccaagttaaaaattgggtggcagacaacatggcatatacataaatctcgggccccacgtatcagagcgaaggacgaagcagagaggctttaggacttgaaggctgggatgagcccaggtctgctgttgggcatgggcatccctcagctggcaggggtgcatcccttagcagccaccttttccgctctccaggtgctttttaacttttaaaaaatgcaaatttgggatttcaggtggagactagagacagtattattaagagccatgaatataaaatagaaaataggtacacattttattttgaatgcacatatttgagtgtgtgctcagtccgttgatttaaaaaaatttaaaataaaatggtaaatggaaattaagtgtctatatgatcccaaggccgctgggctcttggaatatagcttgaaaactactcaagtcagtcatctctcaagttccagccgccttgcctgtagggtgccctgacttagaagagcataagaagtatcacacagtccaagacaccctaacttaaatgcagtctgtctttgtagcccggggagggaaaccatttttcattcagcatagagttgtgtgcctcccgcgtgtcaggggctgctctggccattggggattattgccgttggacacagcagcggaaagtcctgctcttggggagttctggtggggaggtctgtcaattacaccgtttgttagaaggttccttccttacaaggaaaacaatgcaggcgagggaggtgaatgggggagctggagtgaggatgagccacagagggcctgagaccagaaggttttagctgattaaaagatcagccagtgttgccagagaatccgagggacaaccttggaatctaattacaaagggacaatgctacataaaccagtcacttaatcaggcagagatgtttgacggacttaaaaaatgagtacacgacatgggttttaagaaatgagatggcatattcattaatgtttaggccaagttgccatcatagcagctctaaaacagtgtctcacaaaagatagaaatttatttctccccctgcacatggggtcagtggctctggtccataccgtcacggtctgtgctggtgggtggcttcagcatctggagccccaggcttcccttggtcttcagccattgtcctctcccactgccagtgcttcagggccaagaccaagcaggggcatggggcacatttgctcctgtctgacccactggcgaggtcttagtcacctgaccacaggctgctgctcagagtctgggaaatgtggtttcttgttgtggctgagtgccccggccaatagtccctgttacagagcttcgaagcaggggaggacaggctcggggagggggagttagaagtcacacagaggtgggatgtggtctaggtttttttcctgggtcctatttgaagagtctgcaagtgcctgaatgatggagagcatggtcgcaatggcgaacaccagctgctgacttggagagcttggcctggtccgagctgctcatgaggcactctggggggtagacagcagccgaataccctttatagtgaattttgacgcagaaaggatttccccccaagtaaggagagttttatctctttttctccccttcctcctcgttccccatgggcatataagtcaatgatggatggtgttcagggcagatttaaaagggcagaaccatgcagacagtcatcacagagccagcccttaattatccaggggaggattttccatgagtgttcctcacctcttcctcttagcgccctttgggaatgacagcaggccgctctgccgttgcttttgggagacttggtaatggaagggaggtggttaagtccagatctaaccacaggtattgatcgtcggcttgggcacagacttggtgaaggaggagatgggagatgggacccgactctaatgtgactttttttttttttttttgagacggaatcttgctctgtcacccaggctggagtgcaatggtgcgatcttggctcattgcaacctctgcctcctgggttcaagcgattctcctgcctcagcctcccaagtagctgggattacaagcatgtgccatcatgcccggctaatttttctgtgtttttagtagagatggggtttcaccatgttggccaggctggtctcgaactcccgacctcaaggtgatccacccgcctcggcctcccaaagtgctgggattacaggcatgagccaccgcgcctggcctctaacatgactttgatctttggtcgactggattctcctgcactccagcattatgaacaaaagcaaacactccggcatctctatcctcctccccactgtccacccaggtgatgagaaaagtctgtgttcctcattttgaaaattaaaatttctacattctatgaacactgaaaaatagatgtggagaaagctgacttaaggcatagttttcctgattgtgttctttagaatagtagttttgatatgcatttcttataaataagacttttgttcaggtaactgggaaaaaactactttctggggaacagagtctgtggcgtaatgccttagtctgaggtaacttttggacaatatcttaattggaatttgggacaatttctggcaggcgatggagatgggcattttgaccttctctgagcatatgtgtgcggtcaaactaaaagcgacaagtgcattctctgcacctgggtcctgggtggagaaggccaggggtggctggattccaggtgtgtctgctgccaggcaggccagagtcccagcgaggccagtgtgtgaggagaggccacctctgagagtggccctgaccctgggattgctgtgtagaccagggcaggcctgcgagccaaggcagcacagctcacccatgggccggaaagcagggccaggtatgagtcaggctgtggtttcggtgacaagggctgtctcggttgcccccacactgcaccccacaagtacttccggatgtggaacaggatgtgaaggagctgaggcacgcaaggactgtcgggctctgtcccagagatgtgcacgcctgagtcggatgcttcctgtggaggagcgccctagttttcatcccctttggcttaaagcacatttcttatctttttaaaactaagtgaaaggccccagattgtatcttcctgttggctaaaatgtgtgggtgtgggctgtgaagacattcactgtcaagtctgaaaaccaagaatgggggaccatgatttgggggaaccctacctgcatcgattagacatctgccctctgtctggctccgtttctgtggttccggggagcactggtggctttgctgctgtcatctgtggaattactgtttgtgactgactgccccactctgcagggggcgggggggggcttcccgtctggtttgaagtgagcctttgttagcctggttttcctttccttttaaatggagatgtggatacctgacatttcttcctttcatctgatatagttgtggatataaaggagtcaataggaacaattattttgagtttctgagaataaaagctttcagaggtaattattatcttagggataatataatagttattattattatataatatctattatataacaaatcccaaactattaggatttaagctctttcagctgcattcccccaagttggggagctttaactgcagatttaaaaaattctaatacaaggatatcctcagaggcgcctggctcctaggccttctttcctgggtgtttttgggtaccaggggtgagccttctggtaagggaaccacatatgttaggacagatcctggctgctctgtctcttggctgttcgtttcctggagtgaaatccccagcctgtaccccgcccctgccatggccagaggggcaccctgaggtcagctgcaggcgcaggccgggtcgtgggcttcctcattggctcagcctgcgccccgcccctgccatggccagggggtcgccctgtggtcagctgcaggcgcaggcggggctgcgggcttcctcattggctcctctttgcttctctgctggcttggcttcattgagcaaagccattttctcgggccctttgtttttttaagggtccctcagtggactgtaattgttagggcaaaatcatgtgttttaagtgaagaagatttcaggttttaattacccttgtccattaacatggatagtgtttctgttttatctcaaacttttcataagataatcatttaagtaactttaagaatttttttctcttcttagttagaacctggcccattagatgaaacccagatcgctactatattaagagaaatactgaaaggactcgattatctccattcggagaagaaaatccacagagacattaaaggtaagagaacatccgttttcattcctttgaaatactgaaggtggtggtggggttgccctgaagacttctcaagggaaggtgctggcgcccatttgtcctgcacgtttgccttgcctgggctgggctggctttgagggggtctgacaaaaagtgtagccccggtgcctgtgctcggtgggttcgccacccagccagggagaagacgcgcttgtggcagtgcacggagttgtaagtccgcaccgcccagggccgccttggctttcttttgcagcggccaacgtcctgctgtctgagcatggcgaggtgaagctggcggactttggcgtggctggccagctgacagacacccagatcaaaaggaacaccttcgtgggcaccccattctggatggcacccgaggtcatcaaacagtcggcctatgactcgaaggtgaggggagggtgagggcggcgccgtgcctcacgaggcctggagggctcccgccttttgttctttagcctggtagcttttctaagttggaacgaagctggtaccttgaggtaggtcataaaggtaattcttcaaccttggttatgaacagttttctcctctgtctcctgctgtatcatttaataccctgtgctgatccagcccaccatgatcgaggtttttaactcaggctatgtttgtttggtggcagcggggacacaggatggagcgggtttggaggggggtgggaggaactgaaggccatggtggtgaggggtggaggcgtgtgcggtgcagagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncctccctcctttcctccctcctccctccctccttcctttcctctccctttccttcctccccttccttctctctttctctctctttcattattgtatttatttcatattgattctttcatttaacccattctgtgtaggcacatttttctggattccagtaatactggagtagacaagaacaaaagtctcttctcctgtatgtcttaaattcatatgggggagactgacagtaaacaggaagaattaacagcactttaggagcaagcgtgctgtgttgtagtcaccattttcagtgagttacctgccttaggtgacaaatatccctagagagtggcggggcagaaggcatgggcacctcagtgtgcggccatttcagggttgggccctggcaggatggcgttctagttgagatgcaagctgagagaggtttaaaagagttttgaaagcatcagtgcacagctttaattggtgttttgaaagaaaactccagaataaatagaagaatgtttaaagatttaaaacttacccaaggtcaagaatgatgtgaacccataagtcaaagaggttgcctggtaccaagcaaaatgaatgaatagagatgattacatatgtcagaaccttttccagaggaaaaaagttgtattacaaacttattaaaaaattaagtgccttcaaaggaagaaaatcaagctggtgccattcattcacaaatttgtactgagcaactgcactgtgaatacaactgtgatcacgacagcacactccctcctctcctgaagtagaagaaacaataaataagcagtttcagatcatgcaaagtgccgtggaaaaaaggagacagggccatgtgaagatcttccgctcttggttgcaccatcactgctcacatgagaacctttattcgagagctgtcctgtctgcctgagccatccgcacccaccttccttgaagggcaagtcctcccttcagagttccagttccaactctgaactggaaatcatgagcaaactcttatgttgatgtgaaattgactttccaggtttgtggacccgggaggcgtgtggtgagggccgatgagggtcacgtctgtgtctgcgtctcaaagttctcagaagtggggtttcacgctggggccttagggctgagatttcctttgtttcccactgggcgtggctctggactggcagctcttgtcgcaagcagggcctgataagggcgctcttcctggctgccctgtgtgtgtccctccagtggctggcttgcctgccaggcagccagtgctcttcagggtacactggaggccgctctggtctcatggctcactcagctgcttcccagctttccctccattctctcttgcatgacttgtagacatttcccctcctagtctgtgcactgcaggtaaggaaagaccttccagctattggggacagggttctgtatggtagttatgaaggcacgtgcccaagtcacacctaggttcacacgcagattgtcaaaggaagggtgggttgggagaagtgatggacttcacctgcctcactagcttcttcatctcactgaactaaagggaatacaaacctccatttcctgtatatgtttggaacctttttgagcattgtcacctctggcagtagctgtgcccccttatcttgtctgggctgctcaggtgttgctgaatgtctttgcatacaaagagaatcttatgtcagtcttaacctaagcatgacattactaagtcctgattgcccatatgtcgtaagaaccttcactactactgttttaaggtgatttggggaagtttggtttgtttgaaggagtccccatcctttggagatggtgctaagggagatacctctgctcactgcgaagaagcctccggtttcaacactagagaaaggtcttgggctgaagaactctcatctccctttttccttgtaagatcattacgatggtatgttagcgaatggattgtgcttggtttgaagtgtaaccatggtgaaaagtggaaactggtgatgcattgatggaaaaaaatagcattgttgaagatgagtgaaagcgtggtgggatgagccgatgggctgccagaacccaggcagccagcctgtctactgcactgcgtaccagcccttcctgtcactggtcactgagcccatggactccctgctcctgcctacggctcaggaattgtccacaggcctggctgggaggatgagccctgagggccagggaagaatgtgaaccaggagacagcaggctttatttttgcatgagtaatgttgggccactttggtcaaccttgtgttgctcttaatggtcataaacatcacatacgcctctagatgccagttacaagtgtgttcctaatgatcgcatctgcttaagtaataagcttatatcaaatgagattttgttttgattgattacagctgtgatttagggttatccctggttttcttcttgattatagagttggtttcttctagaattattttctctatataattaaaatcacttaaattgtatcttcagatgtgtagctagcgtactttatttgacatgatattgtgaagatgtaggatgctgttgcatagatccccacatctcccaatgttgaggagagtccagaaccatcagtaacagagaactcagggtggtcactcaggagcatgccccaggagaagattcgttcgcagttaatgtgtgcatttgcagcttttgactggagcttatattagaaaccactgtttgttttctctgtgagcagtgtcttaatgtctaatttcatatctttcccaaatgggtctctccttccacctcattttaattgctttggaagatgactgcctgctccccacataaagtttactttaaaactcagacataggccaggcacagtggctcacgcctataatcccagcactttgggagtccctggcgggaggacagcttgaggccaggagttcaagaccaacctgggcaacaaagcaagacccccccttgcccccccgactcccacctctacaaagaatttaaaaattagctgggcatggtgatatgccctatagtcccagctatccaggaggctgaggtgggaggatggcttgaacctgggtgacagagtgagtcccctccctgccaaaagacacaaaaaaacctcagacacaagttcttgatctgctgtcatttttcctagaagcagtaatagacaaactcaattatatttatgagtttccctatcaacacattgttgagtacatcctacttcattaagttaatgtgccatagcaacttaatcattcttctgaggttgaacataagtaatgctgctgttgaatattttgggcagcccataccattttccaaatttaaaatgtagtagagatgcctaggaatcgaagtaattggttttaacaagtttggatatttttgtggctttcgatttgtatgccaaattgcttgccattgattcacatgccagtccaggattccaaattactcatagttagatgtctggtgggagagccagcaggcaggaagaccacttgggagccccctacagaagtcctggggagaagagatccctttagactaatccaaagttaggaggggtagaggggacgcagggtgctgagagcccaggaaccatacaccctgggttgcagctggatttaggagggtccaaagaggggatcctaaggagctgggtgaccctcgtgtccctggcatggctacctagtaggatgtcctccccccgccgccttttttttttggggggggggatgcagggtcttgctctgtcacccagacttatgatctcgctcactgcaacttcttcctcccaggttcaaatgattctcctgcctcagcctcccaagtagctggaactacaggtgcagcccaccatgcccggctgatttttgtatttttagtagagatggggtttcgccatgttggccgggctggtctcgaactcctggcttcaagtgatctgcctgcgtcggcctcccaaagtggtgggattacaggcgtgagccaccgcgcctggcccccatgtttgttcttgatggtgctgtactggctgccctccttggaagccaggagactgatacgtgggttgcgttcagatggggccagcaggggttttctcagtgaacttcccgtggtgcacactgcgtgcagaagcaggcgttcgcaagcaggcgttcggccgcctgcttattatctgtccctgaacctgaaagcaagtcctcgggcctctgagtaaaatcaaggcaagcgcatcaccgacgtactctcagcagagatcggcttctgccagggcctgcctgccagtcaccgagtgtgtttagctggttgagaggtgcttggaggtctggaggtgcatccgtcagagatcatgttcagtagcacaatagggtgaccgtagttaataatttgttgtgtttcaaatagccagaagagaagatttggaatatcccagcacaaaggaatgagccgtgtttgaggtgagggggatcccagctacccggatttgattgttacacactgtatacttgtaccagaaaaaattcatataactattatgtacccttacaaatgagaaggctctgggtctgtgtggccaggagacagcatgctttgaaaacagcagtagctgtaatgaaatctgagaggcctgggggaagcagacagatgtggaatcacacaaacttgagagccacctgttggtgtggagaaccgctgccacacaagagtcacaattgccacctctgttcttgcctctcccctcctcggtcctccctccttgtgcctgctcactcctgtcctcctgtcgctgccacagttctgggtgcttgcccaccctgtgctcccatgcacctgcttccctgctcctaggggcaagagactgggatcagttgcatttctgctgatttttaagataatgcaatgcaagataaagcagagtccaagttgtagagggaaggaaaatagtattacttccaacgtcagctcttctagactgaccccttcagtacaagatttagtagaaagaatttagaacaagacttgctggcagcttttcatcttcactgagaataaggaaatagaatatgccgtaggcatcattcccatggactgctgggcttgggggcttccagtagggatttctggtactcactaaggctgcaggaacatggtaagtgtatcctctggatagttaaagcaccctgcagccacaacgatgcttccgcctatgcatttccttgctgtagagtgagtgtgagagatgtattcaattctcactgaagttcttggaataatgatggattccagtgcacagtgagaacagcaggaaagctgtaccagactcaggcgtgttctctaccccagtccccattcgtctttcgccagcccatataggactatgtcctgcctcattgtcggcctctgtcctgtttggggattggtgtcacatgctgtcaatgtctcatcagctgtcaagttcctcttaggatggcctggctcttctcattgacatgacacattcaaggaattcattcctttgcctaactgcttggttgtgccacaggcctgtgctgggcagaaggaggtggggcagctggacctgagatgtcctagtggggccacacggcttctgcagatgtctcctctgggacattcggcagaaaatgcagacactagagagacacagtaaatgacatcagcaagaaaccaccagacaaatcccgaatttgggacctgtttctttaagttgatgtccctggggagactggggacaggactgttgtaggttgaaagagccttagcgacctggcagtcagttgtaccccgtggactttggatcctgattcagataaaccaaccatggaatgacagtttttgaacagctgagaacatttaattatacatgacattaaggaattcgtgttaatttcaggcactgataggtagtaaaaagtctgtatattggcacacggaaatactcgggggaaaatgtcatgatgactgattgattttaaaatatactcggggaacacatggacaaagctcgtatggcaaaatgttaattagtaaattcatgcaataggtagatgaggatgcattatattaatatttctcagttctttgtatgtttgaacattttcataataaacttttttaagttctgggcccctggtaaggcaccttacatggccacctcctcctcttccacctccattctacagatgagagaaacagggctcagaggttagctctttcatctaacgtcacaggactttgactgtagaactggcatttcaacccaggtatcttgagaccaaggtgcccactctcgacctcagagctgtgccctaagttctaagcactgctggagggggtgactcgcgagcgtacacccactccggactcctcctctctgctcacctctcttactggtcctgctggcccccgggactccacggggaatgccgaatgcatccagcaggaggcgtagtaggagtgaattgataagccatctccatgtagaggcagaaaacatttggcctattacagtttctcctgttgtctcttttgaaattacagcgagggcttatgtttttaaatatcagttaaaaatacctttttcaaaacctcagaagtattgagacatgttaccattttccccctaaatactgtgtattggaatagattcctgcttggtgtttgtaaagatgcttttcttgttgcaggcagacatctggtccctgggcataacagctattgaacttgcaagaggggaaccacctcattccgagctgcaccccatgaaagttttattcctcattccaaagaacaacccaccgacgttggaaggaaactacagtaaacccctcaaggagtttgtggaggcctgtttgaataaggagccgagctttgtaagtttcccagggatcacagcgtacctcttcatgtgcggcttgacttggttgagatacatcctgttgggattgctttaatcactcttttcagctgtcttcctggtattattcatttttctttttctaagtaagtatgattgacttctttggtttgcaaatacattttaatttttaagtattaaaaatctccttattttcttttagatttctgccatctcatacttcattgaatctgaagaatattctccttaatattaaatgtggaatcataaatgtttaatatttatagaagatcaggccataaactgttacactgtttttaataatggcaaaggttagctggaaacaaatggctaaatatgtctttaaagtaaatgttttcactttccaggtggcatgtgttaggaaacaaaagattagaaaatataaccaagccaccctctgtgcttcttcccctccccttcctgcctactttctctttttaggtttaatagactctggcagagccatacagcagtaacgactgtgtggctttgcctcattttctgtctgaattaggacatttctttgaaagtagtgtgtgtgtgttggtgttggaggtagcaccatatgtccttgttttgtttctgagttttccagcagagttagctgaaggctaagctgagccccccttttcttaactcttatgtaaaaatgggtggttacttttacaagagcaccatggtttcctaatatgccagttctggtaaaggaattaaatggggaatgcaacattttctaagtacgtctaaggagatgcaggctgagaccaccacaccagtgtttgatgactacatcagcatcgggtggtggtggggcttgtcctgcatgccacgatgctctgcattttattacacgatgatgtttcttgcagccatcatgcaccagcaccagtggagatgcgtgcaggcatgtcttcccatacaaagcatgtgtcctgtatgggcttatgccccagcacacagagctccaccccacagctaccgaggagctggctgagaggcgagaatatgagcacctccggggtagttggggtttcacccttggatggacagggagggagaatacttgaggtgatccacgtttctcatgagtttgaatctgaaaacatgcttggctcttgtaatcaagcttttgtaatttggagtgagtgggaacttggttcgactcggtgtttgggtgttcctgctgtctgttcccatttgggccatgctggtttccttgggaagcacattccctgtcactatcgccatcctcaaggcaggcagctgaccaggtgctgcttgcggtggccatgctgagcccagggcatgggtgaagtcctcagcccaatcacaagggaagggagggagggacctgggaaatagcccttctaaaccgggaaagttggtggtgaagcgcatccagttgctctttcagcagacaggaaaaaggggatctcctggctcctttccagtttctctgagataattccaaattgacatttctattatatggttggatgtggccaaacgttaatacagaaagttaacaaagcagcccagcatggtggctcacatctgtaatcccagcactttgggaggccgaggcaggtgcatcacctgaggtcaggagttcaagaccagcctggctaacatggtgaaatcccgtttctactaaaaatacaaaaaattagcctggtgtggtggtgcaggcctgtaatcccagctacccaggaggctgaggcaggagaatcgtttgaactggggaggcgaggttgtagtgagccgaaatcgtgccactgcactccagcctgggcaacaagagcaaaactgtctcaaaaaaaaaaaaaaaaaaaagttaaacaacacagaacatatattttgtcagcatttgtcataaagtattttataaactaggagataagcttttttttgagacagagtcttgctctgtcgcccaggctggagtgcagtggcgcgatctcggctccctgcaagctccgcctcctgggttcacgccattctcctgcctcagcctcctgagtagctgggactacaggcgcccaccaccacgcccggctaaatttttttgtatttttagtaaagacggggtttcaccatgttagccagggtggtctcgatctcctgacctcgtgatctgcccgcctcggcctccgaaagtgctgggattacaggcgtgagccactgcgcccgaccagatcatttaagctctcttaaatgatccctgtgaagctctgtgcagagttttctgtgaaaatgtatttattagggacatccttggaaagacagtgccctgcccaccatagcacccagagcccaggcgtaggtcctgagcgactcgtctttgggtgagttgcagtgagaagcgctgtggagtagagagtccagccatcaggtgtcagtgtggcggttgacattttgaggcagaagtctgtcctttggggtaggaccaagaacttcatctcatactttaattgttgggtgtgtttttccagagacccactgctaaggagttattgaagcacaagtttatactacgcaatgcaaagaaaacttcctacttgaccgagctcatcgacaggtacaagagatggaaggccgagcagagccatgacgactcgagctccgaggattccgacgcgtaagtcggcccctgagtgacccaagcatgtgtgtgggagggatccgctggtctttgtcactgtttggtgtgggtttcgttttctgttgagttttttttttttttagacaatccaggttggtggcaattgttgtgttagacacagcctgggcctgtttgggagttgtttagcctcttgacgttgctggtggagtttctgcgagtgaactcttgtggtagagctgtgcatggggaactggacctggctgtttcattctgttttgtttcgttctgttctgttctgttttccattaaacttcctgtttgtaaaaccctgatcaggtgaaactgctttacatggatgtctgaaaggccagaaatgcatgtgtttgtgattctgtattgtgtctggtagaagcttctgtaccaggagtggcttactgagaattgctgtcaagtttggcatctaggaattcccttggcttaagaggcggagtggggctggagccatttgtgtggggagggctgggggaggtggtcgggcagacttgtgtctggaagtccgagcgtgggactcgtctgttctcgtgcatgccttggcagaagttaaagttggcccacagtgcaggtccatgtgccaggccagttgaatgaggatttccggggatgagaccctaagtggtttttcagggtctctaggtgattccagtttaaagccaaggttgagaccactgcccccggaagttcttgaggtactgccattgggagattgctggggtagcaacagggatgacaagagaaagagactggagagaggtttggagagccaggacgcggcggtggatttgggtgaaggagggaagccaatgttccaggctggggcagcgtggcaccaggtgttgtgatgtgtggtgcgggaagccgagtgtggggtgaaccgtgtgtgagtctgagttgtccaggagagacgtccagtgtgaagtggcaccgaggtgtggagttcaggtgagaaagctgggcaggtgaagcgggcttaggggccactgctctgtggaggtcacttgagccgagagaaaaaagggtgtcagttggggcatgtgggggagtgaggctggcccctaggtgtgagggtgaggctccgcctgtgagtgagaggggagaggtatggccgaggggcgggaggaggtgcaggcttaatggggccacaggcatcaggggatgatcagcagggcctggggctcattgcctctgaggcccatacaggacagggagtgatcagcacaccatcatctcatgatgggggagggagcgctcggagggacacgggtgggctttggagcgagtggagggtaccaaatagaggcagtgagtgtgaatcccagaaccagggctgagagatggccaaggtgaggccaaagtgttggaatgacaggcatgagccaccacacccaacacagggacatctgcttccctggtgagaggaggagcccagcagagagaagctgatgtcccagagatgggctcccagggaggtgggggaggtgttctccgggaggaggaggagggtgggcatgcacacactggcacgccagggagttgtggaaccacctcccgatggtctcttctctgtgagggaggaggcgggggggtctttgggaaatcccagagggactggacaagggtgtgatgggtggggacttggggctggtgggtgtgggtttagaggtccccaggcggcctccccctgaacgtcccagcgcccccagagcaggtgtgcgagcactgatgggatttcctgcatttctgtgttaagggaaacagatggccaagcctcggggggcagtgattctggggactggatcttcacaatccgagaaaaagatcccaagaatctcgagaatggagctcttcagccatcggacttggacagaaataaggtacgtctgctcactccagaatggccacgctgacctcagtctgcagtgttttggaggcacttgtgtgtgaagcttgctgtgggtgcggctggggtcctttgtggcagctgtcctggaattttgttgctaggggatgggcagatgaagagctttagttctgtctgatgatccaggtgttcacaccagggagtctggcctctggtctgttttgtgccactctattctgctctctgcagccctgctgttgagttaggatgtcccgatgtggcaatgtcatggggtttgggggtgacccgtgaaatgacttcatagctctgagggactgttgtgcatgttgcggttacttacatacatatcataattttgtgactgagttttaaggaccttataagtaaatgcattgcttttgatatttatgtaaaacaattttgattaattggttttatgcctgttaaatttatgaaaggccatatatttagggtcttgtaaagcatagtggtgtagtttctttcaggcagggtgggccagtggctgtcccctgttgatcctacaagtcgcgctttgataagtgaacaggtgttaaatgtccaaatagaggttgcaaaagtagaaactcggtctctgtcctagacagccattggaatggccaatcttgacctgatttctatttccagggtttcattagtaaagtacttttctctctctctctctctctctctcttttttttttttgagacggggtctctgttgcccaggctggagtgcagtggtgccatcagagctcactgtagcctcaaacgcctgggctcaagtgatcctcccacctcagcctcctgagtaactgggattgcaggcatgtgacaccacgcccagtttatttaaaactttttttttttttaatagaaacatggtctcactatgttgcccaagctggtctcaaactcttgggctcaagtgatcctcctgcttcggcttcccaaagtgttggaatgacaggcatgagccaccacgcccaaccagtaaagcacttctgcgtagatagcaagacgaggcagttcaccgcctgtgcccacacagagtccccttccacatggaacccagatgctggtttccccggtgcgtgggttttgcatgtcactgcagatgaaactttgaagtctagtgagaggcagccgatagtctccttcagatgttatggtgcgcagagggtgtttcctcagcgtgaagtgtagaggcaactcctgcgcttccatagtccaggtgggaggtttattaaattattgccaatgtgaacgtcaactgtttctgatgacctttttttccctctcccccaagatgaaagacatcccgaagaggcctttctctcagtgtttatctacaattatttctcctctgtttgcagaggtaggtacctggctggccttttcggagtgggaggggagggggaaggagaagctggacacacttcagtggtgatgttgccagttaagagttggggacattaagacaagctggcaaaggctcggaaagcctgcatggtgccttcccaaaggctgtcagcgtcaggcaccaccttgcgcctcccctgtcctgggtgatgcccactccgccgcagcctggaatgtgtagactggatgacagtgacccagcccgagaccctgtgtcacccgttgccctgctttttagcaaatctcattgtgtacagcctgctctctttgcctcagaccaatttctggccatgtgaaaagtagattctttcttctaaggagacgttggatgccctggagtcctccggtttcccctgagccacatgtttcactgaagtccctcctctgctcagcagtgctgtgctcccagctgggcctccccacgcccactccctgctcagcctctccctcccagaggaaagtgctcccgtggccgtgttttgagagattttcaaaagtaggctttataagaatgaagattgttctgcatctggttagtagcggatttgaaaataagttggaagtcccctcttttcttgttgtgccccttcctggctgaggctgcctttgaggtactcactgtgggccacacacgcatctgtttgcgtggggatcttccctctttgggcagttttccactgcggctgtgtttaggggtcctggtccttgaaggggaggtgctcaggagaggaagtgtcataggagctcattctcctcccctgtgcctgcgtcacgcagcgggggacccccggccatgggccgtgcctggccagccacggtcctgccagtgcctcttcccagccctccaataagccttcacctgttgccctgcccagcaggtgccctggagggtttgtctgagggcctctgacctggcaagttcagggcccggtgggagcagggctgtggccagagcccgaggcctcacctgcagcttcaagtgggaagtagccgagcccgctggtgtcggggaagccacagggcacgcggaggccctgctggatgatgtctggcttcagccctggctcatggttctgggcacctgtgttcttcctaactaggatgtccgggttgagcgccatcctgcgcttcattttgtcccatgggagttggccccgtgggatttccaggctgtgctcctgcggccctgccattggccgctggaatagggtcagtcaggcagttagggaaagtgcatggactttttcattctcctgaggctgtttatttttttactgggcccatgaagcaactttgacataattattcaggacatatcctaaacgccgtcatatcctggattttccaggtaaccaattgctaaactcacaggcatctttcccaatgtatttttaagaatgatatttgctaccctagagttcagagtgtttattgtgtattatttcatacaatacttgtagaagcccagtagaaggattatatccccatgcttacagatgaggacattgaggagacgggtgttggcgtccctgctttccttcagggagcacaggtcaggttgctccctgaagtcagtgatgggtccagcacgttccacacggcaaggggacaggccctctcccagggcggcccttctgccgcctttgctccttctttgagacttaggggcggggcatgggcaggagggagagtgctggattgtagctgaccctctcgggacttgtaaatactgtcaagtgattgggagtcctagacaaacacgagtggccgcctcggggccggcggcgtggccctgtgacagcaagaacttcaggaacaaatgctctctacacccactggccctccaaggtcagacccttctagttcctgcctgccccttcagtagcgaagagagaagccgttgctcttagggcagggctgggtttggaaatgacagcatgtgttcaacaacctgaaaaccaagctgaatgtcgcctgagatgtttctttcttccctgaagaggaggcggtgtccatcacaaagagcctcttctgttgagttctgagccatgctgtatcttgacttgaacagctcttattttcacagttcacgtttttgggcctccagagagagacttggagttgaccttcaactgagggaagtgtctgaaggcactgttgtgatttctcttgggagtagaggtgccaggaagaacactggagattcccagaatttaaggctgccacttatttacatgaaatcaaatattttgactctactctggatcacaaaggcagtttgctggagtttaagaaccaacccattaacattaggaagtaagcagtgttgagatcagaataacttaggataggctttgaaattgcttttctggtacaaggttatggttgaaataggaaaacagcacagagaggacagtccatcacggtgagacttgggaaaggcacacagagagctagtcgtctctgttctggcctcgaacagtaatgattatggtctgatgattgccctgtgtatacataactgctctcagagcatttgaatcacctttcttcaaaaggaacccgggccgggcacagtggctcacgcctgtaatcccaacactttgagaggccgaggcgggcggatcacttgaggtcaggagttcaagaccagcctggccaacatggtgaaatcctgtctctattaaaaatacaaaaactagctgggcatggaggcaggggcctgtaatcccagctactcgggaggctgaggcaggagaatcgctggaacccaggaggcggaggttgcagtgagctgagatcacgccactgtactccagcctgagcaacaaagccagactccgtctcacaaaaaaaaaaaaaaaaaaaagcaatttgaagtggcctggagccctagccaaagcttttcccggacaccctggggctggggtagtgtcgtggtccacacgccgtgttgttccttgaacagcatgcttcccagttttgcagctggtgtgcttcatgccattcttcctgttcgtgtgttttcagttgaaggagaagagccaggcgtgcggagggaacttggggtccattgaagagctgcgaggggccatctacctagcggaggaggcgtgccctggcatctccgacaccatggtggcccagctcgtgcagcggctccagaggtaactacccagggcccctctgggctggggaaggagagacctgcacttgggctgggacttagttgatgagtttggtacttgattcttggcctgtctgttccttttatcttgcaggcctcagggtagacagagttgaattagaggagactttgttctgaattctagaaatcaatgtgaatgaaggatctgaatctggaaactactggaaagcccacaggacttagtgcatttgtagcttttgccacataaatacagggtggtggtgaaatacctgtttcctcttaattatgcagcttaattattggccagagaatgatcgttcttagccagatgtgtgtaactatctatctggttttcggctttaaagtcaagtgtgagaaatgacagcagctttggtgtggtcaactcagcgggagcgggcgcaggtgtgttccctgtgttagctgtgtgtgtcatgtctggaagcctccttggtaggggttcatctgtgccagcctgtagggagcttttgtccctgcccagtggccccacctgttgaatgcactatgggtgaggactcagtggggtgacagttttgccctccctgccccctcccaacttgttgtaggagtatccatgggaaccaagcccctcctgactgccatctggcacaagtgcaggcgtttggaggcagtggatgtgtgctgggaagccgctctgtgtgacctgagggtgatttgtcactgggctgtcctccacacccccaggaggaccaggcgtgctgctgccttgacagttcatcttcaggtgtccaggctgacacctcccaaagctggctgagactctgtgatcatgagggggatttctgggtctttcctgagactgcgtcccacctgacagtacataaagaagttttgcacacgtgaggtcccttttgctatttggaagtgattgaaggggctgcctactgtcctgtgaagagcccctctacgtggggacagcaggagaaaaccacagttctgatacttcacgtttatgcttctgaactcgggtttcttagtaagacatttcaactttttaagttgctagaaaataaaaatgatctacttggctgccttcaattttgaggcaattgaaggacgatccctccctcctttgatactaaaaacaatataggaataaaggaaaatagaattaaaaagtcacccatcttttgcctgaacacaaactttttgatttctcaaacttagcatcacatacctcattctagaggcatttatttcccattagaaagagctttataataaaacaaatagaacaaaaccagaaacgggtaggattgttactgtcttgttgggcattttgctctctgcttttgtagtattacttttaaaaccaatactttccacactgtccagaattgcctgaaattgttatgaactgtttgtttatatacgtgacttgatttccccagggcagctccagggcacagagtgtgtggcttgtatgtgttgaactgatccacgtttcccattcccaggcccctatctctctgttcctcttcttttagttgttaaggcaagttgatctgtaccagtgctggccagtagaagtacagcgtgggccacacacagaattttatgttttctgctggatgtggtggctcatgcctgtaatcccaatgctttgggaggcccaggcaggaggatcgcttgaggccaagagtttgagaccagcctgggcaaaatagcaagaccctgtctctaccaaaaaaaaaaaatttagctaggcatggtggcttgtacctgtggccctagctacttgggaggctgaggctgcagaattgttcgagctgaggagttcgcggctatggctgtgatcacgtttgcactccaggctgggcaacagagtgagaacctgtctctaaaaaccaaacaaaaagagaattttacattttctagtagccatatttttaaaaagcaaaaagaagtgaaattagtttcaacaatacattttttaacctgccagatccaaagtattatttcaacattaataacaacaatcatcaataaggtattttacatttttggagggaccgtctttggagttggtgtgtgttttacacttagcacatctccattcagacgcagcacattttacgtgctcactgggcatcgtggctggggttgaccctatttaccctcgggcgggtctgtagctacctgatgtctgtgttgtgtttaaaactttactttgcagtgatgcatgggggaagccaagttggtgctctctttcctttgtctgtgatgaggagtgccctctttcctcctctgtcctcagatgagctgcctcttgaggtgcttatcatctctctgcaggcttggctgtggtacccacttcttccttccctgctcctgaagctcccactgagcgttcaccccgatggctgccaaaaccacggtggccatggcttagacttcctgccagttttgctccaaacatgttgtttcagtggatggctgtaggaaaaatgagagccgcctctcctctgaagcattttcagagcctttctgtctcagctggaattaatgtttggattcttttgtgtgacatcaactcatcccgtgatttagtcatttgtatttcttgatagttgagtcttaggctccgtggctaatgtgtgcttttgggaggaccttatgtaaccatttgttctctgggagagatgccaagtatttcaaatgcctgaaaagaggagctctagattggaacgtttgagataagcctggtcaaagacatcctcagccatctctcctggacctgtgatttggagtctgttgtaaaatggttgagggaattgtggtcatgaggggaccccgttctcaccctttgttgtcttctgaagacaatcttgtagaatttttggaagacacagaaattacccatgatcccaccactgtagcccaaatctcatcagcatctttgggtgcattgccttctgttgtcataccaggtcataaacttactgaattctcttatctaccttatagtgcaaagaagattttttagaatttctatagtacttaatttaggatacagaagttgttcatgtaaatatacttatatagtgcacatatacaggctgaatatcccaaatccccaatctgaaacttttgagcgccagcatggggctcaaaggaactgctctctggggcatgtcagatttcggatttggggctgcacactggtaagtataatgcggatattcccagatccaaagccagaagcatttcagataagggatgcccaatctgtaattttgtatgtacttttaaacttgtacatatttttaatattgctttaatatatatatgtaaatacagataattaccatttttagtctgttatttcagtttgtataatttacttaactgattctgtactgttgggcatcagagttgtttccaaattagtgtaattacgaaaatcccgagagacatctttgtgcagacacgttgttcctgctttggaccatatttcggaagcagttctaggaaatagattcttggactgcatcactatttttatggccaaaatgggtttcctgccctcacatcgggaatgcatatgcatccctggaatcttactgtgtcatcatgtatggatcaatgttcactttttgacaattgatcgtaagtaaaagggatatgatttcccgttttattcacatctctccagggaggctgaacccattcttggtttttggtgacatgctctggagtttttgtgtaagaatcatgatcttctcagtctttatatgcattcttttaaaattagacttacacattgatatttgctccacttatttttgtatgacttggaatttcttatgaaaactaagattttggttactatatgaatttttgcacagggatgagaaatgacatgtgttgacttctctctctctctttttccctagatactctctaagtggtggaggaacttcatcccactgaaattcctttggcatttggggttttgtttttctttttttccttcttcatcctcctccttttttaaaagtcaacgagagccttcgctgactccaccgaagaggtgcgccactgggagccaccccagtgccaggcgcccgtccagggacacacacagtcttcactgtgctgcagccagatgaagtctctcagatgggtggggagggtcagctccttccagcgatcattttattttattttattacttttgtttttaattttaaccatagtgcacatattccaggaaagtgtctttaaaaacaaaaacaaaccctgaaatgtatatttgggattatgataaggcaactaaagacatgaaacctcaggtatcctgctttaagttgataactccctctgggagctggagaatcgctctggtggatgggtgtacagatttgtatataatgtcatttttacggaaaccctttcggcgtgcataaggaatcactgtgtacaaactggccaagtgcttctgtagataacgtcagtggagtaaatattcgacaggccataacttgagtctattgccttgcctttattacatgtacattttgaattctgtgaccagtgatttgggttttattttgtatttgcagggtttgtcattaataattaatgcccctctcttacagaacactcctatttgtacctcaacaaatgcaaattttccccgtttgccctacgccccttttggtacacctagaggttgatttcctttttcatcgatggtactatttcttagtgttttaaattggaacatatcttgcctcatgaagctttaaattataattttcagtttctccccatgaagcgctctcgtctgacatttgtttggaatcgtgccactgctggtctgcgccagatgtaccgtcctttccaatacgattttctgttgcaccttgtagtggattctgcatatcatctttcccacctaaaaatgtctgaatgcttacacaaataaattttataacacgcttattttgcatactccttgaaatgtgactcttcagaggacagggcacctgctgtgtatgtgtggccgtgcgtgtgtactcgtggctgtgtgtgtgtgatgagacactttggaagactccagggagaagtccccaggcctggagctgccgagtgcccaggtcagcgccctggactgcttgcgcacttgctcaccgagatgatgcagttggaggttgctgatctgtgcgattgctgtagcggttgccggggaccttaagagttattttgcttctctggaaggggcctatgcttgctaggcaggcagccagtgtgtctgtttttcttggtttgctgtgggaccttgcttggcgagggggaaaatctctgggtttctggagtgggagggttcgtgcagcagctgttgactggtacgtgaagcattcttttatgtttgttgaagctgatgattgacatctcccgtgggtgtgccagttcttgtggagttaagacaggatttttggaagcaaggaagttagtgggtgagcttggggatgtagctcagctatctgctggtctagtggcctctaagctatagggaggggacagagccctgagctacagatgcttgagtgggttattgtgtcggtttgctagtgcagtctggtttttaagctctaaaattgaggtattttattagaagtggatttgggttgaactcttaatttgtataagggatatattttggttggggaaatagaactgagttgctaattcttattgtactcattactccatacaagaatgttatgttgaataataaaattggagaagatttcattttgtgtttccagggagtattctgtgtggggaactgtttccttacgtgaggccggcggcataagtcaaagatgagttttgtccttgcgaatcacacagattgagtctgtgttccccagggtgtgccgttacctgatttttaagtgagccagggcggacagcagcttttctgatttacagagttcttcagatttacaaatggacaatgacatcacagtttttagcactgaagccagtctcatgctagtaacagtgggtgagccgctcgagggactgggttctaatgaatactggtatgaacggggagtctctgcagtcgccagacaaatcatactcagccccttcccccgtagagcaacaagtggttcttttagagttgactggcagcatttcctgtcgggggaggtggggtttgatggagttagaaagctcgcctctgtgtacattctctcctgggctgttactttctgtagacgcacaaaatcagccccaatgtttttaagggcatcttagccaaggaagctggcttttgtgtcgccacttccaggcctgcattaagagagagcccaggcaccagggctaccactggaacctgcctcagcgtcaactgctgctggtctgtagccaggcccagcctttgagacgggtttactgtcaccagtagcctctcagtgccagccctgagctgctcctggctcagctgcccagagcctgcagcctggggaggtactcagcctctgggagacgagggccgtggactgggtggct

SEQ ID NO: 12258 - DNA, 10434 bp, Human
  misc_feature (1)...(10434): n = A,T,C or G
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaaaaaagaaaagaaaaaaaaagaagagagatcctcccacctcagcctcttgagtagctgggaccacaggcacacaccactatgcctggattttttttttttttttttttttttttttgtagagacagggcctcaccatgttgcccaggctggtcttgaacttctgagctcaagggatcagtccgtctcagcttccccccagcccagacactttggctttgcccattttatgggtaataagtgatatctcagggttttttgtttgtttgtttgtttgtttgttttgagactgagttttgctcttacagcccaggctggagtgcagtggcacgatctcagctcactgcaacctccgcctcccgggttcaagcgatcctcctgcctcagcctcccaagacacataccaccacgcccggcatttttagcagagatggggtttcaccatgttggccaggctagtctcaaactcctgacctcaggtgatccacccacctcggcctcccaaagcgctgggattacaggcgtgagccactgcgccccgccccctacagtgttgttgactttacatttctcttactttttttttttttttttttaagaaaactgtgtctcactgtgttgcccaggctggcttcactcaagcgatcctctcgccgcagtccctggagtagctaggattacaggcacccgccaccactctcggccccatttctcttatttaaaaaaaaaaaaattgccgtgaaatacgcatatcgaaatgtaccatcttcaccatttttaagggtaagattaggtggtgttaggtatgttcacttgtcgtgcaaccagattgctgttttaaataacagcacttagagatgccgacttcgtgccaggcccagtttgggacattagggactcccagatgaatcagccgctccagtggaactccctgctggtgggggaggcactggcgaagcggtgctgagccgagtcctgacggcgctggagctgaggggcagtgcgggatgccccaggaaggctcctaggaagaggggacccacggtgacttcctaaggaagcgcggttcccaggtagaggagcgcatgtgagccaagatccctaggcctgagccgtctaggtgtgtcccaggaactgcaggaaacggttgggtgagtcagtggtgggcagcgagggtgataagccccttcgtgtcttcgggatggtaagtttggggcacaggtgagtgaagaccgaaggccaggggtggactgacactccgtggcaggcgcagggccgggcaggggggcggcttgggggtggcaaggtttgggtgagaaatggcagcccatggggaactaccgcagggctctgggaccttcagagccaagccccgacgccccttcccacctgcggggcagaactggggatggcaggggggagggtggttcccaaaggagataccatccctggtaaggggacatgggcccctgggagttgggttgggccacaaggagagaggcctgaacggccaaagggagggggcgtgggggaagccgcagcatcagacctctgcctcctccctcagatcgtgaggctccccagcctggctcgggagaccccgagatccccggccggtgacagcaggcgaccccctgctcctgtcaacctgtgggtccctacggacgtggggaagggaggagggaggccccagctccctgcgggggaggggcgtgaagacgcgcgggggtggggggagatgagccggcgtcgccatgacaacgaggccggtggtccggccttggggacccgggagggagggaggcgccgtggccgcgcgcgcgggcgggggcggggggccaggtctcccaggagtagttggggaacacccggcgattctggcggctgcttcctggtggcgcagggagcccgcgtgtttgcgagtgcgtgtgtgtgcgaagttctccgggtaagtgtgccagcgcgcgcctgggtgtgtgcaagggtgtgagcgtgcacacgtgggcacgggcgtgtgcgcgcgggggtgcccggttggatgtgtgcacacgagtgtgtgccggtccgcgtgcccctgcgtgagtgtgcgcgcgcgagcacacgtgtgtgtgcgcgctcgcgtgcgctcccgagcgggccccgggtgggagtccgagatcccgccccctccccagccccagcgcccctccccgtcccccgccgccgcgccggctgcatcctcgcctccacctcgctcaccccctcctccccgcactttctcggcgctccctccctctcggctcgcacagctcgactccgcgctctcctcgccggccgccgccgcccagcctgcgcccgccgtccccccagtgcctgggcacctgttggaggcagaggcaggtgcagggggctgggcaggccgggggcgtgagggtgcggggaagcgtgccagcctgtgtgcgctacgggggtgttcggctctcctgcggctgcaatttctggctcccctgaggagccagaggtggcatctgaggctggggtctccaccgtgggctgtggtgagcgagcgggggaaccaggcaggcagacaggtcctggggctgaatgaggggacagtgggcagttggagcctagaggggtgggtgacaccctgactagaccagcgcctggtgcagaggaggacagagcctccgagaaacagaggcggggccctgcagggccccttgggggacaggcaggctcaggagcagaggggagccccggaggagaggaaggagctggcaagatgatacagggacaacctagaagtgggtgggtgaggacggggtggtgcaacctcgacttctgcaaggagtgggttggcagcccagcccctgtggagtcagcttggggtctgcagggcccaggcctcccacctgccaccggctggcacacaccaccctctccctcgacacctaggaagggaggccagtgagggccccacagaccgaggaggccgtcgcctggccctcagccaggatggctaggtatgatgggctcactggctcacacgccctctcctagccaggggtgctgcatgaggggccgcaggggcgatcgcatgaccatcaacatccaggagcacatggccatcaacgtgtgccccgggcccatccggcccatccgccagatctctgactacttcccccggggaccaggacctgaagggggcggcgggagcggcggggaggcccccgcccatctggtccccctggctctggccccccctgcagccctccttggggccaccacgcctgaggatggtgcggaggtggacagctatgactcggatgatgccagtgagtctgggggcttggaggccccatgtgctggtgggggtctccaggcttgccgtggtggggggagagggggatgggccctgctggctgtgcatgtaggtaggggaggagggcagtgggggggtggcaggggacggccaccacagctgcagtcagcgtggagattacagcttcagcaaggctcaatattcagtatttctgctgagacactccaccacccacacagccccagttgcggccgagccagggacccagacgcacacacgcatgggcccactcagcctcttgcactcacactcgcgggctggcaagagagagagacacacagagccagtgcccacctgctggcctctcgcacacacctgtctccataccgacccatgctgcctttcctctctctccagccgccctaggcacgctggagtttgaccttctctacgaccgggcctcctgcactctgcactgtagcatcctcagggccaaggtgggcactccctgccacccaagcccgggcccggtttgcgtgcagcccccagagggggcccattcctccttcccttcccaggcctgctccttcgtcctgcccttgccccctccttctgggctcctccagggtccagctctacaagagggatggagagaggtgccgggagcctctagccctctcccctgccctcctctccagggcctcaagcccatggatttcaatggcctcgccgacccctacgtcaagctgcacttgctgcctggagcctgtaaggtaacagcctcctctcgccccgcccggcccagcccatgactccagcctgtggggctggaggacaggtattgagaacctttcatccccacatcccaggccaataagctaaaaacgaagactcagaggaacacactgaatcccgtgtggaatgaggacctgacttacagcgggatcacagatgacgacatcacgcacaaggtgctcaggtgagggcccccctccccaccacccagcagcagctcggggacagctgacattgtaaccgctggttggttgatctatgtcccattaagcccgtacctctctgatgctcaagaaccatcagcggctccctagcccctttggcagcaggccaaaattcttccctgccattcctgcccctcaatatctcctgcctgccaggtgtggtggctcacacctgtaatcccagcactttgggaggccgaggtgggcggatcacttgaggtcaggagttcaagaccagcctggccaacttggtgaaacccccgtctctactaaaaatacaaaaattagccgggcgtggtggcatgtacctgtaaatcccagctactcgagaggctgaggcaggaggatcacttgaacccgggaggcagaggttgcagtgagccgagatcgcaccactgcactccagcctgggtgatggagactccatctcaaaaacaaaacaaaagtatcttctgcccctcaaacagaggactcccttcttccaactggccagttccacaactcctgaacttttcctgttgttttctatctggaaagctccttcctgccagcctaaattccgctcatctgaggttcagtccaagctctgccccctcccaaaaacgttcctgggttgccgagaccccttctcagagcccttggcttaagccagacctctgcagctttggtctgccccttccgtgccttgagttcccctaaaatctcttaaggagtgaagtcttcagggacagggaacttgctccgtcatcctaggagatggagatgtagggagagtactccctcaagtcaggtggcgggcagcgaaacccaggctctggagagacctctgcctttgtgcttggatttgcagctgggaccttccctgatggtcagggctgtgcagcagagaggccaccttggtgtcagctattcgggtggaatggaggggaggccagaggccaaaaccagaatgagaccaaaaaatgagcgctcaccagggcccagcccaggcttagcattttcacatttctttctttcccttgactatctccatttacagatgggaattgaggcatagggtgatcaagtgacttgcccaaggtcacacaggtggctcagaagtggcagggctgggatctgcccatcctccatgccacagatgcccagcctggtagtgggtcactgcggaggcagggcagggactgcaggaggacaggtggctggaaagcaatcatttcttagtgagtccctgcggggctggctctctgctgcatgcaggaaaaggacgggggttcccgaggaggcgtggggtactcgtctggctgcccaaggctccaaggcccttctagctctcacggcctgtgtctatggccacatccaccgtggtgttcggctcctgcccccaggccctgaatggaggcagtgagcagcgtgctccaagatttctgagggcttcccacaatggctgagcatgtcctgatggaccagggacagccgggtggctgcagagggagggacagaggaatgggcaaatctgcttgtccttctcaagtgccagcctgtcttccagatgagacatagtgtttagggcagagctgggctggtccaaggcccttcctacaccccggaacggggctcaggtaccccaggggccctgacactgcagttcccgaccaggatcgccgtctgtgatgaggacaagctgagtcacaatgagtttattggggagatccgcgtgcccctccgccgcctcaagccttcgcagaagaagcattttaacatctgcctcgagcgccaagtcccggtctgtgtgggggctgcaggggcgccaggggagggggccctggggaggccaggcttccagaaccttctctttgccccctcagctggcgtccccctcttccatgtcagcggcgctgaggggcatctcctgttatctgaaggaggtgaggcacctcatggggatggggatgcatgtgggtgggaggctgcaggggcccaggctgaccctgagtctgtgccccgcagttggagcaggcggagcaggggcaggggctgctggaggagcgtggccgcatcctgctgagtctcagctacagctcgcggcgccggggactgctggtaggcatcttgcgctgcgcccatctggctgccatggacgtcaacggttactcggacccctacgtcaagacgtgagcccttgctctgaccctctcctccccagggagcctgccctggcctgagttgggcctggcctgtccctcacccctcagttcgtctccctccaccccacccccaggtacctgaggcccgatgtggacaagaaatccaagcataagacgtgtgtgaagaagaagactctcaacccagaatttaacgaggtacccaggaggggacgggacgtggagggaggccagggaggggctggggagctggctcacgaacgggtggccggccttgtccctaggagtttttctacgagatagagctctccactctggccaccaagaccctggaagtcaccgtctgggactatgacattggcaaatccaatgacttcattggtgagggaggagctggctgcgggtgttgagggcgggcaagtggcagggaggtggccctgaccctgcccacctgctccccaggtggcgtgtccctggggccaggtgcccgaggcgaggctcggaagcactggagtgactgcctgcagcagccggacgcagccctggagcgctggcacaccctgaccagtgagctgccccctgcggccggggctctgtcctcagcctgagtggacagcagtgtcccggcacaggcccatcgagccgggtccagtacccaaccttcgcacgagtgtgttgcacgtttacacagggtgggctgcccccaccctgcactacctatttttgtgagtctccgtgacccgggtctgtctgctcatgaggggctgcggagttctatattcacatatgcaaacctcctgcctgactcgctagtccctgcaaatatgcaaaccccccatcatctgcacacccgggcagtgctcagagcccggccccaggcccccgcgctcctcactcctgcctctccacgctgccccgtccctctcccccaacagggaggaggtcggattaggggaggttcagaggaggagaatgtctcaaaaaaaaaggacaaaaaacaaacccagagccactcctttaatacagaaacttcattgaaaaaacctagccctgtacagctgcccttttaaagaggtggccattgcagggtctctgcctccccagcaggtggcagatgctcccggccactcgtttaaataactgtcccctggagggggccggggtttgaaggcagggcccctgccaccctcctgggggacacccgtgcatgtttacgccttttctggttgtgtcagtggccggagcatggcagctgggcatcaataaacacctccgaggaagctggactcgtgtgtgctggcacggggagggcgccgggcggggccgtggtgggcatggcgtgatgtcacggtcactccgggatgtcgatcaccaggtcatcgtctccatccaaggcatcgtccccgctacctgcatcgctgaacatctgccgagggaccgtgctcaggatcgtgggggggggcannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 12259 - DNA, 59977 bp, Human
  misc_feature (1)...(59977): n = A,T,C or G
gtccatcctgggcccagcccctgtctactctctctacttgttccctgggtcaccccttcccttctcagtctttcccatcatgtgactacgaaggagtctcaggtttgtatctttaacccaaatctgtctgtttaaacttcagtttacacacatagagtagaagctcgcttatcagtctcactttaactgacttgaattggaaaaatgactctctccaatccctccctgaaatacatgagctgatgcccaaggtatgatgacgactttcagcaagtaggcttcactctaatatatcgcaagcttttgccagctaagttgtatgtgttctcatatccagatgtgtttgttctcaaatctatttttgctacccgaacctgttatggtagttatgtacttttaagctcatcaatgaaatatgaatgcaaaaggaaacagttgtttctctataagctaagttgtatgtttttaaaaggctcacttgagtttgttaaaaaaataattaggtatgggggaaaaattgtaaaagattaagaaaattctaaagataatcgtatcaaattggttcttaaatgcctatatccttgtttaactttaaataaacttatattggaaaatgttaagtctgcaaagattaggccaaaacagacacagcctaaagaaaaggccctgggcttacatcaaaagattggcaagtatagaacttgaggtaagtggtgtaaaaaaaaaattggcaagtgaatgtatactttcatgttttaagttaaaaacatacatccatttcttcgtgattcctgttttaaccagttttctcaattaaccaagcaactgctgggcccaatcatgtcagacttttcagctatcaagtacgtatctttacccagttgtcaacagacacctcaaactcaacatgcccaaaactttatttctccctccaaatccactctattcatctttttcccagattacaagcctgggaatcattcttaactcctccgtgtccctcagcccacccattcttattcaccacgtcttggtaatgtttccttcaaatattttaaaaatccattccctatatttcctatccctgttaccacagtgctggttctgaagacaggcatagtttagtggaaagaatatgcgttgaatctttacaagtgtccatcttttaactgtgcttctgctacttacaagctgttgaacaacatctgtcagacgcatgtaccgagcgatatgaagtgtgcattgtgctcggagagtgaagggcgttaaacgacagcgaggacgaggggcacgagcccggcctgcagcacggccacagcctcgcgcttactcctccatcgcctcctggagtccccgaattcatcccgcatcctgctgggaaacagcgtccatccgacacagcaccgcccacagcgggccctcggcgtggcccgcaggcccttcggaccgcctgggagcgcggccacacgtgccagcaagtgagggcagcgacctgggaccgccgcgtctacttacaccgcgacgactccgcgatccacggacaccgcccggcccccacggcggccctgcaggggagaactcgggccgccttcccgagtcccggccgccgctgttcggctcgcgcggctgcccgccggggacccgaacggaagaagggtggcgaggcgggaaaggaaaaggcctgagggtccaaggcaggaggggacacacggaacacgccgagggccaaccacgccgccgcgcgctccccggctaggacccacctgctgcaggtactggttaatggtaatgtgcgccatgggagcgccgccgaacggagagcgccaccccctacgcctcaagcgggccagctggcgtcacttccggccctcggtccgtctgggtcctggcgcccccggccccgccgcgggtgcgcaggttggttccggagggagaacctggggaccggctcggcgacgcgctcgggctgagggggcccggggtctttctgccggggccccgtcctctcagccgggacgccagcggctctgattgtgtgttcgggcccgcccgggctgaggggtttggggtccagtggcgaggacagccccacggctaaactgcctttcactgcgctgacccttcgtctgccccttgtgaaaaccaggccgcggaggaccctccgcgcctggctgggccagggcctcggggcgcgcgcgcccgaggagggggagggggagggacatggcgcgcgctcccgagctctcataaggtgcctccgccgcgcgctcccgagcctgcaggagttagggcacgtcccggcgcgcacccctgagccctcgaggtggtctcacgcccggggtgggggtgccgagccctcaggaggcgcgcgccccggggccctcaggagggtgtcccggctcccgatcccctcaggaggggtgcccgcggcacgcatccccgagccaggagggggtgcccggagccctgggggcagggtctcggtgcgccccccggagccgggggtgagggtcccgatccctcaggacgggagtcccggcgcgcgccctcgagccaggagaggggtgtccgaatctcttagggggagtccgatccctcaggagggattcccggcgcgcgttcctaagccctcaggagtagccgggcgcggcggcggttgggctcgggcacgcgggcggggcggggcggggcgcgcgaggaggacggggcggaggccgcgcggaccggggcgggcggagcggagctcggcgggcggcggcgctcggggcggggcgcggcggttccggcccagccatggnnnnnnnnnnnnnnnnnnnnagggccaggcgccccgggcggggaccccacgagaccccgcccgacttggggggaaggccccgagatccgtgcgggccccgggagcgggggcgccggggcgccggccgggtcgggggtggctacgcggggcgcttcgcggcgcgccctgagccgcccgctctccctccgccctgcagacagacctcggctgcccgacaactacacgcaggacacgtggcggaagctgcacgaggcggtgcgggccgtgcagagcagcacctccatcaggtacaacctcgaggagctctaccaggtgaggcggcggccggggctggggacgccgctcctgccccgcgtgacgcagacgcggccgggcggccgctccgggtgcctcgcaggctctcgccggggagcggaaaggcagggcgtttgcctccactgcagggccgggagccccagaggcaacaagtggttttgtttattgccgtggtggaatttttgttttcaggcttaagctgcttagaaccatatttaaagttatcccattacggaagagaaggaggtgtgtttctaggagccacgtgactcatattttgcaagtatacggcaaattattttctcgttatatgtaaaactcatgactgtgtcacttgccacagtaataagagggtcttttctctgttgtgttttgtgattaatggttgcctttaagatattcaaacagattttgaaaaaattcaaaattcagaaaaagtggttttgttctctgttgtgttttgtgattagtggttgcctttaaggtattcaaacagatttggtagcatttaattcaaagtgatggtgttccgtttctgaagtaacaaaaaagtacattttaccatacttggatattttatttataagcgactttttttctggtgtcttctttttgtaaagtaacattcattcagtagtctaatatctatattttaggtcacgatgtgtcatacaattatttctattaaaaggcttgaattaaaaaaactttttttctggatatgcaagtgactgcattgtaaaaattataaaaaatacaaaaaagaagacttcaatcacctatactcctaccacccaaagaaaactactgttgacagtttggtgtacatacatccattctttgtctgaagtgtaagtggatgatgttttcttaccagctttgagatagagtctacatataatgtgcacttcaggaagttttaacagatgcatgcagttacgtaaccggcaccacggtcaagatggaatctttcttggtagaatggtagaatattgctaccacccccgaaattgccatgaccacttttgcagtcagccctctcccctgactcctagcccttggcggtcccccatttgctttctgttactatattttgcgatttctagaaccttatctaaatgcagtcatgtatttcatagtcttttgtatctggctttcacttaggacagtgcttttgagattcatgcacaacgcagtgtgattgtaatttattacctagtagaatgggtataccacagttgttttatccattcaccagttaatggacatttgggtgtccatgtttggggttttttgtttgtttgttctttgagacggagtttcactcttgtggcccaggctggagtgccatggcacgatcttggctcactgcaacctccacctcgcaggttcaagcgattctcctgcctcagcctcccgagtcgctgggattacaggcacctgccaccacgcctggctaatttttgtatttttagtagagtcggggtttcgccatgttgggcaggctggtctcaaactcctgacctcaggtgatccacccacctcggtctctcaaagtgctgggtttaccagcataagccaccgcgcctggccttgggttgttttaaataaagctgctgtaaacatttgtgaataaccctttgtttggacatatattcttactcctctcaggtgagttctgcttacttctttatctagaagtaagttctcagggtcatatggaaaatgtatgtttaactttgtacggaatttcttgtttttgcaagtgactgccccttttgcgtctctcccagcagtgtatgggagctccggttccactccgccaccagcgtgtgcgtctctcccagcagtgtatgggagctccagttccactccgccaccagcgtgtggtgtcctcagtctgtaactttagctgtgcttgtgggtgtgtggtggagtgtcattgtagttttagtttgcatttccctctgatgctaagcatctttgtatttacttgccattctatgtatcttcgttgacgaagtgtctatttaaatattttgctcatttttattgggttggttattttcttattattgagtatttgagtttattatgtattctggatacaagtcctgtatcagatattcgccttgcaaatactttctgcctagtcttcaacttgtcttttgattctcttaactgtgccatttgaagagtaattgttttaagttttcaagtcacatgtatcagtttgttcttctatggattgtgcttttagtatccaagaaatcttgcttaatctgaggtcacaaagttttctcttatactttcttccagacattttagagttttaggttttacatctaggtctacgatctatgtagagtgaatttttgtatatattgtgaaatacaaatctagagtcagagtcgggtgcagtggctcatgcctgtaatcccagcactttgggaggccaaggtgggtagatcgcctgagcgtcaggattttgagaccagcctggccaacatggtgaaaccccatctctactaaaagtacaaaaaattagccgggcgtggtggcaggcacctgtaatcccagctacttgggaggctgaggccggagaatcgcttgaacccgggaggcggaggttgcagtgagccgaggttgtgccactgtactccagcctgagcaacagagtgagactccatttcaaaaaaatacaaagaaaagtctagagtcagtgttttccctgcaaatgtccagtttttcagtctcttttcccctactgaattgcctttgctcctttgtcaaaaaccacgtaggagtaggaggagtgagttgtgaaatcagggtgtgttggccccccagcttcatacatttgcacaggtttctggctattcttggtcccttgtgtttccatgtgaattttagaatcggccaatttgtataagaaagtgtgctaagattttgattgacggtatatagaatctacagatcaatgtaggagaattaaattcttaacagtattgagagtctgggctcagtggctcacacctgtaatcccagcactttggggggctgaggtggcctgatcgcttgagcccaggagttcgagaccagcctaggcaacatggtgaaaccccatctctacaaaaaatttaaaaattagcctagtggggtgttgcatgcctgtagtcccagctactcagggcccccacaccacaacctggaagctcttcacacaggaagctgagcagttggggcctgtttgtctcccatctttctgagattcactgtctttcatagcccagtactcagtgcttcgaaaactgttgcttcgtatattttgcctgattttgtggttatttcaggcagaaagttaatacagttcttgtactgtgtcttgactagaaacgagtcccacctgaactctcagaggtctttggtttaataaaatatgataccttacagctaaagcttcttactactcttttcctggagatttggctgtctgatatctgctgcctcattatttttacttaaaaaggcggaattactttgcaacaccttgtacacagtgatatgtcttataaaacaatcactagatattatgaacaatgtttgtaggtgccttaggtgtctgtcttgaaaccctgagaactaggagtgcttaccccaaaatgacagtcactggttcctccttggaatgagacatcgcaaattccaggggcatctctggaggtgctgccccaccaggggatatgtggaatcagttgattcacttacttgtgatcatctctccacgcacaggtgggcttctggcctctcacagagtctgaagcatgagctgcctcagatctattggaagcaaatgggatagaaatctaagaaaagcaaatgtgaaattactgatgtctgatcaagcaggcaatacatttgacttggtgtttcaaaataaagtctcagtttttgtataggtggggtggtgtatactttgccaaagaatcttatgtgaaaggaccaattctcacccaagtttgaaaggtttggtttcgtgtttggtttttggttttgctcactctccctctacgtctaaacaccttaggagtcctgtcacttacactttttgggcctcagctggcctgttgtttctgtttgttactttgtttttatcattttcctcctgtagtgtgtagaggagaatgttgtgaaggcatggatcttttccattgaacgacctgaatttcggtctgtaataactaactcctgaagaaagtgcatcttctgtgtcttgtgtctctatgttttagtcctgcttgttgctaaatgagacaacagaaaactgaagactgcatttctagaaaggtttcagagaaaggctgtgttttgatttagaactggtttttttgttttttgttgcacaaaaacaaacctctcaggccctttaaaaaaaaagagagagagaggtgtggcctccctatgttgtccaggctccttgggaactcctggactcaaacagtcctcctgccttggcctcccgaagtgctgggattccaggcgtgagccattgcacccggctgacatgcaagttctgaggaaagccaggctgtctttcttgagtcacggagtagttgtcttcatgacatgttgataccaggtgataatggtcagtgaaagagagaggttagtcctttgtattaggtggcatccttccctcacacccaagctgcaggcccagcgtaggaatgggacctccacagccacacaggtctcatcctgtgtggctgtgaaggtcgctatatgactctggaggtagctatgtgactatggaggtctcgtcccgtgtggctgtggaggtcgctgtgtgactgtggaggtcacgtcccatgtggctgtggacatcttgtctgtgtggctgtggaggttgctgtgtgactatggaggtctcgtcctttgtggctgtggacgtcttgtctatgtgactgtggaggttgctgtgtgactgtggaggtcgcgtcccgtgtggctgtggaggtcactgtgtgaccatggaagtcgcgttccgtgtggctgtggaggtcgctgtgtgactatggaggtctctctcgtccgtgtggctatggaggtctgtgtgggagtatggaggtcacatcccgtgtggctgtggaggtcgctgtgtgactgtggaggttgctgtgtgactatggaggtcgctatgtgactatggaggtcgctgtgtgactatggaggtctcatccatgtggctgtggaggtctctgtgaccatggaggtcacgtcccatgtggccgtggaggtcgctgtgtgactatggaggtcacgtcccatgtggctgtggaggtcgctgtgtgaccatggaggttactgtgtgcctatggaggtcgctatgtgactatggaggttgttgtgtgactatggaggtctcgtccatgtggctgtggaggtctctttgtgactatggaggtcacgtcccatgtggccgtggaggtctctgcgtgactgtggaggtcacgtcccgtgtggctgtggagatctctgtgtgactatggaggtttcatccatgtggctctgaaggtctctgtgtgactatggaggtcgcgtcccatgtggctgtggaggtcgctgtgtggctatggaggtcgcgtcccgtgtggctgtagaggtcgctgtgtgactatggaggtctcgtctgtgtggctgtggaggtcgctgtgtgactatggaggtcgcgtcccatgtggctgtggaggtcgctgtgtgactatggaggtctcgtccgtgtggctgtggaggtcgcgtgtgtgactatggaggtctcgtccatgtggctgtggcggtctctgtgtgactatggaggtctcgtctgtgtggctgtggaggtctttgggtgactatggtggtcacgtcccatggtcccatgtggctgtggaggtcgtgtgtgactatggaggtctcgtccacgtggctgtggaggtctttgtgtgactatggaggtcacgtcccatgtggctgtggaggtcgctgtgtgactatggaggtctcatctgtgtggctgtggaggtctttgtgtgactatggaggtcacgtcccatgtggctgtggaggtctctgtgtgactatggaggtcatgtcccacagctccatggccttccttgttctgtcttccacatctgagagcagggattgcccttatccgcagtgagcattttgtttaagtagcagtgagttcactccaggcaatgctttgacactataaatagacgtgtatttgacattcacacacgtgtctgttgagctaatacagacaatcatttgatgaacctgctagttaggaagtagctgtgatgtgagaagagacagtgctggctgtagatatacaccaaatttcctcacttggctgttgatacaaggaaagcatcttgatactaataggagtagaatgcaaatgatacttctctacctccgatcattggattacattccttttctctggggtgaatctttaaaatgctaatggcctgagtgcaccaacatgaagcacacagtaccatctgattagttgctttatgcatccagagagggtatttctaaatctcaaagtatgattgagtgtcaaaaatccatttgggggaggggcaactcctgtgttgtgctgcttctataacagcacaaaaaagtcttccagtatgttcctgccagcaaggagttggcagggcggggagaaacaaaggctgtcgcctttccagtgatgagtgcctgtaatatgaagccgggagtcctgactcagcacctacagcaaacctgggttacccagggcttgccacttgttttgagaggttcttaaattcttaattttaaaaacaaagtaaattgcagtatgactcatatgaatagtaaatgtgcaccaaataggacacataggaggcagagtgggttataaaatatttagtcatttgccacaaccaggaaaagatggttttaaggatattggttcttggtctaggaattaaaacatccagaaaatggtcctaagttactgttgatttttgctgaagaaaatacattttcttcatgtgttatataaaaaacttactttgtaataattatgtttgtgggattcactaatgtttaactactggagcaaaacctttgtcgtaaagttctcttggttgtttgaggagacaaaaggatggcagatctttgaccaaattatgaagatatggaattcaaagggatggaattgaagagtttgagaaaggagttaaagtaaatacagaatgtgggtaggaattccgtttctatagtaagacaaaatgtagggggaaagtttgtatttctttgttattatgctgataataagcttgctagaaaacaggattataattaaaaacaggattataattattccacatcctcttttgatctttgtaaatatgcatgtattttatatggtagtaatcactgtatgtatttaactttggttaatatgtagcagctctccgatatttagtattggaattattaatacttgtgtaagtattagtaaaatgaatagctttataactttaatttaccttttttcctaggggtatattgtatcctaattaaattcagattatttatctaaagtgtttttattctgtatatccccacatttttcgaaccccacattggttcaaaacttgttagaaaaaccatatttctgtttataatatttcatattggaattgaatgagtttaagtttttgtacctaagattggaaaggaaattttattagaactggtaagaatgtacaagcattgtttctttgaggtgagtaaaaatattgtgagaaaaaattttctgcttcaaaaaatggtgtcagctgggcacggtggctcatgcctgtaatcccagcactgtgggaggccgaggcggacaaatcacctgaggtcaggcgtttgagaccggcctggccaacatggcgaaacccctcctctactgaaaatacaaaaattaacctgtgcgtggtggcaggtgcctataatcccagctactcgggaggctgaggcaggagaatcgcttgaacccgggaggtggaggttgcagtgagccaagatcctgcctttgcactccagcctgggtgacagagcaagactccaactcaaaaaaaaaagatttcttcttgtattaggggtgttcacagaataaaaaagaaagtttattaattaaacaaactgaagtgaattacacatctagcctgcagaaaaataaataggaaacaatacagtctggcctgtgtcacccagaaaaagctcagtttggattgaatcactgccctggggagtgtgaggggaaggcccagcctgttgttctccttcctgatgggaaggtggtcactgagggaaaagattttcttggttctctagccctgatttcactttgtaatcatcaaggtgaacttaaacacaaacacactccagtgacccccatctcagactgaggaatcggagcacccggaaacaggcctgtgaggatcaaacctgttgagaagtcccaagtgactgggcaccatagatgctcaggagtggtgcaggccagctgcctgggacccgaggtccagcaggtgcaatgtgcccacattaactgttgttacctctacccccatgccaactatgactggactgcagtgttccaacgagaagtgccctaaacttagccataataagtaatttatttgtagattcctgaagtactggggtagggtgtggggtgcctttttcttatgattacagctatgttaacaatagggtttttttatgaaccaatctgttgttcatactgaagaattgatgtagcccttttgtttgcaggctgtggaaaatctctgttctcacaaagtctccccaatgctctacaagcaactgcgtcaggcctgtgaagaccacgtccaggcacagatccttccgtttagagaatatcctttttttggttcataaagtttctattcattatctaagtcttttaaaactgaacattattatgataaagagctaatgagtatccttaatattaaaacaacagcttttaaagttctcttttatttgataggtttgtaagcgaaatttaccatttaaattattttgctgatttgaattaaagggaaaccgtgttcatttattgggtatggttgaagtatttaggaaatgttctgaaaaatgtcttcaagtttgagtatcctttattctaataaacaccatctgcattggctttctgtgataggcaacaaagtcccatcgacttggcgacttatggagacacccacttatcagcgcacagttgtgtctgtcaggaggccaggcaggattcagtggattctatgctcagtctcacgggcagagtcaaggtgtcagccaggttggggcctcacctgaggtctttgctagcacgggcaggcagttggcggaagccagttcctgtggtagtgggactgagggccctgccttctgtcccgtgttgcttggtgtcactctcagctccacatgcacaggtccttgcctctcctctcacagcacgactcttttctgcttctagaccagcaggagaatctgcctgtctgacctgctgagatagggccttatatgatgtaacccgtaacccagtcaaggaatgatgaccttcgtattcacagcctcgttcacagttgcgtgtgaggcatcctccacgtggggacagggcaggagcatctcagaattctgctgccacaccagctgtgactcagacgtctacaggggagtctctgggctccttggcatcctatagaaaatcctttaatctggactcaatctcattccccagcctcctcccagtactgtagctgtccatgtgtctcattgggtaggaattagaaagtagagtttataattgcagaaaatctacttgtggctgtacttttctaggcctccgtttcttcatgtgtaaaattaggtggtttgtgtttgcttatttctaagtgttcttctagttcaaggaaacttctgctcccccatctccctgatcttgggaaactaaaccattctgagttcattggaagggtcctcagggaatctgcagcagttggtgctgctgaagttgaagcacgtgacagggaagctgaaatgcagggtgagaggtctctgtttagacaatctccacagcaccccgcacagatgtgagtgaagtcggttccagctctgttgtgctggcttctgtaaatacgcctctgcagtgttttccagcaaagccctttcctaaagatcatgaggtcgttcaagagatcagtgaccgcacaccaccttttggaacctggccaaagtgcaccttatctcaggaggcgcctgtgagggcgcacagaagcaggccccgccccagtgccacggctcagcaatgcgcttccaggaacctacgttccagatgtttccatccaaaaagcggcctgactcctaggcttgggggaagtctttagcagatgcccaagccttctcccaaagacttaggcgtttatgagagtcagtaggcggtgattgttcctactctagttgctgtcccaatttacttgaaaacgactatctgattacctgatcaaatgaatcttttgccagttactcctactctgtgggttgactaatgtgccatcagttcactcactgcacaagcacttgctttctacctactgcactggcaccgcaaaatggaaagtgacccccatgcctgatttctaccctccaagaagtcgcaggcttatgggagaggcaggggaattactgtatttccctggtgcagtggcaaaactgtgattacaaaaattatcatttggttcattaaaggcaaaagaaaaaaacactaccgtattaaatgcccttattagtcatgagacaagatcttgagttgagaactgcgcgtcaggccaggaatggtggcatgtgaagcatctggggcagagcctcccagaggagaccctcctgaagggatggggaggatgcgccctcctgtggctgtggcaccagaagcagagcgtggagggtgctctggaaaccccgagcagcgggcacaactagaactccagagacctggtggcccttaggctgtgatgctaagttgcagactgaatttgaatctttgtggatactaccaaggagtcagacttcagtctgtgagtatcccagagtcctcacaggttttttaagcaagaaaccagaattagattgttcatggaggtcactctggcagaatgatgggataagtttacatatagaccagcacaccacagccttccattgggtcggcacatgtttttaagtatctgtcatgtgctaggtatgatgccaggccctgggaaaataaatctgagcagaatgggattctgtccctttggagcttaaacccgaatggcggtggcaaaagcatcaggataagcatttatgcagtgctgtgataagggttttttttgttttgtttttttgtgttatttatttatttatttttgtgagatggagtcttgctctgtcacccaggctagagtgcagtggcacgatctcggctcactgcacctctccctcctgggttcaagccattctcctgcctcggcctttccagtagctgggattacaggcgcccaccaccatgctcggctaatttttgtatttttagtagagacggggtttcaccacattggccaggctggtctcgaactcctgacctcgtgatccacctgcctcagcctcccaaagtgctgggattacaggcgtgagccaccgcgtctggcctgtgataagggttttcaaaggttcagataagctcctgggacctaaagaaagagcagctagcccacctgtgtaggggagcattgcaggggcgaagcgatgtctgggccatgtcctaaaggatggatgaggaagtggcaggcgctgtgggatgccaaggtggcacaggccagggagcagcgtgggcagccctggcgctgaggaagcttactgggcagaagagccaggtatgctgctgggtgtgggagagttgaccactgacaggatccctaaaggggaaaatgagaggaaggtggatgctgaattgtggaggagcctttgttgaaccaagaggttgaggtttatctgaaggtggagattgagccaaggtgttcaggcacagcatggctgggttatgttggtaagaagttagtgtgcctgtgtgtgtgcactgtggtgtgaggggtcacaccacaatggtttgactgggcagcaaaaccacagggtggaatggcagcatcctgccagcaaacctcttatggttagagggaaaggatctgactgctgtggaaggatgaaccagacacggattgaggcggggagggtctgtcgtggtcacgttgatttggaaggaggagacacggattgaggcggggagggtctgtcgtggtcatgttgatttggaaggaggtgaggaggcactcaggtagagatgcctgttgtgcatttggggctggagacacagatccagtggctccagacatggatgagatgcccaggaaaaatgagcagagtggccagacacagtggctcacgcctctaaccttagcactgcattttgggaggccaagttgggagggccagttgagcccaagagttcaagagcagcctagacgacaattagccgggtgtgtggttcacacctgtggtcccagctactctggaggctgaggtgggaggattgcacgagcccaggaggccgaggctgcagtgagctgagattgcgccactgcactccagcctgagcagcagagcaagacccccatctctaaaaagaaaatgagcagagccatgagaggaggtggatgagggctgctgtcaggaagatgagaggagaacctggagagtcatcttgtgggaatcgaggggcgagtttaatatggcaggcggcttagtgaccagtaagtagagtctgaggggatgatgagaccaggaagtggctggttactgtgatgaaggcttttaggctacattcgtacgttaacctagtaaacatggggtgtttctgtccaactcagcactgtgcgttggggaccagggacaggcatgaatggcacgggtcctgctctcaaaaagcttgtttttgctggaagagagttctgacccagcccagtctcacatggggaaatgttaatgtgatggcagatgctgagatactgtgtggcagggagtattccaaggtctgcatattcagatttcttttgcctctgggatattccagtacttcaagtaactctactttctaagatttaagtaatttgttgttgttgttgttgttttgagacggagtttcgctcttaattgcccaggctagagtgcaatggcgcaatcttggctcaccgcaacaacctccactcctgggttcaagcgattctcttgtctcagcctcccgagtagctgggattacaggaatgcgccaccacgcctggctaattttgtatttttagtagaaacggggtttctccacattggtcaggctggtctcgaatttgcgatcttggattatctgcctgcttcgacctcccaaagtgttgggattacaggcgtgagccaccatgcccggccagatttaagtaatgttatgtaccgattatattttgattgtatgctgatattagattatagatgaaacccatcagatgtgcaggtagaaaaagggcttttgtggaattgagtcattcactaccatcttcttcgtttaccacatccgttttcttgtctcacatgtttgataaattctgcacttagctgtccgtttcaaaatagatagctgctcttggtgacgtcccttcctcaaaataaaggccatttgtacccttgcactcatacacatgctcagccacaggcagctgctgcagaacccacaccacatgctgcaggaccacgtgccacccagccaagctacgtgggcaacaggagctcttcaaaaatgtcaagcccgcagagtgcggtggcttacgcctgtaatcccagtactttgggaggccaaggtgggtggatcatgaggtcaggagatcgacaccatcctggctaacacggtgaaaccccgtctctactgaaaatacaaaaaaattagccgggcgtggtggcgggcacctgtagtcccagctactcgggaggctgaggcaggagaatggcatgaacccgggaggcagatcttgcagtgagccgagatcgcaccactgcactccagcctgggtgacagagcgagactccatctcaaaaaaaaaaaaatgtcaagccaactgtcctcagaatctaacctgtagataactatagatgaaactcacattttccttcccctggttcaccttgacagcattgcagctctggtcagccacagaatgccaggcagtggtggacaccatgatagccgtgtggtcagaagggaagggcacgggagtgagctgggaaccttggctgttggggaagttgcaaagctccagtttcctctaagtgtgcctttatgatccgcactggcgacagcaggctttgtctttccttagaaagactttgtgcctgttctcacttgaccagatatcgtgtacggagcacttgctggcagtaggccaagctctgcacattcatgaattgctttgtctcacaacaccctgagccgtaggtatctttattgaccatattttccagatgaagagacgaaagcccaagagaaccctgttaatgctcggccagatcagaggagacaaaacaagcacccctgccttcatgggttgtgtggatgaatgagggtcggcctagggctgtcccctcgcggtctgtccggtctgtcggtacaggcagcagatgggccacttgttcctggaattgcagaagcagataaccaagtgtagaaaatgtatgtatccctcttctaccccaacagaagcaccgtctttttgctttttctttttttttttagttacagatatgataggtaggtttttttctatggtgtaagcatttctgctgttggattttgtttgctgtttgaagacctgcctaactcgtctcagtaggctgtataaatcgtttaatgaagattggcccttttctgaagtgagaaaaaggatggttgctgaagaacctatctcgagaatacactattgacagactcacggtgtctgtgtgtctcacatcctggaattacttgcacaccattgtggctatgtgttatatcccagaatatggaattgattttgatgtttagaaggccaaagcttacttagtaaatgccacactgattttagcttaccattttgtagtttttttctgtgggaaataacaaaaaaattattgattgaggatctatattgattttacagagctattttagaggaagtatttctcatttaatgaacactttacattggactttccatcttaacaagacactgccccaggtggaactctgtcttcacaacacctgagctgcccagtggtgtcagattgactggtgtcagtttaaccccgttaagtttaaaggatctgtgcaccctcatctggaagcaaagctccgccttcggctgctgtggcccgcctgcccgcagagaggcttgctgggaggtccaggccgcagttcccgtccagctcctggagtcagagctgcaggatggctgttgggggtccttgaagcctgtccagatgcacttgggatgggtttttttgttttgtccagactgtttctgtagattcctaatataatgagccattataattttgaacaatttgtaaagagtacttccagaggaacctgttaaccattcaaccattaggtctttgctgtaagtgtctgtttttaattttctggcagtgcttctgagaattctgcaaagcctcaagaaaaaatagagtaagctgtcttagccaggcccctgtagctttggtcacagcacttcctggtgtgacaaggactcagaccccccgggagccccttggctatcctcagcactgtttattcctcctcaggctctgcctggcaccctaccctccctggcactctttctttgtcaggccactcgttgccaccctgagactccagctcatgtctgatttgtgcatcctacttaactgatgtgtttttcctcctctctgtgtgtgaggatgttgtcaccacctcacattggctcttgagtgtgaagtgtcttgctgcacggcagaaacagacctagagaagtcccttggtttggccagtattgtgttgctgacaggcggtggatcaagagttaaaatgtaggaagtccatgttctgtcccctttgacaagccattttcttaatctgtacaaagggaacaatgtctgcaccacgaggttggggagattttcagtgagagtggatgtgaagagtgtttcgtaaaccataaagcagtttattgtcattgatgattctcagctttgcatgaacctgagggacaccagaccacttgctctaggagcccatattctgggttctttgtcctaaactactttttgggccttttcctaaaaatacacattctaagagtcaaggtaagagtgttcctaatttggtgcatggatgagagttcatgttagttttcattgaggctggaagttaaacctgagccattttcctgtccagctgcactttgccacaggctgggcacactggctcatacctgtaatcctagcactttgggagactgaggaggattacttaagaccacgtgttcaagaccagcctaggagtatagtgaggtgccatctcttttaatttttaaaaaatagtcctagtgactcttaccaggccagtcaccatctccaggagcccccctgtgggagtatgttcagtgtctgccctttgtgaagtggggccttttgtcccgccacctacccccagggcacttaaggcctgggtgtgtttctgccggcagggacttgaaggtgtctggcagtgaaggaaggagaggatgaagggaggctggagagggagtggcgagcggccagaggcaggcggggccgtgggaagggaaagcagcacaggcaagctgagtgcacattggtgatgagatacagagatccatgattgaacttctagtgtatcttagcccactggggctgccatgacaaaacaccatagagtgtggctcatcaacagcaggagtctgttgctcacagctctggaggctggaggtccagggtcaaggcactggcagattgcatgtctggtggggccccgcttcctggtccatagccagcaccttctcactgcatccttatgtggtggaagaggcaggggagctctctggggtctcttttgtaaccccattcttgaggcttgtccactctcatgacctaatcacctcccagaggccctgcctcctaacaccattaccgtagagtgagagcttcagcctatgaattttggggggacatgaacattcaagactaatattctttcagtattccagttactgaatggtgtgtagtattcagtggagaaggtagctgaaattaaggggttaaaattgtaataatggccggttgcggtggctcacgcctgtaatcccggcactttgggaggctgaggccagtggatcacaaggtcaggagttcgagatcagcctgaccaacatggtgaaaccccgtctctactaaaaatacaaaaaattagctgggcgtggtggcacacgcctgtaatcccagctactcaagaggctgaggcaggagaatcgcttgaacctgggaggcagaggctgcactgctgagctaagatcgtgccactgcactccagcctgggcgacagagcgagactccatctcaaaaaaaaaaaaaaaggtaataattaaattggccagcatttttaaagttttccttagcagatctgtacagactcactagatagtgttttatttttaaagaagattaacacgtgctggcaggaccactgcagacaaatggtaagcttgttcactttttcatcaaaacacgacctcatccatcttccctcacccacatgattgagagctgagacatagaagttctgttgaggattctgtctgtgttcagtgctgtggttgaacagcacgatgagaaaagcagggaaggtgaactcctcagctcctgtgagagggcaccactgaccctcttggccttcaggtccacagtcacagtccgcagtggtgacagggttcttagatgcctgcatgggtctctaaatgtctctttaagcacagtttactcctcagaatctagcctgaatcccaggtctttcctgcagctgcacaaccagcgtcttaggctttgtagatgtcttggctttgacttgacgtcatgtatacatttttagtgtgacctggccgttaattacttaagtgagagaacagaccgtattaatagctttcctaagtaggttgaaatcttccgttttctaaatgatatcagtaggagacgatgggtgtatttcttttctgggccaggtagctggcagctgctagagctcgctgagggtctgttgggaagggtttggtgagatgcgttcacaagtctccccagccaggtagtgggctcgatggtaggagcacaggacaggaccagggatcatcctgcatccctcactctgctcgcaacgcagagtcagagacacacgtccaagagcctcatcatgtaacaggaactcaggttttaaaagctaagtgcatctccctaatctagtaagaagtagcacatcagtcaaaaaaatgaccaaatttaggccgggcgcggtggctcacgcctgtaatcccagctctttgggaggccgaggcgggcggatcacgaggtcaggagatcgagaccatcctggctaacacggtgaaaccacgtctctactgaaaatacaaaaaaaaaaaaaattaaccgggtggggtggtgggcgcctgtagtcccagctactcgggaggctgaggcaggagaatggtgtgaacccaggaggcggagcttgcacatcacgccaccgcactccagcctgggcgacagagcgagactccgtctcaagacaaaaaaaagaaaaatgaccaaatttaaaagatatcctttaggccttggctgaacacaggatctctttaaaaagaaaaaaaagataccattttaggctaagtgcgttaaaattcctacagtcagatttacaatattaaagagatggaaatcacataccaaggggacaaaattaactttagaaaaaaaaaataaaacatgagggctgtggtggacaggaaacagctgttggatttgagacagctagcatggagttaaaaggcctgatctttcatattttgctagtagaattcataagtaaatggttctcctttctgctggtcagatcatgatcagaagcatcttcctgttcttggaccgcacctatgtgctgcagaactccacgctgccctccatctggtgagtgtcctcacagcgcagagctgcgtcttccctgcagctgatgcttttcgtcccgtttgtgtcttccgcaggctaagatggtaaagtgtgtgtgattacttgtgccttcctttcttcagccaaaatcattaacgtgaacgtaggagtccaggtgggtcttagccttgaaacaccaggtgtctagccagcagcaaggagtggagcaggaagctcggacaggcggctgactttggtcatgagggtgaagacagagggtcttggtttctctctgacgactggaggttgagcctggagcggctctttccagcgctgcagttgaaactcggagaaagactgcctgctgcccgtggggtcgcagccctgaggctgtgcgtcccctgtggaatggcttgctcagcctcccggcctcctgagcacatagcactcatcgtccgtcatctttcggggactgtatacaccaggggttctggggcctttcctcagcagcgttcgcggccacggaccccacatgtcctctgctgacccctgtgtgtcctctgtggccaccccatggcgctgaatcctgccgcctcctgcaagccgactttggacaaaagctgtgtccggtctcaccgtctgatttgtcttgttctctgttaatgtagtgtttcattcttctcacattcatacataaaagtgatgtcgtgccttctcatgagctttaaacccaagttctttaaaatgtgcctgcttttcctaccccacccactgggcacgctgacccaaggcaatgtgatttctgctttcgccatgtagagattgctcttgtctgagatgtcggtgacctgccagttaccaaatccagcaagcatttttgtccttattttatacaacatctatacaattttggacaccctgtccttgttgaagctcccattaatgccatttgcccttctaacttcctcatggaactcccaaacatctcctagtaggcatccatgtggtctacgagaaggcaaacgctgcacagaaaagacagcctgtgttccaggaaagaatggagatgataaaagtgatcatagcagattatttagcatttgctctgtgcaagggactgtttcctactaatgtatttaatccctagagcagctctgtggcgtggccattgtcactcctattttatacaaactaaggcacataagttaaaataacttgccctacctcagttgtctggcccatagtctaaatgcttttcaaaaattattattattattattattatttttagagacagggtctcactctgttacccaggctggagtgcagtggcacaatcataactcactgcagcctcaaactcctgggctcaagtgatcttcctgcgttggcctcccctgtagctgggactataggcacgcaccaccacattcgactaacttctaaaaattttttgtagtgccaggatcttgctatgttgcccaggctggtctcgaacccctggcctcaagcgatcctcccacctcagcctcccaaagtgctggaattacaggtgtgaaccaccatgcccaacactaaactcttaatttataaacatagtttataccataactgtcatacaaactataaacattgtttataaaatagaataaatgataccacctccagtctaccacaagtggctaaaaacctgaacgtgagcatcattacaagaagaatcctggttgaggtgtgtgtgggcaatgcatggtgaggagatactttgtccatctctgggatggggaggagggctgagggtgaaccttggcctgtgctttgaagaatgagcaaaggtggtcaggcagctaagaaagaaagagtagaaggaagcagtaagttcaaagccgagtatctcctgctagtgatggctaggacggcagcatgaccagaagaagcctgtgtggggagtgggaggtggggagggatagagctgatgagggccctgaagggtttttcagctgaggttgatgttttaaagagaagatcccagtggcagggtagagagtcacacaagtggagacctaagccttcctaagcactggctacctgcctggcactgccccaagggcttcagaggcaggaactaataacatttgatccccattttaacagttcaggaaggaaaggcacagagacattaagcttctcacccagggtcacacagctagcaagtagtagggccaggattcaaacccaggcagctgcctcgagcccacaagtctggccactgcaccttcctgctccaactgtggtgaagtgcacagaagacctggtgtgcagcacacgcgggagcaacaggagaggcccatggtgatgtgggcagtcaagggaggtgcacgtctccaccattgaggtggctcccagggccctctgcacacctgtgtggcacccaccactgcggctgctgccaccactgccaccataatattattaataatactaccaccaccacccgcctaccactgttactactgccaccaccaccaccaccattactgctgccaccactacccgcccaccaccattactgtcaccactacccgcccaccaccattactgtcaccactacccgcccaccaccattactgtcaccactacccgcccaccaccattactgctgccaccactacccgcccaccaccattactgctgccaccactacccgcccaccaccattactgctgccaccactacccgcccaccaccattactgctgccaccactacccgcccaccactattactgctgccaccactacccgcccaccactattactgctgctgccaccaccagtattactgtcaccgccaccaccgctattactactgccaccaccacctgtccaccactatattactgctgccaccaccaccactattactattactgccaccaccagcaccactcctgccctgatgtgccaattccggatttctggctggagcccagcatctgtatttttggcccctccttaatggcgtacttggccactggggacagtaggagtgttgaagcaaagcacagagcccacaagatgggttttgtggacagccactggcagctgaaccatcttcctaacattcctcaggccatgagctgaggactgcgatgaactctgaaagctgtgcatcaccttctcttctcaggggaaagcagcaaacatttggtaggagagctcccagggcttggagaagggaagctgctgggacgtgctcagcagaggacactgggaagagagtgtaccctgagggctgttggagacggtggcgggaggggcaggtggggcaggcagggtcgtggtgcccaactgcctgagtgtctcccgtcgctcagcaggaaggtggcgaggaccccgggcttctgccagcagcttgtgtgataccagttttactgtcagtggcatgcatgacctagcagcgtctccaggaacgtggagcagctctgtttaaggaaggaaatacaaggcgcgctagactggctgagaaacagaagtttttaaaaggaattcttggcacctagatgtagagaattagcaacttcacatttttgggatgatattgaatagcatagctggagattcacccataacttctaaaaagcgaaactaaaatgtagtcctgtttcttactgtctatacagggatatgggattagaactgtttagaacccatattattagtgataaaatggttcagagtaaaaccattgatggaatcctactgctgatcgagcgcgagaggagcggcgaggccgtggaccggagcctgttgcggagcctcctgggcatgctgtctgacctgcaggtgagtgctgcctgtgcggaagatacctgggtacctgcccagctacttgcaccagaataaatggttgtaccaaagatgttaaacaatgaaatcataaaggcatttgttgaagataggagagtctttaaaatccctagaaggggaatagcgctcaagctaacaccacaccaggtgccacaaaagagaagatagatcaatatcactacataaaatgcacggatagatcaatatcactacataaaatgcacgtttttcatggaaaatataaacagagacaaagccagatgacacgctgggggaaaatattagcaacacacacaaaagacaaagggcgaagttctttagagcaataggaccccaaggcactataggaagagaacagaggagggcctgcccggccgttttgggaaggacagtgcagccggccggctgggtggccacaggcgcctccaagttcaggtcatggcagcctgccccgtcagaaactgggatgtgttagcacttgtgaagatagtttcctttactgaaattggtcagtaactctgcttgtttcttaggtgtataaagattcatttgaactgaaatttttggaagagactaattgcttatatgctgccgaaggccaaaggttaatgcaggaaagagaggtgagatgatgggatgtttccgaatcccctggcttcgtttctgcagatgagcacctaggaggactttcctcatgtttgccttttcacacacatgcaaatgtttcattgaaaatcttctgaaagctgcaatcttgccagaatccccagtaatgagcttcgttcttagtatactaagaatttagtttatgtgaacttagaaactattgcactccccccacaagtaaaaagctgtaagatcatttctgaaataattaaaataactcaaatttaagcaagatgataaaaacatacatgaaaacttaaaaatataaatgtaaatgataaaatttttcatttgtgtgaagcactgcaaaaaattttcccaaaaaaagctgtgcgaaaaaacatgtagtagtaataggaacccaaaaaacttaatcacctttccagataccagagcaaaatcataaaggaacctgccccatagactgtcacccaaatggtgcgtgctactgccagaatggaccttagccattggttccttcattctggctttgcagaggaagtttcatgtcagatactgagcccagctgcagctaccccagcagagcctcaggcctttcccgcactgtcttgggaaacatgggcgtactttgaggtctcctgcaaccgtgttgtttggtgtcccccaaatgaacaaccaccttgttgacttgcttttgctgacccagctgtgcggggcagggttgccatttagcacctcatcctcctaccaagtgaggctcagctccctgtgggccctggggatgggaggagggtgtgcacagaccccgaaacttggtggtgcacagggacgaaagagaagtgcagcctgggccctgttgtaggatggatgttaatatcagcgtcctttctccatgtcccccacacacatttccgtcctacctctccctccctgttaatctgtgttaatatttggcttgaatatgtattctgctttttaaaaaaattacatgtaaggaaaacaaaatctcaatttcttggatagtgtcgacattctttttgttactgatacatttaattgttttgtttgtaaggttccagaatatcttaaccatgtaagtaaacgcttagaggaagagggagacagagtaatcacttacttggaccacagcacacagtaagtaccgtttgctcgctgagcgttcgtatcttcaccatggctggaaggttctcctggctggttattgaaataaagggtgtctttgtcaattcattcagtactaagagtgtttttgcacctagcatattttactttgttatttgtcattatttggcattcacaaattacagtttttacccagtgccttgtcatgagttacgtctaaagagagtaaatcttgctgagatacttggcatctttgagttttgagacggtctatttatgttaatggagtatcactgaatattaggttattttgattgtgcattctctgttacacattttatatcgctttaattttatttatggtgctgtcacacaattttctcttttcatcttatgtttttttcctgcaaacctgaggttgatgagtagctagggaaacaaaaagggagagattatgtgagcgtgtgtgtcaggcacagtgtgtccatatgatgggaggcaaggacagaggcagaggggacagcaagggagagaaatgaaaatgatacagtgtgcagctgggcgcggtggctcaggcctgtaatcccagcactttgggaggctgaggtgggcagatcacaaagtcaggagatcgagaccatcctgaccaacatggtgaaaccccgtctctactaacaatacaaaaaaattagccgggcgtggtggcgggaacctatagtcccagctacttgggaggctgaggcaggagaatggcatgagcccgggaggcagagcttgcagtgagccgagatcacgccactgcactccagcctgggcgacagagcgagactccgtctcaaaaaaaaaaaaaaaagaaaatgatacagtgtgcagaactggacccagtagggaatgataaaatgtacagatgtgcagaacaggacttggtaggactcagcagagaaaacaggaggagagatgaaaatgatatggtgtgcagaactggactcagtaaggtgcggaaaggggaaggattctgacagaatccagcacaaaaacagagagggtgcagaaaaagagatttggtcacttagacgtgtggagttggaggagcctgtgggaaatccaggatctcgaggcaggccagggtggctcgggggccatgttgtgcttccttccaactgggagcagaagagcagcccccgggagactgggaagcagcagccagggaagtccgggggaaatagtggagagagcggcagccacagcgaagccccacaaccagggtgtgcaggtcacacacagcttccctgagccctttctgcctgtgtaggaagcagaaggcggaatgtcggctctgcccttctccgtaagatggtgcattaaaacgttccttataaactggaaatgaaggcttgggaagatggctaaaatcagcaatccttggaataacgcagaagcatccctgcttccctgggcccgcccgtgggcctgcttgtgctgttcagtaggtggtttttagaaagggcttccttcagcgtcattagcaacaggagtcgtcgtccgtttgcatgaggaaatgttcttaaccttccgtttctgattgcctctagactgcatctgtcatagacaaatgcccccatcttttgcagagaaccagtctcttctttaaactttacttctaacgcttattctttttaccttatataggaaaccactgattgcttgtgtggagaaacagctattaggagaacatttaacagcaattctgcagaaaggtagatttcctaactcttgtgcaaattaaactgaacaattatccttagttcattaggaaagtaaagggggcattacaaatagcagtgttaggacgtttgttattttcataagacagtcattaaaaatcttttctaatgaacatgttagccatccacgggagaaaaaaaaatcagtaagagaaataatggaaggcacctagtggaactacattcactgctaaaaccccagtggcaggaaggcccggcagaccttctgtaccacactcatgctgaaacatgggtgcagtgagcctgttgcagctctctgagcagactcatttcctgtgtccggccgttcttcatgcacactcggatgtaggggactcggggagctgttcgggctgttagattttcgtgaggcttccctcacctgcggacttcgtgcatcttagtgtcagatgaactaccgactaggtggtctgcttaagcagagtatacttttctcctggttttctggaagagaagagcatgtgttctagtgctgacggcgcggccttcacgtccgcttctccccaagtggtggcagtacctggccataggaaggtggcttctagcagcctgcacctttaaaattgatgctgatgtcttacctcgatctttgtttattgctgttttttctaggcttcaaagtgtgctgaattctatgaaaattacaatgagcagtctaacctttgtaacactttagtacttactggcacatttcactgttaccatttgaaacaatgttaccttctgaaagtcattttaaatgtatttggaaaatacgagacttttttcaagccattggaaaccttaaagtttaattttgagaaggccctaaatggtattcaaatatattctgctttgggttctacattgtcagataatagtattatggctaatgagatacttaagtgaaaccagaataaaaccaaaagggaggagaattaacatgattgagcatctcctgttacaaacaactccacttgatgtgaatatcttttcaagcaattctgtgaaatcattatccccattctacaaataagaaaaccagggcttaaaacagccagatgttggtgcctggaatcacattgcttgtgagctgagagtcacgggtccaatctggttatgatgtttctgcttattccacactgaaacctacacatcacctatccacctaaaaacaaatgcattcagaatttgtgtcaggtgtttttatgaaaggagtcactttataagaaaaaaggccaggcatagtggcccatacctgtgacatcagcactttgggaggccaaagtatcactttggatcacttgagcccaagaattcacgaccagcctgggcaacaaagagagaccctgtctctaccaaaaaaataaaaataaaatttttttttaaagccacaggtggtgcatgcctagggtaccagctactcaggagggtgaggtgggaggatcactttggcccagggggttaaggctacaaaactacaaaaacctgggtgacaaagcaagagacctgtctcaaaaaaaaaagagaaaaaagatttcaagtaaatagtagaaatttgcataaattgttccagtgcatactttgttaagcaaaattatttaaagaaaatggtaaattatatatgtaaaagcttaccctaaattttattagaaatattttaaaaattaaaaagatacttttgaattcttaagacatgggttttagtaaaataaagtataaaaagtttgtgtcagtagatcagaatgtaattgagagaaataaacatttggagctctaggtgaggattgtaattatagccccaccatgtgtttgcgcacagctttaaacctcctcgtttgtgtgaacatcgtgcccagtgtaggcagaatctgagactttgtgaattgtatgactgttcaccattttatgctttaacctggctgcctctcagtagttatcataaagcaagtatttagaaaatctatgagagtttttctcattgaggtatggtttcagaaaaccgttataaatattaaaaatctaaaacactgaaagcttttttaaatgctgtgttaaacacttcaaaatatccgatgatgtttttctcttatagtttactataggtgtgaataaatttaatccactataaattagatttgatagcttgtccttttacattgtctggccgatggactaaatcagaagtagattgagaacatgaacctcccaggttaaatagttggtgtaaactggattttctgacttgctaacttaagtgaaataagagggcttcaatgacataaagaagtaaataatacatcttccaacatactcagagaaaatgaggttcacctaataggatccatctcacatatttaaccagatcaacctgctcatgtagaggcagcgatgtggagacccgcccaatttctaagcggtgtattgacgttcttctggtgcacgctgtattctagttgagttgttgttaatgctgcccatgctgtactctgctgacgtgtactgcacatctcagggctcgaccacttactggatgagaacagagtgccggacctcgcacagatgtaccagctgttcagccgggtgaggggcgggcagcaggcgctgctgcagcactggagcgagtacatcaaggtactggcggggttttgaggccgcgggcgtgggcattccctgcagggagcagagcccctcctgagaacgcctagtgtgccctggcaaagggaactgggctgctggagggcccgtctgcattttcatcacagatgatagggtggacagtaggcttccatctgcttcccaatcaccagtgtgaatttgctttttaggataacaccagcagtgattagcaccatcaaggtagaaagtataacttaaagaacaactgttttgctcttcttcatcagcataaatattggtttaattctaaatcatgatttttcctaaagtaatcatttttgtaaatctgcttgtcagacatgatctcctcatgccctttcctcagggagaactattatatatttggcatatcagtttgctttataaactttatttcttaacggtccaaatttaggatttattacttaaactttcactttcatgtttcgaaagcatttctttggcatccctaacaagcccagtccaacccgtcgtagagtggcttcttgggcagtaccctgagttttcacatgtcctgtgcaggagaacggccctttggtgctgacataggacctccctgaagactaggggctctcggcccagggcaccaccccaccaaggggacatttgttgatgtctggagacatttgtggctgtctgaacagagagggtgcggcttgctttgctgggcagcaccaggggtgctgctgaatgcacaaggcagccctcaccacaaagaatcacctgcccagagggccagagttgcccagcccaagaaacctgctgaagaccctctaatgagaagccattctccagatgcccctcacagaaacaggagaactgaggcagacatcagggccccttcacagatagctcgtgttttcaggatgtgccagttgcctagcatgaattttccagcttaaatggtgaacatttagcaaaagtctgtgtttttgcttgctggtgactattcttaaatcccataatgaaaagataaacaaaatttccagagaattacactaagaggaaaaaaagaaaagccaatcacagatacttaacgtgttattgcataacattttggaaatgacaaaatttagaaatggaggatagatgaaaagttaccagggtgtagggatggggcagggtgtgtggttataaaaggccccaggaggtagccttctgcgggaacagtcggggtttcggccgaggtctagatgtgcacacccagatgagttacgagtaaactgggccatgtgaaaaagacgggtgcgctgccatgtcagtaccccagctgagacactgttgtgtagtttcgcaaaccgttgccattggaggaaactgtggaaataaagacactgggattgctttgctatttttactattatgcaaatctgtcattatctgaataaagatttccgttaaataaaaaagataaagcttacatgctgctttatggaataatcagacctgaagtcatgtatcagtccagctgtggaaagccagcactcacagcacccctccccacaaggtctcgtacaatgatagaattggaacttataactgagtcacactaaattggccataaagctactgaagatttaggttttttgccagtgagacagtcttcaggggatgggaatgtgtgctaaaaactaggaaaagttcacctttgcagtttccagtctgggtaataaaaatcagtgagtgaccatcacccctgagtgtcagcaataagtagttatactgtaacaaaatagtagtttatattcaactccacatgccgttatcaaaataaagctgggccttgtagtgtatgtgcattatttcaaaatgcagttagcaccaaagggtgtagagtaagaggtaagtccctcccacacctgctagccacacaccgcccctctctgggagagtctgtgccctttctgttggcatctttttttttttttttttttttgaggtggagtctcactctgtcatccaggctggagtgtagtggcgtgatctcagctcactgcaacctctgcctcctgggttcaagcagttccctgcctcagcctcctgagtagctgggattacaggctcccgccaccacacctggccaatttttgtatttttagtagagatggggtttcaccatattgtccaagctggtcttggaactccagaccttgtgatccacccgccttagcctcccaaagtgctgggattacaagcgtgagccactgcgcccagccttctcttggcatctttccaccagccagctacctcgcgtgtgtgtgtgatgtgtgagtgcacatgtgcattctattgagacgaattttttaaatccaatcattgtattcagttcctcttcggcatatatagtttatatcatcaaatgttaactgtttattagtgccctacacagacttttaggaatgtttaatataacagttttaaattaaaaatacaaactaggctaggcacagtggctcacgcttgtaatcccaccactttgggaggccaaggcaggcagatcatgaagtcaagagatcaagaccatcctggccaacatggtgaaaccccgtctctagctgggcgtggtggtgtgcacctgtagtcccagctacatgggaggcggaggttgcagtgagccgagatcacgccactgcactccagcctggtgacaaagcgagagtccatctcaaaacaaaaaaaaaaaagtacaaactaaaaaagtgagcttttcatggttagaagtgatggagaaggaaaactagccaagaagtcccaagaggtatattgaattaataggaattaacttgtcttggaggaacttacacataaacattctttaaaaagcaacggacattttccagtcgtttgtaagttctctcagaaacagaatcgtaagaccaatgcattaattgtgtatttaattgtatattcacaccaagcacaggggctcatgcctgtaaacccagcactttgggaaatcacagtgggaggattgcttgaggccaggagttcgagaccagcctgggcaacatgaccccgtctctacaaaactttaaaaagatgggccagatgtggtggcctgagcctgtagcaccagctactcaggaggctgaggtgggaggattgcttgagcttgggaggttgaggctgcagtgaaccgtgattgcaccaccgcactccagcctcggccgcagagtgagggcctgcctcaaaaaaaagtgtattcacttaatttttgaaatgtgaattcaatttgtgaaacttttaaagttattgagtatttactactaagagtaatttatgttaaactatcctgattatatgatagcaggagaagatactgtttgctattgtaaacatgttgctgagttggtattgatttgcttttgtagacttttggaacagcgatcgtaatcaatcctgagaaagacaaagacatggtccaagacctgttggacttcaaggacaaggtggaccacgtgatcgaggtctgcttccagaagaatgagcggttcgtcaacctgatgaaggagtcctttgagacgttcatcaacaagagacccaacaagcctgcagaactgatcggtagaaaaatatttgttttttttgtttgtttgtttttgagacagtctcacccatttctagacaattttttaatatgggaaaataaggcaaaatcaaccaaaatgttcaagctgctcaaggggtgtgtggaaagcgtttttatcaagtcttattaggacacaaatttaaaaaccgacacacctgcatgcatgggtggaggagggcatttccataagggaagatgaggtaagaatttagaaaagaaatgatgcttgacttcgccaaagaagggaggggtgatcaccatctttgtatcctctaatccatattaaaataggataaaaccagatgagatctcaaatgataatactatttttaagctgtacaattttttcacaataatatcaaaatatatttcagaattcataggctttctctagtcagtaaaattttttttttaattcgaaggagaaagggggcaaagagagctgaaatacgacgatactagattgactgttgattactgctgaagatgtaagatggaacatggagctcattgtgcaattgtctgcttttctgtgtgttcagaatattccattacaaaatgtttaaaagaaaaaaactaacaaaaacagcaacagaaggaattcaggaggcagtttactttggcttttgttcctctgtatcatttgtggtttctctaaagcaaagggatgttgagctcttgggagtttgggcttctggaagtcttgggttctcccatcacatggggactttggtcctccctcccaagccacctgacgatggcttgtgcagcctcagaaacaggaagcccgagtagaaatgctttcaccctgcgttgccaccttggatgctctgagaaagtctttctctttgagaatgtctcctctgcattcatgacaccagatcctagaaataggcactccagcgtccggggcagtcacgtcctgaaacctgagcatgtatttgctgaagtcattttattttgaaattcagagattgcatttaaagataagaaagatatttaaacctgctttaaacattcagtcctggcttcattaaaattttggcaagtatttactctcacttgacttgagaagtacttaccttagaaaatcagatatttgtttttttgtcatatagtcattttgggaaggttccagaatgttcctgtacaatgttgctaatagaaattgaagatgctctctttttctagtttagagtatttactatatgtttatgctcacagcaaagcatgtggattcaaagttaagagcaggcaacaaagaagccacagacgaggagctggagcggacgttggacaagatcatgatcctgttcaggtttatccacggtgagactcgggcactcagaaaatgctgcataatcaagaggtgtaaacaggccctgctttcccagaggaggtttagcatgagaatgtcagtatcagtagagccagtttgcattagaatgaacacttttcatccttgctaacatggtgaaaccccgtctctactaaaaatacaaaaaattagccaggcgtggtggcaggcgcctgtagtcccacctacttgggaggctgaggcagagaatggcgtgaacgcgggaggcggagcttgcagtgagccgagatcgcgccactgcactccagcctgggcaacagagcaagactctgtctcaaaaaaaaaaaaaaacacttttaagggttttcagcagttgaagtttgaagtttaacatttgcttatcaactctctgatgtcttgattattctcgtctggttataaataggtaaagatgtctttgaagcattttataaaaaagatttggcaaaaagactccttgttgggaaaagtgcctcagtcgatgctgaaaagtctatgttgtcaaagctcaagcatggtaagtatgtggggcctgggctcctcccctgtaactgagggttgctgccccgtgtgttaccccgatctcactccctcctttgctgtgtccagagtgcggtgcagccttcaccagcaagctggaaggcatgttcaaggacatggagctttcgaaggacatcatggttcatttcaagcaggtgagttgtgtttcttaggtaaagcggctttttaaaaagtatctgttagtgtggtggctcatgcctgtaatcccagcactttgggaggcagaggcaagagacgttcttgaggccagaagttcaaaactaccctgatcaacatagcaagacccagtctctacaaaagaaaaatttttttaatgaacaggtagtcctagctactggggtagggctgaagtgagaagatcacttgagcccaggagtttgaggctgcagtgagccgtgactgcaccactgcgctccagcctgggcaacagagtgagaccttgtcgtggatgggtggatagatagataatacatagacagagatagcagtaccttgtcatagatagataaatagataaggtaggtagattcaatagattagatagaatgaatctcactctatgtaagaagaaaattacactattaacgtttcacaagtaaattttaaaagaagaaaaagaagatctaaacgtgtggcaagaattttatttcagtgagtctggtggtgacacctgaagaagggaaaaaggcagtcctagtgaggcattgggtttcatggaatacattctggggactgagataaattctaacacagatgaaactttatattgaaaattacacggtttattttgttttaggttaattatgttttattactttctcaaaatgattgtcttggatttctctgttttagcatatgcagaatcagagtgactcaggccctatagacctcacagtgaacatactcacaatgggctactggccaacatacacgcccatggaagtgcacttaaccccagaagtaagtgtgcagaaagcatgctgtccgctcccgctgtcatgcccttaccaggcacagatatgttgccttcaagaattgttgaatggggagtttttaaaaatagcccactcagtccaaaatcaaagtgctcttatggtctttggaaatgtgcttgagaaagtgaccacttttgtcaccttctgtggctcctcccagtgcagcctgtgtccacctgctgacctgcagggggcccatgagcacaggcacttgttttggaagttatggcttattaagctgcggttcttgtctggttgttctttctttccattgtagacagtgctgaagtcttgggaatggcattatttagggccttctttgtcagccactactttagctacactaaacccttcagtggagggtttgcatgccggaggtagaattctgtgctcaatgaagttaacatcagcaggagatacaatacatgcaccattcatttaataccaggcgaagggaaagggctgagaccagcctgcaatcatggaagacttcctggaaaaggcgtcccttaagcctgatctcaagtaaagatgaatgatgatttcgtcagctgagaagggaagaaagacacacagctacagtggtaggacagtgtgattccttttcttatccatcatgagggtcatggccaatgctcctttaacaaaagacaaattaggaggagaaaaccttaacaaatttatttaatcaaagttttatttaacacatcaggcttcagaaacgaagaccaaagacccagggaagactgtccattgttatgcttaggtttgataaagaatgggcagccatgtagaaataggtgtgttagtctgttttgcattgctgtaaaggaatacctggggctgggtaatttgtaaagaaaagagttttcattggctcatggttctgcaggctatacaagcatggcacctgtgtctgtgcaacttctgatgaggtcccaggaagcttttactcaaggttgaaggcaaagggggagtaggcgagagagagggcgcaacaggtggtgggggaaggtcccagactccttaacaatcagatctcgtggtaactcattaccacagggagggcgccaggccattcatgagggatccacccccatgacccaaacacctcccaccaggccccacctccagcactgcagatcacagttcaccgtgagatttagaggggacagacccccaaactcttatcaatgtgactggacagaagggtaccatctaacagtagtagagtagcggggaaaccagtaaggcctgtctgttcagattcttcttggcctcactgggcaatgttctttcctcccaggtgtagggcaggacacctctggaacaagagtcttatgacttaactatcagcaaggtagttcagagaacttcttaatatccagatcctacacaaaagggcatgggaagcatcgagtagtatctccaggctttatggctggctttgggcaagaggggtttgagttttctctggcctgccttggggaagaagagttctcattccaggagaactttgggggagaaggtgagtgagagagcttgcttctgaggcgtcctagccagacttagagaacatgtgcgggatgctcaaagaaagccaggcagcctgctttccacgctggccacgtggtgctgtcccttcctgtctccacagatgtttgtgcttctgcaccattccctttccccttaatattctagtggctatttcccaagaacataagcacctgtcaaatgagggcattcactctgatgtaatactttcaccccatttctgttggttgtctcagatatgtcctttgtggtgtttttccggtacccagctgagcccaggacccaggcggccttcgatgctccctgtgagtaggttcaggttgggcaggtccagccagatgccccgtgtccccatcaggatcctggcgggaggtgcgcactatcacgtgccccagtgtcttggtgacattcgataggatcctcctgtgaaggtgctggctggtttctccaccgtatcgttagtgtttttccttttgtaatcactaagtaatctgtgaggagacatttcaagactacgtaaacctcttaatcctcatccagctgtcacctgtgtggcgattcctggctgaattgatttttacctggtgaatggggatttttttccagctctatcatttctctatatttagaagttggcattctaaggaagagcccttctttccaccccctttatttacttatttatttctctctctttatatcattatgaactcagggattcttaatttatgtacttattttgatgcttaaattgtcccatatgtggtctgtgagccacccttaacactggttcctttgctctttgatatgcctacatcatttttttagtacttttttgttttctagcaaaagttgtttgaagcttaccatactgtatttttttattgtggtaaaatatactttaacattcaagttacctttttaaagcgtgtggttcagtaacatccagtgcagttgttcctcagtatccacgggctgttggttccaggactcccacagatactaaaattcacactcaagtccgttattttatataagtgtgagatcttagataacctatgcatactctcccatatactgtaaataatctctagatgatttgtaatacctaacaaatgctgtgtaaatagttgttacactgtattgttaacagtacagtaacagacctgtctgttcagattcttcctggccttttaggggatcactgacaaaaaaacttagtgcatgttcagtacagacaaccatcctttttttgctttcgaatatttttgacctgagattggttgaatccatggctgtggaacccatggacacagaaggccagtggtacatttacagtgttacagagctgtcacccctgtcgattccagaatttttccatcattccattagcagctcctccccagcctgctctgctccggaccccggcagccactatctgcttcctgtctctgtggatttgtctacattagatagttcacagaaatggaatcacaatatgtgagcttttgtgtctggcttctttcacttagcgtgctgttttcaaagtccatccgtgctgcaccatacatgagcgctttattccatccatgctgtaccatacatgagcgctttattccatccatgctgtaccatacatgagcgctttattccatccatgctgtgccatacatcagcgctttattccatccgtgctgtgccatacatcagcgctttattccatccatgctgtaccatacatgagcgctttattccatccgtgctgcaccatacatcagtgctttattccttttctggctgaataacatcacattgtatcgataggtcacatctggtttctccattcaccaaacattgggcatttgggttatttccaccttttggccgctgtgaataatgctgctatgaacatgggtgtacaagttttagtttgaacacctgcggtcacttattttggggtatatacctgggagtggaactgctgggtcatgcagtaacttgaagtttaagttactgaggaattgccggactgtttcccacagtggctgcagcagcttttattccagttagcaatcacgagagcttcccaccttctcacctacacctgtgatctgcctctttcgttgtagccatccctgtccatatgagctggtctctcatcttgccgtgatttgcatttccctgatgactgttgatgttgagcatcttttcatgtcctgattgaccatttgcgtatcttctttggagaaatgtctgttcacgtgctttgcctagtttttaaccgggctgtttatcttttgttattaagctataagagctctttatattccaaatgctagacccttatcagatctgtgatttgcaagtattttctcccattctgtgggctatctttttactttcttgatagtgtgcttctacaaaagtttttaattatggtaaaatcacatttattttctcttttgtaacttttggtgtcatgtctgagaaaccattgccaaatcaagatcacaaaaaattgacgaggccaggtgcagtgcctcacacctgtaatctcagaactttgggaagccaaagatcacttgagcccaggagttaggaacagcctagacgacatggtaaagccccgtctctacaaaaaatagacagattagccgcatgtcgtggtgtctgcctacagacccagccactcaggaggttgaggtggcaggattgcctgagtctgggaggttaaggctgcagtgagctgtgatggagccgctgtactccatcctgggcaacagagtgagatccgagaccgtgtctcaaaaaaagaaaataaaatagcactatgtattctcccaaaagttttatagttttagctcatatgtttcagtctttgacccattttgggcctggactggtagctagcacatagtacccaaacgatagcattatgatgataattatcctcattaataccaatccagtcctaggaatgaatcccaaggagatggtttttaggaaagatatgcactaagaggtttatcacaaaccatggtacttctcaaggcaaaaagaaagaagaggcttatcacattattgacttttatttaggtatggtaatggcatagtagatacatttcctaaaagagttcctgtcctttagagatacagaaatacctacaaatgaaatgaaatcgatgatatcgcgcctgggatttggtgtcattgaagatggggagtaggtgcagcaggtgatttatacatgtggtttcatagaaaggtgactcttgggctgagttttgaagcatgaagaggagattgccaagcagatgtgaggtcagcaggaatttctgacagggcacagcttagacagaaacacagagaaactaaaagggcacgtcaagtctagagagcagcaggcatttatgcagcacctgctggtgccatgtacagtgctgcaatggggagtcagagagccagaggccctgccctgtgagcccctgtccggagtccacattcacactgtgctatagatgctggtagagctaagagggtgtcagagaagacctctctgaggaggcggttctggaaatgagtaggtttcatgagggagatgggatatgggatccagcagaagaaaccacgtgtgtgaaagtctgaggggatgagaatgtatgaaagacagtggaatgatcgactgaactgggcctggaggatgggaggggcacaggccaggtctgtgagatcagaggttagaatttcacgctttctttgtcccaagatctttagaagccatccagagacacagggaatggtgagctcgtgggagaggagggattggtttggatttgtgttcctgcccaaatctcatattgaattgtaatcaccactgctgggggagggcccgggtgggaagcgaccggatcatgggggcagatttcccccttgctgtgctcatggtagtgagtgagttctcatgagatctggttgtttaaaagtatgtagcacctcccccttctctctcttccctgctcccgtcatgtgaagacgtgcctgcttttttccccttaccttctgccatgattaaaagtttcctgaggcctccacagccaagctacttgtacagcctgcagaactgtgagccaattaaactttccttctttataaattacccagtgtcaggtatttctttatagcagtgaaagaatggacccatacaagacgtataggtggatgctgagtcccggagcattggcatttgtggagtggacgagagcagggggaggccacgccctgggctgtgcagagatggtctcctgaggcgaaactggtgagcccttgcgtgcgcagcacagacgtgtcggagatcccgggtgcagtggacaccagacaggatcaagctgaagagtggagggtatgacggaccaggaagggcatgcagaagtcagggaaagcaccgcgcatgggagagtcacacacagcctgcccctgagaggcatccggaaaacacgagcaggatccgggcgatgggaaaggctggtgcactgaacgctgggaacttgaaaatgcagcaaccacaattttaaggatcagtagaaagtttggaaaatgtaagaaattcactcaaggccaggcacagtctaattccagcgttttgggaggccgaggcaggaggagcgcttgggcccaggatttcaagaccagcctgggcagcatgagaagacccatctctacaacaacaacaacaacaaaaatcaacgggcttggtgtcatgtacctgtagtcccagctgctcaggacactgaggcaggtggatcacttgcacctgggagatccagcctgcagtaagctaggatcacaccacaacctggctgacagagcaagcctgtgttccaaaaaagaaaagaaattcacccagaaactaatcatagaaacaactaactcgtgctgcactttctgtgcaggcccagatggaggtgtttgccatcagcccctgcacagtgcaacgcaaggggttgtggtgtcacccttcacagatgaggaagcaggagccccgctcattgccgggaacaccagccgaggccagggctgggcatggccgggctgagacacaggatctggcctcagacacctttttcttgacgggctccagtcttcactctgtgccactggccccagcaagccctggtatgtacagagaccacggaatacagctggtctgtaccatgaaacaccagtgcaggcattatctcgttgacactgagaagccccaaagttcaaggattgaggacgtttttacaaataatggaatccagaaagtgtgagaatatagagctgaccttttaattcagccgtgagaaattgtaaaactctgtgcattgaatggggagctattgagatggatggtgtgtggcataattttgttgttctcctatgcttaacagatgattaaacttcaggaagtatttaaggcattttatcttggaaagcacagtggtcgaaaacttcagtggcaaactactttgggacatgctgttttaaaagcggagtttaaagaagtaagttgtctgtttcatttattttttattatttgtaaatatgttaatataatttttttattgttactggactttagtagcaaaaaaggagtgtttcactttaattcactagcttttataagtcaataaaatttataacagttaaagggttattattccaatcaataaaaattcttaagaaatcaatccatagaaaaccatttacctattgaaaaaaagagcagagaatgtgaagaggcaactcataaaagcaaaattgaaaaaaatatctgtgaagatgcattacacttctctgctaaacagagggcttcaaagtaaaatacagtaagatgccactttttgactaagagatttgatgaagcctaaaaaataaaaaaaaattaaaaaaaacagactcttgcccactactggaagaagcataaactgtagtgagcttttggaagggcagtttggcattgtgaactttggcaaccctgctgccgagttgttgccttagtttcaactctaggaactcatcttaataagacattttcacggattaatgaatgagaatagtggttgcagtgctgttattatgagcgattatttaagaggggagaatgcatacaatgcactgatcaatgaaaggcgcttatgaaacggcaattatatacactaagcaaaaacataaaattcctattttgtatagctgttatattaataataaacttatctgtacattatcaaataagttatacatacctactttattattgtagagagtcatatacatgaaaccatatattctcttccttaaggtattaggaaagttaatttctattatccccagttttttacctacttgctgactttagttgaacttgacctccacagggtctgtaccagcaccaccaactgcagctctctccaggtgtgcaggaagggcttgttatgggcttgtgatgagtctgggctgggtccgcagagggggccaccaactgtcacccaaactctcatgtgcctctcgtgggtctgacctggaggcatgtggcaagttgctgcagcactaactcctgaatagaaaaggagatcatcctgggatatataaggccaaattgcattcacccctacgttacagtcagtcccgtataaaagaaagctggactgtaatcccagtacctggggaggccgaggtgggtggatcacaaggtcaggagatcgagaccatcctggctaacacagtggaactccatctctactaaaaatacaaaaaattagccgggcttggtaggcaccagtagtcccagctactcgggaggctgaggcaggagaatggcgtgattccgggaggtggggcttgcagtgagctgagattgtgccactgcactccagcctgggtgacagagcgagactccttctcaaaaaaaaaaaagtttgagagcaaaaagaagcttcttttaatttttcaaagattgtacatgcacagcttcagaggtgtgatgaggccttctcttccaggggaagaaggaattccaggtgtccctcttccagacactggtgctcctcatgttcaacgagggagatggcttcagctttgaggagataaaaatggccacggggataggtacgaaaactgcagagtgcatagctccatgagttgttcttaaagcatgtatttgttttaagataagacatagacttggtagcatgattggtttactgttgttgagtctcattcgtttaacgccagcctttgcctgcatttgcttcccattcagaggatagtgaattgcgcagaacgctgcagtccctggcctgtggcaaagcacgtgtgctgattaaaagtcccaaaggaaaggaagtggaagatggagacaagttcatttttaatggagagttcaagcacaagttgtttagaataaagatcaatcaaattcagatgaaggaaactgtatgtataaactttctctttttacttatagggggtttagcagggaatcatttgtttttgtagtaatgtttttggctgttagaggcctgaagcacatttctacaataatccaatttcactatgtaatgtttataagagtactcattttcctgtcgctttcattaacttcacattctcagtaggaaagaaaatcagaaaaaaagccacttaatgttattcctattcacaaaaaagttgtgtgctaagccagaactccccatggtcatagggtttcgaaaattatccacactttctatggtaatagaatctgatatggttcactcttggtgttgtacattctgtgggtctgggtaaatgtataatgttatgtatccaccattataggatcatacaggacagtttcattgccctaaaaattctcttatgttctgtcgctgtatccctgtctccctccgagcccctggcaacccctgaccctgttactgtcaccatagttttgccctttcctgaatgccgtacagttggagtcatagtgtatatagccttttcagattggcttctttatttattagaacgtatttgaggttcaccgtgtcttttcatgactgggtaactctgctttttgcactgaaggattctccgttgtctggatgcatcacaacttatcccttcacctactgaaggacatctggttgtttccaagttttggtgatgatgactaaagctgctataaacatttctgtgcaggtttttatgtggacttaagtttttaactcctttgagggtgcaccttttatagtgggcaaaagtgagaaggtctatcagttctttctcccgaaggtaaccactactgccctttttgtttgtggtcacagcctttttctgtggtgtgagtgtatgtaaactttttttttagtgggatcactaagccaggcacagtgacatgcacccatagtctcagctactcgggagggtcgcttgatcccgggagtttgaggccagcctgagcaatgcagtgagaccccaaactctacaaaagaaaaaacacctgggatcactgtacatatggcacctgtcagggccttcctgtagccagttttcgttgctgatcgcagtcttctcctggccaggacttgttgcaggagcacagtgccggttgtgtagacccaccagggctggcagtgccctcggccacaggcactaacattcctccactgcccctcctgaaaataagattacgttcaacaccctggcacagacatttctgtgcacttgttagattgtttctttagtgtgattcttgctctggagctgctgggtaaaataatgtgtacttgtcttagtttgctcttttccaagttgaagtctggcagatttcaccagagcacagtgtctgcccccacctccacctgtcctttgctcaccctgttctgagcagcccaaagatagtttgttgcagttttcattttgatttctgattctttacagcatctttctaccactcagtagtttatacaaattatataatctttctaatgctcagtttctcatatttaaaatagacatactactacctcaagttgtgagaattaaatgaatcgtttagaaagctctttgccacacacctgtaagcacttcatacatgttgatgctgctctttttatgcttagccatttgtatttttctttttctaattgcttttcaagtcatatgcattcattataatgttttttctcttactgattagtaggttttctttatatattaaggatattaatgctttgtccctttttttttttcgtttttttttttttttttttttttgcatttcactctgtcgtccaggctggagtgcagtggtacaatctcgctcactgcaacctccgtcctccgggttcaagcgattctcctgtctcagcctctcgagtagctgggactacaggcatgtgccaccacactcaactaagttttctatttttagtagagacggggtttcaccatgttggccaggctggtctcaaactcctgacctcaggtgagtcacccatctcggcctcccaaaatgctgagattacaggcgtgagccaccatgcccagcctgctttgtcatttttgacagataattttgttgtttttattgggttttttttcacataacagtttttaagttctcaaatatagtctccttttcttttatggtttctgacttaatgtgtaatgctgtattaggccattcttgtattactataaggaaatacctgaaactgggtaatttataaagaagagaagtttaattggctcacggttctgcaggctgtacaggaagcatggtgccagcatcacctcagcttctgacgaggcctcaggaagtttccagtcatggtggaaggtgcaaggggagcaggtgtctcacgtggcaaaagcatgagcaagaacagggagggaggtgccccacatgtttaaacgaccagatctcatcaccaaggggagggcccaagccattcatgagggacctgcccccacccacccggtcccatctccaacactggagaccacatttcagcatgagattttgaggggacacatattcaaaaccatatcattggcctaagagagaaattcccttaaccagagttttaaaaaacatttatactatgttatttttctagaagtttttacatttaaatctttcttttcatgttgcagaaattattttagtatctgaaaacagtctaactgcccccatcctttccaaaaccaaatttaaaatatcatccttgaacaagttatttgaattatcaccttattatgtatcaaattcatataggtcagtttctcaattctcttctataaattctgtgtctatttcatagccagccattttttttgttttgttttgttttgttttttgagacagtgtcgcccaggctggagtgcagtggtgtgatcatagctcactgcagcctcaacctcttgggctcaagcgatcctcccacctcagccccaggcatatgccaccacgcccagctaaatttttgtattttttgtagagatgaggccttgccatgttacccaggctggtcttgaactcctgggctcaagcagtcttcctaccttgaccccccaaagtgctgggattacagccgtgagccaccgtgcccggcaccaggttcttttaattaatgtagctattcctataactttattcttccaatgaacttgacaataattgtatcacgcctttgctcccccaaataagaacattgacatttttaatccatattgcattaatttacagagcttttatctttatcatattaaatcttgtgattcatacatatgtgtatatatgtaaatacatacaaatctttttctcagagctttctagttttcttctgtaagtcttgcatatttcttgctagtcataaattttcattcattcaacaaatacttattgagcatctgtggtggcccaggtcctctgtgaagcactgagaattcatccattaacaataaagaataagtccttgtttctaggagtgttcagtcttttccagcagagaggtagcagaggatcacacacattgactaacttgtaagagtggaggaaaatgttaggatagagaagtgcaggagagtctaattaaatactgtcgtcagccaacgctttcctgaagaagtgactagctttgctcaggaactgaaagaaggcctctggctgcagcatcgttgccaaaaggggaagctgagccagacaggcctgatcagggagccacagctggaccctctgaagatggctcagatccatgaagcatttggaaaaccactagagttttaagcaagacaggctaatgaaatgctgatatcttataaaggggaccttttttctttacatttctgacggtttttatcagaatgtatgtattaatgctatttgtctttgtatatttattttatttccagccactttacaaaactctttagctttgaaagtttttctgttgattttcttggattttccagctcatctacaaataatgaccgttttgtctgcaccttttcaatatacctctttagtctgttcctgtattgcatagttagaacctctaaagtaatgtttttaaggaatagcagtgcagctgagcttcctaattttatctctagttcagaggatgttaactttttgggggtcatggatcctgttgaaaatgtgatgaaagcttggagtctctcccatcctgaagcatacttgcctcatatgtatgcacagaccttcccccagccctcatttcaactgcagatccccatcaggttcctgttggactaaggttaagttgtctctagtatttgctgtttgtttctgataaccatgttttatcatgttcagattcttttttattcatccttgtatgctaatgtttgttttaaatcaaaaaatcaattttatcatgccttttcagcatctatcaagatggtcatgtaatctaacctttcaactgctacagtgctctcacttatattcacagatttcctaatgttgatcaacacttaacatttctggaatatatcctgatggtcattatgttttgtttactgtgctgctagttttaatctacatcacacatagagttgttgcagctttcttataaggaaaataacttttaaaaatattttttaagttttggttttggagttttgctattctgggaaggtaccttttactacaacaagtaaacatgcataataaagtaggattcatccaatgtctgacctttctttgcatcaaaagaacatttccggccaggcacggtggctcacgcctgtaatcccagcactttgggaggccgagccaggtggatcacgaggtcaggagatcgagaccagcctggctaacatggtgaaaccctgtctctactaaaaatacaaaaatgagccgggcatggtgggggggcaccgtagtcccagctacttgagaggctgagacaggagaatggcgtgaacccggggggcggagcttgtagtgagccgagatcgcgccactgcactccagcctgggtgacagagtgagactccgtctcaaaaaaaaaaaaaaaaccatttcccatcaaattcggtaacatcaggtcattaatattgaaatataggccaggtgtggtagctcacacctgtaatcccagcactttgggaggccaaggtgggcggatcatctgaggtcaggagttcaaaaccagcctggccaacatagtgaaaccctgcctgtacaaaaatacaaaaagtagccgggcatgacagcaggtgcctgtgatcccagctactcgggaggctgaggcaagagaatcgcttgatcctgggaggcggaggttgcagtgagccgagatcacaccattgcactctagcccaggcaactgagtgagactccatcgcaaaaaataaaaagaaaatacagttttacacttaactttttttttcttttttatacaggttgaggaacaggttagcaccactgagagagtgtttcaggatagacaatatcagattgatgctgctatcgtcagaataatgaagatgagaaagactcttggtcataatcttctagtttctgaattatataatcagctgaaatttccagtaaaggtaaatgtaacattagcataattaaatttgtagtatttgctaaacaattgacaaagcatgtttaattctatgttcagtcatatcatttgacctgcattattcatggtgctttgtgtatacactgaatgtagaaaaactggcaaatgtgaagctctttattccaggtgttgctcatcgccactgcagaaatgatagagccctaaaactctccttcccagggatggtgcgcgcttgttcatattttcaggaagggaagaggtagatgggacatggaaagctgaacacttttctcatagtagtagcggtcaaggttacatcacaagattttaaggaaatgataacaataactaacttactcagcgtttacagcctacaccgcgttttccaccacggtaatagtctactgttgctgttgcttatgaaagtcagcccaggcctgtcaacccgcgttgttttcagaactgagatttactgtcctgccacgtgtgggatgcaggataagccgggaaagtattatgaaacgttttttacatgtatttatcaacccaggaaatactgaactctgatgacgcctggcctctcagggacaggaccggccacacgtgctttggagggaaagtccccagattccatgttgtgcagtttgagcctcccattccatcaagggaataaagttgagatgcactaaatagtcgaacacttaagagtctggtggaagtgccactgtccatcagcccgcatttgcccccttccctgcagaggtgaggtgccgtcctcagggccctgggaagctccaaaagcaccatcaggttcactgccccttcctcccaccagctggagcaagtctcctgttgccactgcaaacaatcaggcccagcgcgaagcagaggtgagcaagagtggagtgtggcagaccagggcacctgctctgctctcgggtagagagtggcagaccagggcgcccactctgctctcaggggtagagtgtggcagaccagggcgcccgctctgctctcaggggtagttgggttttttttttctttgagatggagtcttgctgtcccccaggatggagtgcagtggcacgatctcggctcactgtaacctctgcctctcgggttcaagcagttctcctgcctcagcctcctgagtagctgggcttacaggcacgcgccaccacacccagctaatttttgtatttttagtagagacagggttttaccgtgtggtcaggctggtctcaaactcctgacctcgtgatccgcctgcctcaacctcccaaagtgctgggattacaggcgtgagccaccgcgcccagcctcagccacatcttgtaaaatgtgtggcttatcactgaatagaaggtgaagtttgtttggaaaatagagggtctcccttgtatagggagagccttgcacgtaagtgctcacacagattttcttcctaatacagcagagctggagtggctgttccctctgggcagagacaggctgtggctgtggattcgtctcctcagtcacctactcttagtgcaggaacactggggattgtagtttcacttacgtggacatggcatgcaataactatgtaaatacacgagaataaaactacaggccaggcgcactgcctcacgccagcgatcccagcactttgggagctgaggcaggcggattgattgagcccaggaatttgagaccagcctgggcaacatagtgagaccccttctctacaaaaaataaaattagccaggcatggtggtgtgcagcctgtgatcccagctactggggaggctgaagcacgaagattgcttgagtccaggaggtggaggctgcagtgagctgagatcgcaccactgcactccagcctgggcgacaaaatgagaccccatctcaaaataaataaacaaaataaaatacagtacttaggcagaagcatcctttcaaaggataaaagttgccccagtaagacatgttgagattttcctttcaaataaaaatgtgtcacgtgatcgggtctgcctcacttatacgtgcccttgctgatggcagatgtcggatctgcctcgcttatacgtgcccttgctgatggcagatgtcggatctgcctcgcttatacgtgcccttgctgatggcagatgtcggatctgcctcgcttatacgtgcccttgctgatggcagatgtcggtctgcctcgcttatacgtgcccttgctgatggcagatgtcgggtctgcctcgcttatacgtgcccttgctgatggcagatgtcggatctgcctcgcttatacgtgcccttactgatggcagatgatgtatgtacatttcacaagtttcacgtttccctcaggaaaccacactctgaccataaactcacatggacgctttttttatcaagagataacgttaactttgtctttaaaatagaaagttttgttcatttcataaatatgtgtataattataaatgattttcatataaatatctatttgtatatatatttctataagtatagttacatacttcatgcatataccccttgtatgtaaatgtttgtaaatttaatgccattgtaattaggggggttttattcttcttttttagcctggagatttgaaaaagagaattgaatctctgatagacagagactatatggagagagacaaagacaatccgaatcagtaccactacgtggcctgacgcatctgcagacggttccccttcatgaaacactagaatgtaccctcagagcaggaagcacacctgtgccatttctgggactctgattgatccagctgtggacattggaaggcgaaggaagggaggtggctcctgggtcatctttcacaaggctcaagacttcaacctgcagatgtatctttttccctccagtttttcctctagttcttttaggcatttaaattgtttctgttactctgtgcaaaataactttgagattggacaagaagatgttactaaagagaagttcctttaaaaggtcttgttcttgtgtcaaaaagctgcaagtttggtttgttctcgtgtgtgatcatgagtgcacaatgaagaagaccctagatgctgcattttttagctctgaagattccttaggtatccctgaagacagctcgctcagatgatcagcatttagagtgaaaacaagggcccttcatgggtgaacattagaaagagccagggttcaaagctggcgaatggatgacgcaccctagccactggcccctctctgtttcatgtatttccaaaagttgtaaactttgatggctgatttttcgtaagtcaggtttctaagtgagctccctgaggtgccaaggccatggtgtccgccctgctgcgtctgttcgtcagctgagttccttgtgaatctctgttttagggtttggggctagtgtgtttgtgtttccattctaagattgagtctggcagtccctgtttttttgcattggggtaactgctctttgattttttttaattgcagtatttgtgtgattgcaataataaagtttggtttggtttttacagtcatgcgcagggacgatccttgttctctgctgtaaactgtaaaaagtttatggagacttaaagtcttgatgttgtgaagcagaggttattttgtggaaagattaaaaggattttgttggtacctggttttgtgttgtgtatatatacatgaggttgaacagtgaaaggaaagttcagtagtgatgttagaagggtaactatgacaaagatacttttgagataacatttaaaagtactttatattttacataatagcatgtttcattttgattaaaagctaccaaaggaattttgatcatggcataagtgtttaaagcaatattttctggaatataccaagtttatataatttgattttgtgctaaattattaagagtctctttttgaaacatgcgggtttgaaatatgacaccttgtgggtttccatattaaaatcctcactctttaattgtcatttctatctttgaaaattttcatttatgagttccatgatatgtggtctaagaaagaccaaacagatttctatttttttttcttataagttcgttgtgtctagagattgttaatattgtaatttaatgtagacttactttgaataaaattagtttaattggccttaaaattacattaataaaactttgtgatatgcaaatgacacattcttcataactctttagcagctttgactactagtgcactagacagaagtcagagcagggagcacctgtcccctctcaagtgattattctttcctggccacctctaccacaaaataccagtggggccaggtagtgacaagtgggtcttttttacttggacgattcgttgtgctgtgcctttgtttcatttgagcacagtggctcacgcctgtagtcccagctatgggagggcaaggtgggaggatcgtttgagcctgagttccagaccatcctgagcaccatagggagatcctgtttccattttagtttatttatttttaattgaggtggagtcttgctctgttgcccaagctggagtgcagtggtgcaatctcagctcactgcaccctccgcctcctgggttcaagcagttctcccacctcagtctcccaagtagctgggattacaggcacccgccatcatgcccagctaatatttgtatttttgtagagacggggtttcactatgttggccagactggtcttgaactcctaacctcaggtgatctgcccgccttggcctcccaaagtgctgggattacaggcgtgagccaccatgcccggcctgcctgtttctgttttataaaagaaaggaaaatctatttatatctattctcttatttagcaatatttaatgttttattgttaaaggtcagtgtggtaaaacaaatagtatagaagaaatcattgaaaaagaaacagcacttagacagaaatgctgtaaaagtggaaaggagaaggtgaaattacttgcaggttagatggttgcatacccaggtcatctaaggagcaaatgaaaatctgtgactgaagaaagaattcaccaagttaaccagacacaaaattaacaaaaacatcagtagctttcctataaatataggctataatggagggtcattttttatttttatttagagacagggtcttaactgtcacctggactggagtgcagtggcatgatcatgtttcacggcagcctctaccttctgggctcaagcgatcctctcttctcagccacctgagtagctgggcctacaggtgtacatcaccacgcccagataatttttattgtattttttatagaggcagtgtcttgctgtgttgccaaggctgttcttgtactcctggcctcaagcgaacctcctacctcagcctccccaaatgctgggattacaggcatgagacactgcacctgaccagaagtcattttttcaatagcaacccccaaaaaagataaaatacctagtaacaaatagggaaacacctatgtgaaaggtattataacattactaaggaacacaggccctgaataagtgaaagttctgttgattctcacattttgctatacagtatcttaagatgtaaaaccttcctttaaaacacaagcggattctaaagttaaaacagaaaagcaaatatgccagactagtcaaattgttttaaattctgctgtttttagaacattgtaattgaaacagcatgatgctggccctttaaaaagattcctggaacaagaaagtccacaaataagccaaatacacaggaactcggcgtggcacaaaggggccgtgtgtgatcaggaactggaactttgcaacaactacccatgctcagaagtttgggccaccttgaaaagagaaaagttggattagactcctttttatactaagggaagttccaagtggtcaagtatttacgtgtaaaaaaatacatatatatgaaaccataatcataagatactttttttgtaaattgactattattgtataaatttatagagtataaagtgatcttataaattatgcatacattgtggactagtcaagctagttacatccatcacctcaaatacttaacatttttgtagtgagaacatctgaaatttactcttagcaattttgaaatgtacaatactcaatttttgactgtattcaccatgctgtacaatagaactcagaaaaagaa

SEQ ID NO: 12260 - DNA, 120217 bp, Human
  misc_feature (1)...(120217): n = A,T,C or G
cacggtagcccaaggaggaagtattgttattgtctcccttttacagatgagaaattctggggattgtcaactccatgccccaaaagatgcaaaacacagctagtaaagtggcagaattgagattcaaacaatggctccaagaacacatattcttttttaaaatatttttttatttctttttttggttcctcagagatccctattctgaacatatattcttacattacaaagaaactgggccatatgagagtacaaccaagagaaaaacattgtttgttattatattatgttatggaaatggaggttcaattagcatagagattataaactcctattcaaggctgacattatcttacattgaagtcagagcctctcccaatcttagtttatcaactcagttcttgataacctatttttagcttcagtatttacagatattgtcttaagcaacattcttgtttcttaagctcctgctttaattagccaataccaaaaaactcccacaaaaaaaaaaaaaaacaagaaaatatggtatttgcagtggggcgttttaagcaagaaggggctttaagcacaacactcataagcttagtcatcaggattaagttaatttagggcaaattcaaccttacagtcaacaaataagtgtatttcactttatattgtttgctatttaaaagtattaaaattccagcttctaaatgtagatatccatcccccaaacatatgcttctttaaaataggaagaacacaaactttaataagaactcacgtattcccttgcagagtcagaaacccaaacataacagcaattgggcaagtaggtaaatgaggaagtacaattcataacaaatggacagcaaaaccgataagtcaaattagacattttgactataaagcgaccaaacgcctctcctccaaaaccaaaagccaaaaccttttcaaatatacagcaactgaatcagacggtaattttggctttaaaaatctacaatactcttggtaatggtagaaatgatttatccggtaggttaaagataggtttctatcattccacttaacattatttaccaaatgctgcatttcattaatggagctgtcagtttattctgatggtaatgaaaaacaggttttaacatgaataagccctgggtccaccagaaaatatcagtgaatcaagaggtcccgaagcttatgcagtttaagggaacttcgtagattaaatttccaccttccagtcctgagagctgtggtgtgcacacccagtccgaataccttgttgagcatacaggacactaatttccgacactgcagctaactcctgcacaaactcttcaagttgcaggcttctactcaagtacccatccctagtccacatgccctagaaaaacacaggaaccagttcgggacgtagttacacatctagcaccccacgctcctcctcaagactatcctcctgctgtcccagcccagtggggcccagcccactaccatcccgctcccgctctccgaacttcccccctcccactccccaccatgtgaccaggaccctcccaaccgccgctccgagctccaccaatcagcaaccacctccacccagaacccgggacctggcgctccactttcaaaaaggcagcttaatcctcccgccctcagccacgccccctttccgcttccaggccccgccggcccctcccacttccttcagttccctgttcccctcctcccctccggtggcgcccaccctctcccgggcttcgccccgcccaccaggggggcagcgcgctcgccctcttctcgcgagatctgagcgtcccccgcggcggccgccgggctccccctcccgtcctcccacctccctcccccggcatctctcactctccggctctcctccctccctcctcccccctccaccctctgggccggatctcgtctcgctcaggcggaggaggagaaggaggaggaggaggacgacgttcggcctgcgcagtgagatgtttgtccgtcgccgccgccgccgccatcgcggaggagcgcgataaagggagccgagccggacgtgagggggaccccgcggagccgccgcgccagcgcagccccccagccgcatcggagtcgccagagtccgagccgccgccgccgccgccgccgcccccgccgccgccgcggctgcccaggggccggccagctccccagccctgcccgggggtcgcgccgccgccgcccccagcgtcgcccctagcctgcctgcccgccttaaatgtgacaccggcgtcgcggagcgcgacctgaagccgccgccggggaggggacgagcaccatgtcgaatctgagcaaaggcacgggcagccggaaggacaccaagatgcggatccgggcctttccggtgagtctctcctcggcgtccgggaccccggggccgggggccgggccgagagccgcacgcgaggcccgggctgaagtcccccaacaggccgcaggcccggcctcccctcccccacgcccgccggccgcggggcgcgagccttcccggcaaccgggcggcgcggggccccggcgcggccgccctcccgggccgttccccgcgccgggagcccgggcctggcgccgcgcccccgtccgggagctgctccttcagccgctccgcgggcgtcggctgcggccggggcccctcggccgccccacgcctccccacgttgccggggttgtaggcccagtctccggcgctgctagcagccgcggagtcctccctgtgtggggcgtgtgtggaacttttcacgtggggtttcgctacactttgaaaaattacccagcctagcttttagggtgatgaaggggctgccctctctctctgcccccctccccaggaaggtctatgccatcaacctgcccccgacgcagtgacagtggttccacggaatgctccgtggtcataaactagtaacattgggtgtatttatagcgtctttcatcctacaagcttcctaagcactttacaaactcttgtgcaggattgcctcgccactcggaggaaggccgggtgggggggaagcaacagagagcaaaccggccaattggttctccatttctcagccttgggagcccaaagaatgagtgtagtcgccttgcggagtagctttgtttcatcgctttcagtgacagcaaacgtgttctgctcagaaactttttcttttttggcattacgttgagtcgtacccttgcgatgtttagtatataggatataactttgggtgtcaaatctggttcagcttccccgtggcaagcaattaaaatgtactgttaacgaactgggcatacttgcctatgtcgctacaataaaaggcatacgtcaagacagacgaactagcaatcggacagaagattttaaaaagtaaaattagagaaagatcttggtcttcccttcttagattcataaatacttcatatgatgtaccagcgaaagagggggatttgttgtcactttttaaagcatgcttttcctgaagcgcagttgcagtgaggaaagacttaccttgatgtgattgccccagttgagtcaagtgatttagtttcagagaacatgaggacctctctgaattcctaaaatttaaaaggatacacctcatgcagaattctgaaattgtaagaacataaatactaaagtcagtgtgcgaaaacctctgctttgtgtaaataggtacgatggaatttaggagaataagtgttttgataataattaaagattttttgaatgtttcaaacttttttctaagtaaacgtgagaaatgttgacaagcgagtactaacgaagcttactagtatgttttcccttataattgggcagagctgggttatgcatttgtgagtgatattaattttcctactaaattctgaccactttagagtttagaattacttagaattttatgaagttaatagttttatacaacagattttctttttttttgagacaagagtttcgctcctgttgcccaggctggagtacaatggcgtgatctcagctaaccgcaacctccgcctcctgggttaaaagcctcctgagtagctgggattacaggcatgcgccaccacaccgggctaatttcgtatttttagtagagacgaggtttctccatgttggtcaggctggtctcgaactcccgacctcaggtgatcaccgacctcggcctcccaaagtgctgggattacaggagtgagccaccgcgccaggcctatatacaacagattttctagcagtgtgtgcagccttacactactcaattcttgaagtctcatgttctaaataagattttttgctaaaatgtggagtaactcaaatttgacatcaactcactcaagttaatggccttctgattgaccagttgtacgttaatgtatgtgtaattaaactctttgacctcttcaggtttccctgctcttacctgttttgccatcatttaatttgttcagcaaatactgaatattatgtgccaggcactgttctgggggtctgtcagtatagctagaaagaccaagatccctgccttttggagctaatattgttggggagaagaggtgggagagaatttcattattcctttagctgaccagtataataacgttgtgtgatacgttaccacatagtactggaactgaatttttttttgttagcttcgttatgattatgagctaatttggatccattctgtctataacttttgcaggtttttctgaaaaccttacatgaagtaagtgactagttttggtattcagtagttaatagctgctgatttctaaaagaatttttcattactgtttaataagtattaataacattcctaagtgattcccattggaaagaactattacagtttatggccctttgttacagatagatgtatatctcagtgttagggtgtttcatagatttatcttactaaccgtgtgcttatagaccttcaaaattcctgtcttccagattggcagtcttgttcataactacagactgcgtgagttgctagtcaaaagtagttaatacctagtgttccgtaaagaaaaaatatggccgggcgcagtggctcacgcctgtgatcccagcactttgggaggccgaggcaggtggatcacctgaggtcaggagctttgagaccagccgggccaacatggtgaaatcccatctctacttaaaatacaaaaaattagcggggcgtggtggcggatgcctgtaaacctagctacttgggaagctaaggctggaaaatcgcttgaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaaattatatatgtttaagatgtacatgatgttttgatatatgtatacattctgacatgattactaccatcaagctaacacataatcacctcttttttttttttttgagatggaaactcgctctgtcacccaggctgaagtgcagtggcacggtttcagctcactgcaacctccgcctcctgggttcgagcgattcttctgcctcagcctccccaagtagctgggattacaggcgtgtgccaccacgcctggctagtttctgtctttttagtagagatggggtttcaccatgttggtcaggctggtcttgaactcctgacgtcgtgatccgcctgccttggcctctcaaagtgctgggattacaggtgtgagccgccacgcccggccaatagttctgttttttatgtctgtgtgatgagaacaagtaagatctactgccatagcaaatgtaaaatatgtaatatagtattattaactgttcttaactgtgctgcacatttgatctccacaatgtattcatcttaaaacttgtatcctttgaccaaaatccacgcccccatttctttcattccccagcctaggccttagagcaagactcttgtcttaaaaaaaaaaaaaatctcaagcactcatctcagattgttttacaaaattaacttgtaaaaaaatatagaattgtgttttgagattgttttcattgcaaaatagagtggtaattgaacttactggatattttatagatactactccagataaattcccatcagtaatatcagattctttttagtgttttgagtgcattttttttttcttttttgagacagagtcttgctctgtcgcccaggctagagtgcagtggcacgatcttggctcactgcagcctccacctcttgggttcaaccgattcttgtgtctcggtctcccaagtagctgggactaccggtttgcgccaccacgtctggctaatttttgtattttaagtagtgatggggtttcgccatgttggccaggctggtcttgaactcctgatcttaggtgatcagcccaccgctgttacgcaaagtgctgggattatagctgtgagccaccgcgtttcagccttagtgcgtattttaagtataccttcatcattgtctgtagaagttataatacacaacagtttaatgcacaatttgcatttttaaatagaccttttcctagaagttctttttaagatggaagacaataaggacgtttctgtatttgtaagctgttgacaaaggaaaagtttattccagtttataagctttcccgccttgcacaaaatgtatcatttcacatctttttgataatgtttaaattttaatttgtatgcagaggaacaaggaccacaaaactttttaaagaaagcaggctgtaattgtgaaacttctggaaataatgtgggtctggatcaaataattctgccccagggagtctcttccttactcctgggctttgttccacctatgtaggattagttgctctcaggtgaaccttttattatctttatctctgaaaaatcatttcttaccatttttactgtctggggttttgcccacatgggtttgatgagcttgattagaattggagaggatacgtttgaatgaaaatgctgtcctttcctgtatcaaacggtaataaagcctttcttggcctagccttcagagtttgggaaacctgttatgaaggtgactgtctccagaatgtaatcaggctcttaagatctctaccctggggtcctggaagtagcttcagttagtttataaaagcttgctaactcatcaggagaaagagtgttatgataaaatgcccactccctaatgctagaggaactccacttgtgtagcatggacagcaactgtttggaagtgattgttagctggaacatacagggcgactcacattagtgaaggagttttatgttcatttgtgatatacttaagaacaggaagagtcttaaggacagatgggtacagttaatctttttttttttttcttttcttcgagctacagaaatgtttgccagatttgagggaacagctttcatcttcatagtaggtttctctttcttagggaaggtagttgttggcatagtactacctggactggtacatagaggaaagctggatggtagtcttgcagatcacactgagcagagaattaattataaatttgcttttcatttttcatgttatgaaacaaagtgaaacagattcattaaagtgttacttatacttaaactaatactgtttatagttttgggacagccagtattgtcatagctgttagtactactatgactttagaagttagaaaaataaaagcatacggttgttattaacaaagtatttattttgtcttgtctttctagatagcagttcagaggaacctggaaaattattagtaccaatattgaattagaaactatttaagtaatatgaaatataatgtaaaaatttggctttttaagtaatacataaatcacaaacttgattcaaacaaattagagaatgcttcatttgtttgtacatcattcattaaatgaagttaagggatgaaagcatttgtccagttcaggaagattatatgattaaggctagaaaaagtggtatgccttttttttatattatacattgggggactttaaagggaattttttgttattttcattccagagtacatggatggtctttagtagtcctgttaggtttatataaaagttactagacaatttgtagttttaaataatgcaacttttttttaaaagtagttcttgttagcccattgtaaggtcaacagaatgtaaaggtattactagtaagaacaaatcactgagttaacacatgaattacaattagttattagtctatcagtgtcttgtgaaaactattcaaccatagtctgttaaagcaatgaatttattttagtagcttttctaattataacaatgatgtatattcctggtagaaaaattgataattatctaaatgtacaagtagggaaataaaaaaaatcacctgtaatcctaccacttggaaacaaacaacattaacattttcatgtgtttttggaattttaatttcatattgttggctgaacagacagtaaaattaaggtaagataatcattgtatatgctgctgttaaaaaatttcttactgtaaatttttgaaaacatagtttttaatgactatcatacttcagtttgcttaaccatttccctattgccaaatattttggttgattccagggagtccatattttttctgttaaaaaagattgcaactatgactatttagacacataaatatttgagtccatctatgattatggaattattgggctgcacataactgaaatatattacctaattgacctccataagggtaataataatagctaacactttctaaatgcttatcatgtactctgcatatctaaacttaatcatttgagcaaactctattgaatactactattatctgttctacaaatgaggctttgagaggctaaataatttgcttaaggtattcttccaagtggcagaactaggattctgacccaagcaatctggctctaaagtgagcactcttaagaattaattatatttctcaaggttgtatccgtttaacttctgtgtagcagtatcttacccagcataatgtatgtttaattttataggtgaaaaaatagtactttaatgctttaatttgcatttctttgactacttaggagaataaaactatgaatagtctgtagagaattttcatttacttttgcactggagtattcaacatatgaatatagggatgtgactaaaaagtaaagagactgaaagcatagtagttaagagtgtgggcttgaataccagctccatgtctttctagctgcatcaccttttttttttttttgagacagagtctccgctctgtcacccaggctggagtgcagtggcgtgatctcagctcagtgcaagctccacctcccgggttcacgccattctcctgcctcagcctccctggtagctgggactacaggtgcctgccaccacgcctggctaatttttttgtatttttagtagagacggggtttcaccgtgttagccaggatgatctcgatctcctgacctcgtgatccgtctgcctcatcctcctacagtgctgggattacaggcgtgagccaccgcgcccggcctctagctgcataacctttaacaagttacttcttgtagcctcagttttcccctgtgtaaaatgagactgctaatgagacccaccttacaggtttgttgtgtgataaataaaataaagctttaaaatagaacttagcagatagttaactattattataccaatatttagccatgattaggccaatattaaaattggatgttgtttttgcaagcagttacatcgaatgccatacacttattttagcgatcctgtcattttattgtacaacttctagaacttaagttttgaaaagcctgcagagccagtttgtgaatcgttctaagaaagcattctcaaaggatatgggtttagtaccactgggatacttaaagaatcctgttggctcttgaggggtggcttcaaaaacagaagttcatatatgattcacatgtaatccatagagtaagtgtgtaacctcttgtaactttattgaaggaataaacactcatttggtttgcatgttctataatatgtacgttaaatgtgcatctaaaaacacatctagtttttcttttttccttcctttcctccctttctcctccttctcctcccccccccccttttttttcactcctgaactaggttaggttgtggtccctgtccaaagcttatgccagacatcgttttgaaccatgcagcatttagcatagtgtgagtggttagtgaatgattgattacatgagaaactagtcctctaagccaaaccatagtaattgataaattcagtgagtcagcgcaaatgatgctctgaaatgtttgaagtttttgtaactctaagtgaagtcttaagatgtagtagagggtcgttaaagatcatgtggcacttctgtatgtagcagggtagtcagcctagtctcctggaaaaatgagttgaaattgtcagtgaccctgaattgggagttagaagacttagtctgcggtccagtctttctgtttactagctgtggtctacatttcacttcctccaccatgactgttcttcgcatctcatcccttcctgtcacactgttaaattgtacactctggtcccctatttctcaggcttatctttttgaattgaggtttctattacagtccttgaattattgggcccagatgtggtttattgccacttccatcatcatcttttttggcttgagaattactctcctgctctctccctatgaccatctgacttcctgaactcatgctccctcagtcattgaggagtttaataccttcctcacagatactatgttaatacattcctcacagatattatgtctagcctctattttaattttgttcattgcatgtggaagtcattcatttattcaatttaaaatacgtttattgtgtgttgctgctatgggtcaggtcctggatctacagtggcgatcagacaggcttgtattgcagggatcttcacgcttagagcttgtcatcctactagtttaaaaatcttcaaacttccattttgcattttatcctagctcttctgtttgttagatgtaggactttgagcaaatcacttagtgtcttgtctgttccctcttttgcaaaaaggaaaaaatgatgatacctacctcataaaattgttttaaagatggagttaatacatataaagcttcttagaatagtgcttggcacataataagcattatacataaatgcaaggtgttattatttaattattctatcttgttgcttggttccttctcacgttaatgtgccctttgatctcaggaagacccatttattctcccaagccatggtgctgtcacttccacctatgttaccagttgcccctttcttactacctccccagaacaaggccagaaatagcagcagaaagcatcttggatcgttctacctatttgcccccactgaacatattttctagctactcctggagaaaattgcaagacagtggtctctaatttagctggactctcagtgcctctgagcagtttcttttatgtccctggtcagcttcctctcccctttcttgcctgagctattccaaactttaatcattgtccttaagctatctcttgagaattctcttattgctcttacttcaagaaacctaactactacatcagtgtgaaaaggaatgtaattaggtgaaagttcgaagttcattcagcattcttccctttcaattatattatttaatctgcatctttattcattctcgactccttccctctggtctcagagaaggaaaatgtctttttcctgtcttctgcattatagtaactacctcctttcacagccaagattcttgagagaggagtctctatttccttttttagagcataattttcttgaggaggcctcagtcttttttatgactttgatcagtacagcagtacgcacccagcatatagtacacaatgttgaataaaggaactaacagactctttaagtttgtttcctcctctttaagatgagaactacagcagtctttcacaaattgtgaggattaaatgaaatcatgtcagaaaatgctaatagtggtatcactatgacatttaaaagaatttcccaatcataaaatcaaaattttcaactataattctgtttcatgtagggcagttattttcaaacgtttacagggagcctggagggtgtctaggacccaggaggcctaggaagtgttaagtagaaatctttgaaagctccctctgtggtccttgagagcagctcctgtgttaccatttgtatatggggttctgtaaaagatttcattttaagaaatgctgttaaccattgctttaaaatcactagtaataattattaatgaatcttttttaaaggtgaggagaatactacttgctcaacttgataacggttaataggaaattgagaactgatcctgtagttgccttaactcctaatccaaatctgttgctactagacagcattcttttttttaaattcagttttaaagttgaaaatataactaagcaaaacttcctaatttgacctccatttagtacttgtaatcattgagaaaggattggacccaaatttactctttaaatgagaaatgttactgctgagcagatgaataaaacgacttcaaaggggaatttttacctactttaagaaaatataagattccttagagatactttcttataaaagcaagccatcattgctaagaggaattccttcacatatgtgtttgtaagtcactcttacctaaaacagctcttaactgagcaacacttagcctcttctgtttgccctgtcctctccaaagtaatggtgaaaaattcctttttctttttcatctccaattcctttccatttccactagaggttgccttgtaagattagtgacaacttgttgaatgtctgacttgtggtaggctgttttagatacttttaactaattatctgaaatcctgaaaacaattttaagtataatgtggttactcctgttttaaatctatttgggtctcagagaggactagtaaaatatttatgatattacatatacgcctagagaagggcagagttgggattcagattctaggtatgtctgactgaaaagttcatgttgttttcattatacagaaaattaattctaaggttaccttttaaattattagccaggggcagatctggggacgctgaagcttatacaatgcactactctctttacaaaaagaatctaccttcaggttccaggagttggaagaagccttcgtaagcttccttcgtaagcttaagttttactggctttaagtaaatggaccatttataaaagttatgaaaaacttgggaaatgtgtattgttcagtaacatttgaatatataacttgtttaaggggaccttagtgtgtattgacttgaataaagcagtcaaaagcataacctgtaagaaaggcttattattactagttgacctatttatgagttaacactttgctactttaaattgtaaggccgacgacacacattaaaaaaatttggttaatagaaatttaagtatatacttagcaaaaagtgattccttgaagttaatatgtctaaaatactttgatttttaattttttgtctttaagaatatactaaagagatagattaaacagtaaaatgtattagaaatacaaagattaaattctctagtaataatttactacttttggtgtacgcaaatgcaacatgaaagaaataatgcttttttgatgaatgctatcactagccaaataataatttgtgtgctcttgtgttagtattttaatttttgagggctaaaagtgactcttgaaatctttttgtggtgctataacaaaatcctgcagactgagtaatttataaagaacagaaatgcattttctcacatttgtggaggctgggaagttcaagatcaaggtgctgcaggttctgctgtctggagagggctgctgtctgcttccaacacgatgtcttgatgcattgtcctctcggaatcctttggtggggacgaatcctgtatctgcacatggcagagacagaagggcaaaaaaataaactctctgtcagcctcctttataaggccacctaatcccattcacaagggttctacccttatgagttaatcacttcctgaagaccccaccttttttttttttttttttttctctcactctcacccaggctggattgcagtggcttgatcttggctaactgtagccatgccctccagggcctaatggattctttcaccgcagcctcctgggtagctgggacgacaggtgcaggtcagcagcaattttttttttttttttttaagagacagggtttcactgtgttgcccaggctggtctcaaactactgggctgaaatgatccacacactttggctttcaaaagtgcaaggattacaggcgtgagctgctgcacctgcattgccgtaccttttaatactgttaaattgatgattaaatttcaacatgaattttggaggagacacaggcattcaaaccgtggcagagacttttgagagaatctgttctttctcaacagatgagcaaacaggggtctagagaaagtggtttaccaagggatacactcctgacttgaatttatggaaggaccatgaccagaagcttgatttctggttaaaagctcttttctctttagcagactgaaacaaacatgtagccgtaataactcaatgttaacactggcctatttaattataaaatgatttctcagtattgagcactctgattatttgagttgacatggtaccctggaaggacactcagcttaggacacttggactccttcattgctctgtgtgatcttggataagcttccttagccttagtttcttctttgtgaaatgaagaggttttaacttggggttaccttaggcttattctagctccaaaaatttcagtaaaagacaattgtgtttatacataaatctaggcaccgactactagtgtcttttcctgtggcctttgtttgaaatattttgtgtgatgttgcaaaaattacttactttttagtcttagatttttctttatgaatggtatggttcagtgatgatggttaagttctaatgtgaagcagtgggaaagttagctgtgttcttgtgtacattttttttggtgagttgacagttgtaggaaagttttaaacagacttatagcagatttttgtaacaattttgtgtcatagaccttttgctgtcatatcttatttgattacagttagaatcattcaaagacagagcaaactatggcagttcggtattttgtatgtttttttcctttccctttgggttatgtgtaattgatttaggtacaatcaatttgtcattgtcttacagtttatagagtttttatacattatcatagatgaatgtgtaaaaagtaattttatatacatgtgacccatgtataaataaatagtagtgttaaatagtataaatagtagtgttttggatttcatagtatattgggaaatacaacaaattttattttgaagtgttgattttagatataatcactaattttcttaatatagagggtctgtaagtacaatgtttgaattctagttatgatgactactgtgttttttggataaaatgtgtttaagggagtcctgtaacatctctatttttatgggtggaaatagcaccaatagtaggacagtgacaagctttttacctcagtgagagtacttacattattgtatcttatttgttgtggtcattatcacattttgaaatgttatacatacctttttttctatatatgcaaaagtcattcacagagatatagtcgaaagagttgttagtacttttagctcaattgctctgtgacttaaatggacttaaataggctaatctggaagcttgaccttgtgtctttgaaaaaattgtttcacatttcccacattctcaaattgagttttggatagcctactcatattgaggactgaaatgcaaatcataattgaaccttctattgatgatttaactttctcattatgaatgttactgttctgtaatgtaatgatactagagcccaattgaatgtcgatcaggttgtgatttcatggaattgtcccatgctgctgtgcttttctaattgataatctttttttttctttttccttggcatcagctctttttttggcagcactcccccactcccatctgttctccactgtaaccagagaaaccagttaaccaaacatcagtagtttttacattcagttttaagtcactaatcaaggctatatgtctcttctacataggcaaggaagaaacaaacatatttattgagcaagtgctgtgtgccagatgctttcacagactttcttaattaccccacagtccaccgtctcacgtttctctggccacaagcaaatgaggaaagtgagctttgaaaggttaatttgttcaaagtctgtttgaatgtgtcccactgggctgtttttctcaaagcttggatctttggctacatttttgatggttgatgttgcttaaggaataattgatggataaatggtattattgcagatgtcataagtagttgtatactgtttggtcatcaaataagactccttatcattaactgcaaatggactgtattcagatcatttttttttaatattatctatacattgtgccacgcattgtaaggggtacaataacataaagaccttatctactgtgaggtgcttacagtttgggagggagcttccttatgtaattaatagtttagttgtatcagatttaaaaaatactgccattcctcagatgcttgtaccaaagcttttttttttttttttttttttgagactggagcttgaaattaagatcaagtattttcccttgtttattttttttctagctgtgtcattctgaattgcctggaatttcaaattctcaccctttcccccacccaccctgttctaaattttttcttgtagaaaattattcacagaggactaaagacttcttgtcctttgtatgtagtagatgttaagaattcacttcttttcatttagttttaatttgtctcatgatgtagttctctcagtaatcacagaaccttcaagatgtgtaagtatataatagactgacatcctttcaaattcaggcattttgaaggttatattttttatatcatctgaagtaatgtaaatgaaaagattttgctttaaagaaaacaaagaccattatagatttatttttgttattgatacttttctgatgggaaaattgtaatcctggattggagggaggtaaggaggcaaagatcactttcaaaaattaaattcttgacttggtttttgaaagtcttactaaactataaacatttaagaatccttaattatatttttcctttaaaaaagcttttgtttctttttctgctgaatgaatttaatttgcttgctgatcattttgtaacttggccttcttggggaagggtcctgtatacatctgataattagatagcaaatattacatgtttgtgtatatagatgataaatgtgtgtgcagtttattttattgttttgctgacgcattagttgctagatcccttagtgtatttgcagttattgcaacttaatcagtttatcaatgggattaaagccctgctcaagtaatttagaatgttactttaaaagaatgttacttctcttttaaaaaatatattaatacataaagttagagcctttaaattttattgctcctggaatgaagtatagcttaaagtttttattgttaacatattgatgaggtgagagttgaacatttaggcatttaaaaaatttttcagtagcagttaatgttgcttctgtgtcagggatgggcaagtggaaagattaaagctcattagtaacataattattttgccaaggatgttgacgtgcatttgatgccaagacccgatcatgtgtatgtattaatctgcacttgaagcccatttcatttgatatgtagtttttggacttatttgatttagggaaagattgtagcttattgatctgcttctgaagggcctatttcgtctaccctttttttcccagttaatatttattagtaaaattaatgattaagcagccttctgggtgaggcctttaggtgaatgggaaaaatctgaaaatattgcttgatgtaaaatttaaaagtgtgttacttgtacactacttctgttagaaaaagatttgattatttaaaaattagattaattgctgagggtaaacacattcaaccgttttcctgtatcattgtgccttataagtaaaaagtttgtgttgtcaaaattacattggtataacatggataaagtagtattcattcaacagacatttgtttacaaccttctgtgtggcattgaagaaaaatgcataatctcttaagctcatagtctagtggaggaagatgcatgaacagataattcagctacatgggagtgtagtgatggttacaaactgtcactagtagttatagactatcaccacattcccatataaacgaaaatacactacagtttatttagtgtatagttaagtaaatacagtttacactataaaatatcacggaagaactgagaaggagttgttaactttgcttgaggagttcagtgaaggattcctagaggttatgacacctagctgtgttcagaagatatgtgtaaagaatcagataaagaaaaggcaaagcaaaggaggaccaaaagcaggggggaaaaaagacatgggaactgaaataagtggggaggggctgtgacagtgatggaaatagagtgagaaacagcaagttgtatatttaagaattcccattggtttaatgttgttgggaaatacatgtcagacaggtgtggataagtgagcataaactaggtctgtgcctactatgctaccatagaaaggttttgaacagggtcatggtgtgcctatgtttattttgattgtgattttgagggaagtagattccatgaggttggagttcatagtgtttggaaggctcttgcagtgaactaggtgaaaggttttttttttttgagacagagtctcactctgttgcccaggctggagtgcagtggcacaatctcggcttactgcaacctctgcctcctgggttcacgccattctcctgcctcagcctcccgagtagctgggacgacaggcgcccaccaccacacccggctaatttttttgtatttttagtagggatggggtttcaccgtgttagccaggatgatctggatctcctggcttggtgatccgcccacctcttcctcccaaggtgctgggattacaggcgtgagccaccgtgcccggccgaagcctagaagttttaacaccaccctgggcaacaaagcaagacccccatctctacaaaaaaaattaaaaatattagccacgcatggtggcacacaacggtagtcccagctgctcaggaggctgagacggaaggatcccttgaacctgggagtttgaggcggcagtgagctatgattgcacctctgcactccagccttggtgacagaagaagaccctgtctaaaacaaaaacgaaaacaaagagaaaaacaccttgtgactaatcatcttcgtgtgagcagtttctctctgtagtgtagtaaaaagttttcttttgcggttttcacatatttttcattatgtttagtggaaaactgtaaacctggaataacacgatggaacccattcgacgtgcccccagtgaacctggaagtgctcccaaaaagcagagaaaagtcatgacgttacaagaaattgttgaattgcttgatgtgtactagattaagttctgcagctgtggttacctgccatttcaaggtaaatgaagccaggaccattgttaaaaggaagtttgtgaagccatcgctacacctgtgccagctggtgcaaaaaccttgtgctttttgcaaaatacttttttatctcatattgaatatgcagcttgtatgtgggtgcaggattgctgtaagaaaagtatacctactgattctaatatgatttaagaaaagcaaagtcattatatgacaaagtcaaaggaaggtgaaggatctaaagctggagaatataatgccagcaaaggatggtttgatacttttagaaagaagtttggcttaaaaaatgtcaaggtaataggagaagcagcttctgccattgaagaggcagcagacaagttcccagacaccatcaagaaaatcattggagacaaaggatctgtctaaacaggtttttgatgtagacaaaagtgccctattctggaaaaaagtgccacaaaggatattgactagtaaaggagagaagcacatactagggtgtacaaggcaggaagggataagctaactctgctgttctgtgcaagtgcagtcaggtttttgatcatggctgactttatctataaatctactaacccctgagccttgaagagaaaagataaacactagctgccagtcttttggttgttcaaaaaggcctggcctggacagtgagaactctttttccggattggttccatcagtgctttgtccctgacgtcaggaagtaccttgtcagtaagggattgccttttagtattttttctactggacaatgcacctagccacccagaatctcatgagttcttcaaaactgaaggtgttgaagtggtatccttgaccttaaagtgtttttaattcagcctgtagatggggaaggtggggggtcaataaggacctttaaggctctttaaacgcagcagtagtaatctatggaaaagattgtcattgctatggaagagaacctcaatagagggaacatgatgaaagtctggaagggttacaccattgaagatgccatcattgttaaaaagccataaaagccatctagcctgaaatgatacattattgctgtagaaaactgtgtccagatgttgtacatgacttcccaagatttacaacagagccagtcagaatcacgaaagactgtggtaaagtgaggagtgaagggtttcaggatatggatcttgaagaaattcaagagctaatggacatcacaccggaagatgacttgatggagatgagcgcttctgaaccagtgacagatgatgaggaagatgtagaagaagcagtgccaaaaaccaagttgacattagagaatctggcaggaggtttctgatactcaagaatgctttgacttttacgacatggactgttttatgatgtgggcactgaaacttaaaacaaacagtggcaaaagatttgggaacagatagaaacatttttagaggaatgaaaaagcagaaaagtcaggcaaattacaatgtgtttttgtgaagttacagagtatggctccctctcctgcctccctttctacctctccctcctccatctcttgtgcctgtgccacccctaagacaccaactacttctcttcctcctacacctcagcctactgaatgtgaagaccagaaggatggggacctttatgacaatccacttccacttattgaataccaaatacattttctttttcttacaatgttcttaatattttttctctttattctaagaatacggtgtgtaatacatgtaacatacaaaacaggtgttaatagactgtttatgttattggtaaagctttgggtcgacagtaagctattagtagttgggggacttaaaagttatacacagtattttgactgctcaggaggtcagtttttcctaactctcacatggttcagtggtcagctgtattcgggatgaaaaaatgggaacatatttgagaaataccttggggttaatgtcagtagtacttgatgattggataagaaggagatgagagataagaaaaaatataaggcttatgtttctagcttgtataattaggtagtttatattgccacaactgaattagagattacaggaagaaggtttgggcaggtttggatggtgagttgtcagggatttttgacatgataagtttgatctgtgtctggagcttttgattggagatgtgtagcaggtggttgaaacaagagttttagactttgtggggaagatctgggcaggcagtatagatttgggagccactaatgtaaatgccagtacagaagtccccaccccatccacagggaatctgtttattccaagacccccagtggatacttgaaaccatatagccctgagccctatatgtactgttttttcctatgacgtttaatttacaatttagaaacaataagagattagcaacaacaataataaagtaaaacaattataactatattgtaataaaagaacatgaatgtggtctctcaaaatatcttgtactgtacttaacccttgtgatggtatgagatgatacactgcctatgtgatgagatgaagtaaggtgaatgatagtggccatacttctgtagttttgagttgcgacagcaaaactagtgcagattctttttccttctccacagtttcgtggatagaagaagatgtgttcttttcttttctgagacagagtcttgctctgttgcccaggctggagcacagtgccacaatgtcagctcagtgcagcctccacctgggttcaagtgattcttgtgccctagcctcccaagtagctgagattacaggtgtgtgccactgcactcatctaatttttatatttttagtagagatggagtttcatcatgttggccaggctggtcttgaacttgtggcctcaagtgaactgtccacctgggcctcccaaagtgctgggattacaggtgtgagccaccaccctggcgagaagatttattcttaacatagatcttagcaatctcagcatacctttttttttccttattaagtagagaactttcaccttttcacttaaaggaagcactttattgcttctctttggcatttctgaattgtcagcatcactacttttgtggtttggggacagtattaagtaagataaacattgcctggacataagcattgtgattttgatctgataaaccagatggctgttaagttaccaagtttttaatgggtgtggggtgtgtaacatagtgtggaaatgctggacaaagatgtaattcaggattcacatcctgagtgggatggcatgagatttcatcatactacataaaatggcatgcaatttaaagtttatgaattgatatttctggaattttttatttaatattttcaggcagtggttggttgctagtaacttaaaccaaggaaggtgaaactgtagataggaggactgttgtagtttatcttctttaagatatggacaaacttaggaaatctgatagaaattagggacctactctccagaaaagaagtgcacacacagtatacttggaaagttttgtttattgttttaggaacctctggaatccctcttaagttttagaaccctgcatgtacggataatagatgtaaccatgacaatgaatgaaaatacatagagacccagtagagagtgacaagagccaaggacagagttctcagggtgaaaatgatttaaatggctctggaaaagtagtatacaagagatgtaggggaataatgttttctaaaagaaagctacgttatactgaggtgcatttatcatagtgttattcttaaggtgcctttgttttagctcatatctgtatatttgctaagcttgaaaaagctatatttctttctgacatttatttgatgactgtcgatgagcgttcaagagattctatcattgggcactttcctttgttgatgcatgagggattatactgtgctctgggctgtgttaaatctactgacgttctcatttaatcttcatgacagccctttgagatagatgctgttattgaacccaggacttaattttctcaaggtcacatggcttgtgagtaacaaagctgtggcacaaacctaaggctgtctgacagcaaaacccatgttctctaccagtatactaactatgtttaccaagataatcagtgactgtgatgttactttaccatattagcacaatggaatgtgacattagtccactgatttggactaggttttgggatatataagttctaatcccagctctatgattttgggtaagtcatttaatctctctgggtctatttttcattgtcgtcgtctttttttttttttttttgagacaaagtcttgctctgttgcctaggctggagtgggctggcgcgatctcggcttacttcagcctctacctcccgggttcaagcgattttcctgccttagcttcccctgtagctgggattacaggcacgcaccaccacatccggctattttttgtatttttagtagggttggggtttcaccatgttggctaggctggtctcgaactcccaacctcaagtgatctgtccaccttggcttcccaaagtggtgggattacaggcgggagccactgtgcctggctcttcttctcatttgttagaaaaatttttaaccttagctatcaccagaaggaacattttttcctgcagccccatcttttatctatcaataaggcatgaatttaaaaagaaaaaaaaaacgcactacatacaaccttgtgtagtaaaacagctcttgatgtatatatgtgaaaatggttatgttataataatgtgagagtacttttacaatgtttgaagcctcttggttttatagttttaaaattcttcagcttctagtagaaaaatttagtaatttactctgggtagagacattttaatactttttctggctttcagaggatcttaggttatagagcctgtaaagatgatttgatgttttgctcagctattagcagtataggtatctttgaggcttatagttgacattaacttttctcttttttgaaattgttctgagtattttgctttatctatttgttactcaatgtcaagagatagtgtcttagtttgctttattagaacctcagcatatgtagtcaacaaactaaaaccacattgcacgtacatagctatggtatttgaggccatcattattacatggccttgaatcttctgtttgtgaaaagttagccgcatcagtacattttatatggatgacatcctatcaggatatctgattaaaaagaggtagcagtataggtgtaggggtaaattcttttacagtcatttgataaaagtctctgacagacttaggtcttggataggatttcggtaaaagaaaagaaattgttctgttaaagttccttctcaagctcttcagaaaagatcagaataacaagattcagtttgagtcatttgcttaaggatcgtcttgattgagagttgagctggtattttactgccagggtgactaaaataactattttgcctactccttcctcttttcacattcatacacatcagacgtgacttggagaggattccactaactcagtaatttttatccagttcagatcagaagtttgtgtgaagctgatcaatgttgcttaggttgtaaatgcagaacttggagattttatgtggcatttacaaaggggtcattagtcatatattagcagaaaatcagtcaccgaagtatgaatccttgttatgtgccatatactgttttagaggctgaggaatttggcagtgaaaaaaagatccctgccttcatgaagctgacatttggttgtagagagggggaccaggaaaataatgaagaatgtgggtcggagttggggatcagtagtgaggtgaggctgttactgtaaataaggtgggcatttaaaacttcactgtaagatgacagttgagtagaggtttgagccatgcaggaaactgagggaagaacatttcaggcagaaagaatagcaaatacgaagacactgaaatcagcttgtttgatgtatgccagggagtgcatggagcagagcgaacaaaaggaaaaaatggatgaagttgagagattatcagatcgaataaagcttatagaacattgtaaggactttgacttcaactccaggggaaatgagaactcatttgagagttgtgagcaaatgagtgacatgatttgatttatgcttttacatggtcaccctggttgcctgatgatagcaggccaggagtggagatggagaccagttggaggtggtggtggttttaccaggatagtagcagtggaagtggtgagaaagagttgaattctggggatacattttgaagttagagacaacagcattttctgttggagtagtagtggggtcagagagtagttaattatgatcacaagcattttggccggagcagctggaaggatggagtggacatttgttcagctggaaaagacttcaggggaaaccaactgagggaaaagatgaggagttctgtttcaggcttggtaagtttgagatgcctactacgcattaaagtggaaacattgagtaggtagctggatatatgactctggcatgtacagagggggccagagaatgtatcaattttaagattgatttaaaaccatgagaatagatcaactccacctagaaaatgagtgtgactaaaaaaaaacaaaaaacaaaaactgagtgtggctagataagaaatcgagaacttgagctttaggattggaggtttaggtgataattaagagccagtaaaacagatgaataggagacagaagtagaagaaaaacaagagattgtagtgcttggaagttaagtgaggaatttgtttcttttttttcttcttcttttttgagacagggtcttgctctgtcatccaggctggtgtgtagtggcgcagtctccactcactgcagcctcgacctcccgggctcaagcgatcctcccgcctcagccccactaaggagctgggactacaggtgcatgccaccatgcccgactaatttttgtatttttagtagagatgggtttttgccatattgcccaacctggtcttgaaaccctggactcaagtgatcctcccgctttgactttccaaagtgctgggattatgggtgtgaggcaccatgccttgccaaatttgtttcaaggagtaggagtgatcagctctttcaaatgctgctggataggtaagtaagaggagaactgagactttgcccattagattttggcaatatagaagtcactggtggccttctcaagagtagttgcagtgaaatggtagagatgaaagccctactggagtagattcaagatataatggaaagatggaacttggagacagtgcatgtacaatctcctcttcttgcctgtgattttgccataaatggaaagagagattagatggtgctgaaggaatatatgggtttgtgaggatttgtttttgacataggaaactgacatttttttttttttttttttttgagacacaatcttgctctgtcacctaggctggagtgcagtgttgtgatcttggatccctgcaaactctgcctccgggctcaagtgattctcctccctcagcctcccgggtagctgggactataggcatgcgccaccacgctcagctaattcttaaaaaatttttttgtagagacagggtctcactgtattgcccaggctggtctcaaactcctaagctccagtgatccttctgcctcagtctcccaaaatgctaggtaggattacaggcatgagccagtccatgtggtgaaactgacagttttcagtatgaatggaaattatctaccagaggaaaaattttgatgatgcttagatgtgtgattactaaggggaggagttttctttctttttttttttgagacagagtcttgctctgttgcccaggctggagtgcagtggcgggatcttggctcactgcaagctctgcctcccgggctcacaccattctcctgccacagcctcccaagtagctgggactacaggcgcccaccaccacgcctggctaatcttttttttgtatatttagtagagacggggtttcaccgtattagccaggatggtctcgatctcctgacctcatgatccgcccgcctcggcctcccatagtgctgggattccagacgtgagccactgcgcccagccaagggaggccttttcaataggtggtttggcatagaactagagatttacttgtcaaatttcattctgtataatattacattgggttcttgttaaaatgtcgattctgtttctgtaggtctggagtagggcccgaaattctgcacttctaacaagttcctaggtgttgcttatgtgtctggtccttatgctatacttcgagtacaataacttggcactttgagcacaagaacctagcaggttttattggcataaaatcaggtcggttggtgtgtgaatatgatgggaatttgtatagtgtctcatcgggttgtttttattttctcagtggaataggaagcagtcataatcatagagtgaggatggaggaggtggtataaaatcatctagaagagtagagtgagtagactgactagtggaattgtggggttgcatgaaggctgcacttaacgttagtggttatgaatttaaactcagatggaccaaaaatatgggcatatgttattctttgttttctttcagctatacggatatatgtcaggagtatgtgggctgttgggatttaacttggcaagtattttggtgggagagagataaggggtaagtgacttacgggtatataaatcattatgattttatttaaagtgaagagttctgctccaggtaagattggagggaggtcttaaaagatgagaaagtgcttctaacagatctagaacctatttttaaatgtatcctttttttccccctgttaaaataggttgttaatgttcttatgtgtcatagatttataatcatatctatataatacaatatttactatatatggacaaatatagaaagactttcaaccattggttttttttttttttttttttttttttgtctcttctctctcttggatattacagatgaccatggatgaaaaatatgtaaacagcatttgggaccttctgaaaaatgcaattcaagaaatccagcgtaagaataacagtggtcttagttttgaggagctctatagaaatgcatatacaatggttttgcataaacatggagaaaagctctacactggactaagagaagttgttaccgaacatctcataaataaggtatcaaactttaaaggactgttgctaatactatattgaatgtagaaaatcctttataccatattgcactttgaccggaagtgttctttttaaaggtgccagaagcctatagaaattactaattcgtgactgttataagcactcatgaaaaatttataatcagctaaatcgaaaatttggatatttgagagatgaagtttgtgagctataataaatgctttctttaaatcataatgaagcaaactcagtaattcacaaatgcttattaatatgttaattacaaggaatttttttccttaaaatgatttaatcagcccatttttactttctcatttttctgtatatttgaaaacaataaaactacgttgtttaaaatatatttctaagatggatcactaactaaaattgactttattttaactgagttctgtggtacatttgaattttttttaaagataaattattgttgggctgttcacattattaaaaatggttctctgatttcagaaagatgtatttttttagaacaaatgtttttatagagtgaactcttccaatgcatgtaaaatgtaatttcatttagaaaataaattttattacaatgccttgctttaagattgtcaaataaaatgtgaaataccacacagactgataaaaacttctcatagtctttatgtggtattggggtatttattttttaagttttattttgaaaaaaaagtttcatgaatagcacgatgtgaactcttgtgtacccttcacctagattcaccagttgtttacattttgctacattttttttgccagtttttctattgatatgtgttataattactgttaccaatattattattgctgaaccattagagagtaagttttagatttcatctaccccaaaagactttgcaacatttcttttaagaataaagaaatcttacttaaccaaagaacaatgatcaaaatcaggcagtttaacaatataatactgttgcctaatacattccttattcagatttcaccaattgtcctgtttagtggtgatttcctttatagcaatttgttttctgatccaggatccagtccaggatctcatgttcagttcctcagcctttctttgtctttcagcacattgacatatttgaagagtataggtcagttgttttgtagattatccctcagtttttggtgtgtctgattgtttcctcatgactagtttcaggttatgcatttttggcaggaataatacataagtgatgttgtgtcctcagtgcatcacatcaggaggcacttgatgtcagtttatcccattattggtgatgttaactttgatcattggtgtccgccagatttctccactgtaaaggtaccttttttccctttgtaattcataagtaatctgttcagatatattttgacactgtatgaatatcctgttccctagaaactttcatgtgatggttttagcatccattgatgattcttgcatgaatcattattactatggtggttccagaacagtaattttctatttctgctctttcttctgtaatttctttctcttaaagggaattacatgagccacgcagttagtatcttatgaagcaaggtgattgtgtttttcacacaatcagcagttttttattaagtgcctattatgcacagctttcagtcataatgtagtggatgcaaagagataagatactatcctttcctggggtttttattgtgatgtgagagatggatgatacacacatttagataaccgtgtgaggcattatataattaagtggcaagtgagttgcataggcaataaatggcttaagaattcaaacggaggagaggttgccttgggatgtaagattttatgggaaagaatgaaattgaattgagccttgaaaaatatttgggatatatatgaacagtgtggtggaaggcattccatgatggcagatgttgtgaaattatatagagatgaactggttggttaaacttaggtggtaagtagagtttgactgaggcatataataattacagggattagtggattgtagtgttacaaagatggtttgggaacagattgtagaaaaatttgggtgccagactaagtaatttggactaaactgtagacagttattggaggtttttaagtgggtgaaaatgtgacagaatatttgaagatgtgattttaagtgggtgattatgtggcagcatattatgaggatgctataaatgtaaaattgagaggaggtttataaaatcaggagaagacctggaaagatctgggtaaagtgataggctagaaatgaatggatgatgtcagaaattctaaacttaagtctagacaaagattgcttactgggagaattatagtgccaccaattgcaaatactgtgaagtaatagtgggaaactgatttgaaatgggtagagaatatgataagttttgtttagattatattgaaaatgtttatccttggaagataccttagaaatcattttgcatgtgaggaaaattgagtgtgagatcatagtaagatgcccaagtagagatatcgtatgtttggagacacatagatttagagcttgggcaggaactcaaaattagatgtggagatttggcatttggtaacgtatactgaggaacaagtgttggagttcagaaaatgaagagcccagagccaagggatgaatcttaggagcaaactatagtaagtaggtgtgggaaatggaaaagaccaatttaagaaatttggcatcaaaaggacaagtggaagagttttgtttaaagctgctgaaggagagaagattggaacagctgagttattggatatagagagtatgggattaagaacaatggaaaagaagtaaacttggaagaggggcatgttctcattcgtcagaggttctatagggaatgataattaacacaattaacttttatttagcatttactgtgtgctaggcccagttctagtgcttttacatgttttaacttagctaacagtcacagcccaatgttgcagatactactattatgtctgttttacaaatgaagaaaccaaggcacagataattggtcatttgtccaggtccatatagctgttaagtggcctagccggaactgaattcaggcaatgtggctttagtctgagcccttgaattctctgtagatctgctcctaaggtagaatgatcaagttgtagtatgctgaaattcagtgtaaggggcttcaagttaatggacttactgtctgtaaacctccagtcctttaaattctaggaatcctttaaatttacttaataatggagttggaaataatatccctgagattctttatttctaaaattattatgaatctaataaaccatccatcttctgaaaacgagacgaagagacttggagtagcctttgtaagggatatactaaggaattggcaagtgcagaagaagatagcttcataggagttggcctgaatgtgtgctatgtcagtttttttaaaccttgggcacaggtgcagaaaaaaacataagtagttgtgtgttagggttgagaagtggctcgtccaaagagtgaggagaagagagaaggccagagtgtgagatcagtgtttcggtgaccaagttttgggctccagtatggtcaattggatgttgaagatatggtccagtagatattgaagttacgtgagcagtcactccatgagaactctgagtttcagtatattataagttgcttaaagtggtcccatatttaaggttaactgttgtcttcctcatcttaagctactgtaacaaatcccataaaccaggtggcttaaacaaatatttctcaccattctggcaagtgagaagtccaagatcaaggtgcttgcaggttcatttttctggtgagagtccccttcctggtctatagacaaccacctccttgctgtgtcttcacagggcagggagggagagaggtcatgtctctcatgtatcttataatggttccatcctgttaatgagggtaccattctcaagatttaattgcctcccaaaggccccacctctaaatactatcacatttgggattagggtttcataatatgaatttgaataacacaaacattcagtccataacaattatcatttcagaatataggcagtttttataatatattcccccaaaacatgcattcaagttgattgtactaaataaattttaaaatatacagtatatgctaaattcttaaatttactttccttatacatagtcattaatgatcattgccggcatctgaaaatgttcttttatttattcttttctttcacgctcatttgaccagtcaatttttgactaggaaatgtagcaatttcagcatgtctgttcattgattatttacagtgaattaggttttgaagcctctgctagtttctgtgcttttgttttcatgtttactcctattttataaaacaattttaataatcatataaacacagtactactgtattgaaggggacactatcgaaagaactattaactgataggtaggaccatctgacatgtttgtttcctaaggtaggacctctgacatgtttgtttcctaaggtagtaagtctcagtttgttctactaaatgagacttagagatgttactgatacaatgtgcaaaagcatagtttgcatgaaaatcagtactgcctatctctgcattgcatcttttgactagaaggtgagatattctttcagggttctgtggtatcagaatacctatctttaatctcacagaatatacctttttttgttgttctgaaagcattactgtttggtctgctcatcagtttttaattcacaatgcttttggcagttagctgaactgcctgacgaaccatatatttatttattttaaagcaaagtgcttttagtgctatggtatacatagccaagacccatcttttcacattgaagaattccaaggaaatataatttttacatggattgagggctggtttgttatatagtttgttggtactttgatttcaaggtgaggatagtgaacaaagtcaaacattttggtaaagtagcgcaacacagactaccagacagcagatgacgggaggcttcagagaggacatctctttgggattgttgtagctgattgttggctttcaaaataagttcacaaaattgaagcaggcatagaaaatataagtactgtttctctaataaaagcacttctggtaggatattatttttcttgtctctggaagaatgtttcctttgaggaaactgacacccataggaatttagttcatttctcaagaccacaaggcaaaatttagggtgtaatgtggcctttgtacctcaccataagaaaaatcttggtttagaaaatgaaaacatttcaacttacacaggaatttgttttttaactttttttctaaataaaaaagcatagtaatggaggaaaaaagttctgcttttcagatttaaagacgtttagaatatatattattttgtcaaagtgtcaaaggtatcctgtaagacttttcccatcacagaattcagcattcaaaactgtttgccaggctctgtgctaggtgtaaggaatatattggtaaatagaatacatctgattcctgcacttatgaaacagatagtaaacaggtaaacaagtatttagttataaaatataatcaagaaaggacacagtgatagaggaaaaaatgataaagacaaccacataggtcaagaaagggctgtttgaggaagtgatagtgtttaaactgggattagaagaataagcgctcacaagaaaagtgggttgaagagtattctaggcaaagtgaatggctgtacaatatttttttctgtaaaggaccagatagtcagtatttttgtttttctgagccatacattctcaggcacagctcctcagagtctgtttttgtagcacaaaagcagcaacagaccaaatgtaaatgaatgaacatggcagtattccagtaaaactttactttaaaaaggcagcaggctgagtgcagtggctcacgcctataatcctagcactttgggagactgaggtggcaggaacacctgaggccagcagttttgagaccagcctgagcaacatagtgagaccttgtctctacaaaaaaaaaaaaaaaaattgaccaggcgtggtggctcacacctgtaatcccagcactttgggaggcccaggtgggcagatcacgaggtcaggagatcgagaccatcctggctaacacggtgaaaccacatgtctcctaaaaatacaaaaaatgagccggacgtggtggcgggcacctgtagtcccagctacacaggaggctgaggcaggagaatggtgtgaacccaggaggcagagcttgcagtgagccgtgatcacaccactgcactccagcctgggcgacagagtgagactccgtctcaaaaaaaaaaaaaaaaaattgccgggcttggtggcacacacctgtagtcacagtcgctcaggaggctgaggcccaggagtttgaggctgcagtgagctgttactgaactactgcactgcagcctgggcaacagagcgattaaaaaaaaaaaaaaagctggaggctattctttgccacttcctaaagacattgaataaaatcccatcataagtagggagctaagacttggtaatggagaggaatgggacaagatggggttgcagagagaagcagaagccagatcatatcatgccagaccttgaagccatggcagaaggctttgtaattaattatatgtacgttaggaagccatttaaggattttaagcaagataaataagttagagagcataagagttgaaataaggggaccaggaaggagtaatccagaaattcaggtgaataacagtgatgatttacactagtgtagtgacagttaagattgagaaaagttttaaaatacaagatatattttggatgtagaaagaacgttacctgctagcagattgtttgtagggaataagaaacggacaaatctaagatcagttttaagtttttggctcttggctaggctaggtgatttaattttctgatacggtggggcagacaaaggagctccattttgaacaggttagttttaagatacctgtaaaatttgatatgcaaatcaaattatccgagaagtttgaactggagatgtgtatttgggaattgtgaacatatagatggtacaggttgaacatccctaatccaaaaattcagaatgctccaaaatccacaactttttgagcgccaacatgatgccacagtggaaaattccacagcttatctcatgtgatggagtcacagtcacagcacagccaaaactttatttcacagacaaaattactaaaatataacattaccctcaggctatgtgtataaggtgtatatgaaacaaataaatttcatgtttacacttggattccatccccaagatctctcattatgtatatgcaaatactcaaatctgaaaattgaaacacttcgggtccccatgcatttagggtgaggagtacccaacctgtatttaaagccctggaagtaaatgaagtcacagagacaagagaaaagagggcccaggattgcaccctgaggaatttaaacacttcgtgttcagatacattgaggattgcagtggagactgaaaagttgccagttagtggtacttaagacttagctctaatcttacattataagataataatatttgacaggtatttagcagagttacagtttttcacagccattttgcgtgtgtgtgtgtgcgtgtgtgtgtgtgtgcacgcatatatgtgtatatgtaagtcagatactaaagcacggttttaaatttagaaatagtaataattagttttgctacttttgggcatgttaagggtggagccatcttctttcattctcctttcataaggttcctatttgggattcaaacttgacagtttttaagcttgttgtagagtaacaaaggacttgccttttcttcttctaactcctgttgagcactttaatagtaagaaataacctagatgcagctgcagtgggaaaagtaataggtagaaaatagaactgagcattggtacttaattctctcactaataatcttgaacaaattactaaacctttctgggatttaaagtattaatctataaaatgagtttggagttggtcgttttagcccaaagaactttaaaaattatgattatgtgtcttgataagtttaggttattaagacttaggaagataatagtctctaagactgtttattcctgtgccatgtgttttgaataaaaatgtttcaatttttttttttttttttaatttattttccgagacaaggtcttgctgtcgcccaggctggagtgcagttggcgccatcttggctcactgcaatctccaccttgtagtttcaagcaaatctcgtgcctcagccttccgagtagctgggattacaggcgtgtgccaccatgctcggccaatctttgtatttttagtaaatatggtgttttgccatgttgtccatgctggttttgaactcctagtagcatcaatgatccacccgccttggcctcccaaagtgttgggattacaggcgtgagccacagcgtccagcttttttgttgttgttgttgttgttgttttttggagaccaggccttattgtgtttcccaggctggagtacgttggcacaatctcggttcactgcattctccgcctcccaggctgtggtgattctctcacttcagcctcctacatagctgggctaccggcacgtgccaccatgcctggctaaatttttgtatatttttttgtagaaacaaggtttccaccatgttgcccaggctggtctcgaactccagggctcaagtgatccatccgcctcccaaagtgctgggactacaggcgtgagccattgtgcctggcctcaatttttaattttcttgaagtcaggggagaaactttagttttaatatgggaagagctttattatctcaattttgtaatgcttagcagttttcttagatttaccttatgcttaatttcttcatctttaatactccatagtaataatcaaataacatggtaacctcataaatgaacctataaaaattattgaactttgaaagttggtttcttagaaaaatagctgaacaaaaaaaagttaacatttaaaattaacttatctttttagttattattggaaagaacatttattctagtggttttcaaagtttttctatccgtatgtcctattcttcaaataatatcttactccgattgaatgggaggaagccagaataagaggagcttcatcctgctcacctttcctttattcagaaaaccgcctgttgagcaaggcactggtgtgagcatttgtactatatcaaggaaagattcctgcctttgtggaagttacgttttagacttacatacttggatctacgctttgtagtcataatctgttctaagcacttttgttttaccagtggggaaattgcagccttgaaggggacatggtttcaagtttcaagtgactttcttttttgaatttctttgtaaactgcaatgtctttttgtagaacaaataattcctcaccatttatcttttgtacctagggtcttatttgctgaaaatgctgtctctgtgtgaactactttttcaatatatttttctccctatttctagatggggaagaagaaccagttttaaattttatatttgtttgtaagtaagttaagatatttatgtgaacatgaagttggtaactttaaggtaaactgtggactcttctttatgtcaattaaacagacttccttttataataaagcttttggagtgcttttccctttctaggcaaatattaattaatctaatggaaaacattaaaattaatgtttttaatggcatatatatatacaatatataatgactgcagtgagttaagaatattgatagaaacacttgggaataagattttccttagcaaattcagattcatttcagaggcccacagagattgagtttctcctatgtttcagccacccaaaaataaataagacatgattcttgccagcaagaatcccataattttagcgaggtaatcagatttgagggggagttactttgcctgaggaattcagggcaaggtagaaagaggaggtcacttttgattatacttaaagcattactcaagattcatcatgtgagcaaagccaaaatactgtcccggtagataacaaggagagaaagttgaatgagaaaaatggcaggtaggtatgagcgtagtgagatagatcagtatagatggaaggtgaacatgttgttcataaggatgaacaaaagcatcttcgaatgtttttgtaggaaatgaggatagtaaagtgggttgggctagattttgaaaaccattgtaggggatttgagtgtttttctgttggtggtgggagccattgctttttaatccttagaaaggctgactgcagtggagaagatgtagtcaggcatttaggatgagtgccattttcagttccttgttgctgcttgctcatctttagttttcatgctatcttgtcttgatgtttaacttaaaagttgctggaagtactcaacccattatgctttttgggatggtggtgacaggagtgagaagagactgtgagctaggtgtgaaaactgttaatgggtatgatatggggatagtgacctaaatataaatagcataatcccaaaagagacagagacttgtcggggatagtgtgtggaaaagggattattagagagtcaggaaaacagcaaccgtgggatatgaaggacattggaaattgaatggtttctacattgaaagggatggaagagaaatgatgttaggggagaggaggcttaaaagtgttgttttaacaagtttgcccatgttaagtatcagctattctgcttaagttgttaggtagactgtactttgagggcaagtacccgccccccatcctatttctgttgtattttttagtgatattcttctgttactaagtgaataaatgaaggaggacctgttcatttatctttgtgtctcctctttgcatgtggttggcactcagttgtctgttgaaatgaatctttgagaatactaccagcagtcaaaatggaaaccaccttggttcatagccacaaatagctgagatccattttttttttctctgtgtggggtaatacctctccctactcgagttaattactaaatctgacaaccatttaaaaacacaggtgattatcgggctatatgcttctgtttttttgagattgaagtctgtctgtcggcttagaaccagatcatgttatcttgagaaaccatggtggttttttccatcgtactcgagaacaaaaatactggtagctatgttgtcatgctttgtgtatgttttcctgattaattctgtcagtgtgcctgttactaagtttaaccatgatactaatgctataataatagcttttaatgtatatcttaaccattgggaatagtatactttacaaacgataagtcatagtggtgtttttctgtggtgtactgtcatttttctttctgcattcctttccaaccagtaagtaaaaagctatcatttttcatagtagtattttgtactgattgagaaatcctgatttttctaagtcatactattttaagaccagtttaaaagcatatttgaactaagaatgccttttttaaaaatgtcaaattttatgtgatttttaaaatagtatttgcttcaacacgtagcaaattatctttatgtatgaaattgtgaaagtgtattgtcctaacacctgttctgtgttccttctttgaactttgtaacttttccgtagtgctatttattgtattctactttgtattgaggtcatttgaatgctaatattaggctcccccttctcccctctccctcagagattataaagtggctgaaagtgtcttgtatcccccatagtgccaagcaccctgttttgcctgctggaagcaaacataaatacatgaattgtcagtctggggaaatactttgtatacttttgaatgagtggttgatatctgataataggacctgatttctttaagagcttcattttggacacttaaagcaaagagtaagaatggggaatatttccactgagaatgaatttgattttgaaattgagaatagtgtgctttttgtgaaatgctgttaagttacattactatgtacgttagaaaattacttaatgaggaatcttctggcagcaatggagaaaattttttccctacagtggctatcttactgtttttttaaggatactggtataatttttctgatcactattgccatcttaattattaaagttaattaaaaataatgagaataacacagtctactgtatgaaaaggatagtgaattttatattattcaggaatctcatcattagttaattcttggaaagtttaaaatacctacaaaacttaaaattaattatcttggccttagtagaagcttgtttgagatacagaaatcttaagattgctatatgtattataacagcaacatctgttaaccaaatttatattagttgtacaaataattggagtttgactgcattaagaattcctcaaaatatgaggtaagagttccttccagtcattcagaaattctatcctttagaggaaaggaaagcaagtgtccttattcctgacctgcccctatttttgtatatgacttctgtaaaaatagcagaacattgcagtgtttctttttaaccttttagatcaggaattctcagggtgagggaaagagccatgaagcttttttctcaaacagttctgtcagctgtcctctataccttatggcttgtctcccattgggattcactttatctagtaagccacttttattgataggtttgtgtcataccactgtggtatgataaggtggaaaaattttgaaatctttaagaattatttaatggcattccttggaagactaaaattcatgtaactggcaaaatttataaagtgacaaacccctagaccacatgtgattaatgcaggactgaaaaaagtatgttttaagtggaaatttaaatgctatttttatttttattttttaactttttttgtatatgtaagaatgtttttgtaacattacttataatggtaaaaaactaaaagcaacttatccatcgttaataaagtgattgaagaagttatggcattaagtgctatttttgtaggtcatagtaaatgttgcatgcttttgtattatgctgtctttaacagatgaaacaggcaacatgttttggaatttagagccagaaagatagcaggcatccagtggctgtcaattattttaaaatagaagccccaatttaaaaaatcatacaaaactattataaatcatatttaataaggggaaatgaagtcttttctgcagtggtgctaagtaaggcattgcagtggaacatgatgtcattgatctaatcaaccatagtcacatcacaggtaaagaggtgctacagactagataggttaggtgacttgctcagagcccttagttagtgacttccctgggcagttgtctgcaaagaggttgagtatccctaatccaaaaatccaaaatctgaaacttttttctttttttttttgaaatgggaggggtctcactctgtcaccctagctggagtgtagtggcatgatctcggctcactgcagcttccacctcctgggcttaagtgatcctcccacctcagcctcctgaatagctgggactacaggcacacaccaccacccccagctaattgtttatatttttggtggagatgaggttttgccatgttgtccaggctggtcttgaattcctgagctcaagccattgtgcccacgtcaacctcacagagtgctgggattataggcattgagccgccacaccaggccaaaatccgaaactttttgagtgctgagatgatgctttaaggaaatgctcattggagcatctcagattttggattttcggattaaggatgcttacctggtaagtattatattccaaaatctgaaaaaaccgaaaatctgaaaaaatcaaaaatctgaaacacgagtggcctccaagtgttttggataagtgatattcaaccttagcagatttttattatcttagcttctgggtgaatgttaaaatactatagatttatagaatgacatacctttgagttattgtacctctgtgatactttttaatgtcctggtataattaggatgtgctccatgttattatgtctcattttatgtttttaatacatgattagtatttttttgatggacagtaatgccaagtataaatttctgtactttggggatttgtctatatttggacctaatgttgtcctgaatttggagacttgtttaccaaggaagtcctcaattttcagtattccatatcatcattgattatgtgactctgttttagtttcaatgaactttagaattaaagtttttaatttgttttagctgatgatttctttgttttacctagacatttaattaggattggctggctgggattttgccccaggcattgaaatgtagagtgtgaaaaaattttaattaatgattaaaaacaattatgtgtgttgtggggtatgggagaactgtgcacattatgtccttcagctctccagctagcccaagagctgctggcccagtattgcttccttgtcaatccatggagatatttgggaatgaaaactcaagggcaaagtttggaagcctgtagctcctggtcattcctgctgttgtctcctgtcatcctcctttccagctccttttgtttctctttaccagtaatttgactgacttgaggatgtgtatattgcagcttggacattaatttatcattaagcaggttttattatacagttgaaaaataggccagacacggtgactcatgcgtataatcccaacactttgggaggccaacgtggaaggatcactttgaggccaggacttcgagaccagcttgggcaaaacagtaagaccccttacctacacacgcatgcgcgcgcgcacacacacacacacacgcacacgcacacagccagaagtgctggcacacacacacacatacacacacacacacacacacacaaaaagccagaagtgctggcgcgtgctgctgaagtcctagctacttgggaggctcaggtgggagcatcacttgtgcccaggagcttgaggctgcagtgagctataattgtgtcactgtactccagcctgggtgaaagagtgacaccctgtttcttaaaaaaagaaaaaggtttccttttgacagtaattccactttaatctttgctaaggatttaatttttaaaaatgcgagaaaagctatatccacagaaacaaagaatagtggtcaagtttgaattgttgcagagtggttcataaggttgatatactcaaattgtttaacaattctttcattgtttggaattaaaattgcttttatgaataaagcttgtggcatcatagcttatgtttatgataaaataataaggaaacagggcccaattttcaaataataattcaaatttttaaaaattagtgtataataaaattggcctttattttcatatatctctgaatttcagcacacataaagattcatgtaaccactgtcacacttgatatagaacagttgcttgaccccagtaaactccctctgttatccctttatagttctcttaacccctagttcctgacaaccactgatctgctatcttaacactatagttttggattttttttttcaagaatgtcatataattggaattatagtttgtaatcttttgagtctggtttctttcattcagcataattattttgagattgatccaaactattctatcaataatttgttcccttttatggctgatactctattgtatgaatgtaccacagtttgcttattcatttacctgtatacttgttgaaagacattttgtggttgtgagtagagctgctatgaacatttgtgtgtgatttttgtgtgaatgtaagttttcatttctctgttaaatacatagaagtagggttgctgggtcacgtgatgttatttaacttcctaagaactgccaaactgttttctggtaaggctgtaccattttgtttatggtagttctagttgttgcaaatctttgtcagcagttgatactgtcagcatcttttgttttagccattctgatgggtgtgtaggggtttctcatggttttaattagcttttccctaatgacttacattgttgaacatctgttcatgtacaaaattgccatctgtatatcctctttggtgaagtgtctgttcaagtcttttgctcatttttaaattatttgctgtcattgctaagttctaagagtttttttttttttaatatgttctggatacagtcatttggtttttctcctattctgtagcttctctctgttactgtctcagtggtgtctacagaacaaaagtttttaatttcagtagagtccagtttagcattttttcttttataaattatgcttttggtatcatttgcttaaaattatcagatgacattttcttcttacactttattgtaatctgacctttttctttggattactatggtgcattggacatgatatgatacagctaggtatttttcttctaaaccaaaggttaatattaaatgttaatcagtggcattaaaaaagcagggctcttctcactcataagtgggagctgaacattgagaacacgtggacacagaagagaacaacacacaccagggcctgttggaggatgggaggtgaggggagggaacttagaggatgagtcaataggtgcagcaaaccaccatggcacacatatacctatgtaacaaacctgcacgttctgcacgtggatcctgtgtgggtttttttgtttgttttttagaagaaaaaagcaggactcagaattgcataaatactattattacaataatataaaaacatactcatgttgaagaagttctgcaaagggaagagacagaaatggctagtgtgggagccagtggtttcctagtcctggatgttatatcagagtcacctgggtagatactttaaaattagggttgtcttttgatcttgtgtggtccccaaatatttcttcttctttcttctttctttcttcttcctccttcctcttccttcttccctccctcccttttttttttaaatataaagtttggtttttagagccgttttcagaataacaccaaaattcagtggagaggctggacacagtgtaatcccagcaccttgggaggccgaggcgagtggatcacttgaggtcaggagttcaggaccagcctggctaacaaggtgaaaccgttgtctctactaaaaatacaaaaattagccaggtgtggtggcgcacacctgtaatcccatctacttgtgaggctgagccagaataatggcttaaacctgggagacagaggttgcagtgagccaagattgcgccactggaccccagcctgggcaacagagcgatactccatctaaaaaaaaaaaaaaaggtggaggatggaaggtactaagatttcccaaatacacccctgccccaacatatgcacagcctcccccctgtatgcacatccacaccagagtggtacatttattacaattgatgaacctacattgacacgtcatcactccaagtccatagtttacatgagggctcacttttggaatgaactcagtctatggttttggacatatattcactagtatagtattgtacagaatagtttcactgccctgtgaatcctgtgctctgcctacttacatacctatttttttttttttgctctctctttagttttgccttttccagaatgtcatatagttggatcatacagtatatacccttttcagattagcttatttcactttgtaatatgcgtttaagttatctctatatctcttcatggcttaatagctcatttctttttagtgctgagtaatattccattttctaaatgtagtacaatttattaatccactcatctgcagaagaacgtcttggtttcttccaagttgtggcaattatgaatgaagttgctttaaacacttgtgtgtggggttttgtgtggacgtaagttttcagctcatttaagaaaaaactcaggagtgtgattgccagattatatggtaagagtatgtctggtttcgttagaaactgccaaactgccttccaaagtgactgtaccatgttacattcccactggcagtgtatgagatactcttttgctctgcgtccttgctagcatttggtattgtcaatgttttggccattctcaaaggtatgtaatggtatcagattggtgttttaatctgcagtgtcctaatgacctatgatctcctcaaatgcttacttgccatctgtatatcttctttggttaggtgtctgtcaagatcttttgcctttttaaaaattgagttactttctaagttttaagaattctttatatattttggataatagttctttattagctttgtcttttgcaaatactttctcccagtctgtggcttgttttctcattctcttcactgaagtcttatttatttttagagataggatcttgctgtgttgcccaggcttgcctcaaactcctgggatcaaacaatcctaccccctcagcctcgtgagtagctgagaccacggacacactactgcatcgtacttaaaatctgtttgtaaaagctcttcgggtgactctaattttctgcctgatttgtgatccactgtgttgagctttctctttcttcctttgcaaagctagtaccaggcacagccatcagttctccattacttgcacttcatcttttttgtcacagctggtcccatcctgctctcaatttctctggtgttgctacttgttcttccatgtctctcccctcaaattccaactctttatctgtgtaattttagtataggttttctttaattatctgttcatacttaatccataggctgttttggttctggtactacctgtacagcagggttccctcccatttgccttgctggtgcagaaagtaggtgattgtgttaggccatgagattaacaatgttatccctcccaccatatttcccatgcttgctttctttttcaatttttttataagatgttaataatttgtaaaataaagatccttttttcacttaatgtgtagtttatgtgccaacttaaccatctttttaaaagcctattttaatcttcataatcttcatctcattcctaccattttattgtgtatgtttgaataaataatctgttcactttcaactaattttctacagaaatgttggaggaaaaattttttgttcatagagtaatctgaataagaagacattgcagcagtgtatctaaggcattcattttacttctttcagtcatgagtttgtgtgtgtgtgtatgcataattgaaaaataaacaaaattagctcttaattgtagctattttctgctagtaaaattcaccgttattggtcaggataattttttgaggtatgatgcaaacaaggcaattatgacacattgtactaggagatcacgttttattttgctgaaaggcaggtataaatatgatgacaaatatgtaaatacttgatatatttttttataaaatgtacaaatcagtgatttgaaagaacatgccttattttgtaacattaactttttatttaattggtcaattttttattcattcaacaaatatgcaggcacatttacgtgttccaaattcagggtgattttaatgtagttaacatttaacttaattttataatatagcggtatgtagaagttcatataagtccttaagaataattaatgggcttgatattctgatgtttgaaatacgtattttttttgtatgtagcgtagattgctcttgcattgtcatgattttaatttaattgctactcttcagtaaaggaatatgaagcttggtgtaaaattttgaaaataagcacgttttcagcttgctgggtttttgttgggatttgtatctgacaagtgctagatttaatgagttgaaacaaatgatacattattcattttgtataagtatttccattaactaacttgatatagttaacatttttggaggaatttctgggtgatgtaacttgaagtcatggagcttagtcttgtgaacaaaagattaaatatatgataaaattctaaattatgtggtacaggcctagtgatttttatactgtatatttagtagactagatatattgtctcatcattaaatctaataacctcgttttccccaatatgtaggaaaagattctgttttcttagtttgaatttattcttccacagtgtgttgtgtgtattttctttggcacttttagccacttgttcatattagatctgatacagaatggcattttatttatgtgtatttataattgttttagaggtgtctatatatctcaacatacattaaatagttgatgtttctcagaaagcaccatgacttcagctttttcccaatctgaaaaagcataaccactattagaaattctctatggtaaaggatatttggagataaaaaagttttgtttagtgtagagttattgagagtttagctggattatggaaggttggttggatttgaataactgtagaagttggcagtatagtcccaaagtgttacaggaacttggagacaaacacacgacgactttgtgataaaacaagaaccagagtctagattctgtttctgagtgaaatggtctttcttttgggcagatagcatagcaggaaagagtagtggtcaataacattttatcagagaggatggtactaagcttgtggactgtggaaaggaatttttgaagtcttgaatagtcttttattagggttggattggaaagacatttcaggctcaagggaactttatgtgcaaaagcaggtaatcctgaaagtgcttatgttggaggtgaatcatggcattggagggcagggatatgaaataaatggtgttatatataccaagcactattctaggtgtgggatatacacatggaaaagatagaaatcctgccaccatggagacatttacattttagtggaagaaacaataaacaaataaactaatatagtaggtaatgatgaatgctatgacaaaaaaacaaattgtatggtgaagaagtagagctaggctttctttgaagtaattggttgggaaagacctctccagagatgaaatttgagcaaaataaagtgagtgggacgagccatgtgaattgaggcagaaggaatggcagagcacagttgctgtatttagtaaagaggccattgtagctgaagtgtactgagtagtttattatagagtgtttacggagtactaagcactgttttaagtgtattactagcgttaattcagttcttaaaacaatcctacaagaagaatgctatttcacatataaggaaactgaggcacagaggttaaatatttatcccaggtcacccagtttgttagggagctgggattggagcccaggtaattgactccaaaatcagtattctcaaccattattcaaagttggggaagggaaggtgtagtaggaaattcagcagtagcatgaagccagtcttacaggcccttgtaacttactataagaatataggattttactctgacaatgatgtcaagtcactggagggttgggaaatacctaggaagttgatttatgttctggagatcagaagaggagtctgtactatacatatacatttgatactcttctgtgtataggttatagcttaaaatatttctactagcctataacatttctttgatttaaattaaagattccacttcattattttattaaacagatatgtgcatgcctgtatatacgagtgtgtggatgtgtgtgtgcaaactaatgaactcttctgttactaggtgcgagaagatgtactaaattcattgaataacaactttcttcaaacgctaaatcaagcttggaatgatcatcaaacagctatggtgatgattagagacatactaatgtacatggtaagtagagctttttaaatgttttcttcctttaagcagttaagcatttgaaggctgggcacggtggctcacgcctgtaatcccagcactttgggaggccaaggtgggcatatcatttaaggtcaggacattgagaccagcctggccagcgtggcaaaaccctgtctctactaaaaatacaaaaattaggtgcagtggtgggcacctgtaatcccagctacttgggaggctgaggcaggagaatcgcttgaaccggggggtgagccaagatcgtgccactgcactctcacttgggcaacagagtgaaactccgtctcaaaaagaaattaaacatttcaaaacacaatgactttctgtctaacttagttatagtacgtctcagtgtggaaggtggtttttgttttttaaatgaacagtactttctttgtaagggccaaccgaagcctatgtgaataaaaatctttatttatttatttatttatttatttatttatttatttatttatttatttatttattttgagacggggtctcgctctgttccccaggctggagtgcagtggcatgatctcggctcactgcaagctctgcctcccgggttcacgccattctcctgccttagcctcctgatgagctgggactacaggtgcccgtcaccacgcccggctatttttatttttatttttattttatttttctttttagtagagacggggtttcaccacattagccaggatggtctctatctcctgacctggtgatctgcccacctcggcctcccaaagtgctgggattacaggcgtgagccactgtgcccggccatgaataaaaatcttaattgttcacatacttagtgaatgcttagaatgagaaactgaaagggaatgatttaatttttttcttagtatttagcacttgtcctttaaaatggaaaatatggaaaaaaccatattaacatctccttaagagttgttaaatgacaatgagaaacaaaagctgaatattctcttacaagtttttaaatccttaattcttacatcttcagtgagagaggatgtcatattaatacaattattttttctgataatcatacactcatagctgccatctatttttcttaatagtatattattgcagtgcaatattgcagctagtcttgtttaaggatattagcttcttcacatgtatattccatttttcaccggctattgctgtattttgttttcatcagtcaagaaaaaaatcctgttcagcaagatcatttggaaaacactgactttgatctcagctgtttaataactttcagagagattaaattccagttaaaaaaaatttggtgctatagaatgacgctagattcattaagtttaattactgtatcactccaaaattaataagttaatgacttgttttacatcagtgtttatgtttgtgtattggatataattatttttcccaaagttttacctttttatatttttgtttctagtttttttagttttaatgtagtgatgagagcttgtcctagtttcttttacttggtagaataaagcaatgtttgggaagaatttccaataagaacaaacagctgtaaagttttttgttctgctctgtgaattcagtcaggcctattacccctggttttgtaagggcttagtggcaagggggtcagggagaggccacttcacttttaagggatttgataaaaggtataacaaattatttagcttttctgagcattatttttctcatccggttataaattaaccttgtgttatcattttgaagttaaatgagatggtatgtgacaacatatattatctggcatataaatttgaaataagttagcttgttgttttcgaagttctagatatggtgagtctttaaatcgcatcctaactatctaacattaagatagaaaaccacttgtaatcttacggtttattcttttgacaaaagaagaactttaaaattttatacacacgcagactctgatgttatttttaaagtgtgttttgtttcagtcctcctcctccctttttttctttcttttttctttttttttgcaacaaaatctcaaaccttgaattctgactctacacatggtcaagaagttaattagttcacccctcaggttcctcatctataaaatgaaaataatattgggtagagtagtcatgaggcttcagtggaacaattcatgtaaaccacttgtagggcttggcccatagtaacatgctcattagagattaactggtattatttcttgtcccttcatcttttcatcaaacccattcggtagtaccacagtgctgcatgaactgaaaattcatacagggtagattgatgccactgtttcactgtttgtcgcatcacagacctgtggtcaacccttcacactgcccagcagtttcactctttttctttagtcagcttgctccagcagttatttctcttcagacctccatctctcccttgggtttcctcccttgtagtaaatgatcttactttctatttctcagagaaaagagaaagcatcaggtaggaactatgctcattttttgccgctaaatctagaactttacttgtattttctccccttttatgtttttctttttccctcctcttttagtggagggtggtgtcctcttctgtcaggccacatctcaacctgtgctatgggtcaatccctttctaccttgtcatgaaccttaagtattttagggttctacctttcatattggatcttactcaaccagcattaaacatgttcaagccactcactcaatcctcagaatacaattctgttaaattctctggtgaacccctgcactgtctcccaggatctgtcgtgtgtcattcataactaaatgtgttgtaagaaatgttgacatttgccatcttccttttctcatctttcatacactttgaatacattacagttaagcttctacctcaactattatgttaagttttgcccttactagtatcaccatggtatcttttcatctcagaatagagagactgctaatccccattctccttgatttttttttttttttaagcagcatttgccacagttggtcattccttcgttcttctaacatgtttccttgatttctgtaacaaagaactctctttgtatgcctcctacctaccttcttactgtttcttagcctctcctcctccttcaatgactactaactgcccccaccatccccccttaaatagaggcattcttggggtttagtcctagttgttcttctcatggtacactctcttcaccttatgtagcttcatgtgcctctgtgcagatgattcccaaattgtgtctctagcttcatttcctgagattcagactcatatatgcatttgtctagttaatggagccttcattctctgaagtacttcaaacttggcatgtccaaatgagctcataatcactatcattcagttgataatcactatcatactgaaacctgagaattattcttataagttctttttttctccctacatcatctgttgctagactctccagttttctctttattgtctgttactcaacatcaaaccaccttcatttctctcttgaaatattcagtgttgctagtcttacagtgttcactgggcacttctctgttttccatattgctcccaggattactattttaaagccaaatctgatcatgtcactgccctgttgaaatccttatctctcatcttggaattcttttacatatcttctgtctggaaatgtttctagaattttttttttctttaatgtcacttgctctacttattctttatgtcttaccttatatttctggtaagctttccctgacccacgtactccccactggctgcagttgctctcattgtacctagtactattcctttgcaacatttatcacagtcattaaccaactattcagtgtgtagtttgcccactggagtgtatgaggatggaaactgtttgtgtactattatgtctttaatacctaccacagctccttgtacaaactaggcacttacatatatctttaatgagttggtgcagagttatatagtatgtttttttttttaaataaactacactttttaaaaatgcttattaaaaatatgctattttaggccaggcacagtggctcacccctgtaattccagtacttggggaggcctaggtgggtggattacttgaggccaggaatttgagaccagcctggccagtgtggtgaaaccccatctctactaaaaacacaaaaaatttgctaggtgtggtggtgcgtgcctatgatgccagctactcggaggctgaggcaggagaattgcttgaacttgggaggcagaggttgcaggaagccaagatcatgccactgcactctagcctggatgacagagtaagactcttatctcaaaaaaaaaaaaaaaaggctattttaggttcaaaaagaaagtgttgataccttcatgttctacaagataaattttttaaattttcatatccttcatttacttacattgcctttttatgtgtagtgttctaggcttaattaaaatctacttaaaagtacatttttatggggtttttttgtttgtttggttttgttttttgagacagggtcttgctctgtcgcccaggctggagtccagtggtgctgtctttgctcactgcagcctccgcctcctgggttgaagtgatcctcctgcctcagcctcctgagtagttaggactacaggtgcatgccaccacacctggctaatttttgtatttttggtagagatggggtttcaccatgttggccaggctggtctcgaactcctgacctcaagtgatccacctgccttggccttctaaagtgctgggattatagacgtgagccaccacgcttacactggactgagagacatttgcttgtgaatcaaaattcaaatatgttcatatactatggttacaaaggcaagaaataagtagattttctaaaatttttccaacaggagctgaaatgctaagagctaaatattcagtttaccataaaaatctaagctctgggaggccattgctgagcattnnnnnnnnnnnnnnnnnnnnaggcgtgagccaccatgccgacctgaaatccatatgacttctttcaaaaagctttctgctaaataaatctggtctgaatggagggagacaagtaggcatggttgatctctgtgagaagtgaagagaggaaagacattgcaggggtaacaagtagataccaaattagagctcttcaagctcaaggctgttagtttgctcttgtgagtgtcctttagtttttttttaattaaaaagatttttttaaatcacagacaaggactcattctgtcacacagactggagtgcaatggcaccatcacagttcactgcatccttaatctccagggctcaagtgatcctcctaattcagcttctggagtagctgggactacaagtgtgagccaccatgccctgctaaccttcgttttgtttttttaagagacagggtcttaccatgctgcccaggctagtctcaaactcctgggctcaagtgatctacccgcctcagcctcccaaagtgttgggcttacaggcatgagccactgtgcccaaccaaaagtgcattttaaaattaaggtaaaatttaatgtatgttgaaatgaactaaagtgtacaaaatgatttttgacaaacatatgcacctctctaaccgatacctcatttaagataaaatatgcttttaatttttcagaaatcaaaaaagtttttctctgtggacatctccacttttttttttgtaagacttttaccctcaacctagactcttaggttatattaccaactatgcaggtttcttgtggttactggctctaactattgggatttcagatcttaggcccagagcaggaggagagaagaaacttcactgtctgcccacctactacctaatcagctagctgacttttgtttttgtttttgttttgttttgttttgtttttttgagacggagtctcactctgttgcccaggctggagtgcagtggcgcgatcttggctcactgcaagctctgccttccgggttcacgccattctcctgcctcagcctcctgagtagttgggactacaggcgcctgccaccacgcccggctaatttttttgtatttttactggagacggggtttcactgtgttagccatcatggtctcgatctcctgacctcgtgatctgcccgccttggcctcccaaagtgctagaattacaggtgtgagccacaggcccggcctagctgacttttactcttaacaaggaggtgtctgtgtctaaaatgttatgcattaaactatgggacacactgcctcttgaaaatgtgaataaagtcacaggttacatggaggtaacgattgttcaaaatttgtcccacataactttgttgtttggcaggttcggtgttgcaaaaatcaactctacatctctcttgatggaacatgtggcctctagtttctgccactccaccccttcctaatgcttgagacttgcattacctgtttggctcctgaaagcattaagagtttgtaatccctgctttacttacatacgttaatttgattcattcttttttttttctttttgagagggagtctcggagtacagtggcacgatctcagctcactgcaagctccgcctcccgggttcatgccattctcctgcctcagcctcccaagtagctgggactacaggcacccaccaccacacccggctaatttttttttttttttttgtatttttagtagagatggggtttcaccgtgttagccaggatggtctcaatctcctgacctcgtgatctgcctacctcggcctcccaaagtactgggattacaggcgtgagccaccacacccagccgattcattcttttattaaagaaataactccatgtttagcttataagatagtttggtactggttaatatgtttcactttcagttttaaattattcaaatgattaatgattgggaaaagatttgacattacagaaaatttgttatatacgttatattacagcctgaattattgatacaatccataagtatttattaatatttggttcatttttctctttcaagctatgaaaatgaatataatgttaagggaaaattatagatagtattccatagactactcaagcaattacagttaatgtcaaagggaacaaaatgatttcctatcttgatcttctgttaagaaggctaatagaagaattgctgtgcaaaactttatggagaatttcaaaggtatttttgtgtttcttcttgaatttgtatttccagtcattttcacaaacagcaaaggtattctgaaaggtattctgcaaatacctttgcagcaaaggtatttgcagcaaaggtgttctgcaaattattctgaaaggagattagagggaataaattcaaaggaatggggagagagtaacccaagaaaggagggtcactgcttctttgagctatttggaaagtcatcaaggatgggtaaagagatgaagtggtgtgtaaaaataactttatgaagaggagagaagctgagaaactctcttttggtattctagtctccttagtaaggtagaaggtaggaccatcagtttagggtgacagaagcatgtgagttgttgagcccttaaggagtgtggtaggctactccccagccccctaatcccgaaatatgtccatgactaatcattgaaacctgggaatattgcctttatatggcaaaagggactttgcagatgtgattatgttatggatttttagatgagattatcctgggctgttcccctgggcctgatgtaatcatactggttcttaccagagagatgaaagagtcagtcagagaaaaaaggcgatatgattgtagaaacagactggagtgatggactttgaaaatggaggcgggggcactagtcaaagaagacagatggcccctagaaaagcaaggaaatgggtgctcctgagagcctccataaggagccagccctgccaacatctttgctttagcctgctgaaactgatttcagttttctgaattctagaatataagagaatagataaaccacaaatttgtggtaatttttacagcagcaataagaaactaatacaaggaaaaaaaatggaatgctcactgtgctgtgatcaactaggtgtaaataaatggattatctatagttgtgaggggataatttaggtgagttggcacaaattttgtatagtggagccagttagagtttgacctttttccagggtacttagcctcagagaagagtgttcaaaataaggaaaacccactgatagaattttccctcttgggtgtgggggagaattctaagatagtagcgtttttgaaatggttgctgtgggtctgtgctgttaaaggaagcaagtgaatctcatatggtccatgaaatagaagtattacgtatttgggatcagcagacctagagatctagtgagaatgagaaacgggatcgttcaagtgtaacaaagtaggagaggtgggaagaaaaagatgatcttcaatgccagagttatttgatgtcttctaatgatgaggttcaaggtttgcttatatcaatgtgtggctggagggaatcttgataaaatgcaagattaaaatttaggcatctttaaggagtgtgtcagattgctcattagtgtgaacgttgtagtgcaaatgttgctcatggtgtgaaccaaaggtaataggtggcaaggagcagagtttagatgaatactatacgctatttgctaaagctaccgtggagaatttgtgtgcctttttggaggccagaagataggataagaacatagagatgatggagtctgtgggtctgtgttttctcatgtacattttgatgattttagctctttaaaaagtttgttcacaatattctaggttgcacatttagagaattttgaaaataactatattctggaaaagcacagatagattaagaattttcctggcaccttctctgctttcagaatgatgtactagaagaaacaggatgcagtgacttttgggctatacctcttcaacattttgactgactttgcttttgtaagaaaggtctttttaagacaggctttccccatttgtgctctaatttttatagctatgactgaccagtatccagtaccccggcatctttttatagttagaagtcacatactaggccttatgtcaaggaaaccagggcatcatgaaatactgtaaaggttaagaatgtgcctgataataagggtttcttccttccttaaattcctgctgctttttaattttatttttcttgctacttaaaaatgttatttaatatttttcagcccctatctgaaacagattaatagaacagtaaacttttttttttttttttggagacttagtcttgctctgtcgcccaggttggagaatgataaacttgatcgctgtgccttgtgaactgttttctgggtatatgcagtgatgattttagcagtccatgacattaagtttaggaaggcaagtattcagtgtttacactgcctaacatgaagtagaccctgtggtcagaaatagagcacattatttgtttttcttttctttttttttttttttttttttttttgagacggagtctccctctgtcgcccaggctggagtgcagtggtgcaatctcagctcactgcagccttcgcctcctgggttcaagcgattcttctgcctcagcctcccgagtagctgggattacaggcgcccaccaccacgtccagctaattttttgtatttttcttaaagacgggattcaccacgttggccagactggtctcgaactttcgacctcaggtgatccacctgccttggccttccaaagtgctggaattacaggcatgagccacagcgcccagcccggaaatacatcacatcttgatagagtaaagggaatgaacttgtatacataaagtggactctgacaatgtatgtgggaagtttggagtagtgagaagaatgtttaatgtgaattaagaaactagttcctgctttgtcattaatttgctcaagttatttaccctctcaagactcttgttttcttatctgtaaaattattggacaagagatctgattcttatcttttgggagtcatagatcctttggaaaatggtcatatttcacgaactctctcctggaagaggcaggcatgtgtgcatgcacataccatagaacacatactttgtgcagtttcaaggggtttatgggtgcctgaaacctatctatggaatctgtaaggatatgttgattagattattttaaatgttagagcccttttagctcttaagttttataccatcttaaaactgaaagtgaacagctagatgtagtgtctgaggaattatgataatgaaggaagaaaacagagtagattaagttgatcacagtttctttaggaactcttcaagtaggttaatataagccttccttggctgagtctccccaacactgctactcaaaagagcaaataatacttttacctttggtgcgtgccaggcactgtttaagcactttatgtatgtttatttaatcctaacaatattattatcttatcattatttttgttatttttaagcaatactttaggagatcaataaaacaaaaaaatttattgtgtttctttgaaggtaaatgtttttccaaatacataacaacagatatcatttattacatacctgtatcactgtgccacatgttttaaatacttgaccttaaagttgaatgttatctccatttttgtgaatggaaaactgaggttagaaagattaagaatgaggttagagagattaacctgccaaaatcatacatttactgaataactggagtagaatattggatttaagcctttgaatttgcagtgtttgatttttgattcaaatttgaatttagaagttgattctaaagctcatggtcttcaccactgtgctctatcaatcacctcagtgcaaaagaattacattaattgactgtttagtagagtttatgataaacccagaattttaaggtgtatcacttgttccatatattgaagcatttagtttgtttacatttaaaataattactgatacatttgggtttaaatttactgtcctattttttttttctgtctcatctgttctttattactttcctcagctttttttttttgctttctttagattaataagtgtattttattacccccacccccattagcttattatttacatgttattttagtagttaccttagagattatatgcattagattagttttttgttttgttacttaccactttctgggtagggcaaaggtcttagaacattttgacttcttggggtttttcccctttggtttttatacttttgatcctgggttgtttttgttttgttttgtgggggaaacgggcaagcatggtgttttaaaatttgaattccagtattgtttgtgaaaaattgtggaggccctgcatgataccttcctccaaagtaaatttaattttgttccggcaggcaggtaaagtacagtcagatcaccgtgatctagttgaggctagcttttagttagtgttggtctgttaacagtttgcctttatttccaggacatacctattcacagagcatagttcctctggggtctgaactgaaagaaagcctgaggtgtttgccaggttgccttctgaattaatgttcctagaattctaacagttgtctcttcagcacagatcttcagcctccctttgatagtttctgtttggattcttggtgtcatcaccccttgcttagggtgctgtatcagtaaacatctcagtgaaaaatttcttgcagaaattgcggctctttgtgtttctctcctcttcagaaccttgacatcttaagtcctagctgcttggtaaccaactccacttttgtctttctggttgggctcttatttccagtcctccaaagacagcaagtgactgaagggaaccagtgaaggctggtatggggctcctctcagtatgtttgccttttctccggaatcttggccctacaagtctaggttgcctttgttactcttgatgcttttaaacactgggggtttttggtttgtttttttaattgtggtcaaatacatataaaatttaccatcttacccttaagtgtgcagttcagagctattaagtgtacgttcacattgttgtacagagctgtcaccaccatcctctccagaattcttttcatcttgcaaaactgaaattctgtactcactaaacagtaactttccattttcccctccaccaagcctctgccagctaccattctaccttctctgtttatgatttgatcactcattacctcatgtaagtggaatcataaggtgtttgtccctttgtcactggcatatttcacttagcatgtccttaaggttcatcgtattacggcatatgtgagagtttacttcctttctaaggctgcataataccgcattctatgtgtagaccacattttgtttatctgttcatctgttgatggacacttgagttgttttcaccttttggctactgtgaataatgttgctgtgaacacgaatgtacaaatacctcttcaagatgtgctttcatttcttttgggtgtatacccagaagtggaattagtggatcctatgttaattgtttttgtaatttttgaggaactgctatattgctttccacagcagctatactatcttaggtttccaccaacagtgcacgagagctctaatttttccacattcttgtcaaaacttgttattttgtgttttgtgttttttttttttatagtaactcttctaatgggtatgaggtggtagttttttattttcatccagcttttatagttgttcttccaggggcgttggtcttacaaaagcttttctttcagtactaaaggtggaataacattttgaggtagatgttattttacagatgaggcaactgagacagatactaaggtcacacctagtaaatggcagacaagactgaaacagaggctatttggttcttgaatcagtgctcttaaccactgaattgtattgcttctctaatacaggtcttctttcctgaaagatagtcttataaattcattgctctaagacctcaaagtgtgattaactgttttttttccctctgacctctagattattaaatttgaagtagagaacagtgtttttattttatgatttattgcagtttacacaactttagagaaacatgggtttgatttgtccaatatcttggtagacaattcttaaatggaaattatttttaaataaaaaattttcacaactgtgtttttcttgttaaaatttttcagacccctgagaaggattttttttttttttttttttgagacggtgtctcacgctgtcacccaggctggagtgcagtggcaggatcttgactcactgcaagctccgcctcccgggttcataccattctcctgcctcagcctcccaagtagctgggctacaggctcccgccaccacgcctggctaatttttttgtattttttagtagagatggggtttcactgtgttagccaggatggtctcgatctcctgacctcatgatctgcccgcctcggcctcccaagaaagattttaagaaaatttttactgtggtggaaactctgagctttttagtagtggctaagtccaccaggttttttgacaccatatcatatgcttctctaccaaatttatcagtaatatttttatatctagaaatgtttatctgtacaatttactaattcatatgttactggtgctgttttagaagtgtagtcagttactggtatcatggaaagtattgagaaagttctttaaacttcgatctaattataattagactttttttcccccactatgattctgcagtagaaactttttactacttttctgctcatttaaaatttttctatttctgtcttcattgtgttaaacctttttaaatctgtatttatttcatgatttgaaagtgaactctgaaaatattttattacttgttaatagaggattaccttagtgattaaatttggtaaggcaagttctaacatgttctgacagacttgtcatagagttatttgcctctttttttttttttttaattttaaatgtgagtttaacttttcagggtttatctctagcttactagcagaataagtatttaatatttataaagatttttttaaccctgtttacatttgtcttttcgtattctcttttacagtagtagacaaaaacagttacagatgttcttagtatgaggataagaaactgaaagaagaactatttaagagtttgattaaccagcttgacagttagcttaaaagaccaactttcacagcaattcacacattgttaaaccttttttttttttcctaaataaatagctactgctggccatatgtgggaccaggcagaggatagatgaataagtactaataaataactatccttggtctattaggagtagtagtaaaagtactgaactactttgagaggccgaggcgggtcaggagttagagaccagcctggcccaacatggtgaaaccccaactctactgaaaatacaaaaattagccgggcatggtggcacatacctgtaatcccagctactagcggggctgaggcaggaggatcacttgaacctgggaggcggaagttgcagtgaaccgagatcgtgccactgcactccagcctgggcaacagagcgagactctgtctcaaaaaaaaaaaaaaagaagtatgaaactactggactttaaagcaaacatgttattaaaagctcccttaaactttgtaatagaaccagaggacttttgtatttatatttatactaagctttcagagttgaatgtgacccaaaggttagttttagaatttgttctcaaacacctgtttactcatagttacaaatgaaacattagataggaatgataaaataacaatttttaagttgtttctttccttgggtgcaccattgattttgcctagaacccatttatcctagcttgcttttctgtaacataatgactattaaaaatatttactaaactttttcttgcaggtaaattaagtagtaagagttaagttgttttttggacttaattttcacatttgtttttattttaactttttatttgatttgtttgtaatgccactccctgagtaatgaaactatttagcgcactttaagagacaccccttgactttgcataggtttagcttcaataggaactgtatttttgcattgtgtgtcttgacacctttgagcatacttttatgtgctgaatttgatttcttatacatcatttaactatttagatatgttggtagggtgaagaggaaaaggcacatctttgccaagatggtggaagtagtaatatctgtggtcttgtagggccaagcattttgtttgttggtgtcctcgtgtcttctgggcatgcaaagagccctaggtcttgagtaagcatttgcaggagttttccatggaggtcacctggttgagctttccttttcttgtggcttagaaagactccatctctctccagtccaactcctggagacctgcctgtcctagttgatgttttaaaactggtggtgcttttgtatttttttatccagcctttatagttgttggcagggaagttggtcttaaaagctatttattttcaggactagaagtggaaatgagtggaatagcattgtgagatagatgttatgttacaaatgaagtgcttatgttacaaatgaagttggtttatcaagcttactgtatggatgaagtcagatgcagaaccagctgtgaaaaggggggcatgaggtgggtccccaccattggctcctgtctctcaccacaggtccacctagcttgtgaaagtttttgctcattgcaggcctgcttggccaaggaatagcaacccttgagagagaactgtaaatagagatttaaaatgtggtttatctctgtggtgatgaaactcacatccctttatgtaaacataatgcttgactcacattaggctttcgaacatgtttttcagaacattttatatttaaaatgcctgtttttggctttaaaaaggcaagtagaaaaagccaccaactttctatctctgctaaggtctctttagtagataagtgactaatgtcaaactcatactacattttggtcactacattttggtcaaagcctgggattaagacattttaaaatcagtctttaattttttttttttctcttttggaatgatttttaaaatcttgttcatactttgagtttgctagttagaggtaaccggagctgggacttttaaaaaatcttaaaaaatagacacataaaaattaaaacctcacaagaatttaaatgatattagaatcatatcatgtgcatatcacaagtttactgtgaatatatgtgtgcatttctgtttaacatatgcacacaaatactcaagggttatgcatctgtacccttaattgtacttgatggtaattaatcatacatgtcagacatttaatataaatgattatttagtattactattaatagttttatagagccacacttaagtttctgtgtttcttctccatttattagctcttttttatctataatgaaattttagggttatcaagtttttcttaatattatatgtcatttaattatcatcacacatcttgacagtctcaagttgaaagacaaaggcttagctcttacaccacagtaacccatggctttaaacattctgtgttctgcctacaccttccagcttcaggttgattttgtctcttacccgaaatgcttgtgaccataagtgttttcagattttgcattttggggggattttggaatatttgcatatacataatgagagattgtggggatggaacccatgtgctaaacataaaattcatttatgttttatatacaccttatatacatagcccaaaggtaattttgtacaatattttaagtaatttgtacatgaaataaagttttggctgcaacccgatgcatgaggtcagttgtggaatttacttgtggcatcatgttgatgctcagagtttcagagtttggagaattttagatgtcagatttttggattggggtgctccaaactatgtattctgatcacatgccttggcttcctttactgaagcatcattttcctctatacacagcattcctgaagaattcatcagttctgactgatgtctttctgcctttttgccagagggcttaagatagcagacattgtaggccataaggtaatagatttacctcctttagtagcgataccatcactatgcttaaagttgggacaggggaaatccaagccatgggagaccgatagcaaatagaaggggaagaagtagtgaagtgtacatttatttgatcctgcatgtatattattttttggtgagaggattttcataggaaatgatattaatgttttagagattatctttaccagccatttgttttactgagggccacaatgaataagtgacttaaggtcacatagccagttaacagtagagccaggatcatataaagaattcctaacttcacatcaaatattattcttactattagaggttttttattaaaaaatttaccataagtgatagatcccccttagaaaagtttgataatttccatacagcccagtaattcctctcttagaatccacccaagaaaaatgaaagcatatgtccacaaaaatattgtacccaaatgtttatagccaccttatttgtaatagacaaaaaatggaaacaacccaaagtatccatcagcttatagataagcaaaatgtggtgtatccatgcaatggagtgctgtttagccctaaacagaaggaaatactgttgtatgttacaacattaataaaccttacaaactttatgcttaatgaaggaaatcagacaccaaagattacatattacaggataattatatgaaatgaccacaaaaggaaatttacagagactgaaagcagaagtgaacaaaggacttgtcagaattgccagtactttctattctagctgcaaatcccgataaaaggttctctcactactgttaggctacttttccagtataatcttccatattcttcacttaccagttgaactttgtgcttattgaagttctgttgtatttttcaaacctgtgtattcgaattgtacttattattaatatataattaatattgtgtaaattgataaaatcttgtgaaaaaaataaaattttttatttggcaagctagattggatgctttggaaagacttcataaaagcaaatggctacatactggtttgaattaagtgtaggtaatttaagacattagagtgaaaatagtaaaaaaaaatctagaaggattttacattcagattacttcacaaatgcctctagttcatgcttcaccttaatgaaactgagctaggaatgctagacaatttattatgtatgagtgtttataagtacactatttgttttctttttgaaatggggtcttgctgtgtcatccaggctggagtacaggggctggctcattgcagcctctgtctactgggttgaactgattgttctgcctcagcctcccgagtagctgggactacaggcgcgcaccaacatgcctggccaatttttgtatttttagtagagacagggtttcaccatattggccaggctggtctcaaactcctgacctcaagtgatccgactgcttcggcctcccaaagtgctgggattacaggcgtgagccaccgcacctggcctgtatgtatacaatattgagcttcagtcacaggactcattttcaaagaaagtcctgatgtctgaatgaacgtttatatttttaaattaaaatgttcaggatgcaaatgtgtgtatatgtttaatagtttccctgttttactacctgtctttagccattcagatagtgtttttgatcacattggttaaaaggtattctcctgtctctggtgcttttctgtacaatatatacttatatgtagaacttagaaaaatcaaatgtgtaaaatagtttaagcaataatagtgattatttttataataaaagggattcttgttggtttttgaattattaaatttatgctagtttttattatgtacatattgttctgtgctgagaagtaaaacacgattagttatgacagtaggaaaaggttgggcctggaggtcatgtgagatgaaagaggaggtttacaggcggtggctcacacctgtaatcccagcactttgggaggccgaggtgggtggatcacgaggttaggagatggagaccatcctggcccacatggtgaaaccccgtctctactaaaaatacaaaaattagccaggcatggtggcgggtgcctgtaatcccagctacttgggcggctgaggcaggagaatcacttgaacctgggaggtagagattgcagtgagccgagatcgcaccactgcactccagcctggtgatagagtgagacttcctctcaaaaaaaacaaaaaacaaaaaacagtgttagccatcaaaagcaaggagggaggctgggctcagaggctcgcgcctgtaatcccagcattttgggaggccaaggcgggcagatcacaaggtcaagagatcgagaccatcctggccaacatggtgaaaccctgtctctactaaacatacaaaaattagctgggtgtggtggcaggcgcctgtagtcccaggtactcacgaggctgaggcaggagaatcgcttaaactcgggaggcagagttcacagtgagccaaggtcacgccactgcactccagcctggtgacagagcgacaccccatatcaaaaaaaaaaaaaaaagcaaacaaaaaaggagggacgtggtcagagggaaacttggaatttaagatcttgaggatggaagtgtgaagtccaagaagttcaaagtcatcaataagcattttgaactcatcaaaattgatgttaagatttcaaaaatgtgatgtgagcttgtgctgagattatatagaatgtagaaatgtgagcactgaagaagataatataaaaaatagctttccttgttattaggtgttaaaccatcatacaagatgaatgaaaggagaaggttggaggaatgatgtcatatgaagcaagaactgcacgtggagaatttaattaaaattgtttggggccgggcatggtggctcacgcctgtaatcccagcactttgggaggccaaggtgggcagatcacttgaggtcaggactttcgagaccaggccaactgatgaaaccccgtctccacaaaaaaataaaaagattagccaggcatgatggtatatgcctgtaatgtcaactactcagaaggctgaggcagaattgctggaacccaggaggaagaggttgcagtgagccgagatggcaccactgtactccagcccagacaacagagtgaatgagactccatctcaaaaaaaaaaaaaaagtttggaaagttgattagtattattctggttacattgttaatgtggtagagctctgttcatgttcaccttatcgttagctataacctgtagattcatgttcaagaatctggtgaaagatatgggctttctttccaaagtacttaagcgtgaacaaacatataacttaataattttagaaggctcacagacccaccaaagcccagagagatccttgctgagacgagaaaggaattacattactaatccttctgtgcattacaaaaaacagtagttttatttcagtgtattttgctatcaatatggattttcaaggaatgcacaacacttctggattatctgtgctctataaactgagatatctgtaatcatgttggtaagaacttgaaagtaataatctgtttgaagtgacagtaagtagaggtgttttaattatgtaatacttaatgctgctctattttatgcattaaagccttttaaatatttatcagtaacaatcaatctaagttgtataaatccgtactttattcaactctcagttttacttcaaagaatatgatcttcaactacagtatttaagaacgaaccatgtttgagtatgctgtagctttggggagaaagtgtgctaccttactatttacctttttttactctgtttttttcttcctggctatgatgcttactttttaccctttttctttaggtaaatgggccaccatttatagccattgtcaattgtaaaaacttaactttatataacttgagaggtgctggaaagttgcacattgcttaagatcatttgaagtgtttctcacctgaaaaatgattgcttttggaattttatttcctttatttgttattgtagcacacaataattattatgctcacaagaactgtactcatatttatatgactttaactgtaggaccgtgtgtatgtacaacaaaataatgtggagaacgtctacaatttgggattaattatttttcgagatcaagttgtacgttatgggtgtattagggatcatctacggcaaactctattggatatgattgcaagagagcggaaaggagaagtcgtagacaggtaaaatttctctctttactcttgtggttttggttttagtgattatatcttgagaacgattcactgtcttagttttattaaaataaataaaagtttgaatgttgagcacattgggaaaatcctcagaaacttagtatcagagttaacagttacccaaaatttaatttgaaagcacacatcttttatatttttagaagagactatcctaagcttttatttaatatgcttttcagctagccgtcacttttggcttttcatttatttttcatgccagcatttttttctttttttctgtgtaataacatttgtatttttttttctttaagggcttttgtctgtccttcattcctaacatttttgaagaaaactattgaacatagtctaaaatgactaagaactcctgtgccccttttaagtcagatttcatcccccttcataacaatgattgcagtgtcattttggtgatgctgcagctaaagtggcttgaaatgcatgattttttttctctccttatctgttttcagaacagctgttggatgaaaacgtgtaaagttctttttatttcgtctttggtgcttgatcagcattgtccaaaatccatgtagtgcaaaaagttatattgcccaggagtagctgtatattggacccatgtctggcagtacagcttaatctgcctatctccctctctcccttcttccagataaacagcctctctgtgttttcaaatacatagaaatatttagacattttagagtaagaacaccttgagagaaatagctgtgcagtcaagatatgctttccaacttaaaattaggctaaatcctttgttttacatgagtggcctattggagattggtcacttcagtaagagttaaatgtcctgaagatatttttacctactcctttttgtaatttttatgtgaatttttaaatgtaatttaattatcaagtgataataacttttttcgacagaggcgcaataagaaatgcttgccagatgttaatgattttaggtctcgaaggaagatcagtctatgaagaagattttgaggctccttttttggaaatgtctgcagaattttttcaggtaatccgtgaaaatgtaaataaataatcttttaagatgttcttaatgttatttaatatagttactaatttaactattttgaccttttttaactgagacccattaagggaggggagtatgcaaaaaatgcccatcagcacactacctcacattctgaccattccagttaagcaactcatcgataacaaattgaagaggttgaacttacacacatggtttttaaaataacagagatgacccttgaacagtgtggggcatagggatgctgacgcccctgtgtagtcaaaagtccacataaaacttttgactccccaaaaacttaactaatagtgtgctattgactgaaaaccttacagataacataaacagttgattagcatatattttgtatatgtattgcatattgtactcttacaataaagtaagctagagaaaagaaagtgttattaacaccattacacggaagataaactgtaatttactgttcactaagtggaagtggatcatcagggtcttcatcctcgccttcatattgagtaggctgaggaggagtaagaagaaggagggcttgatcttgctgtctaaggtggtaggggaggaagaaaatccacttcatggacctgtgcagttcaaccttgtgttgttcaagggtcaactgtatgttatgaaactgtaaacttagaaatatccttaactttttactatatctaatattataaattatttaagtactataaattcacagcagtacatcaccaacgaagtctcatctgcaggcttttagtcacttaaattactagtaaaacacacataaggatatggatgattctgtagtgcatatttgcctaaaggttgttgattaaaatattacaggccaatggtactattgatagaaattggcaacagtggtccaaaccaactaaattgctaaaagtaaagctaaactggtactaatctgtaatgaaatgatgataacaacaataattgagtactagtaaacataagatagtagttataaggtaactgtaacaaggcatttttcctgaaaaccgtaactacctgagcagttaacagtaggaattttgtagtgttgccaaaacagatgtattcgtaggaagctaaagtgttggccgggcacagtggctcacgcctgtaatcccagcactttgggaggctgagacgagtggatcactatatcaggagattgagaccatcctggctaacacggtgaaaccccatttctactaaaaatacaaaaaaattagccgggcgtggtggcgggcgcctgtagtcccagctactcgggaggctgaggcaggagaatggtgtggacccgggaggtggagcttgcagtgagctgagatcgcgccactgcactctagcctgggtgacagagcgagactctgtctcaaaaaaaaaaagaaaaaaaagatgaatagttatttaaaagctcttattttcaaactttagtgtacatgtttactctttgagactgggagtgggatggcactggaagacttaattaaccagcagtatgccagcaaagcttatgataaacatgatgaatctttctggttataattttactttaaaacaaatcaaaaaagaatgtcccactgtatcttggagtcagatgcttctaagcttttgaccctcactggcgtgtatatacttgttctgctattttttggagtacattggcacagtttgaaaaacattgcttacagataatgttttaatttagtattatgtaaataccaaaggctttaaaggatataattcagactatatcagtctttcgtgtaatgagaaattacacaaaatgctaatagtacttattttatttaggctgatttattataaacactgtagaaacccagctaaaagcaaaaacactcttttcttctatgtttaaaaaatatatatatttttaaatggcagatggaaagccagaaatttttagcagaaaatagtgcttcagtatatataaagaaagtagaagctagaattaatgaagaaatagaacgagtgatgcactgccttgacaaatcaacggaagaaccaattgtaaaggtggttgaaagggaactcatttccaagcacatgaagactatagtagaaatggagaattctgggctagtacatatgttgaaaaatggaaagacagaaggtaagtgttaccgattgaaaaataattaaatccttactctgccttatcgatatttttaaaattttcctacaattaaagcagataatatcagctttcaagaagttttggtgtgtattgttaatttgtctccattgttaactttaatgggatttccaagcttgattctgtcttactaacgaagattttagatatttctaatgaattgagcatttcctgtctttaagtctcattttacatttaatccagaagataaaaggtgtaatagtattggtgagcccagtgagctcctcattcattcctgtacttcctgtataccaaagggtgtgggctctctttagtcctacatactctcttggggttttgtgattctcttaaaaccttaagtttccaccttaagatttttgtagactttcctttgggatttagttgtgacagggtgctgaaaatgcaaaaatatttgtgtcttccatattgacatacttagataaattagattggtttggggaacactgaagttacagaatggaaaaggaggaaggaggagtgcataaaagtaaagaacatttttgagataactaacatttgttttttatagctatttattttcctggggtaaaagaaaaattgtgacaagtatcctagaagaaattacaagttaaaagaacaataaccatatcctctattcttagtttctgatgctttgttttaaaactttgcctttaccacttatatggtattaggaaataaaaaacatggtactttgttctcctgcttcctagacgaaatctaagcaatattttatccacttctttttagtaaaagaaatacatattgcctgttggggtcatgagctatgtagggaatgaaaaaattttttaaaggagaattataaagagaaggaggatacaagagaaaggaaaacgaaagctggtgggaagttgagccatgtttatctctagtggaatccttaccttgtgttttaaaattgttaaatgtttgtatatatgagaaatccctgaaaagttatatgtaatttaaaaaaacaaaaaaaaaacaaaaaaaactagagaggcttcctttttaaaagactcttcagttaaaccttttttgtaaaagccaaaaaaaaaaaaaaaacagaagtcatctagtatatttgctgtgttttctaaaattgaggtccaagtcaggggttggcaagcttttttgttgttgaataaaatggcttgtgagccacgcagtcatagtgagaaaatagtcctagacaataacaaatgaataatcctgtgtttctataagactttatttatgggccctgaaacttgaatttcatataatttttatgtgtcactaaatagcattctttacagtttttcctcagccattaaaaatgtgaaaaccatccttagttcatgagctgtacataaatagatggcaggctgtatttgccccacgggttctaattcgatgacccttctctaagtggtctctggtagactgggactttatgcaaagcatttgccctgcttaaacaaaatgagtattgataaattatgtaatgtactgtttaggtattgaatgaatgctttcttacctaccttaggggataggaaatgtttgatggagaggttgttgggcatacctgaattacagcatctctgtaacctgtgtggagatgtatgtaaaaggtgtcaggtatgcctatcatggcgagcacttacgtgaatgaaggaataccataatagtactcaccagagttctcctttatttagtaccttaggtttccaacaacacagtagctatctgtgattctaaattaaattttaaaatcctgcttttgtccaggcagggtggcaaacgcctgtaatctcagtatttttgggaggctgaagcaggtggatcgcttgagctcaggagtttaagaccaacctgggcaaattggtgaaaccctgtctctatgaaaaatacaaaaattagctgggcatgatggcacatgcctagtcccagccacttgggaggttgaggtgagaggatcatttgaatctggctggggaggtcaaggctgcagtgaaccaagatgatgccactgcactccagcctgggctacagagggagatcctgtcttaagaaaaaaaaggtgggggggttaatttttctgagcttccgctagaaacctggtggcaaaatatcctaattgtggtaggccctgctcttggaaaaaatgttgctcttgttgagaatatagcagagccaacttcaccattatgaagccaaattctcataaatcagaaaatgaaaaacagttttctcactgtgaatggaggataaattggattgattattagatgcagatagcactatgaaatgaagttcagaggtatctttttttttttttgagacgaagtcttgctctgtcgcccaggctggagtgcagtggtgggatctcagctcactgcaagctctgcctcccaggttcatgccattctcctgcctcagcctcatgagtagctgggactgcaggctcccgccaccacgcccggctaattttttgtatttttattaaagacaggggggtttcaccgtgttagccagggtggtctcgatatcctgaccttgtgatccgcccgtctcagcctcccaaagtgttgggattacaggcgtgagccaccgtgtctcgccagtatcttattattttattaagtgtatgtagaaataatgatatttaatttttgcatgccaaattattttcatttacttttacattccctttaccccaacatttaaatacaatgaaattgtagtaatttatgtacaactaaatacacaacatgtaatatctaagcaaaacttacaacaacataggattgaaatagacaagttgtgaaccattttgttagaagtatttggtgtgccacatttactgtagtatgtgtccatagattgttgcatttgtaatacctgttctaaatatgggaaacttggttgtaatttatgctaagtatgtgagaagctataaaattgccatgtgtaggttactatgggcatatattattaatggaaactaactaaaatttgctgctgaaagtcactgaaataaagtttagtaaaactttgtaaatcttgctttgaaatattttaaaaatgtatacaactttaagctctaaactactcttagaactgtagaccaaggtaggcaaattagggcctgcctggtgcactaccagttttgttaaaaaaaaaaaaaaatcaagagtatttacacatgaaaatttatataaattttcagggtccatgaagttttatttgaaacatagtcacactgaataatttatgtattatctgtggctactttcttgctacagcgtcagagtagttgagtcagagctctatggctcacattttaaaatatttattatctgatactttacagaaaaaacattggtcagcctctgatctagaaactcttaatgccattttaaaaagttattgattgtaaaacttttaaaattatcattgtaaagttctgacactgtgttctcccagtaagttgttattgcaaagaaacactagacatatgggaaaactgtattttaaaatctgtattttagtcttgtgaaaaatgatattaaaaaatggataggatccagagttttcattctaaatttaaaaagtatagtgagatagaccaaattttgaagtacagatattggcttaggatgctacctgggaaacattagggattgctctcaggaaaatattgaagaagtggtatttatattatacatttcataaaaactttacctgaggtgtaatgaagtaaatcctagtatagttcatttgatttgttttcatgattatcagttaaacctttggaaatacccataagacttaaactggctttaaaatttcttcctcattacagggactaccaattacctcttaattagtgaccctttttgtagacgttttgtagtgtcattaggtctgcattagagttatgtaggataaagtatttatgaactcaaaactgcagttgccatgtttttgtgacattacttgtttattatggtttttgacatctcttccatgtaaatttaaatttgctaggacatttaattgatggtttcaaagcatctcatctaaaagttgtgttttataaattacaataataaccattaactagcctacttcttcatgttttcatatcaatatatgtatatttttaatagtcatgtggtcagcaaatgggggtaatggagaaataagcttctctcagtattatagcgtgaacagagattcgtgtttttttctttaatctttaatgtagccaatttgtgttttctgatttgtagaccttggttgcatgtacaagttatttagtcgtgtgccaaatggtttgaaaacaatgtgtgagtgtatgagttcctatttgagggagcaaggtaaagctcttgtttctgaagaaggagaaggaaagaatcctgttgactatatccaggtaagtaaacccagaagattctctgtgtttatgataaaggcattttgacaagtgctaaaaaggccacttttaccatgctgtgtattgtgtactttcaacttaattgtcccagtagtaaattaatatttgtaattatcctacatattttaggattttgcaaggtgtgcgtatttatatcagggagctaaaattcagctgctacttttcatttaacttctttgatgaagaccttgtttaaatagcctcaatagtgaatgtgaggttctttggtatgccttagtgtttgtatactgtagtatattggaaaaaacaactggtttaagtattttttgtttgaaaatgttttgttttcaaggagtactatgaataaattatgtgccatgttttgtgttttaacataatcagctttttttggtacattttttaagctaatttttttcactggctaacccattccatcaagacaggagaatgagaaacagtgaggaggttctttggttcgtttgcattgtattaatacatatatggaagttataatacttctctcattgacatttttaatagaggcttagatataggcttgaaaataatatcaaaactgtaagtttaaaaatgaatatacatgtttattaccagcaaagttaagataaacatacatggtcataagtgtattatttatggaaaaattattataatgtgtcctaaattttgtttttatttctaagggcttattggatctgaagagtaggttcgatcgcttcctcctggaatcattcaacaatgaccgtctctttaaacaaactattgcgggtgactttgagtattttctcaacctcaactccaggtctcctgaatacctctcattatttattgatgataagctgaaaaagggagtcaaaggggtaagtagtaatgcatttgaaaataacatttaattttatttaaagatataaaattatatgtaaaattaggacatttcacagataaaaattaagcatgacccattgctgtgcttaaatgggtgccatggtctattaaaaaatattgtttgaaatacttgacatgcccaaacgtagttagacatttcacttaatgtgtaattggcttcaaaaacaagcaactggatgggcttggtggctcatgcctataatcccagcatttggggaggccaagacaggaggctctcttgaggccaggagtttgaaattagccttgttaacttagtgagactccatctctacaaaaaaaaagaaaaaagaaaaaaattagtggcacacagtggtatacacctgttgtcccagaagctgaggcagaggatcacttgagctcaggagttcaaggctgcagtgagctgtgatcgcgtgactgcactctatgctgggcgacagagcaagaccttgtctcaaaaaaactgaacaactgtccaggtatggtggctcatgcctgtaatctcagcactttgggaggccgaggtgggcagaccacctgaggttgggagtttgagaccagcctgaccaacttggtgaaaccccatctctactaaaaatacaaaattagctgggcatggtggtggatgcctgtaatcccagctactcaggaggctgaggcaggagaatcacttgaacccaggaggcggaggttgcagtgagccaagatgacgccactgcactccagctggggcaacaatagcgaaactccgtctcaaaaaaaaaaaaaaaactgaacaactacacagctgtagttggtaaacagtcatttttatgactgagagttaggcatgctgaagataaagaactagaaaactttctagtagagagtgttgtttgctctcatctggttctgaaggttatatgtcaaacaataattggatgccaagaatattaaggcatagatagagtagatctcatctcagaaaatggttggtgtagctcaatttcaagcctttgtgatatatgatatctctggaacctgaggagctcacgacagcatagaaaatcaactgaagcataaaacatgctcacatctgaattggtctcttttgacttcattttggaatttgtgacaccaaagggaaaagcaacatgtcgtcacaggttttacaggcagtagctgcaataagggaacaaaatcactaaggttgcacagaatagaaaagtctattaatttatgcattcatttggtcttccgtttttcaaatatattaatacaacctgccacagaatccttttgcccttatttaaaagtaagggcagccaggcacagtggctcacgcttgtaatcccagcactttgggaggcaaaggcggcggatcacctgaggttgggagttcaagaccagcctgaccaatatggaggaaacccatctctactaaaaatacaaaattagccgggtgtggtggtgcatgtctaatcccagctactcgggaggctgaggcaggagaattgcttgaacccgggaagcagaggttgcggtgagccgagatggcgccattgcgctccagcctgggcaacgagtgaaactccgtctcaaaagaaaaaaaaaatagaaataaaaaaataaagtaagggcaatggcctttttactgtttggattataacaaattattgccttttgtttgcacagttgaggctttcagtgagcttaaatgaaaaattccgtcttttggctgtgtaagtttttgcctgcatatgcaaaggcttcataaaataatctctgtgactaaaatttcatttcatctgttctcaatcatcccttaacccagcgctatattaccttatgcctccaattcagtggtagccctctacggaatagaattccactccaacccctcattcatgatgcactaaatgagaatgtaagaatgatgctactgtgtgaagtaggagacactttctcaaaccgtatccctttttttgatgtatgtcaaccagatatctatgttttcaaacaatagtgtttttaagctgtaaatgaaccgtagtactgcttttgtagaactaaaattgtataattgttacatcatcttaattttgcagctaacagaacaagaagtagaaacaatattggataaagcaatggtcctttttaggtttatgcaagaaaaagatgtatttgaacgttattataaacaacacttggcaaggagacttctcacaaataaaagtgtttctgatgactctgaaaaaaacatgatatctaagttaaaggtaaggtgtgttttagatgaaatagagtgcacctaactgaggtttatcatgattgtgtactgacaacgtgattggaaattaatttggtagattattaagtgtttatttctagaaataaaggtagattgttttggagaagaacacagactacactaacatttgttcaagttcagggacattcagagtttgctggaatttctgttggtgtgtcaggatacattcatggaggcctggaagggaggattagtaaaagggaaacaataaagaggctatgctgtgtagttctttttcacaaagtgtggtccatagaatacttgcacgtgaatcacctgagatgctagttaaaaacagttctgggccctgcctttcatgggggtatattggaatctctgaaagaatctgggaatttgcattttaaaatcctaaagtttgataaccacaggcacagagcaactgttggaaaaatttacaggaagattatcagggatagcaataacatgaaataatttatttctttctgtactttctcatagaaacatctaccatttatttgtgtatatttgtgtttttcctccacagactgaatgtggatgtcagttcacgtcaaaactggaaggaatgtttagggatatgagcatctcaaacacaacgatggatgaattcaggcaacatctacaggcaactggtgtaagattctgcgttaatttctacttagatattcatgtaaagtcttttgtaatgggtatattttcatccacttagcagatgacagttgtttctttaaatgtcattagtgacaacatgtgttttatctgtgagtacttaattttccttcacattgcctcttattctgtgtttatgttaaaactttttattcttttaaaatttagttgtttcttcccacttgaaggaatacactgacaatttaataaagagaattattctgttgttaataaagataatacaaatctattataaattgtggaaagagtactgggcttaacacaagtttactgagtttcagtactcttcttttcactttaccccaagattgtgtcatcttgggatagtcacctgaccttcctatacctcactactattattctcctctgtaagtttagcttaaatgggacttacatcctaagggtgcgtagcaggtgaagtgagactataaaaacacagaaattaatgtattataaatgtgtttggtataactccccaaaggtggtgagctggaacttctttagctttggagtctgatgggagttttatgagcatttaatgaaattcagaatttagtttcattttttactctgattttcaacttaaccttaagtttagagaattgtacagtttttaaatttttaaaatcaccgtgtaccactctatggttaaaatgtgtcacaaccatttaacagatttgtgagtcttttcctttggtatctaaatatgagatcatcacttctactggccttatagtctcgcaaaccagatacgtgaaaatacgtaattctgtagaataaccattcatttctatgaaaacattctgactctaatgtaaatagttgtatgatttgctttataaatatcagtgtttacagtggagaagagctgagaggaggaaagatgcaagtccatgacagaaatttcgggtggacaggaaatagtggtgtaattatcctggatttttatttttagattgtttaggaatttatagttaaatctaatatattgatatattttcttgtatttttttgtttgctctagtaagtttttaaatttttttcttccactaatcttacacattgaaagctatagggaagattgggctagatcccatgcatattgatatgggatggatggactgtccactttgtgaccctcccttcccctaaccaacttgcgaatgtataaacagttctccacctcccccagtacaccatctaagagtctcctctatgatcctctcttctgtgcatcatccaagtttattttcagtttccttaaagttaagtaatcatttagtggatacttgtgaagaaatcggagtgtagaatgcttcttgatattcataaactgattcctccccttaaaaatttacattactaaatcattgaggtaagataaaaatggaatgatggtttataacacatcctgaatatcaataatagaaataatatttaatctttaagagtttttgttgtgccttattgttgtttacttaaaaatttaatttgtttaaaggaagaaaataattgtgacagttgatactagcatagaagtagttattcattgtacagatatttgtagagcacctgctctgtagcactggatctatagtgttatagcactggatctgtatgcagaggttgttagaatgtgagctacatgctaaaacgtaaaagttttaattaactgtagttgaaataggtgctggaatattagaaatatgtattaagatagtaaaaatattttaaaactgagacgaaggatattatgctagaattttctctaaaatgatataattgaccccccttgaccttttatttaaaaaggcccaaacttttcagttctcagtgataacagtaagacttgatttatgtgccaaaaactattctttggtcagtgtttttaaattaacataataagcaataattaagctatttgccatgtagttaaaatttgggaaacactgggtgggtctaacctttaaggaaatctgtttttttgccgggtgcgatgtctcacgcctatagtcccagcactttgggaggctgagacgggcagatcatctgaggtcaggagttcgagaccagcctgaccaacatggagaaaccccgtctctactaaaaatacaaaatcagccaggcgtggtgggcatgcctgtaatcccagctactcgggaagctgaggcaggagaatcgtttgaacctgggaggcggaggttgcagtgagccgagatcgtgccattgcattccggcctgggcaacgagcgaaactctgtctcaaaaaaaaaaaaaaaaagaaaagaaaatctgcttttttttaaattagatattagacatggagctaactgctttggtaaatctaacacaatgtctaaacagaacagaaagcaaatcctagttaattttgaggggaatatctctttctgttttacataggtatctttaggtggtgttgatcttacagtccgggtgctcacgacaggatattggcccactcagtcagccacaccaaagtgcaacatcccaccagcaccaagacatgcttttgagatattcagaaggtaaatcaaaatcagactttgtatcactgtgtacaagtaagtgttcaaaattaaaaatgaatttgaacattagtatccgtaattgaggatgaatgtattccatttattacctcgtgatcaaaaggagcatttatcctggcatacagcaatttccccctctataggatcttgatgagtaaagtaaagcaggcataatttatctctagaaagattgtttatatgctggcatttgaaatgccttttatttagagcagcagtaaaaatggaaaaagagaaagtaaatgatgatggaaaactagacccagagaattccttggacttttctgaacacttcagctaactccaattgttggaaatacgtggataccttattcccactagtactcagagtctctgagatggcagttttgatgaggaagaggagcaagatgaaaaaaaaacaagagtgatatgcaagaaaaaaacagagaaagatccaagcaaatattttttttgggctgctgaaaataattggcttatccagtgtggagactgctttgtgaaaagaccactcgtgtgaacactagggatgaagatgagtgtatcacccccttcatcgagcagcctaaggtggacacttagacattgtctgtgagctgattgcacaaggggcagaagtttttgcagtgaccgtagatagctggacacccctgcagggtgcttataagtggaataataccagagtggcttctttatttcttcagcatggtgtagattagttatcagtgaccaaacaaaaggtctcttgacccacttgcatcttgctgctgggatcagagacagcagagctactctagaacatctactggtgaactgttaacctcaaaccagatctgaaaaaacaactgggaagaaactgtatttgatattgccaggaggacaagtatctgtcacgacctctttgaaattgtggaaggcactgtacaaattcttcaccttagtcttaatgattctagtaattgtcttaagtgtccaagtaccagtgccttctttgtgtgagatgtaaaatattcccatagtaaaaggttgacatcaaacatcttactacaaaaaattcattggtacttattaagatgttcttccaggtgaattgcctgaccttgatgtcaaaatgtatttgaaagttgtttgaatatatcttgaatgatttctgtggagtttgtgatttgtatcagaaataatttcgacttgcctacacttaaaaacttgacgtgggttgtacagaaactaaagatatttttggtgctgatccaggagatacgtatttttaaatagcccatatcctggatctttgttgagtattcagcatattgacatgtatctttgtaaggtgaagtaactaagaatttaacttaaaaagcctcgaacattctggtgctattcctgctgtcttctctacattaccatagccagttgctttcattttgaaccagaagcactagcatattattgacttgtagcttcataaattaaaaaaataaaaactagattttgtcttttagaacataggccattttccaggaaagcagctaggttttaatccattaatcttgtatactgtctccaccaccacaattcacataatcctgtagacagtcctgcttcaccctggtcaactgcatgatccttattgtaatagtgaatcagtataacactttagacatgcacacagataacacgctgttgcaagagttcatgatatgtctgctgtccaactagttttatttgcctgatcctactggtttaggcactgcctatagtctcgagttcacagaaatgttgggttttttccctccccaaagtcctcattttttataaactgtagaaaggcaaaatgacaagggaaaaggaattctaagagtgaagggatgattgttatattggggcaagaaccacagagtggctcaggctttggaaaaaatatggtgtggatagtgacaaaaaacataaatataaaaattcaagaaaaactaccagttttgaacaacaaaaacaaagggagagtttatcctttataattttaatatgtaagaaaaaattacataaacttttcccagaggaatattttataaatgtgcattgagtatttttcgtactgtggtataggagtatattttgtactgttgatgtctgctactgacttagaacaaattgattattgggttactatggagaaaggtggtcttaagaacagcaagggctgagcagcagtaggttggggcagagtgtacagtagaaattatttagtgtggggcctttgtcatttaatatctagctgagttacttaggactctctcaaggtcttgcctatagaaagttgaaactgaacttgattcctaaagtttcctttaagttttaaagtccatacacacacacacacacacacaaatgtttaagggatgttatcctgtagtttgtaatttcaaatgtgtaagtttgtttgattttctaaaacctggtttgatttactgaaggttctacttagccaaacacagtggtcgacagctcacactccagcatcatatgggttctgcagatctcaatgccacattttatggaccagttaaaaaggtaaatattgatagtttgaacgtattaagtaacttaaagttagtctattagagctgatgtgtgatttatgttgacctgggtaaattacttacttctgtttctctgcctgtctcacatgttagaaaggttaaaaatcctagctttgatttattacttctgttctctcagttgctaactgcacctttgaaaatatgaagactataccagtatagtcttccctaaggactaaacattaggataattacatattttattcataaaattaggtttgagaaaatattgcataaaatagtaaaatgtaagttgatttcagtgcatacaaagccatgagccccttttcaaaattctgtcacctataatctttatttctaataaatcaagattgggaaaattaacatttgtgatttgttagatatataaatgttattaaagtaatttaaaaaattagtattagaccagtgatttgccttcatttttaaaaagcaatcgcatttttatatctagattgtgaggtttagagtaataatttattttcattacttgatatgaatcaggattttttgccttcagaaaatattaagtcttctagaaaaactgtagaaatatacctaaattgtcatctaggaggcaaataagctttagattttaatgagaattttactagtttggtatgatgaatcactgttaacatcagattaagtattgctgaaaatgcccataaaaatattctaattttgatatttaattgaaatgggaaatagtgctttataatttcgttaaataatattcgacacatatttaagtgtaagtgggaaggacaaggaaactaaagaactcagcttttaattactgcctgcttttgttttaaaagagggttttttttccctaaataatcatgttcttttgaagtttattaagcagatcagtagatttttaaaacatatgcatatgttaattattgaagaattagaaagttccactttgtatcccttaaatcgtaaagcaggaataggctttgagaatggcagttcccccctcctcccccagcccccatgctatgctatgctattttttgatctcttactgtgatcacatcacacagaaagaaacctaatcctgttacttttggtggtagtataacagtagtggtgttttgtaagtctattattattatcatcccatagtgtactgttaaaataattttagcattaaatacagggaattgattagttacttgttcagataacattaaaatgttcacaatggggggacaagggacagtcctaaatactgtttgtgtgtgtgtgcacacattttaaaaaatagatttcctttatataaataagttatgtagttttgttgggggaggatggagattatgggacctatttctgaaacataccattaaagttaccagaaaattggtcaggcgtggtggctcacgcccataatctcagcattttgtgagcctatgcgggcaaatcgctggggcccgttagtttgagaccagcatgggcaacatggcaaaaccccgtttctacaaaaaatacaaaagttagctgggcatgatggtgcacacacatggtcctagttacttgggaggctaaggtaggaggattgcttgagcccaggaggttgaggctgcagtgagctgtgtttgcgccactgcactgtagcctggatgacaaagtgagaccctgtaacatacatatgtacgtacatacatacattaatgttaccaggaaatgattgtgtctttgtttatatttttttaaaaatgaaacaggaagatggatctgaagttggtgttggaggtgcacaagtaactggctctaatacacggaagcacatattgcaagtttccactttccagatgaccatattaatgctctttaataatagagaaaaatacacatttgaggtatggattgtggttatatacattttaactgtgttgtttctaactctcacttgttacttgagtctttcttatttgaataacctttagagagtctctttgggtacttttagagaaaactgtataaaatggatcatggaactgtatgaacatcatacatgtattgagttatgtcttatttttaaattaactttatagaagtacttttatataaaacataccttatataagtagacaatttgatgagttttaaatgagtgcatctttgtaactaccatcacaagaatattgcccgaaaatacagagcattacctccaaaattgcgttgtaccccttgccagtctattccctcctaccacctccagccccaggcagccagtgacctgctttatatcactataaattagttttgtttttttttagactttcatgtaaatggaatcatacatgttgtctgtatgctttaatcctttgtcagttcacctgcatttgggttgataccggatttaggctaagtagagctatatgtttaacattttaagaaactgccgaactgtatcccaaagcaactataccattttccttatttgccagcagtgcaagacggtccagtcgctctacatcatctgcagtctttagattttgagccgctttagttggtgtgtaatagtgtctcattttggatttaattttcttttttttttttgatgatgatgttgagcatcttttatgtgttaatatgccactgatatatcttgtttggtgaagtgtttgtatcttttttgagttgttttcttactacattgtaaaagttctttataaattctggatacaagtccttcgtcagatatatgtgctctgagtatttttttcagtctgttgcttgccttttcattttcttaatggtgtcttttgaagagcagagttttaaaatactgaaaaagtccagttaatcactttgctttttgtagtttgtgctttaagtcctaagaaattattgcctaccctgaatttgtaacgatttacttttattttttcaatagttcgtaattttagcttttacatgtatgtctacgatgaattttaggttaatttttttatatagtataaggtaaggattaagatacatttcccctcacgctgtcagttgtttgttccagcatcatttgttgaaggcactatttttttcccaccgaattaccttgtcgtcattatttaaaaatcaattgatcatatatgggtgggtctatttttatgctgtctgatctgtttcattgatctctatgtctgtctttatgccagttttatgctgtcttgatagtgcagtcatttttctctttgcacccatcttttttcattagagtaactaattttataatatgcttttttttccttttccttttctcccaattaaaatatgatttgattacattaaatccaattagtcttttcctgtacatttaaagggtgttttggggttaaaatgaaggtcatgtgattcacattaagtttaaatttaaggtaatgaatattttgaaagactcaaaattaattccatatttgtacttaattgaaaaccaattttcatatacaggtgagcacaagaaaaaaaatagtgtgtttgaaattaagagcaagttctaggcctatttaatattcatgtccatactcccatttatgtatcccatttatatgggagtatggaagttagtataattaagagagccatcatttttatgtgatatatttaaagggaatgcttgaaatctaggtattttagtagctcagtggctaaattgagaagtttttcttatggatttccatgtgggtcttacctagggagtaaccttgaattttttttacttttatttttattttattattaccttgattttcaagcatgagttatatttgattgagtcccaagaatactgattaagcaagcgttgagtaccttacccaaacctaggcttttcaaacagaggtggaattaaattatctctaacagctgtttttgtgtagtcatttttttaatctgcggctcttaatggataaaatattttaaacaaaattagctacttggtaaatgctagagttgattttcagagtcctggcttataaagacctggtaaaaaataatgggataataaaaaatacgaattcattttttaaagctgttactggaattgctggaaaatttagtggttcaagcttttccttttcccatctgacttggaatcattgatgctaataagcagttattagatggaaggttaaaattaagtagagaatatctgtaagttttccaactttagctaagtcacaaagcagaaactgattgtagtgtatatagaatgccatgcctatggctccaaagccttctggctgctgacacctcaaatctggggcattgtgagaaggcacaagaaatgtatctttactcaacaccacgtgtttctctacagtctgttgctaatgttttattagctagcctttttaaagaaatcacctccacaaattagtggagatagttaaaagtatttaattataataatttaaaggaaggtgaacttttatttttgaatattctgtgtgagttcagtaagatggtgtattgtttaatgccacatgacaaatttcaaaagttagtgatttaaaacaaccactaacaatttattatctctcgtttctgtgggttagggattgagaagatactcagttgggtagttctggcttggggttcatgaggttgcatttagatgttgtctggggttctggtcatctgacggtttgactgaagctggagaatacacttccagggtggttcacatggctggcaaatttgttctggatgttgttaagtggccttagtttctctgcacatgggccttttcatgtggctctttgtcctcaaatcttggtggctggttttcccaagagcgagcaatccagaagacccaggcagaacctgcagtgcctttttgatctttccctggaagacatgtagtgtcacttctcattttcttggttgcccaagtcagccctgatagtgagaggaccacacaagattaacatataccagggttattacgtgctgtcatagaagctggctacaacaggtggcattaatttgtagtgtcatatttaatctgtagtagtcaggctgctgctgaggttttttcttttcatgttttttgaatgactaaaggtaagtttattgtgatttagaacagctaaaaataggaaatacatacagtggtagtctgtaccttggactttagtaattagcagtgggtttttgaaagaggtatggataagaactattaatacatatttttgttaatgttctttattttttataattttatgagaatgagtctgaaatttaaaaactacagacaatagcactattaatgtcagaatttaaatagaaaacttaacagtagtatttgatattcatcaataatttatagcaatcattagggacataacttcacaatatagaaaggaaaatgaaagtacaagggaaagtagacaactcgagaatcatggaaattccttacaaatttattgactaacctgagttgaaaagggggatataggaaatttgaataacacaattagcaagttaaaattgaaggctgtttagcgaactttgaactcagaaggcaaaatagacatactgctctcaggaaatatctgaggctagcataatttttttgctaaaactgagcaaggaaaatacaaaagagaaagaaagcttaaggttattcatcattctgccttgctccttagattctaatacactgaaagcataaatctcaatattagcaagtcatattcagtagtgtattgaaagaataatgcactgtgttcaaaaaggatttatccctacaatacaaagaaaggtcagcataggaaaactttttgaaaagatcgttattaagatattgtaataattgtaaaaacaagcagttgcctaattgccaggcaccattttaaggagaaaaccatttgatctctatagatgaacaaaaagtatttgataaaagccagtcctcattccttataaaagtgggggactcatcgccaccttagaatggattgcccttaatgccataaggttgtatctgatgacaaactaaatcattgtagtagttagtaggaaaatactagacacctttctattagactgaggaacaagatgaagttgcctatctttactactactattatgccttgctctgcaggtcctaatatactaagaagaagaaaggaatgaaattcataagtatcaggaagaaattgaaaaaattatcaaaatctgtagataatatgattgtcaatttggcaatacatgataatcagtgagaaaacatttctttagaagagttttgttggaaagaaaataccttttcagtaaaccagcattaatcagtaaatgacatgaagaaaaggatgttttattaagaatcatagccttcccaggaatcatcttaacaagaactgtgtagacagggtacttataccaagaagacagtaaaagctaaagaatatgaaagggtaaatgtacccaaatgggagaattacaagttataagtgtgctgtttttaaaagtcacctataaattcaaggaaatctgaaatgaaatgtccaaaatatatatatttttaaataaaactcgacaagctgattccataattcatctggacaagaaaatgcacaagattaggcaaaactacttttgaaaagggatgggtcttaggtaggaaagctcagtgaaaggggaaggaatttgtcctaataacaaaacataccatatcacgtttttttaatttataatttttatgggtacatagtacatgtatatatttatgggatacgtgagatatcttgatacaagcatatagtgtgtaataatcacatcagggtaaatggggtatccatcttagcattatttgtgttatgaaaattccggttgtattctctgttattaaaaagtatacaagttaacattatttaaaatgcatagacagacagctcatttgaacaaaagggagttcagaagcaaactaatatatttgtaggtgtctgggatgtgataaatgtctttttttttttttttctttaaagctctgggatgtatgtgcagaacgtgtaagtttgttacataggtatacttgtgccatggtggtctgctgcacccatcaccctgtagggtccagccccacagggtcggttgtttttctccccttgtgcggagacgagagattgtagaaataaagacacaagacaaagagataaaagacagctgggcccgggggaccactaccaccaagacgcggaaaccggtagggccccgaatgcctggctgcgctgttattggatacaaggcaaaaggggcagggtaaggagtgtgagtcatctccaatgattgataaggtcacgtgagtcacctgtccaccagccagggggcccttccctgtttggcagccgaggcagagagagagggggttagagagagaggacagcttatgccgttatttctgcatatcagagacttttagtactttcactaattttgctactgctatctaaaaggcagagccaggtgtacaggatggaacatgaaagcggactaggagcgtgaccactgaagcacagcatcacatggcatgagatggtatctcattgtggttttgatttgcatttccgtaatgaccagggatgatgagcttttattcatgtttgttagcaacacaaatgtcttcttttgagaagtgtctgttcatatcctttgtccactttttgatggggttctttttttcttgtaaatttgcttaagttccttgtagattctggatattagacctttgtcagatggatagatcgcaaaaattttttcacattctgtaggttgcctgttcactctgatgatagtttccttgctgtgcagaagctcgttagtttaattagatcccatttgtcaattctggcttttgttgcagttgcttttggtgttttagtcatgaagtctttgcccatgcctatgtcctgaatggtattgcctacgttttcttctagggtttttatggttttgggtcttatgagtagttttttctctttctgtgaagaaagtcaatggtagcttgatgggaatagcattgaatctgtaaattactttgggcagtatggccattttcacaatattgattcttcctatccatgagcatagaatatttttccatttgtttggtttgtagttctccttgaagagatccttcacgtcctttttaagttgtattcctaggtattttattctctttgtagtaattgtgaacgggagttcactcgtgatttggctgtttgtctattattggtgtataggaatgcttgtgatttctgcacattgattttgtgtcctgagactttgctcaagttgcttatcagcttaaagagtttttgggctgagacgatggggttttccaaatacacaattatgtaatctgcaaacagagacaatttgacttcctctcttcctgtttgaatactttatttctttctgttgcctgattgccctggccagaacttgcaatcctatgttgaatagcagtggtgagagagggcatccttgtcttgtgccagttttcaaagggaatgcttccagcttttgttcattcagtatgatattggctatgggtttgtcatagatagctcttattattttgagatatgttcaatacctagtttattcagtgttcttagcagcaaggggtgttgaattttaccaaaggtcttttctgcatctattgagataatcatgtggttttttcattggttttgtttatgtggtggattacgtttattgatttgcatatgttgaaccagccttgcatcccagggatgaagccaacttgattatggtggataagctttttgatgtgctgctggattcggtttgccagtattttattgagaattttcacatcgatgttcctcagggatactggcctgaaattttctttttttgttgtgtctctgccaggttttggtatcaggatgatgctggcctcataaaatgagttaaggtgaagtccctctttttatattgtttggaatagtttcagaaggaatggtaccagctcctctttgtacttctggtagaattcgactgtgaatccgtctgatcctgggcttttttgggttggtaggctattactgcctcagtttcagaacttgttattggtccattcagggattcaacttcttcctggcttagtcttgggagggtgtatgtgtccaggaatttatgcatttcttccagattttctagtttatttgcataaaagtgtttatagtattccctgatggtagtttgtatttctgtgggatcggtggtgatatccactttatcgttttttattgtgtctatttgattcttctctctcctttattagtctggttagcagtcttatctattttttaatcttttcaaaaaaccagttcctggattcattgatttttttttttgaagagttttctgtttctcttatctccttcagttctgttttctcttatctccttcagttctgatgttagttatttgtcttctgctagcttttgaatttgtttgctcttgcttgtctagttcttttaattgtgatgttagggtgtcaattttagatctttcctgctttctcctgtgggcaattagtgctataaatttccctctacacactgctttagccgtgtcccagagattctggtacgtcgtgtcttagttctcattggtttcaaataacgtatttatttctgccttcattgtgttatttacccactagtcattcaggaacaggttgttcagtttccatgtagttgtacagttttgaatgagtttcttaatcctgagttctaatttgattccactgtggtctgagagactgtttgttacgatttccattcttttgcatttgctgaggagtgttttacttcccattatgtggtcaatattagaataagtgtgatatggtgctgagaagaatatatattctgttgatgtgggatggagagttctatagatgtctgttagtcgagagctgagttcaggtccctgaatatccttgttaattttctgtctcattgatctgtctaatattgacagtggggtatcaaagtctccccctattattgtgtgggagtctgagtctctttgtagagactttatgaatttgctttatgaatctgggtgctcctgtgttgggtgcatatatatttaggatagttagctcttcttgttgcattgatccctttaccattatgtaatgcccttctttgtctttttttatcagagactaggattgcaacccctgcttttttttttttttttttttttggggggggcgggcttggtaaatattcctccatccctttattttgagcctgtgtgtgcctttgcatgtaagatgggtctcctgaatacagcacactgataggccttgactctttatccaatttgccagtctgtgtcttttaattggggcatttagcccctttacgtttaaggtaatattgttatgtgtgaattcgatcctgtcattatgatgttagctagttattttgcccattagttgttgcagtttcttcatagtgtcaatagtctttacattttggtatgtttttgcagtggctggtaccgatttttcttttccatatttagtgcttccttcagaagcccttgtaaggcagacctggtggtgacagaatccctcagcatttgcttgtctgtaaaggattgtatttctcctttgcttatgaagcttagtttggctggatatgatattctgggttgaacattcttctctttaagattgttgaatattggccccccccactctcttctggcttgtagggtttctgcagagggatctgctgttagtctgatgggcttccctttttgggtaacctgacctttctggctgcccttaacattttttccttcatttcaaccttggtgaatctgatgattatgtgtccttggggttgctcttctggaggaatatctttgtggtgttctctgtatttcctgaatttgaatgttggcctgtcttgctaggttggggaagttctcctggttaatatcctgaagtgtgttttccaagttggttccattctccccgtcactttcaggtacaccagtcaaacgtaggtttggtcttttcacatagtcccatatttcttagaggctttgtttgttccttttcattcttttttccctaatcttgtcttcacgctttatttcattaagttgatcttctgtctttgatatcctttcttctgcttgatcgatttggctgttgatacttgtgtgtgcttcacgaagttcttgtgctgtgtttttcagctccatcaggtcatttatggtcttctctaaactggttattctagttagcagttcctgtaaccttttatccaggttcttagcttcttagcttcttagggttagaacatgctcctttagctcagaggagtttgttgttaccccaccttctgaagcctacttctgtcagtttgtcaaactcattctccatccagttttgtgcccttgctggcgaggagttctgatcctttggaggagaagaggcattctagtttttggaattttcatcttttttgcactgggttttcctcatcttcatggatttatctacctttgatctttgatgctgatgacctctggatggggtttttgcatgggcattcttttcgttgatgttgaatgttattgctttctgtttgttagttttccttctaacaatcaggcctctcttctgcaggtctgctgcagtttgctggaggtccactccagaccctgttcacctacgtatcaccagtggaggctgcagaacagcaaagattgctgcctgctccttcctctggaagctttgtcccagaggggcacctgccagatgccagccggagctctcctgtatgaggtgtctgttgacccctgctgggaggtgtctcctgtcagggaggcatgggggacacggacccacttgaggaggcagtctgtcccttcgcagagctggagtgctgcgctgtgggatccactgctctcttcagagccagcaggcaagaacatttaattctgctgaagctgggcccatagctgccttcttcccaggtgctctgtcccagggagatgggagttttatttacaagcccgtgactcaggctgctgcctttctttccgagatgccctgcccagtcaagaggaatctagagaggcagtttggccacagcagctttgccacccgcccagttcgaacttcctggaggccttgtttacactgtgaggggaaaaccgcctactcaagcctcaggaatggtggacgcccctccccccaccaagcttgagtgtcccaggttgacttcagactgctgtgctggcagtgagaatttcaacccagtggatcttagcttgcttgctgggatctgtcggggtgggacccactgagtaagaccacttggctccctggcttcagccccctttccaggggagtggacggttctctctcgctggggttccggctgccactgggatatgaaaaaaaactcctacagctaagttggtatctgcccaaacagccgaccagttttgtgctagaaacccagggtcctggtggtgtaggcacacaagggaatctcctggtctgcgggttgcaaaaactgtgggcaaagcgtagtatttgggccagatagcacagtccctcagggcttcccttggctaggggagggagttccctgaccccttgtgcttcccaggtgaggtgacgccccaccctgcttctgctcaccctctgtgggctgcacccactgtctaaccagtcccattgagatgaaccaggtacctcagttggaaatgcagaaatcacccaccttctgcattagtctcgctgggagctgcagatcggagctgttcctattcggccatcttgccagatctcaaatttgtcgtttctaaaaactgaatttaattgttttttatttgtgggaatgagaagagggtagtattaagacctcaattccatggatcacatcaaatataaaattccagataaatgtgaaaatctaaatataagtgcaaatctatataaataatggaagaaaatgttgaatattttggtaaccttaatgtgagaaatgtctttttaaaaatgtattaccaaaataataaaggaaaagattaacagatttaaccacataagtgataacacatctatatgatgagatatattaagttaaaaatagactaggagaaattacttataacataaaaattgaaaaccataatctataaagagcatcagtaaatcagtatgaaggcaaacaattgagtataaaaacatgaaggaatatagatagagaaagcatagaagattacagatatcctgtaaatataaaaatattttttcccatagtggtcatgagaagtacaaattaaaataatgagatttcatttttagccaaacatgagcaaaagaaaatctggcgttgaagagggtgtgagggagtggatattcatatactatttttgtggggggttaaattgttaagcaacttgaaagcagttcattagtatttatcaaatactaaaaaaaaaaaattttgagacagggtctcattcttgcccagactggagtgcagtggtattatcatgtctcactataacctcgacctcccaggttcaagccatcctcccaccttagcctcatgagtagctgggactacaggctattttttaaatgtttggtagagagcagatcttgctatgttgaccaggctgattttgaattcttgggctcaagtgattttcttactttggtctcccaaagtgctgggattacaggcgtgagcaaccgtgcttggcgcaaatataaaatatttataactttgaggaagcaagtgcatttctagaaatttgcttttgaaaaacaggctttcgtgctcaaagtcagaaatgcatgtaccaacagaacattggatccagtctaaatctccacttgtgtcatgatagaacagtactatggaattccttgtagctttaatctctttttgctagctgaaaaatctgaagaaattaatagaaaaattcatgttatggtctcatttaacactaatactggtgtataggtggatgtgttcgtgtacgttcatgtatatgcatatacttgtattcatgtgtatatatagatgaataggaaaacattgcttttaaaaagtaatttaaatatacaattgattaccagagtgcaggtaaaatagtaatagtaaagataggcatccttatcttgttcctaactctaatagaaagatgtctagtatactaactactgttatgcttaactctctcattatatatacaaccttatgactttaggggcatttcattctgttcttaggcagctaagaattccccactataaggttttaggactgacttttataaaatacttttggtaatagttacctcttgggatgatctgtaatcttaaaataccacctaaggtatttctggttcattgaatatgattaagcaataactaaagtatgtaaataaatcacttttagcatgtatgtaataataaacatcttcattctaataatagcacctattttctgggattagcatttatactatttgaaatgtctaaagtaggtagatataaccagagattatttgaagaaaatgaatatgtgtaatcactgaaaatcacatttctctgaatccttgcctacctgacagttttttaggagaacagaactgttgctcaaagacttgtctagagagaatgactgactctccagatcagttactcgtataatctgaatatcaccatcttcatgcccactcttcataagctgcttttgagaaagagacagatagctgtatacagtgcatcaaagcaataaatcctagtgtcaagacttttactcaatcacatatcactatagacatgtagagactaaatcatataactgtacagtttccttgctgtcccactgacagaatagtgaatttaaaattacacagcattctttcctgagctgctttttctcccctagtattacactttattcataccattcacatcattattcataatacgcagtaaagattattacctgaacttcaaaacagattgcttgttgatatttatgtttaatgtaattccaggtttttttttttcttcatttggtcatagaagcatacatatggtcagtctggatggtaaattttgattgtatggtagaaggcctgagctcaggcttaccttccttttttctatgaaagaaattactaagcaaaagagtagtctggataaacttggatggaagattgtaaaatatttataaaattagcaattatatgttggttaacactttatttttacctaaatgttgaagcaggttcctgataatctctgctggataacatttttggattagccattgtatctcctgaaacaaaaaagtacatgtctttttaatattttataacttgaatcaccctttcctctcgtttgttcaaataatgagattttaatgatgtgtcatagtactcaagagaattcttttttgtgcattatttatttaatggaattacctctttttaactactgcttggtcagtttacttgctaattaactaactttaatctttcaaaaagtctaattatgttaatctgatgaaatttcaggaaattcagcaagagacagatatccctgaaagagagcttgttagagccctacagtccctcgcctgtggtaaaccaacacagcgggttcttacaaaagaacccaaatcaaaggaaatagaaaatggtcatatatttacagttaatgatcaattcacatccaaactacacagagtcaagattcaaacaggtatctggaattatatttttcctctcaaaaaattatatatttttctctttagaaaaaaaatctcatctattggatttcttttaaaaatactccttttctggtgctgcatgatacttaggcttaagaaagaaagcagcttttattgataagtatttgtatcaaaatgcatttgaatccaagtacagtaagcattttaaaaagtaatttatagtgtgaacaaagtatttcttttcatgtttttcaataaatagaatacagtttatgaacatattggtacttaaaattgtttttaagttgttaactaatagtcagtggaagtctaattttaaagctgatttagaagtttttcagaattgggagacctatataaaagtttgatgtttggatgttgctatttatattttgataaatattttttgtttcaaaatcttaaaacccatatcctctttaatttaaaaacatagaaatgatactgatgtgaatgatttttaatagccatataagtcgataatgaaaattctattcattaaacatttaacataatgtaagatgcttgttttctgtgtatttaaaggggaaaaaaggcactccacccttgctgattgatgtttaaaactaattgtttactacttggcttaaaaactagtattagataggcttcctagtactaatatattcattacagccaaatatgtgtgcaataaaacagtgtcctaagataaataagatgatcttttaaatgactgtcatttgttgattttaaaaaaatgttatttatattgtatattatgatagtctttttaaaagtaatgttaaatatacagttgattaccagagtacatggattctagagctttatatgcacacttaaatttttgtttttcattttgatctttttgtttcgtatgtatactttgtagaacagagtagtgtctctggcaaggctttgccccctttgtcttgtagttgtaaactgtatcatagtaatctgcattagccaagattggcccatgtcttgacataaatatatattaagaataaaacaaaactgtgctagccagtgtcatggaataaaatttatttttcttccaatgcaagacataactactttatacatttgggcagatgcaggttttggattttagggctcatttgtatcctagaattagaggaaaatatgtgggaatatttatctggattgccttaccctcaccctactgtaccctaaataagtaactgtctttgttatcccagattctatcatgtccagcaataataatatcagatattagtattatgtttaaaaaagtcttcgtagatttttagattttcgtgttaagtgtgcacacttacgtgtgtatctggagtatgtgtatgtagtgttttaggtatgttcaaaacagaaatatatatatgatgaatttcactagagcttaaaagttcttttcagcaataaaattctacaaagcaatgtttttttcttgggaatggtttttaaatgatcttggctcttactcatagtttaagtcaaaattttctctttggtggtaaatattgtgaccacattggttttactgtcaaaggctcagtaacataatcaaatattcgaagactcagactctacctatttatgctgcttttactgtagccagtagtaaaagttcatgcaaagaagttaaaggaattactaaaataacacagcctttgaaaagaattagattaattgtaatctgggggggcagtttccagagttgacagtcttcaccaccaccaccaccaccacctgcctttctcaaattccatcccccagcgtgcatataggtcatatataggcacttgcacaacaacaaccccttctgctgcactcaagtgaggagtattgtgttaggctccagagtgagcccctcccctcccatttaaaaagaatactcattttgactcatcagcacgatctgcacatccatgtttttctgcaggtatttaagaagacacttatttaggtgaccacatccagatgagccaaagggattgtttaaacaactacttttttccctgcaactttgtattttttgttttcaaatccacaaagaaagtgaaaagcactataatgaatatcaatatggctgtgacctacgtttaccagtcattagaattttgtcttcctccctgccttcctctgtgtgtgtgtatgtgtttgctacagcatttgaagttaatttacaaatatctcagtagtttccccctaaaaaactttagcacacgtctcctatatcatatccaagaaaattaatttcatgtcatctgtttaccacccatattgcctcagttgtctcaaaaatttcttttatatctcactttttggatccatgattccatcaagatttccacattacatttaatttttatgtctttttagtttcatttaaaccagtacctctatctttttattttttcatgacatcaacttctgaggaaaagcatcataagcatcattcttagtagattattttcatcgaattttttttttttttactaagatattgattatcttacacttgggaaatgacaccgaaagcagtatttttatccaaaggattctaattagaaacagttgaatggatacgcacaccagaatgatcttctaaattgtacaatctgctgtctcgtggctatctatgcccatgcctcagtcagcaatgccccatgtgctgctttgcaattttacggtttctacctccagaaacttcacatctatctccttttggtgaacgaataaaacaccagttttctttttctgctatttcattcagagcagagttgcaggagaagacgacttctgtatttcccttaacagttgctttgaagactatagggaagaatagagtaagactcctaaagattggaatctggtatgaatttgtgatgaggttgtgacataaaaagcataataaaatatatgacaagaaatggttagataacagaactctagggagatttttggcaaggagattttaggaactgacatcctagtggtacttttaaattatttatttcactgactgaatcttggcagtacatactcttgtctcctcataaagccttagagattacagctacattttgagttagtaagacaacagatacctatctgagatacttttggtgagttttaacttggagccatggtaataaaataatcaattgacctctgatagtcataagcaatgaaaattatttactggtaattttactactgaatattttcagctactgtttttcttccaggtaagaaattatattctgcataaaaacaaaatcaactttattatctcaaagttaaattcctcatttttgaaaaggataatttagtattcaagtaaacattaaataagacagtttttgaatgcgtacttgaattaataagtgtgtatattcagaggctgaaattggtttttatctgtggattacattgaattataataagcttgcttataaaccaaattttaaaattagatttatgataaatgtctttatttctattttagttgctgccaaacaaggtgaatccgacccagagaggaaagaaacaaggcagaaagtagacgacgacagaaaacatgagatagaagctgctatagtgcggataatgaaatctagaaagaagatgcagcacaatgttctagtagcggaggtgaggactcttcactactgggctaatatagaaaaaacagtaacattattaacaaaattattgtattcaactaattttaaaaacaattttacaattaagaaatcctagtgatgtaacacttatgaaatgtatggcactcacttggtaactaaacatggtgatacatccaaatatgtgcacactctcggaaccaatgtgtttataactaaaatgatagtagaatattgtcacatgaagtattaagaaaagattttcactgctattaatacctttgtgtaaacaaactccctttacttctaaaaattaataatggttaccattcattaaatgctttcattttacaaattgggaaactaaggaggggaagaccccttaggaagccattaagataggtgggagaggattaggacctgggtaaagtattggtagagggtagaaaactgaatcaagataattgggaagtagaattgacagactttactgattgataatgggaagtgagagggagaagttgaagacgccgtttaggtttctggcttgaatgagtagatagaggtttgtttctttaaccaaaaagagaagggtaatgtaatgtgccgctgtggtccagatgtcacttaatattgttttgtacaagttgactttattgtgtattggcacatccaggggcaggtggaagacaatagacatgagggctagaagttgcattgggaattagctatatgagaatgcagttaaaactacaggtgtggattaaattgctcagtgttagcatggagagcaagaaagaactatgggatagacccctcccttattttaggaacagtgagtgtaacaacagaaactctttagagcactggttttcacagtgtggttcttggaacagctaccttagcatcacctgggaactcatgagaaacacagatccttaggttccaccagagcctgagaattgaatcagaaactctgaggatagggcccaagagtctggttttttaacacgagctgtaggtgattctgatgttttttcaaatttgagaacactgctttagaaggaaaagaaaacaaaatgacagtgtcctatgacaagggaagagaattacaaggagtgagtggtcagtaatataaaaaatcatggaaaaaccaagttgaataaacactttggcaattacgtgacaggttaactttctcagacattttcattggactcgtgaaagtggatatccagtggtagtgccttgagaaggaaatggaggtggaaaccaccaagagtggcttattctttgaggtattggctcaagggaaagggcagagagagtagtattagaggattcagtgtagagttgaagggtttgggctttttcccccccaaaatgggaggatactgagcatgtttatatcctatgaataaagaatggatccttaaattgaaaaaaatgagatgaagggataaataccacattctagaaaaggaaaggtgaggattgtatagagagtatgatgatggtagtgtactgacacagatgttactgaacatgcctcttcctgagaacctagggcagggtgcaggggtatgtgctaagcaagatttggtgtaagtatggataaatgtacatgtgtagggtgggtatttaaagaacttcaaattgaaatggcttcttttctctatgtgaaacccgatgtgagcttggtgcaggactgggttgaggagtttaaggggattgtcagaaatttgaaataatacttgtcgaagaatggtgctcaggaacttgctgaacttttgaatactataaatttgtgttagtctacaccagagattggcagatgtttttgtaaatggccaattgtagcatgaaagcagctatagataatacataaatgcgtgtgactcgcggtggctcacgcctgtaatcccagcaccttgggaggccaaggtgggcggatcacctgcggtcaggagttcaagaccagcctgacaaacacagcgaaaccccgtcctactgaaaatacaaaaattagctggtggtgggtgcctgtaatcccaactactcgggaggctgaggcaggagaattgcttgaagctgggaggcgaaggttgcagtgagccgagatcgtgccattgtactccaccctgggcgacagagcgagactccatctcaaaaaaaaaactaataaaaaataaataaatacatgtgactgtgtttcagtaaaattttacagaaacaggtagtggggtgtatttggcctgtgactgcagtttgctgactcctggtgtacacatacggtgttaacaactacatctttactcagcaaagacctctgtggtaggttgataatgatgtagtacatatagaatataggtttaatcaaatagtgtttatgggataggaccaaaagaatcaggagtagaaggtcctgttgagagtgcagctttcaagagaagtgatcttgaatgcagtttaggctcggttaaacaggggagggagcaagtcgataggagctgttaataggctggaagaaaagaagggcaaagggtgggagatctcaggtgatgggttgagagcaagtttgtcgatacaggagtggtaatcctggaagggcgataaattgtagttgcagaatgaagtgctgaattttcagattccaaagaattatcaatccattgtggctttgggaaatgaactgatcaacaagagtaaaagcaaagctggctcatggatgcattagagcaaagaacatggactttgaggtcagaaaggtttagattcatctctgttggctctgttatttactacttgttgatgtcagttttcttctccggctttattttcctcgtttgtaaaatgagacaacttattttgcagggttaagaacattaaataggccgggcacggtggctcacgcctgtaatcccagcactttgggaggccgaggcaggcagatcacaaggtcaggagatcgagaccatcctggctaacatgatgaaaccccgtctctactaaaagtacaaaaaattagccgggtgtggtggtggacgcctgtagtcccagctactcaggaggctgaggcaggagaatggtgggaacccgggaggcggagcttgcagtgagcggagattgcgctgctgcactccagcctgggcaacagagcaagactcgatctcaaaaaagaaaaaataaattaaataaactcatacatgcaaaatgacagatgaatagtgcatagacagactatgactgctgctttagttattattttattattatatatagcacagtacttagaatcctgatagtacttggaaaaaaccaacagaagcacttactatgattgggcagcattattctttattctaaggcattacatctgttaacacatttagtgtacacaccagtgggccaaggtcccagagctagtagtggtagagctgagtttatccaggtactctgagtccggagtttgtgttctttaatacataggctacccaagttctgtgagttttgagtataactcagaattcagtagataacagcatcaaaacggttaaactataggtggcatatgctcacactactgtaattccaactaattcaattattcaactgctatccactttagcattcacattctgatttgaggaagtgtgttgtaaccataatattacattttcaaacagaacctttttaaagtttctgtgcttttatctttggtaatccagttagtaaagttcagtctctgagtgttaaaatgacatatcagttctgttcaaagatacgaatttttatgtgtttatataaaaatactatctactttcttttttaggtaactcagcagttgaaggcgcgattcttaccaagtccagttgttattaagaaacgtattgaaggacttattgagagagaatatttggcacgaacacctgaggatcgcaaagtatacacatatgtagcataaaatgcgttcagaaatttgatttattcttggactgtactcttcgcatggactgggaagttcttttaaatcattaaatattaagacgaccatctcttctattaaattacagtacatgttctagaccattgagatcaagcctttactccctttgagagtttccaacatcagttgattgagcttcaggctttacaacgtttatccctgtagagatcatctttacagttcctcgggaaaatgtgaatgtgctgcgttttgttttctttactgtatgaaaacaggaaaataaaagagaaatttagaaaatacagctcattacaataaaattgttggatttcatttccccaggtcttcagtgttgatgtaaatgtgttttgtagtgttgcttagcactttgcgcattgtgtaagttgggtaacaaaaatggcaaaagaaatgcagatttcccagttatcttgctctgaagacatttctttagctagtcttatttaattttaaaggtttgataaatatacaaagacccaagcatacaatttgagcatgctgtattctaccacttgcacttactcatcttctagccttatgaccaggaacctttgttttgggctcaagtacacatcctgatttggtttctccctgttgtaatttgagatttcccaaattaagtcttataatgattaggttttgttctgagttatttctagagaaagaaagtattttagtatgtgtaaattgtacaataatttttttgctgttgtactcactgctaatagtggattgtatagggtggtgtttttatttcatttattgtagacaaaaataatgaatttagtatacacatacccactaattcaagtatgtcagagcacaaagttggcagctggttatatttaattcagcccctctgaaaagcacatacagtctatactttgtttataaataccctaggtcctccctgcccctaaatatatattttggtgaagctgtggtgcactattaattttctgtttcaaaatgcaatctaaagatgcaataaatatgatgaccttgatagttttaatgaaatcttcaattcttgcagctgtgttttggaaagtgattaagcaatatttctcaaacctgatgattcttggatatttagctattgtcctccaaagagtcatcgtttcacgttttcaaacatgtgctttgtgctgaagattcttgtcagatatcctgtgcttccagagtatttttatcttcaattttatttaattttgtttcattttgttttcataagacaatgtttcagatatgtaatggggcaaaccactatagatttctgttggatagaaaaatgaaatgttactaataagtttaaattgacccttcgttgactatcagtactgttgatacatttattagaatgtatgtctcagaagatggtttctgtttaaatttatggtcaagttacaacaactgaattctaatatggattaaaaactccacataaatatttttccccatgcgtcttgggttataattttccttttagacttgcaaatatgcttttattgcaattttgtctccatctgtactgtagaattacaagccttgtgctctttatctctacattttccacttctacatgatgcaattaagatgccaatgaaaagtattgtgaacattattctcaggacacttttaccatacttgagtagtactaagtcaggtgtaacatggaaagctaagggtttcaccttctgattttgacataattggaaattttctataatggtaagatgtttataggaaagtaatggtagttcatgtttgagaatttttttattgctttcatttcccagttaaatgatatttaacacctgggaaaacaggacagctcagattgtcgagttagtaaacatgagcgatgtaaaaactttatttgaaatctcctaagtgagacattaaacattttagtgctagtttaagccattaaaagtaaagtttaagtttacgtcattgtctcaagtgtggctgtaaaaatcagatctagagtttagagacatacttgttaactttggagcacaggtttgatatttatgcttctaaatacattaaaacatttctgaattgcagttgaatggttggagattgctggcgatgtgatgctgcactgaaaaaactggtcacacaaaatgtttatatgtttgactgcataagtattattttaggtcataaaggttataacaaaatacatttaacattgctttctttttagcaagaggtcacagatgctattttttctcagtttttaatgctttaatttgaaagaaaaatgcatcctaaccattccatcctgttggtgcagagaaattttggtgatttattagaagacttttaaggagggtggatacatagtttttcaactgcaaaaatcatgtcatctcttcagtaactgttaaagtgtaattctctgccttcattatcaagtccaggacagtgtttattttgaatcgttaacattatttaaagactgaaaattcattgcaattagggaacgcacagcctcacaaaaagtggttgtgattgcaaggattctttatgtcagtgaacttaaaaagggaatgggggaagagatgcatgcctttctaaaggtatgctagagtcacctgtgtagcattgtaattatgtactatcaaacccccaagatgctgatgataggccttctctgtaagaatccttctcatagtgaagcactgttgatgttttgttcaccggatatgttgggtagcagaaaaggcctagaaccagttttaagattatgcctacatctctagaagactagtacactggcatcatcttaggtttctaaatattatttaattccttaatttggaaagcagttttaatgtttacagtttaagatactcattttcagtaactagtgttaaagatttttatctttgcctgtctactgtaacttaagactttcatagaataattttttatagagtatatggtatattgtgtcaatcttggaaggaaagctgttgcatatcaattgtaggtcatgtattttactatatgttgcatagtattttgcattctgtaaatacgaatgttaaaacatttcaggtcagcaaaattagaagtcatttctagtcctcaaagcagaaataattagaaatgttaacatttaagtgcttatcatatgccagatactattctgaatattttatgtatattcattcatttagttgtcatattggctttatgtgacataactgtcattataccagtgttgtccaaggttgctagcaggaaatggcagagccaggagttggacctaggtttaatcctatccatattccatgttacaaattgacacgattttccatattaaaaaattttcatttattttgtacctcattcacatgaatagtaatgtgacaaactaaagttaatacatgaagcattgcaatatggaattttgcacatttttgttagctttacattatttgctgataccaacttttggtaggaaggaaaacagggaaggtgattgctgctattctggaatgtgtccattgaaaagaaaataggcgctttgtctcctacaatcttagagaaagttttacatacttaagtgggtaccacagataggcatgtaccttaaattcaaatctacagttttacaaaatgttttcctttgtgtgcctttcctatgtcaaattagccagaaggaagaagagacgttaagaatggcagataaatttaacaggtaatgatacagagattggccattacgccagctctcaggagaaaaacaactaggatgtcttgaaacccgtgcatttaattttagaaatggcaaatttgtaagcgtgtcatttaagtaatttgatgctcagttttagggtctaagttgacctcgagtgagccatgcaaaaatagctttaaaattatacatgagcagctcaaagtaaacgtgtattttttagtaacaatgaaattgtcaaatttcaagattttaataacaggacagttcaactaataaactttattgcatacaagatttattgcaatgtgggaaaattaaaattctcagtctcagaattctttctgcagttgtgattcttgaataaatgcctcagcacgatgtctggtatgtagtggatgtaggcactcagtaaatcttcagatgaatgtgctaaatgatcactcagtgtcttgaaagaaaatctttaaaagaattgaacttcacattaaaatttgtactgcactattggggctatgacagtataaggatatttttataagtagaagttatttgatacttgactttaggtaaaaagtggaaaatacagaccagctcttacgtggttgcagatgggtgtgtgtatgtgtgtgtgtgtgtgtatgtgtgtgtacagcatcttgctctgtcatccaggctggagtacactggcataattgcggctcactacaccctcaacctcaatctcctggcctcaagcgatcctcccacctcagcctctcaagtagctgggagcacaagtgcacaccaccatgcaagcctttttttttttttttttttttttgttgttgttgttgtaagtagagacagggtcttgctgtgttgcctaggctgtcatcaaaccgctaggctcaagcaatcctcctgcctcgccctgccaaagcgctaggataacaggcatgagctactgttcccagccggcatgttgtgttaaatgctgacttctaagccctcttgcatagcatctctgtgataagaacttgaccggtattagatcatttggtcctatggagagcctgtgaaaaaactcaggcttagtgacataaaaatttttacgaaatcccactaatagttaatggggtgcaggaatttggacccaagtctcttaattccaaaacctgtgcttttaaaagcgtgtgtccccaattactggctgttttggcagactgcacagaaccttgaaaattgaatttgaatctgaaggtagattttcttggcacatattttggtgaaagtttgcattgttttattagaaaatgtttttggagaacttgatcttgtaaaactttatagatccttcacaaaaaataggcaatatcagctatgcatgttggtatatggtataaagtattttctttctcataagtttatacaactgatgtcagatattaatacctacagaatgaacctttttactttctatgtaatactatcttctgtattaaaaaatttttctaatggaatggaattgtagactgaaagagactgaggaagcttacctcaagagtgtgaaatcaagtgaggaaaaggacagaatttgcatttgttccagtgcaactctagcaataggcaaccagtgtatgtgtgtgactataaaatagacggtcacaaacctatttcaacatctacatctgatgggggagagggtgctgaggagggtacccctcagggcaagaaagtctgtatgcatactgtgttcatcgcattttaaagattctcctcttaagcttgcctacagactcatgcaatactcctaagagtcctttttttttttttttttttttaccaaaattagtattatccaagtttgtaataaggcatccatattctccagtcttcccttgagctaattaaaaattaatgcaagccaccaggcccggtagctcacacctgtaatcccagcactttgggaggccgaggtgggcggatcacctgaggtcgggagtttgagaccagcctgaccaacatggagaaactccgtctgtactaaaaatacaaaattagtcgggcgtagtggcacatgcctgtaatctcagctactcaggaggctgaggcaggagaatcacttgaacccgggaggcgggggttgtgagccgagatcgctccattgcactccagcctgggcaacaagagtgaaactcaaaaaaaaaaaaaaaaaatgtaagccattttcatagaaatgaaagtttgtaatcattaaggctatacaagagtgctatagatttttaaaagcaattccaaaagaagcgtggcaagtgctttggtgtttttcaatctagcttcacaccagattttcc

SEQ ID NO: 12261 - DNA, 68283 bp, Human
gtaatggctggctccatggaggcagctttatcagtcccagcattttccataaggcaagcactaactatttattggacacatgaatgaattaatgaatgaccaatgaatgaacatgtggctggccatgggcaaattacttaatatctgtgtgccctagtttctgtgtgtgtgtgtgtgtgtgtgtgtgtgtgtgtgtgtactcacccaggatggagtgcagtggtgcgatctacactcactgtaacctctgcctcctgggttcaagcaattctcgtgcctcagcctcccaagtagggggaattacaggtgagcagcaccatgccctgctcattttttttttttttttttgagacggagtctcactctgtcgcccaggtgggagtgcagtggtgcgatcttggctcactgcaacctccacctcctgggttcaagcgattcttctgcctcagcctcctgagtagctgggactacaggcatgcaccaccatgcccagctaatttttgtatttttagtagaaacagggtttcaccatattggtcaggctggtcttggattcctgacctggtgatccacccgcatcggcctcccaaagtgctgggattgcattttttttttttttttttgagacagagtctcacttgttgcccaggctggagtgcagtgcaatctcagctcactgcaacccttgcctcccaggttcaagcgattctcctgtctcagcctcctgagtagctgggactacaggcatgtaccaccacacccggctaatttttgtatttttagtagagacagggtttcgccatgttggcctggctggtctcgaactcctgacctcatgtgatccacccaccttggcctcccaaagtcattttcgtatttttattagaaacgaggtttcaccattttggccaggctggtcttgaactcctagcctcaagtgatccgcccgcctcgcctcccaaagtgctagaatcacaggtgtgagccatgcacctgacccagaaatttattttaaacagataatatatacatatggcaaatagaaagttaaaagagaacaaagaaccaaagttcacaatgaaaagtaagcctgcatgcctaccctaccttttcttcaggtattcaatgcacaagcatacgatgcatagatagctctattatttttccaattttacacatgaagaagcagaagcactgaaaggttatagaacttagactgtgctaagatttatcagtcaggagttttgtttcatttgtgtatatcagggcttcacaacctttacgctattcggcattttttgcagggttttttttgggggggtagtggcagggctgggggtggaaagggtgtcctatgcaccgcagaatgtttagcagcattccaggcctctactcactagatgccagtatcgcctctccacttccccagttatgacaaccaaaaatgtcttcagagattgccaaatgtcgtggtggtggagggatgtcagggcaaaatccctgataaatggagagaatgtggtatatccacaaaaactccctccaaaaccactggtgtgtatgactatacatcagaccacccctttcttttttctgtgttttacacaaacagtagcacgaatacaccccgctgcgggtctacttttcttttcttacaccactttttggtgatcattccacttcattgcttacaggcagaaaggaacttctcttaaacagaactgaccgggagaagtggtgagctgcccgtcctaggggtaagccagcgagcagacaggggcttccagggcggcggggcggggttcccggggcgagcctccgggaaacttcccgaccagcctctgctcacctcgcggtcccgaggcgcagtggaggggatggggcggggcggggcggggccgcgtatcgggcccgcccccgtacgtcacgtcgccgcggccccgcccccgcgcgggcacctcccccttccccggctggggcggctggagagccgggagtcgctgggtgcgtggggctgcctcgccgcgtctcgccacggtaggtggccctggggcggcagggggtggcctcgggttgcaaccgggggcgcgggctgggggccgtgcgggtcggcctcgggcgcctggcagccctccgtcctggcggctgcctccgggcccggcgcgactgctcgggctccggggctgggagctgggatctgggaggcaggcaggcggcgcgggcgcgcggttctgggatccgcacccgctcggcgtcccgagcgctttccgcggggtgcggcatccaccgggcccccgttaccacgcttcccgcttcggacccagcgcctgggagacgctcagcgtctgttggcggggggactgggggggagggcggcgcgtccccgcctccggagtccccaacctcgcccaggcgcgcggggacccccaggcgggcgccagggcgcgtggaagttaacttgcagcagccgtggagttgcgaggagcgtcagaagtggaggcgttgggggcggaaatcgtcggctggggaggtgggcgctgggagcactgggttggggagccctagtgaacttggaggtcactggtgaggagtggagaggaatttgacccgaggatcccaccccaacccccaacctccctccgtaaactccgcttctcggtgtgagctggatgggaggtgcccggaaagccgggactgggactggtagcaggggactgggagcatgggctcagaggctgagcacgcctgacctggcagagtcgttgttagatgggacagaggtcgaggtctggcattcccactcaaaggcccgttccctagggaaggaaccatccacctcagcagagtcattagaaagaaccgtgcctaacctcttgcccccttccccttttacagatggggagactgaggcttggagaggtcacctgcccgtgaccctaggattcacagctaggatgtggcagagctgaaactcactcacaggcctcctgacttaatgtccttggggatgttgaggaggcgggctgttgaactcctacttatcctacagaagccccctcaagcagcacctcctccgggaagccttccctggcattctcctggtattgttgggtgcttcctgttttgaaccccacagagttagccagccctttttctcacttcccaacagacattcccttgcatgtctgtctgccagactgggctgtgggtggacacctctccctagcctccatgtgataaccctttcatctcagcagggtggtctgctggcgagggtaggcttctggatttgaacagatctgtgacacaccggatttagtagtgatgtggcccgggcgacgcattttccttccgatctagtctcagtttccataactgtaaagctgggtttatttcattgtcctaaaggaactgttgggtcatttctgaatccccccaccccactgaaccccaattgtactgttgtttacttaatatacatctttgtatcacctgatttttaaaaatctcatgcaaactttttttataacagctttgttgagatacagttcacatgccgtacaattcacccttttaaagtatatgtttccgtaatttttaggatgttcagagttgcatagtcatcaccactgtctaattttagaacatttttatcatgcccaaaagaaaggctgtttcatggtcactccccaatcctttcttcccctatcccttggcaaccacttactgactctcaaattctctatgaatttgcctgtgctggacatttcatataaatgcagtcatatactatgtggcctttggtatctgatgcttttcacttcagagaatgtttctaaggttcagccccttgcagcctgtatcagtacttcattccttttttttttttttaagtacttcgttcctttttatggctgcataatattctattatgtggatataccacattctatccatttgtcagctgatggatgtttgggttgtttctaacttttgactattatgaataatactgctatgaacattcatgtacaggtctttggacatacattttcagttctctcaggtatatttctaggagtggaatgattgggtcgtaaggtaactttaggtttcacctttaaatatttttttaatttattttattatttatttattttgtagagataggggtcccactatgttgcccaggctggtcttgaactcctggtctcaagcgatcctcctacctcaggctcccaaagtgctgggattataggtgtgagccactgcacccaggtttaacctgttgaggacctgccagactatttttccagaacagctgtaccattttatattcctaccaccagtgtatgagggttccaataatcttaaatacatttagtgttctctgaagcagtcataacccttgaaatcactggctttgatgtgttagttgtaaactattttcaggccgggcacggaggctcacacctgtaatcccagcactttgggagctaaggtgggcaggtcacctgaggtcaggagttcgagaccagcctatccaatatggtgaaaccccgtctctactaaaaatacaaaaattagccaggtgtggtggtgcgtgcctgtaaccccagctacttgggaggctgaggcaggggaatcgcttgaacccaggaggcagaggttgcagtaagccaagatcaatcacaccactgcactccggtctaagtgacagagcaagactctgtgaaaataccgaagcaaggagaggcagtgtaggacccagtggcttacagagcccaccccaggagctggcacacagtattaggagggggtgaaaggaaggtggaagctgctcggatcttcccatcccgggccagcctggagcccccttgccagctgaggctttgtggaggccagggagaccctccatggctctcctagaccataactgaaggggaagacttgtcccttgaccccaaaattaagtctggtcctgcccacaccctatctggaaccccccacgctactctgaaggtgacttctctgggtggccaccggagtgtcctatgtgagttgctgcttatttcaagaggggccaccccccaggcctgagatgagcagtcctgagttacagacgcttcatctgtgaacattctgcacacacagacatcttccccctcctctcagcaccttccccacccctaggaccctgtgtttcttccttcacactctttgcttcagcaagaggctgcaccggaagaactcaggtcagaacccagcgttttcacagaggaagagttccttgagaaggtaggtagttcaccccagcttgaacctgtactctgctggttcaggaacttagaccagcacttatctgcgtgttccagtttcctgacaacttggttcatctgggcagctgctgtttgggaatggtgttaagaccacgcctcccagccgctgtatctggcacctcgtgactttattcttttttgcatacttgcctttccttgtccttttaaaatcctgagttcctgtgcattaagaaagcagcctaggccgggtgcatggctcatgcttgtaatcccagcacttttggaggctgaggtggatggattggttgaacctaggagtttgagaccagcctgaataacatagtgaaactccatctctacaaaaaatacaaaaattagccaggcgtggtggtgcgcgcctgtattcccagatagccgggaggctgaggtggaaggatcgcttgagtagaggttgcagagagctgagattgcaccactgcactccagcctgggcaacagggcgagattgtagggtattaggtcagtacataaaaatcaattaaatattaaaaaaagaaagaaagaaagcagcctagggacatggagacggggtgggaaggctccctaggcaaggaactgccgctctctgggtgtcagtgtaccctactgaggaatgggcatagaccattcagaactaagatgtggtggtgccttgggatcggttaggctgttgaaatgtattattatgattattattattattatttttgagacggagtttcgctgtgttgtccaggctggagtgcagtggcgtgatctcggctcactgcaagctctacctcccgggttcacgccattctcctgcctcagcctcccgagtagctggaactacaggcatatgcctgactaatttttttgtatttttagtggagacagggtttccccgtgttagccaggatggtctcgatctcctgaccttgtgatccgcccgcctcggcctctcaaagtgctaggattacaggtgtgagccaccacgcctggcctgaaatgtattattgatgtgactttgtgggtgtatttgtagtaagagtggcagatcagatgtagcttcacagcctggggttggtgaccagaatgtactttcttggaaaaatgcatgtggcttgtgtggctttgatgccccacgtggcaccagggaagcttctctgggtagcagcagctcctgctccccgacttgctgcctattccgattgcttgcaagtccccgtgccctctgaggacctgcatgtacccggtctggggcccctccagagatctgggatgactgtcccctcccgtcacttctcaggtctcccccaccctttactgcagccagaggaggatttgtgggaatgattcattcagagctgcttgagatcttggccagcccccagaaattgcagggaaggacctcagagggcagtgcccacaggccctagggaacgtctggggctgatggcccagggagaaacttcttatcctatgtgctcagatggcgggcagccagcccgtctgccgagtgactttgtatcagtaagacttttgactggggcttctgcagccagaaagcaggcaggcagcccagaaagcaggcagtgtgatagggagctagggggcactggcctgtattagaatccaggtgctccacatctttctggggctgttggctgtttctctatgctttggttttctcatctgttgaatgcaggtataagtaggacctatcttccaggggtgctggatggaagggaatggtggtaaagcacttatcttggtaccaggcaaaagctgaggccctggggttaaacaggctctttggaattttgaacatgttcgtttgtgaaccttagttcctccgtctgtcaaaaggcaacaattataaatacagccaatatcaacagggcttactgggtgccagacactgttctaggcactgtatgtggtttaactcatttaattcccccaacagccatatgatgtgaacaggctgaggctcagagaggtgaagtaatttgcacaaggtcacccagctaggaagtgggagacataggatttggatccagaatctttcttttttttttgttttgggtttttttgtttgtttgttttgagacagggtcttgctctgttgcctaggctggagtgctgtggcacaatcatagctcactataaccttgaacttctgggctcaagcgatcatcccaccttggcctctcaagtgctggggttacaggcgtgagccaccacacccagcccagactctacactctgaattctcattcttactcctccttgatatcccatcttaaggcctagcacatagaaaacacacagaaaacatcaggtgttgttataactattctgaataaatattgatccgctctccatccctctgtccacactccttccctgatgatcagaacatgcagggctcttggcctgtaaagtccagattcccacccactcctccctactcgctctgttcctcccactcccacactctcatgcacagcagagcttggaagcagccaagtcccaactcttcctccaaattgctgtgtgacattgggcaaggagcttcccctctctgagccccagtttccgtacatgttaaatgggtgagttcaccctgctgcatgttttttgttgagctcccatgctacgtgtgtgtttttaaaattgagtcaacattcaaacatttctagagaaaaattctgatttctcatttctcttggaaacccaggagcttaggccaaactggagtggcctgaagctgccccttaggtggcctggactctcccagtcactgtggttccccctactccccattgtcacgtaagtgcggcttttcaggggatctgaggatgccttaggcctgcctcgtgccacctgaataagcagttccattgctttaaaaacaattttttttttttgagacgaagtctcgctcttgtcgcccaggctggagtgcaatggcatgatcttggttccttgcaacctccgtctcctgggttcaagctattcttctgcctcagcctcccaagtagctgggattacagtcgcatgccaccacgcccagctaatttttgtatttttagtagagacagggtttcaccatattggccaggctggtctcgaactccgcctgccttggcctcccaaagtgctgggattacaggtgtgagccatcgcgcatggcacaatttttttttttttttgacacgctccaagagcccttccagctctgtgtttctaggatattggaggttgtctgaggcctcctgataccctgtctgccattttaagccctcaaggcattttttttttttttttttttgagatggagtttccttctgtcgcccaggctggagtgcagtggtatgatcttggctcactgcaacccctgcctcctcggttcaagtgattctcctgcctcagcctcctgagtagctgggattacaggtgcctactaccatgcccagctaatttttgtatttttttggtagagacggggtttcaccctgttggccaggctggtcttgaactcctcacctcaagtgatctgcccatgtcagcctcccaaagtactgggattacaggtgtgagccactgtgcctggccttttatttgttttgttcttttttttttttttttcctttttgagatggagtctcgctctgttgcccaagctagagtgcagtggtgtgatctcggctcactgcaacctctgcctcccaggctcaagcgatcctcccacctcagcctcccagagtgctgggactggaggttgtccccattgcatactccctgtgtggggagttcctgtctctgggcgctagggtgccgtgccaccttacctggtacaggcccctacctaactgttgttccccacagtgagatatttgttattgaccacgccatttcccagaagccaaggcttggaaatagtcactttcccgaggtcacacaggcctgagattcagcaccaggactcaaagcccatctgcccaacttcagaggctgtcagtggaagtcatgccttgatcccagcactgcacggatagccactgagtgacgtcttccactagaataaggacacatgagaaccctcaactggatgttggggtgcaagatttaagaagcaacgaggtcctagttgtcctggagtttacgttctggtggaggcatcaggcaagaaaaagtaacccacatctctgacgtgagatgtcagcctatgaagttgagtacccaggcctctcagatcttaacatgcatatgatccccttggggaacttgttaaagtgcagattctgtgtttttggttgtttttgtttttgtttctgtttagatggagtttcgatcttgttgcccaggctggagtgcaatggtacaacctcggctcactgcaacctctgcctcccgggttcaagcgattctcctgccccagcctcccaagtagctgggattacagacacctgccaccatgcccggctaatttttgtatttttagtggagacgggatttcactgtgttggccagcctggtctcaaactcctgacctcaagtgatctgcctgcctccacctcccaaaatgctgggattacaggcgtgagccacagcgcccggctaaagtgcacattctgattagcaggtttggggcagagactaagactgtgtttctaaccagtttccaggggcctctgatggtgtttgtctaaagaccacatttggaatagtgagggtctggatcagaaattggcagattaccactcataggccacatccggcccgctacctgtatttgtaaataaagttttatcggaacacagctatgcttatttattgacattttgtctgtggctgctgttgtgtaacaaaagcagagtggagtagttgtgatagagaccagagagcccacattgctggcctttgaagagaaagtctgccagttgcttttctaatcatcttttgagtccctacaagttataaaactttgatttggtgagtgttagatgctgataaaaatagtaatgattgcagttaagacttgggtgctttctgggtacttagctctttacgtttatttttcttagctcaattctatcataggcaatactactgtctccactttacaggcgagaaaactgaatagaggctgggccattggcccagagtttgtggaccaatgagtaggtgaggccaatttgagtcaagttgactgattcttattggacaggagcttctgcctagaactttttcccagagcacagagagggtttagtttagatttccttctgtcccagagtgttctggtgccttcatttctttctcaatccatccttctgtttactcaacaaatacctgtgcaccctgtgctggaagtttggggaccatgctgggttctgagaggatgtggggactaggatggggtcccagccctgcacattccatggggttggcagggaagcaacaccagaagccacacaggatgctaagcaccttgggggatactggtacagggacaggaggcagtcagggaagacttcctggaggaaggggtgcaaatgatgccagtaggagttagctttgtagaggaggtcaggaaaggttttccaaggagagagaatcacaagtgcaaaagtttggaggtgtgagactctgtggcctggtatgtttggtagagttcagggcacaaagactatagtgtgtgtgtgtgtgcgtgtgtgtgtgtgtgtgtgtgtgtgtgtgtgtgtatgtatgttgagggttgggggaatcggtggtgttataataaaattggaggtcagcaggagttaagtcacaacagagcctcagtgcgatgccaaaggacttgaattttgccctggaggctgctgttgcctagtatgaagtgctaaatcacagagcgaaagtcttcctccccaccctctgatgactttccggagaaagcctccattaggtgctaacgcgtctttagtgcttctccccagactcctcttgtttaacaaagatcggacacaaccggctcctttggggatccttccttaggctggcggccgtctctagccagaaggcataaaaaaacattgcttccttcgattttatttttgcattaattttttaattagggcatgttttaaatttaatccagtggattatagtttcccttgaaaatatgttttaaaaatattggatccattgaacaaaaatgaatacgattaaagggggttctggatgtaattaacattgggaaggtagtgttcagaagcttggaatttggagagccccacaacaggtgagagggctggagggggctgggccagtagtcacctctctctcaacattccccttcttccctggatacccaggggccttgactgaagggcgggatggctgtgtagctaagatgtgggtgcagggatgtaggtgcccgttgatggtgtaggagctgaggttcctgttccaggctgctgctagtgctcatctctctccttctctgtctggtgattttcttattcttcttttctttctttctttttttgagatggtcttgctctgttgcccaagctggagtgcaggggcagcattgcagccttgaactcctgggctcaagcaattctcctgcctcagcctctcgagtagctgggactacaggtacagaccaccacacctggttcattttttattttttgtagaaatggggtctcactatgttgttcaggctggtcttgaactcctgggctcaagcaatccacctgcctcagcctcccaaagtactgggattacagacgtaagcctctgtacccaacttgtcttggtttctatttttgtctccctgcctctctctccctcccacccatccccccaactcacgtctttccctgtctctgtcactctttctgtcttactcccatctttgcctctcctctgactctctctccccatctacatcctctgtctctatctccctctgtctctgcctctgtctgtttttttctctctctgtcttcttccgccccaatctgcaccacttcccccttccttcccgctgccgaccccaagcccacacaggtgccagcacggcccttcctttctctcattaaaaacttttcatcccacttgctttggctggtggctgacatcctgccacagaaccatccggacccttgcagagcccgggggctcagccagaaacctttggaggtgtgagaaagtggtagtagctacttcccaggtggaagacagaggccctgtggagtcaggcacctggcaaggccgccctacaaggccatggtttcctctcaacccacaccctttccacgcccccagggccctcccttccccaccgggccccagggctgtggggaagaagaggaagcctgggctagcagcaggacggcagatgctgtttttggtttgatttggtttggggtactgggggagtgtcggctacccttcctctgagcactgctggaagctgcatgcagtaggtgcctttgcccttcattctgctacgtggtcattccttgctcaagtgcacagtagaccagcagtgcatatttgatggctaagagttttgggaagaaaaacaaggttagaaactgagtcttgcctccaggctgggcacagtggctcacacccataatcccagcactctgggaggccaatgcgggcggatcacttgcgtgagctcaggggttcaagaccagcctgagcaacatggcgaaaccctgtctctacaaaaaagtacaaaaatcagccgggcatggtggtgcatgctttattcccagctactttggaggctgaggtgggaggattgcttgagcctgggaggtcaaggctgcagtgagccaagatcacgccactgcactctagcctgggtgacagagtgagaccccgtctcaaaaaaaaaaaaaaaagaaagaaagaaatagggtccagctttttcttttcacagatggggaaactgaggcccagagagttgaggtaacttgttctggatcatgcaaatagcttggaaataatggggtctgggtcttccatgcctcagaaactgggaacagtgcacccctgtgttgagctggtggctgctttgacatccctcagcggttgttgtgtagacaccgacttctgagagatgggagattctggttcgaggcctggtttgctctcctctacctactgcgggactctgggcaaaatcttccttctctgaggaccttggggtccccaggcatagtccccatggcacagtcctgaggatcgcagagcgtggtcaggtttgcagggtcggaggttgctgacctcaccgtggatggagggcttcttcaacacaggttgctgtaccccacttccagagttcccattcagcgtggtctccttgagccctgataatctgcattttgtgtaggttcctaagcgctgttcctgctggtcagagaacccacgttgagagctggggtagtagaggtgcagcagacgaagcacacgggcgctaaaacctgctgtgagatctcaggcaacgacttcacctttctgtgccttggcttcctcagctgtaaaatggaatgacagagcactgtcctcatagattagttgtgaggattaaatgagcgattgggaggcggagatgcgcggatcacctgaggtcaggagttcaagaccagcctatataattgattttaattgaaattccttttggtaattcttaaagataataatacattttgatgtttactcatgaacattactgatattccttcctccagctacatgataatgttttctctcctgtgggtgagatctaagaaatgaaactcggccaggcatggtggctaatgcctgtaatcctagcactttaggaggtctagacctcctcctgaggtcaggagtttgagaccagcctggccaacatggtgaaaccccatttctactaaaaatacaaaaattagccaggcatggtggctcaagcctgtaatcccagctactcaggaggctgaggcaggagaatcacttgaacctgggagatggaggttgcagtgagccgagcttgtgccactgcattccagcctgggtggcagacagagtgagactctgtctcaaaaaaaaaaaaaaaaaaaaaaatggccgggtgcagtggctcacacctgtaatcccagcactttgggaggccaaggcgggcagattacaaggtcaggagttcgagaccatcctggctaacacggtgaaaccccatctctactaaaaaaatacaaaaaattagctgggcatggtggcacacacttgtagtcccagctactactcgggaggatgaggcaggagaatcgcttgaacctgggaggtggaagttacagtgagccaagatagtgccactacacttcagcctgggcgacagagcgagaccttgtctcaaaaaaaaaaagagcaaatatttgtaaagtgtgtagaaaaccccccaggcacacagtaagcactatatgcatgttcacttttttttttttttttttttaaagacagggttttgccctgtcacccaggctggattgcggtggcatgatcatagcttgctgcagccttgaattcctgggctcaagtgatctcaccctcccaagtagcagggactacaagtatgcaccaccacgcttggctaatttaattttcttttttttttttttttttgcaacagagtctcgttctgtcgcccaggctggagtgcagtggcgcaatctcagctcactgcaagctccgcctcccgggttcacaccattctcctgcttcagcctcccgagtagctgggactacaggcatctgccaccacgcccggctaattttttgtatttttagtagagacggggtttcactgtgttagccaggatggtctcaatctcctgaccttgtgatccacccgcctcggcctcccaaagtactgggattacaggtgtgagccaccgcgcccggcctttttttttagagacagggtcttgctatgttgcccaggctggtcttgaactccttgtctcaagtgattctcccacctcagcctcccaaaatgcttgggattataggcatgagctactgtgcccggctttgtcttactattattgttgttattcttattgccatgattatttaccttcccctcctccacaaagacaattctgttcacagtgaattccttgccattctccaaatttccagtgtgctttcacacttctacccgctgctcgagctgttccttctacttgggacgcttcctctaacttctgcacgtgttaaaatgctggcattcttttcgactcagctcagattccttcctctgatgtctgtgatgacatgacttgcttcccctaaccaagctcttatttcattctgtgaattatcctgttacttgggtgtcaatctcctgtgctgaccctcaggctcctgtagatctgacttggggctttgctggtacagagagtctcccaggaatgttactttcaaagtccagctttgatggtgtttcaagaagaccagctccatcgttgtcagtggcagctgtcagagaagccttccaaggcatatggggtggagccccattgggacgtgggatttccttaattagtaagagtgtgaacttagcactccacagtcccaggttcatgtctgtgttttgccatttagtgtgatgcagcctcggataatttccttaaatttttttgtgtgtcctttgcatcttcattttattttattttattttattttatttattttttatttatttacttatttatttattttgagatggagtctcgctctgtcacccaggctggagtgcggtggcacgatctcggctcactgcaacctccgcctcccaggttcaagcaattttcctgcctcagcctcctcagtagctgggattacaagcacacatcaccaggcccggctaatttttttgtatttttagtagatacggggtttcaccatggtggtcaggctggtctggaactcctgacctcatgatccgcccaccttggcctcccaaagtgctgggatgacaggcgtgagccactgcgcccggcctgcatcttcattttaaaaggatgccatcatcatttacagcagcgggtttttgtgaggattcagtggggtctcatttctgcagcaaatatgagcacctcctgtgtgcctgctctatgccggatgccgggaatccagcagtgagcaggagagaccctgttcctgccctgggagagctgatattttagatggacacaaggggaggtatagaaatgatagtgtcgctgtctccggaggatgcagcaggaaggagatggtctttgagaagtgttctgtgcgtggtcttgcaagtaggaggcccttagcaattggtaagtgtgatgattactgttattgccgtaattatttgggagaggaggcaaaaggggaagggaggcattgtgggaagagggaatagtttcagtacagggtcaagaaggcattcggtgtcaaagtcgtaatattcacagccaatgtttatggatgccctagtgtgtgtcaggtactctgctaaggacttcctaggtgcaaattcatctcaacctccagggaagtgctgtgttatccccattttccagatgaaagacatagggcacgggggaactgaaccacttgtctggggaagtggaggggcgggagtcaaacctagattcttacccctgcatctagggtgtgtgatgggaaatgagactgagtggggacaggtcctcatagggagggctcaaatcttgactgtcctcctgctggagtcccttagatggtcccgggatggacagggtggggaagttcatggcacatctcattttatggtccagaaagccagtggcatgcagcccctccaagagtgggtaggaaaggatggctcctcctggaccccttctagttgggttctcctggttggtggcaagtccctggtggggctggagttgtgggaggtgataggcacagtgcagcccatggttgggagcctacattctgggtggtgaggatgctggtgagtgctccttcattgcaaggatgcagttgctcactgtcgccttttcctcgtttctgctctctgagaccctctctacttaggactgggcatgaggggagcccaggagaaaagcagataatgaggatccaagggacttgtatttgtctccagccagtcgcctcccaaatacctatggcttgctcgttcctgggcaaacaggtgcctcaggcagtatctttatcttttgtgtgtgtgatgccattggaacctcacagtgacccgtgaggcaggcatcaagagaaggcctgttgttgtgggatgatagcaactctcaagtcagacacacttgagttagaactccagctggcttatgcatgagctttgagaccttgctccagacacttctctggtcctcagtttcctcatctgtgcaacagggatcataataatgattattttgtgggtgacagataatagttatatggcatctaatgcatagaagtgctcagtaattcatagcaacgaaaattttgttgttcttcacccattttacagataaggaaactgaggctcagagaagttaagggactctccccatggcattttgcttcctggtaatggccaggcaagtttgcagatggaaatactttccataaaacccaggtcccccaaagccctgcaccattaggaaaaggctgttccccaattgtgaatctgtcccccaaaacagtgaaccatgagatcatgccccttctctctcgtgggtttctccctgtgatgttttaagtgttcatactctgagcagctcttaaagcctttgcaattcttccggttcttcctgcttctaggagtgagtgaaaacgaagaaggtatcacagtctgtccaggaaggaaacagaggagcaggtgaatgctcaggaaaccggattcgtagtatgcactaccccagaattggggctggcaaattctgctcttaaaacccccacctagagccaactgctgcccctaataatatgcccaaaatattaccaggacgaaggcctcatgcttcctggatgaaccacaaaaaaaaaggttgaggccatcttgttgaggaacattacatccagcaagtatttatttattgcttgctttgttcttggtcaagccttttcactttttggccatcagccattgcaaaacctccacaacaaagaagtggaaagtcatgcaatcagaaaagccataaactacagctggggccaggggaagagggaagttagctgaagactttgtaagcagaaacatcaggaaaccttctgacatgttaataaagatactctagagtcacatcttgtgtggaaactcaaatccgcattgttggggcggaagtcggagtcagtgactggccccagctgtcaccccgagccttcagataagacggtggaactaggcagggcgccgtggctcacgcctgtcatcttagcactttgggaggccaaggagggtggatcactttagcccaggagtttgagaccagcctggacaacatagtgagacctcatctcgacaaaaaataaaattagccaggtgtggtggtgtgtacctgtggtcctctctactcgaggggctgaggtgggaagattgcttgagcagtccctggaggaagaaggtagagccaggaactatcattaattaaacacttaaccagctctaatatggtagtaaagcccttatgtgtatttagctgctctcccgattcacagatgagaaaaatgaggcccagagaggttaagtgatttacctgaggtcacaaaactaataggtggggaattcaaactcaggcgcatctttctgcaaaacgcattcttttttcactactccctgatatctgaggaaacttattgatgagcaaaatgacctgaaaaaaataaaatgtgaatgcctctcagtgtcaggctctgtgataagtgtaggaaaaaaagaaaaagaagaagaagaaaaaaaacccaccagactgcaatgcctcccagcccgtgagcactcacagtggaatatgggaaacagaagggcaaacagcatttaccatacagaatggtgagtggtaggcagaggggactgtgagacataggagggtagagcttaatctagtcggggtattcagggaaggcttcctgaagaaggagatactttagctgaggagataagcagcccaagataaggtgggaagagggtatggacccatctattagctaggactcttgataaacagagacagaaacccagcttccatagcattgagcaaaaaggtaaatttattggattatgtaagaggtgagcctcaggtatggctagatccaaggactcaagtaattttagggatttgtgtctccatctcggctccaccttcctaggttggctttgctctcatgccagctttgcaggtggtgactagagatggccccacacctccagccctataccctacttgcttagcctccccgcagaattctgtaaaagtctccagttgagtttcattgacctagattgggtcaaacgtccatctttgaaccaacactgcagtctgggaatgaaatgctgtgattggccaggcctaggttatgtgtctgcaccaggggtcgaaggtggactgagaatgaaaataagaaagccagggatgcatggcacccttggggctgatagaaggtccatggggctggagaaggggtctgatcatgacacccctctaagccacgtgaagaaattgcatactgaagacagtgggaagctttgaaagtatagtgaaggcgggggtgacatgccaccatatggggacaggcaggggtggaagcatgatcaggtggcggacagtggggacttggactgggctgctggtgatggagagaaacagttggatcctgggggtgttgagtgtaatgcacaggactcagtggtgattggatcaggggttcatggggaggaagaggttcatgatcttgggtttctggcttgttccaacaggcaagcctggaagagaaaccaagctcaggagatcctattaggagtttaggttgattgtgttgagtttgaaatgctgtcaagcatccaagtgacagactagtggagaattggccatttcacggttgctatgctgagaggggccggtcaggattctgtggccttaggagaaggggtgcagagtgacaactctatctagtaaatattaattgaccacctactgagctgcaatgctccggaaacagagcattcaaggctcccagacaatgaatgcagaatatgtaagtcaatcatatgatgtgttagaaggtggtgagtgctgggggaaaaaaaaaatcacgcagggtgagggcttctggagtgccgtgttggcggggcaggttgcagcactaactggttgatcagaagaggccttgaagaagtgcgatgtgagagaggacaggagggtgagagagtgagccaagtggatgtttggggaaagggcatccgggcagcgggcacagccagggcactggcccagaggagggagggtgcttgtgtgtttgagtgacagcaagggggccagcgtggctggagaagaggcaagggccagtggggttgggggcagaaaggtaaggggtggggtcaaacctgtaaggcaaatgaggactggtttttcctgagtaaagtgggagccatgggaggatgcggagcagaggagggccatagcctgacttccgttttcctaaggtcactgtggctgcttgctgaaaatcaactgatgagacaagggcagaatcagggaagctagtgatgaggtggcttggaccagagtggtaagaagtgaacgcctgaaacaaacgtctggcagtgcgggtggtgagaaatggcggattctggctctgttttaaaggtgaagttaacaggagttgctgctggattggattagggtgagaaagaagaatcaaagctgccttcaaggtttttggcaccagcatgaaaggatggagctgctaccagctgcaggtggggtatgctggggaaaggaccaggctcaacacccaggtgcagggaggaagagagtgggcaactgtgtccaagtgaggagagagatttgggctcaagatgacaattcaggagatgtcagcctgtggggagcatccaggggcgctagtatctcctgaactggagggaggagagagggccacagtagccaagtgtgacctcctgatacctgtgccagaatggctgggtttggccccgcataaggaaaaaccctgtaaacgttttcatggggctgtagagaaagaggaagacaagcagacataacctccttggcatctgatcaaaagccaccgtggcctggctgctcatttattgagtgtgggtctgggaggtgtccatgccaggagccggggtgtgggtggcatgatcagaggctgaagctcaattgtccttgaagttcctggcgcccaggaccgactagccctgggagagcgccgtcctgcaagtgttgattgaatgaatgcaaagagtcttgtgtgttcctctgcagcagccgggaaaaaaaagtgtgtggggtggagtggggcgggtagcataccccagccagcaacaccattcctcagcatttgacaaagtgtgattaattaatttttttctctctttcttttctttctttctttctttccttctttctttctgtctgtctttctttctttctttctttctttctttctttctttctttctttcttttctttctttcttcctttttttttttttttttgacagagtcttgctctgacacccaggctggagtgcagtggcatgatctcggcccactgcaacctccacctcccaggttcaagcagttctccctgcttcagtctcccgagtagctgggattacaggtgcctgcgaccacgcccggctaatttttgtattttttagtagaaacagggttttaccatgttggccaggctggtcttgaactcctgacctcaggtgatcctcctgcctcagcctcccaaagtgctgggattacaggcatgagccaccgtgccaggccattaattttctttttttttaggagacaaagtctctctgttgcccaggctggagtgcagtggtgtaaccatggctcattgcagcctccagctcttggccttgaagtgatcctcttgcctcagcctcccaaagtgttggtgtgagccaccaagcttgctgaaagtgtgattcgttaagactatttttattcaagtctaacgtgtatacagaaaaatgcatatttcatacgcatacagctcaatgaattttcaaaagacgaatgtgtctgtgtgaccagcacctggatcaatagctgaacgtacatagcacccctccctgccccaggacaccttgctccccctgcagttaccccttgccccaccggggtaaccaccatcctgacatctccccctagaatttcacctgtttttgtactttgtatccatggaactgttactggaacggggtcccgatccagaccccaagagagggttcttagacgttgtgcaagaaagaattcagggtgaggctgggcgcggtggctcacacctgtaatcccagcgctttgggaggctgaggcgggcggatcacgaagtcaggagatcgagaccatcctggctaacacagtgaaagcccgtctctactgaaaatacgaaaaattagctgggcgtggtggtgggcgcctgtagtcccagctactcgggaggctgaggcaggagaatggcgtgaacccaggaggcggagcttgcagtgagccgagatcgggccactgcactccagcctgggagacagagcgagactccgtctcaaaaaaaaaaaaaaaaaagaattcagggtgagttcataaagtgaaagcaagtttactaaggaagtaaacaaacaatagaatggctactgcatagacagagcctcccagaggactgctggttggctatatttatggttatttcttgatcatatgctaaataaggggaaaggtgtgggcagttcccagaactgagggttcctcacctttttagaccatatagggtaacttctggcattgctatggcatttgtaaacgtcatggcgctggtggtgggagtgtcttttagcacgctcatgcattataattggcctataatgagcagtgaggatgaccagaggtcacttttgttgccatcttggttttggcggttttgtccggcttctttattgcatcatgttttattaatggggtctttacgacctgtatcttgtgaaagcagtcctgctgacttcctgtctctgtgacaaagaatgcctgacctcttgggaatgcaacccagcaggtctcagcctcatttacccagcccgtactggagagatggagttgctgtggttccagtgcctctgacagaaccacgcgttatggtctttcttgtgctgacttgtttcgctcatcacaggtgttgttattgcgtaaggttctggcttgttctttctcctggctgtttagtatatatctgtttatttgtatttacttgtttatccattctattgccaatgggcatttggatagtgtccagttgggggcaattacgatcatgccaccgggaacattttgatatgtgcccttcggtgaacagttgaatgcatttctcatggatgtataatcagcagtagaaatgctgggttgtagagaaggtgcacattcaggctttgtctcagttaagccagagttttccaaaggggttgaaccaggtttccctcctgccagcagagtatgaaagttctggttgcattacatccttgccaacacttggtatccttttctttttttagttatttagttatgtaatgatcccacaatgtactttaaatttgcatttgtttccccgatggatatgagtttgagcacctttcatatgcttattgaccacttagataacctcttttatgaagtatgtcttcagacgttcccatttttctgttgtgttgcctgtccttttttaaattgatttcacagaactctttatatgttctcagtataaatatttgtttgagatgtattataaatatcttttttcatgcatgacttcatttgatccataagaggaggaaccgggaattttaagcctcaaggtcattggaatccaggacaagcttcacatgtgtgagcctcagtttccctctctaaatcctgtggatattagctcattgactggtgtatagatggaactgtgactgatattagcaccttttgctgggatgaggaagccctgaattaaaatgggcaaaactggccttgcatggctttcaacctaagtcatccctgtttctcaggtctgtataccaacttccaggctaggccttgaaaataaacagtgagcaaggcccatttcctacccttggaggggactgcaccagtggtgagcgcagggggctgtgggatcccagcagaaacactaactgggctaaggcattgtggaaagcttcctggaagaggtgagtctcagggtggagtaagcctcttctgttcaggtacaggcttgggcacctttgtgcatcaggcactggacaggtacctgggagatggaaagaatcggcttagtctcaccccctcttaccccgcaatagaccagtgttcttgatggggatgactgcacccccagggggcagtcagcaatgcctggggacatttttggttgtcaggactcagggaggggatgctactggcatctccttggtagaggccggggatgcggctaaacatcctacaatgcatgggacagccccaccccatactaccacaaagaatgatctggtccaaatgtctatagtgcagagactgagaaactccaagatggacaattacaatacgatatgagcgggggaagagaggagagcagagggattgggagtgttgtcctggccttaaggagtttgtttgtttgtttgtttgtttatttactgactttgagacagagtcttactctgtcatctaggccggagtgcagtggctcaatctcggctcactgcaaactccgcctcctgggttcaagtgattcttctgcctcagcctcctgagcagctgggattacaggcgcctgctaccatgcccagctgatttttgtatttttttttctttttctttttctttgtctttttctttttttttgagacagagtcttgctctgtcaccaagttggagttcagtggcgcgatctcagcttactgcaacctctgcctcccaggttcaagtgattctcctgcctcagcctcccgggagtagctgggactacaggtgcgtgtcactacgcctggctgatttttgtatttttaatagagacggggtttcactatgttggccaggatggtctcgatctcttgaccttgtgatccgccttcctcggccccccaaagtgctgggattacaggcgtgagccaccgcacccagcctaatttttgtatttttaatagagacagggtttcaccacgttgtccaggctggtctctaactcctgacctcaggtaatctgcctgcctcagcctcccgacgtgctgggattacaggcatgagccaccgtgcctggccaggagtttattaaccttcatgcccaccacgtcaaccacaaaccacgtgtggctgcagagccctcgaaatgtggctgctgtggctgaggaactgaatttcaagtctttatctattttaatttcagaacagatactcattcccattcttggaaaacttttaagtgtgtgtacaacagtttgggtgtgtggatatactttgttcaactatcaattttatgaaatctctgtacagattagccatttctactgagaatttagcatccaaattgagatgtgctgaaagtagttttaccctgggtttcaaggactaagtaattaaaaaaaaaagactataaactatctcagtaatgtttatattgattgatgataatattttatatatattgagttaaataaaatgttattaaatttacttctgtaacatagctactggaaaactgagaatttgaagtgtgtctcacactgcatttctattgggtggcgctgttacaaactacaggaaggagctagaattctgtggaaggttttaggcaggggctgacatcctctggccaaaatgacaagagggaattccagagaccagggcaagtctggccacagggagactgcatggcctaggagacctgagccacagccgccaagagaagccctgattccccagagaggaggtgcccgctgccagtccacaggtgagcaacaagactggatccagaagagggaggagcctttaggagaggcaggcccatcgcaaggctgactgatccttcaaaggagcctcccagctaaaagccagcaggagagagaccttggccaccaagggtctgccagctcctggtggtccccactccagccacctgccagctcgagcctgaccctcgcctccaccctggctgctgcctgtaccgctctcaggtttgaaacctcatctcttgctgcttggctctgctctctactacttaccagctgtgtcaactagagcaagtggctttccctctctgggggctaccagctttgcatggcctggcccatgttgcagctagagctcaggaaagatcagagatgcccacaggtgacaggtcttcctgggctgggtgttttggaggtggcattatgaagtctcagtggggggtctgcagacagtattctctgtttgcagatggcttcccctctccactctgtgtgttacgtcctcatttcactgctgagaaagtggaggctcagagaggtgaagcagtttgcccagggccacacagctccacagaggcagaattcagatgagtaatgctgactttgcaggtccaaggataccccttccatggctataactcagtgttcgatcaagggcagagcactgcacctctctgggcctcaatttccccatttgtcaaatggggagaataacagtgccagtcagctgctgtgaggctatagtaagttgaataaaagtaacagagcaccggcccaaggcaaggcttcaggtggtggctgctgtttgttgactgatctgtgcataagtgttcactgcagccttctgcagtgagtggtaggagcccatttttaggggaggaaactgaggctaagatgtgcaactggtgagagcaaagttggggactcatctggcttcttggccctggagcactttccctcctctgctcggccctccggcgttacctgttattcatgacggggcaaggcttgcgctgtccccagcctggtcctccgtcctgcatgactggacatgaaggggcatagcagcagccttgccagtggcgctcacagatgtccagcccactaagcctgctccctccctcaggaactctgcttcctttgctgggtgagctgtaacctttcctccttcctgctccaagcagctactgagagtgagagtggttgatcaggaggctggtacgaagacacctaggctgtggccagatcctaaatgtcagaactgggagaggccttagaggtcattggcccctggcgctggttgtctagacacctcgttcagcctcagtctccatagttggaaaatgggaggaatcgtcagcttggcaaaaacggcaacctccggcaacacaaagttggtgcagaaggggaacatgcagactgctggcaggagggtctttgggagggcacttgcagtatctgctgaaatataaagggagagtggcccctgagcccgccgaccccctacaggtagctacctagagctgtgcttctcaaatcgtattgtgcatggaaacgcctggggtctggttaaaaagccggttaagtaccttctaaggcatgggactagcagcctcccaggtggccttactgcttgcaagaccctagtgaggccctagggcacctttcatgcatgggcacaaggaggcatggtcctttgtgatggtatgtcattgcaagaagatgaaagcagcttacatgtctgtcagaaggccttggctaactgaatggtgtgttgttcctgctgggatgctctggaacaattaagaagagggagggagggccgggcgtggtggctcacgcctgtaatcccagcattttaggaggccgaggcgggtggatcacaaggtcaggagattgagaccatcctggctaacacggtgaaaccccatctctactaaaaatacaaaaaaattagccgggcgtggaggcgggtgcctgtagtcccagctacttgggaggctgaggcaggagaatggtgtgaacccgggagacggagcttgcagtgagctgagatcacgccactgcactccagcctgggctggagtgagactctgtcttaaaaaaaaaaaaaaaaagaagaagagggagggaaggaggtccatcaaggtgttgcatgttgatgtgtcttttcttctggaaggatatcagtgccctctggaggctggggctttgtcttgtttactgatttggccccggtgctagaacaaggcctggcacccagtaggtgctcaagcaatgtttactggatgatagaacaaacatgctgacacggaaagacctcgtgttcagtgaacccagtcagtttcaggaggctatgtagaatccaggacttcttaaccttggcactagtgacatttgggactggatgattctttgtgctggggattacctgggcattgtaagatgtttagcagcatccgtgggctctacccatgagatgatccctaattgtaacaccaaaactatctctggacattaccgatggttccctgaatggcaaaatcgcccctggtcccagcactttgggaggccgaggcgggcagatcacttgaggtcgagagtttgagaccagcctgaccaacgtggtgaaaccttgtctgtactaaaagtacaaaattagctggacatgatggcacatgtctgtaatcccagctacttaggaaactgaggcaggagaatcgcttgaacttgggaggcggaggttacagtgagctgagatcgctccattgcactccagcctgggtgacatagtgagagtcagtctcaaaaaaaaaaaagaaaagaaaagaaaaagcaagtgtagatggctcccctccaaactaatcaacagcagttacatcttagaaaagggggaagaacataggattggatcttttactccaaagagacttatgccttctccctccagtttgtaatatagaggttgtaccaatgagttgagcaattaggtgcatcttaaaagtagaaatggcacatggactggcttgtagagctgtgagggtttagtgaagttacacacctggaatgttcagcacagtgtctggctcatagtgggggtgctgccaaaggacaccattgttgttttattgtgttgcatctctccagcagcccctaagcatacagaagcagataagtccttctcgcatatgggcagactggagctcagagagggaaagggactctcctaaggtcacacagcaaaggaggagctaggcttgccttcatgactccaaaataaggacagtttctcctctgccaccctgcggcccccgccgggccgctgggcctcctggtctttgtatctgtggattgaggctgtgtgggctgcttcaagtcccccagcttgttgactgcttggtgttcaccagcccggctggcacccaggaagcaaacaaggctggaaatgtcacggggtgtagcctgtgggagttgtgctctggctttgcccagcagcactgggaggactgccagggatttggagcctgcgaggaaggaccttggcaaagatgttccctgtaggtgggtactggactggcggccagccctatgcagcttcaaagtcatgctgctcacccactgctcaaacatctgccgtggctccctagtacctaagcctaaattttccttcctgtgcctgctgggatagcattccatgtcctacaaaggactctccgtgagatgctagattccagatactaataatagtaataatgatgataagacctagagcacctgctgtttgctaggtgtggaactaagtgcttcacatgcaatatcttttttttctaataaaaaaattgtatttacttagaagcattcagaatgtcaacaaaacagctgcaactttttcttgcaacaaaacactctgcaattacagagtggtattcagttaacagaataattatttcatataagctgcatcagagacaactgaagatgaaaaaactatcatccccatatataactaatttgtgctgtgcaccaacaagaacccgctttaaatttccatgccaatttacagcccccatactgtaccaggcaaggttagcggctattgaaaataccatcaggacagggctatctaaagacacattcggtagtgtgttaactatacaaaaaaagacactgtacagtttaaaaacaaatcttacacagccttacatttcaatttttttctttaaaaggagtgagttgtgtacaggggggttaaatgctttatagacaagaaaaaaaaaactgcgctagaaccaacttattcatcatcttcttcatcttcatcttcttcatcttcctcctcctcatcctcttcgtcttcctcatcttcctcctcttccttctttttcttgcttttttcagccttgacaactcccttttttgctgcatcaggctttcctttagctcgatatgcagcaatatccttttcgtatttttccttcagcttcgcagccttcttttcataaggctgcttgtcatctgcggcagtgttattccacatctctcccagtttcttcgcaacatcaccaatggacaggccaggatgttctcctttgatttttgggcgatacgcagagcagaacaggaagaaggccgaaggagtcctcttgggtgcattcggatccttgaacttcttttttgtctcccctttgggagggatataggttttcatttctctttcgtaatgggccttgtccgcctttgccatatcttcaaattttcctttctctttagcagacatggtcttccacctctctgagcacttcttagaaaactctgagaggttgactgaagcatctgggtgcttcttcttatgcgcctcccgacaagtttgcccaaaaaatgcatgtgatgacattttgcctctcagcttcttaggatctcctttgcccatgtttagttatttttcctcagcgaggcacagtcgcccagtgcccgtccggctctcacttgccccggcgctgtctctgtggagctcagtgtactgcaatgcgcaatatcttatttaatccttacaaaagtcatatggcactgctgcaatatgattctcattttacaaatgaggaacctgatgaccacagaggttaagtgtcttgcccaaagtcatgtagctctgtagccagcatctgtagcctgactccggagccacactttaaccaggagaccatcctaccgtatcttgttaggagagcaagccagcatgatgccagcagagaaggcctctgggtacatgggaagaacccagccaggtgttcaggcctggctgtgccattaacttgctgtgtgaccttggccacactctcctttctgagctcgcccaggctttctccgaggccactgctggctctgcattcccgagctcaaggacccaaagttatgcatcaaatctagaaatcatcttctcttattttatatcgtattacagcattgatatgtatatgatacatatacattgatatgatatgcttctatacccggtctgtcacaccatgtggatttcctcagaggctcctagaaggccctgctgtccaggctaggaggtttctggcagccccaagctccctggcttctgcgtgaaggtgtgaatagaaccatgctgttaagtgggggtttgcagaaaccagggtttgacctgggagagccctaggcagcaggggatgatcaagtgatcaagataatattttaatgcaaaatttgaaaaatcaaaactaacggatgaaccttgaacagagtgtgctaagtggaaaaagctggtcattaaagaacatgctttgtgtgattccatttttatgaaatgttcagaataggcgaactcatagagacggaaagtagagtagtggtctcctggggctgggaggagaagggagttacagtttgatacgtaagggtacgaggtttctctttgggtgatgaaaatgtagcaaaattgactatgactatacgaaaactctgtgagtgtactactctgcacatactagaaacctgtgaatatattaaaccctgtgattatactaaagaccattgaactgtacactttatttttttattttttttgagatggagtttcgctctgttgtccaggctggagcgcagtggcgcgattttggctcactgcagcctctgcctcccaagttcaagcgattctcctgcctcagcctcctgagcagctgggattacaggcatctgccactgcaccctgctaatttgtgtatttttagtagagacagagtttcaccatgttggccaggctggtcacgaactcctgacctcaggtgatcgcctgcctcggcctcccgtagtgttgggattacaggcgtgggccaccgcgccgggcccatgaactgtacactttaaataggtgagttatatgatatgtgcattgtccctcagtaaagctgttatgaaacaatctaaatgcaaaaatatccatgaaaaacaacatataaaaattgtaaataatgtcaggatcagtattactgatttttttctttctgccttggctccagtgtggcttagcacagcgcaacatcacttgtcctatttaaacactttatattttttgtttgtcatggatttttttccactaatctaaaaaagattgcattgaaacattattgatcttggttactgagttttttggcacccccttgagtttttgtgctcaaggacaatgccctgcttgcctcaccctgttcctgccctgccaggcaaggcttttgctctccctagggtggccagggtctcccccaccactctgtcccttccttctctctgtctccccatctgacggctgagaccagcaagcccaccccaagagaagctatgatttgtctgtccagccagtgagtcatgtgtgaggaccacagtagggggctctctccacatcacatcctcctcctgcccacagtgtctcctttgctgctttctcccttctctcccatctccctcctttttaatttttttgttttgttttgtttaaggccaagcacagtggctcatgcctgtagtcgcagcactttgggaggccgaggcaggcagatcacttaaggtcaggagttggagaccagcctggtcagcatgatgaaaccctgtctttactaaaaatacaaaaaaattagccagtgttgtggcccagtgcctgtaatcccagctactcaggaggctgaggcaggagaatcacttgaacctgggagatggtggttgcagtgagctgtgattgctccattgcactccagcctgggcgacatatatatatgtgtgtgtgtgtgtgtgtgtgtgtgtgtattatatatatttttatataataatttttatataatatatatatataaattttatataaaatatatatttttttgagacggagtctccctctgtcaaccaggccagagtacagtggtgtgatcacagctcactgcagtcttgacctcctgggctcaagtgatcctctggcctcagcctcccaagtagttgggactacaggagcatgccaccacacccggctaatttttaatttttttgtagagatggagctttactacattgcccaggctggtcttgaactccagagctcaagcaatcctccctcctcggcctcctgaagtgctgagattacagacatgggccaccacgtctgaccccatctctcttctttgagatggctccctgggtcccccagcagctatcacttggcctccagcccttgtcttttcaggcatcctacaccagagagagcctgtgtcccctcccaggtcacaaccagaccaatgctcacaatttcccaccgtccccaggataactccaagctccttacctggcattcaaagcctggcacagtctagagcttgccaatctcctttccccacttttcctgctcaccactgctgatttctcatcggtagattcagatgggactcacagttattgaagagctgcaaggcattagccacacccctctggtctttcccttattaagcccctatctcacttaatcctcacagcagcatcgctagtaagaattattgggcccattttacagatgaggaaactcaggcccagagagtggaggtgatgctgccaagggtctggggtagatgcaggtgcacgcccagtctggctggcagcatgggactctgaccacctgcctgtgcctcccctcatccactgcggatgtttgctttccctcagggccatgtgtacagtgcctctgccagggtcacccccactttggtccctgttggccttcacactgctaacttagtagccaaggtcacatgccagtgtgtgatgccagcgtggagaggagccatggttcttttataacagttgccatctcctacctacttatatttggggcttgctatgttgatagccgcaggctgggtctcaaattcctgggctcaagctgtcttcctgcctcagctttgtgagcagctgggatcacaggcatgagccgctgctcctggccacttttacttcttaaaataaaatcagaacatgcaaaccatgctccacaatatgccatcaagtgtttctggtgcaaatccctactgctcttgtgtttgatggtggggcgaggaaacgggcaggaatgggaaggaaggtgaatctagactcctgaggcaggaccatggctccctggccctaacagccatagattttgtgtccataacggagccagatgctggcagcgattcttaattggggttccaggctgcattcgggggcctaggaatttggatgaggggaaaattacatctttattgaccctagtttaacatttcctccaggtgacaacataggtgataaatcacagtagtagtggcagcactcgcatcaccagtagaaaccacactttttttttgagatggagtttcgctcttgtcgcccaggctagggtgcaatgacgcgatctcggctcactgcaacctctgcctcccagattcaagtgattcacctgcttcagcctcccaagtagctgggattacaggtggctgccaccacgcctggctaatttttttgtattttagtagagacggggtttcaccatgttggccaggctggtcttgaactcctgacctcaggtgatccgcccacctcggcctcccaaggtgctgggattatagacatgagccactgctcctggcccatatttttatatcacattttaggtgccacagatgtgtctgcttgcagatgacagtgattattctgtctgctactagatcttgttattgattgctttaataaaggagcagataggttacagataatatttcacagcaatttttgtaatcacattcttagccaaagtttactatgttggtttccttttcatcctgtatattttattgtattccatttaaaagcattattctgggaaggggcccatagatttcaccagatggttgaagagatccatggcacaaaatggtggaagaacccattagacctgggtttgagtcctcatgctgccctgcacctgctgtgtgagtgtgagcagagtgtgagcagcccattccgcctctggatttcttattcatgatccagccagagaggggctgtctcccccacagggttgccgtgggaggcctgcagtgggagtcgatgccactttgttgtggtgcctgtctgttgggtgttattaggtcttctgggcaggacgtgacactgggtgctccagcgtgccctgaacgtgttcccaccgcctcctgcacaccccagtctgtctgggcatccatcccactgggttgattgtctgccggctcaatggccgtgacactcattatgggcaggactgtgtccgtcctaataaataatggtacagaattgtagctgatgcctctgagctcacactctttgccagcttcacaacagctccacaaggtaggtgccgttttcagacttattttggaaatgttaaacgttataacaggtgagtgaggctcagagacaagaagtcactggctcaaggccactggtgagtggccacaccaagatcgcctgggtctgtccaactttaggtctacactcctgacccctgcactccacgatgattgcattcctgagcctggcccaggtgggcagccagtgaatagttagctggtgcaaaagtaattgcggtctttggtattactttcagtggcaaaaactgcattacttttgcaccagcctactagaacgctgagttcagtgccttaagcggtgtttcacagagagggagcaaggggcagcgcttgttaaaatgcaaattccctcagctccacgttaaaatgcaaattccctcagctccaccttgcctcttccaaatcagaatatttgagggcaggccccaggaaatctgccttttaaagttttgggctattcagaagcacaccaaagtttaaccactaccctaaagggaaggaataacagtcaggtagtaacaaagctctgttctgagtgctttatgtgagtttatttattgtgagacagagtcttgctgtgtcacccaggctggagtgcagtggcgccatcttggctcactgcaacctcctcctcctgggttcaagcaattcttgtgcttcagcctcccaagtagctgggattacaggcattcaccaccacgcctggctaatttctgtatttttggcagagacggggtttcaccatgttggccatgctggtcttgaactcctgaccccaggtgatccgcccaccttggcctcccaaagtgctgggattacaggcatgagccactgcaagtttatttatttagtcttcacaagtgttaatggcctccccatttcacagatgaggaaagtgaggcacaaagtagttagataacacctccccactgacccccaacccagggctgcattgctaggaatcagccaggtgtggaggattcctgcccctatgctcagtcccctacctctgacagcttctggacagaggagtagagacgggatcccatggtgggtgggggtgagggctcaggaagcactggtccctacaagatcacgctggccctttcctgtttgccttgtttaccaggcaggggccctctgtgtttctgggcaggaagtcctgagcaggggctgtgccaggtgtcaggggcaagactgggagatggtccaggagtctgagccgggcactactctgagcagctgtctgacctggggcacatagcttccccatctgtgtatggggtggggtcgagatttggaagaggtagttaagagcttgggttccggcatcagatagacctgagttccagatcaaactcagccacttatcatctgtgtgatctccaacaaagcacttcacctctctaagcctcagtttccccttctgtaaaacgtggctaataataatagtgcctaccctccaagcctgtcatgagggtcaaaatatattgttggctctccgtcttcttgggttctgcatgcggggattcagccgacagtggatcaaaaatattcgggaaaaaatgggtggttgcatctgtactgaacatgaacagagcttttttgtcctgtgattgttctctaaacaatacagtgtaacaactacctacatagcatttagattgtattaggtagtataattgatctagcactgatttaaagtatatgggaggatacgtgtaggttttatgcaaatattacatcattttatataagggacttgatgtatactggtattcgagggatattctgtaatcagtcccttatgataccgaggggcgactgtatataaaactgccagccaggtgcagtagctcatgcctataatcctagcactttgggaggctgaggtgggaggattaaactcagactggcctgggcaacatagtgagaccccgtctccacaaaaataaaaaattaactgggcatggtggcacttgcctgtagtcccagctacttggcaggctggggcagacagatcatttgagaccaggagtttcaaggctgcagtgaacagtgatcactccactgcactccagcctttgagacagaaggagaccctgtctctttaaaaaaaaaaaaaaaaactgccaggcatgcacaagcctctctgctagtccttacgtggcaacagacaggatgctggatgattccctatgcatgagtgtgcacttctttttcttttcaatcaactatttgttttcccgaattgtacatttttctcttaccaaaggctggccacctgggtcctcccacagtccctactgagaaaagtcccagaaccaaaactggcttccacctcggctcactgtatttgtgctttgtgagtttgcccaggttgcactgagggcaggtgctgctgatagtgtcttttttttttttttttttttttttttgagatggagtttcgctgttgtcacccaggctggagtacaatggcacaatctcagctcactgcaacctccgcctcccgggttcaagcagttctcctgcctcaggctctcgagtagctgggactacaggcgcccgccaccacgcccggctaatttttgtatttttagtagagatggggtatcaccatgttggccaggctggtctcgaactcctgacctcaggtgatccgcctgccttggcctcccaaagtgctgggattataggcgtgaaccactgctcctggctgatagtgtcttttcgtgatatagaccagggggttggcaaactatgcccacgggacaaatctagctgaccgcctgttttcgtaactagtcttatggaaacgcagccacttgccttcatgtatgtgtcatcttggttgtttgcattacagttgcaaactcgcagtggagctcttgtggcccacagagccaaaaacatgggttttatgacttcacagaagcttgcctacccccaagagagatgataaagcagggtcgtcgaaagttggggaaacagtttgggttctggcatcagatagcctgagtttcagttcaggctcaaccaattaccatctgtgtgacctccaacaaagcatttcaccgctctaagcctcagtttccccttcggtaaaacgtggctaataatagcgcccaccctccagggttgtcattagagtaaaaatgcacagttggccctgtacattttgactctaaatgacaacgaacagggagaagaagtcacccctgatcccacctgaccggaccacgcgttccttagtttgtgtgtatgtccctgccagtctttatccatgtgctgtaatgactgatcctaacatcaaaaggcggccaggcgtagtggcccatgcctgcaatcccagcactttgagaggcctaggcaggaggattacttgagcccaggagtttgagaccagcctggacaatgtattaagaccccatttctacaaaaaataaaatattagccgggcatggtggtgcactagctacttgggaggctgagatgggagaatgtgcttgagcccaggtgtttgaggctgcagtgagccatgattgcaccgctgtattctagcctgagcaacagagcaagaacctgtctcaaaaaaaaaaaaaaaaaaaaaaagaaaaagaaaagaaaaggaaaagaattaaatggtaatagttttcttatgctggctctgcctggcttgatggaagttacatagttcccatgacactcttccaggtgttattcccatttctcagatgagaacactgaggctcagagagctgcccaagattgacccaggacacccagcctttgagtgggggagccaggatgtgacccccagcctcatcagtccccacccctggctagtccctaacagagtgctgaactgggcctctgaacgggagactgggacagtgtgtgggaccctgctttgatggttttaggtaaaaaaaaatgcaaagcaagacagggaggagaacacaggctctggaaagagagagacttgagttttccttctagctcccctgcctcccagctgcatggccttcggcaggttcctttacgtctctgagccccaggaaatggatggttaataagggagggtcaaatagggtcaatggttaagacaaaatgcaatgatatatgtaaaacccttagttcagtgcctggtatataataagggctctaagtctgaactaatgtttttttgtttgtttgtttgtttgttttttaggcagaatctctccctgtcacccagattggagtgcagtggtgtgatcttggctcactgcaacctctgcctcccaggctcaagccatcctcccacttcagcctcccaagtagctgggactatgggtgtattatcatcaagcccagctaatttttgtaaagagagggttttgtcttattttccaggctggtcgcaaactcctttgctgtagcaatccatccccctcagcctcccaaagtgccgggattataggcatgagccaccatgcctggcgtgagccactgtgcctggcctgagctaatatttttaaggctgcatgccagcctccctgccctttttccctcttgaaccactcttcatgctttttatgctcaagcagtgtccagagcttcagaattatttttcccttactcacaccccattggaatctggagggctttcttggctggcttccccccgcaataggtcagaggtccctgattcccagggaccctgcccaagagacctgcgtctccccagctctgcagaaggttgaggcgtggtgggtgggaggtggtgtggtcagcgtggtctggtagggttgggaatagccatggcaatggaatgttgggagctggttcccatggggaggaattgcagggctgatggctgagcctgagcacgtgggcactgggccctgctccagggccactctgtaagtgcagtgacctcctgagctggctttgtgcactgccagctccccgctgttgtcccctccctgcccccctgccgcttttctcttgggaacctcctgatctgctgagcttggagaaatgatgatttagaaagttcctatagatttgagccaaaattcagtgtggtctcaatgcaaatgtcactcccttctttccttctttaacccctggggaatgcctccacctctcatcatgggcatttgcttctgagcctttatcactggtgtcattgtctcacatactggtttcttggctccccactggaatgtcagctctatgaaggcaggaacctttgtctgttgcccttgatgtatcccagtatcttgagcagggccccgcacatggtacttgctcagtaaacattggtggaatgaatgaatctgagtctaaggggatctcttagattgattagcccctcccttccagggacatttcagggtcaatggaaagagggagcaaagtttcctcccatggtctcctgctgcccatttgttttttttgtttttttttttgagatggagtcttgctccatcacccaggctgaagtgcagtggcatgatctcggctcactgcaacctctgcctctcaggttcaagcaattctcctgccttagcctcctgagtagctgggagctcccaagcgcgatcccccacacccggctaatttttttttttttttttttttagtagagaggggggtttcaccgtgttagccaggatggtctcgatctcctgacttcgtgatccacctgcctcggcctcccaaagtgctgggattataggtgtgagtcaccacacctgctgaaatgaaaccccactgtttccaacaaccgattctggcttaatctgattattttttttttcttttttctttttcttttttttttttttttttgagacggagtcttgctctgtcgcccaggctggagtgcagtggcatgatctcggctcactgcaacctctgcctcccaggttcaagcgattcctctgcctcagcctcctgagtagctgggattacagccacgcgccaccatgcctggctaattttttgtattttagtacggaggagatttcactgtgttggccaggatggtctcgatctcctaacctcgtgatctgtccaccttggcctcacaaagtgccgggattacaggcgtgagcccctgtgcctggctgctgcccctgttttatgagccgcatgacaccacgctagggttggcaccttggaggcagaaccgcatttggaaactggcctttcctcttacttgttgtttggcttctgctaatcactccatctcttggagcttcaatttcttcacttctcagatggggataaaaatctccaccatacaaggatttgctgaaaacaagagccagcaggcaggtagcacttgctctgggccaggtgctgttccgacatgccctaatttatttatacctcccagcactcctgcaagactagtttctcatttgcgctaggcacatttcaaagtgcccttctaggaggtgttacaggctgcgtatccctttatctgaaattcttgggactagaaaggttttggatttcagatttttttttcttttgaggcaggggctccctctgacaccgaggctggagtgcagtggcatgatcatggctcactttagccttgacctctggggttcaagtgatcctcctgcctcagcatcccaattagctgggactacaggcaagcaccaccacacctggctaattaaaaaaaaatttttttttgtagtgatggggtctcactttgttgcccaggctggtctcaaactcctgggctcaagcgagcctcctgcctcagccctcaaagtgctgggattacaggcatgagctaccacacctagcttgaattttttccgagtttggaatatttgcatcatactaatcagttcagcatccatactccaaaatgctctgatgagcttgcttgcttgcttccttccttcctttttctttctctttcttctctctttctctctttctttctccttccttgcttttcttctttttcttccttttttccttccttcctttcttctttctttctttttccttttctttctcctttccttacctttcccctttcctttcccatgccctacctggtttcatactcacatcagcccaatcaggcgggtggtgccatgtcctcccccttcccctcccccgcctcctttccccctccctctcccctccccttccctttcctttcaagatggggtctcgctgtattaacagcccaggctggtcttgaactcccaagcttaagtgattctcccacctcggcttcccaaagtgctgggattacaggtgtaaaccaccatgccccacatccgatgagcgttttctgtgagcatcatgttggcactcaacaagttttggattttggagcatttcagattttgaaattttggattagggctacttgacctgtattatcatccccattttacagacgagaaaaccaagtctcagagaggctaagtgacttgccaaggtccttcagccagtagctggtgcagcagaatgttgaacccaagcagtctgggcccataacatgtatggcatacaattcaaaaattactagtcactttattattttatcatatggaaagacaataagatgacaccatcaagttatgtttttaggagaaaaatatcacctaccacccgagtaccacccctggtagcaatgttttttgtttctttgttttgaggcagtctcattctgtcatccaagctggagtacagtggctcgatcatagttcactgcagccttgatctcctgggctcaagcaatcccccaacctcggcctcccgagtagctgggactacaggcgtgcaccaccccctgcttggttaactggtagcagttgagtcatatttccttcttgtcttttttcttaagtgtggtttctatttgttggcgattttgctgtgtggtagagtcgtgctcaccctgcacccacgtgggcctttcttagcttaaaatggagaacatgccaccacctgcctgactgggctgatgtgagtatgaaaccaggtagggcatggaaagcccttgctttggtgttaaatacacaggggtgctgtgtatttaatatattcctcctacaagaaaaggaggggctgggtgaagtggcccacacctgaaatcccagcactttgggaggcacaggcaagagtattgcttgagtccaggagtttgagaccagcctgggcaacatagcgggactccatctctacacaaaaatacaaatattagccaggcatggtggcatgcacctgtagtcctggatacctgggaggctgagatgggaggatctgggaggatcgcttgagctcgaggaagtcaaggctgcagtgaacgaagatcatgccactgcactccagcctgggctggacagagtgagaccccatctcaacaaaaaaagaaaaaaaggagagctctttgactcctacctctccctctcatttgccctctaatcagcactgcccagcagaacactctgcagtgatgggaatgttctagtgcagaggtcagcaaatttctataaatgtccagatagtaaatgtttccaattttgtggtgttcatgtggtttctattgccattgctcctcctcctctctctcctcttcctcttcccttcaccctcttcccttgataaaatttacaaatcattcttagttcaagagtgatttgaaaacaggccctgggttggattgggccatcattggcctaccccatcctaaatgtgcactgtccagtacagtagccactggtcacatgtggcttctgggcacttgcagtgtggctagtgcaaatgagaagctggattcttaattgtatttaatgttgcataaggtgagttcaaatagttacatgtggctggtagctgcatgttggatgcacagctccaaatgactgacagccctgacaaccctgttccattgctctgaaagggcctgtgttccctggagggggatggctgggctcgtgggccatgggagctgcctggctggcaggcctcttgggctcgctggcatttcaagagctgtctgagggcagctgggcgagccatcctgcctctggaagagcttcaagtgcctggttcctaattggttttgtttattccaagagagcaggcctcacatcattgaccgcccatgtcccaggagtgccggggcttgagtatctatagtttgggggtggcctgctgtgggggggtctagttgctgtggttacaccttggttcccttttccatctgggtttagatgtcctaattggcctgatatttcaggaataggaaaatggtatggagaaaaggagtgagtgaataggaaggaatggaggaccaagaaacgcagtcaacaccctgcagccggtttattgccatcatggcacaaataataaaagctgagttttttttttctttttttttttttttgagacgtggtcttgctctgttgcccagactgtagtgcagtgatgcaatcacagctcgctgcagcctcgacctcctgggcttcagcaatcctcccatctaagcctcccaagtagccgggactataggcaggtaccatcacctggataactttttattttttgtagagactgggtctccccatattgcccaggctggtctctaactcctgggctcaagcgatcctcctgcctctgcctcccaaagtgctgggatcacaggcgtgagccaccaccccaggcctggctgagatttaaaaagctgacattttaaagtgttgttaccctggttaaaatctcctgtttacagaataggaaaagtctgagaggagtgatatgtatactcaaggagttggccaactccagagctgcattccaaactacccacctcctgaaacaggactgacaggtgggaggtttagcttcagactcagtatgtgagtctgtaaaatgatttttccttgtgggcctcagttgtcccatctgtaaaatgggggaaggtttgaattggactaaaaatcttccctaccctaaatggtaaggacacagcactgggagatatatactccctgccctaaagctataaggatccccttgattccactttggcctggttctggctacatgccaggactcatcgtggacacagcctcgttcctgtaaccatgggagattaagtgttaggaaggtcttacagatctggatggtgaaactctttccatccattccttgggtaagttgctcttcctcttggtgtcatgctttctcatctgtaaaattgggatcatcacactttccttttattggggtttaaatgacacaggtatttgcgtggtcagcatttggtcagtgttaggtggtgacagtaggatgttgtgttcaattccaggaagcagcatattccttgtaggctgggcctgtggtaccatttggaattgtgcagtccacaacctgatcaaccatacccagccatctcaggtggcaatagtggtgtgtagtggtggttgttgttgcttattgttatatttacttttcctggagtccaaggtccctaggccaagaggaggggagaggcctggttggcataaaccaggggctccctaaggcagcggcgccttagctcagacttcagctcacacctctctgcctaagaagtgagccagttcattccctgtaggagtagataagttgagactccagctgtggtatcttgagctgaagcagcctcccctgcattccagagtccttctcccaaatgtcactgtccagtgctcttgggagcctaaaccctcactctgcctctttgaaggcttggcccctctccacagtgcccatccctgatgcaatatctcctttgcctctccagggctctgccagcagacagccttggcacacaggcacaagggctggagcccagagatgagagtgcccaagggaggtaagtgcacctagaaggaacttcccctggagtcctggcccctcctgagaccgccctccaaaagtcccctccatgcccccagcctccatgattgggtgcctgggcaaactcccctggctggttttcacctttctgttcagccagcaggttggaaatctggtactagaaaaagctgcatcccagcaagcatcatagagagatgagcatcttccttgtctattaggaagacgattctccaggtgataggagagagaaggctgagtcccaaagtgggcgggggacttgcccagtgtcacggagcagattcaagccagaacccaaacgctgttgtgtcccgttctcctaatgttagtgttttaggtatgctttctcagcaccccacaggagttccttggccttctgaatagcttccttgagaaaagggtattattattccttttttggagaagaaagtagaagctcagagaagtgataccttttgtccagatcaccagctggcaagtggcagcagaagtgagatttgaaccttggagtgtagtactccaagttagaagccctcacctatcatcctcactgcaaggatgccaggatacctcccttgccagggtccagcagggtgatgagggtgttgggcaggcctagttccctgggctgggccctctagctccttccacagtggggtccctagctctgggtaaccaggaagctactttctgctttgtgggttccaggctgctttctgtgtcccaagtcaccctgctttttcttcttaagccatcgtgcaggtcgttgctgtcttctgctcacttctgacttgcctgctttgagctgttttcttcagccttggcctggtctgatccaggattcctgccctggccatgcaaccttgggcaagctgcttcatctctttgagcttagatactgcagggaaaatgctttagcagagtttatgctccataatttcgaacacctttgctgaacataaaatgctgaagctggccgggtgcggtggctcacacctgtaatcccagcactttgggaggctgaggcgggcagatcaccttaggtcaggagttcgagaccagcctggctaacatggtgaaaccccatctctactaaaaacacacaaaaaaatcagccaaggtggggatgctgtcactgaaatcctaataactgacaggattctggtcacaggtctcaggggagaatttcactgagcacctgatgaagacaaagggtcgttgcagggatttcggaatggcttcatgtcctgttcagcctgcctccccgcaggaagtagctctgaattagctttctccatcacagaccctgaatcgagggtacaaatgaagccccaacctcttcagcagaacttcatcagcacgtttttctgaagagagggaaattatccaatgcacagagaggccggtgaccccagcctgagatccatctctggtttgtcagctgcttctcatattttcacagcagcctctgaggtcagtggatccaccctgattttgcagctgaagagactgtggctaagatgagggaagtgactctcccaagccacatggccaggaagtcctagcctcttagcagtttccaccccaggcctgagactgtgttccctccgctttgatgtttattttccacttgctatagcctaagaaggcccaggcagcccaagcccttgcaggtggataggcccagctgcagactgggcccttgggtggttttgggtggaacctcacatccaaagaggcatgctgtcttcccactggcttccaccaaaccctccgttcactaagtcacttgcagttccccagtcgtgctgcatcctttcctgcctgtggctctgcgctggctattccctttgctggtaacatccttgtttcccttctccacctgcctgtttcctacccaccactgaaaattctgcatgaaggctacctcctgcaggaggccttccctcacctacgcaggtagaacccatcaatctctctcaggcacaggtccatggtaagagtagactttggaggctgaggctcccagcacatagcaggtgctcattaaatgttggaataagtaaataaccaatgattatgatagaaatcactaatattcttgggccagatggggtaactcatgcctgtaatcccatcattttgggaggctgaggcgggaggatcacttgaagcgagaccctgtttctaaaaattagccaggtgcggtggtgtgtgcctgtagtcccaggtacttgggaggctgaggcagaggattgcttgagcccaggagtccgaggccgcagtgagctatgatctctcaccactcaatgcactccagccttttttttttttttttttagacggagtctcgctctgtcgcccacgctggagtgcagtggcgcagtctaggctcactgcaagctctgcctcccaggttcacgccattctcctgccgcagcctcccgagtagctgggactacaggcgcccgccaccatgcccagctaattttttgtattttagtagagatgggatatcaccgtgttagccaggatggtctcgatctcctgacctcatgatccgctggaccgggtggctcatgcctgtaatcccatcactttgggagacaggtaggaggatcacccaggcccacgagttcaagagcagcctgggaaacatggtgagaccccatctctttaaaaaaacaaaaaaaattgaaaaaagtgcccagcagggtgccaggcacacagctagtgcttatgaaaggtgccctctgcattcatgtcagcagcctcttgtttgcagttatagggctttgcagttattggagagctcacagctcacagacctccctgactatgcatgtccccctctctccccagatgtgagcctggcgggctgcccgctaacctgtcgctgaagccccagaagcgggccctcaggccaggcctaccctgcctccggcccagcatgcgcctgtcggtgcggagggtgctgctggcagccggctgcgccctggtcctggtgctggcggttcagctgggacagcaggtgctagagtgccgggcggtgctggcgggcctgcggagcccccggggggccatgcggcctgagcaggaggagctggtgatggtgggcaccaaccacgtggaataccgctatggcaaggccatgccgctcatcttcgtgggtggcgtgcctcgcagtggcaccacgttgatgcgcgccatgctggacgcccaccccgaggtgcgctgcggcgaggagacccgcatcatcccgcgcgtgctggccatgcgccaggcctggtccaagtctggccgtgagaagctgcggctggatgaggcgggggtgacggatgaggtgctggacgccgccatgcaggccttcatcctggaggtgattgccaagcacggagagccggcccgcgtgctctgcaacaaggacccatttacgctcaagtcctcggtctacctgtcgcgcctgttccccaactccaagttcctgctgatggtgcgggacggccgggcctccgtgcactccatgatcacgcgcaaagtcaccattgcgggctttgacctcagcagctaccgtgactgcctcaccaagtggaacaaggccatcgaggtgatgtacgcccagtgcatggaggtaggcaaggagaagtgcctgcctgtgtactacgagcagctggtgctgcaccccaggcgctcactcaagctcatcctcgacttcctcggcatcgcctggagcgacgctgtcctccaccatgaagacctcattggcaagcccggtggtgtctccctgtccaagtgagtggagcccctgatgcttccactcagactctggccctggagtcagaggcgccaggcaagaaaatcagcactgcctttcttgagctgtgtggccttgggcaagtcactatatctctctgagcctccgtttcattatcccaaaaaatgacaacaattactcctctcctttctgagagaatctgcaaacttcgtgggctgtttgtttgttttttgaggcagtgtctcggtctgttgcccggctggagtaacagccgccacctccctgttcaagtgatcctcccacctcatcttcctgagtagctgggactataggcatgcgccaccaagctgggctaatttttgtatttttggtagagatggggtttgccctgttgcccaggctggtctcaaactcctggcctcaagcagttcttccacctcagcctcccagagtcctgggattacaggcatgagccaccacacccagcctagaatctgcaaactttgaatatgctttgtagtaaggcaatagtgggtaaaggttaagagcacagattccagaacaaggatgtctgggttcaaacctcagctctgccacttcttagctgtgtgaccctgggcaaagcgactcaacccctgtgcttccattgcttcatctgtaacatggaaatataatttgcctaccttatagatacctgtgggcatcaaataggttaataaatgttaggtgctattattactattttagtgttgatactgcttttattgatggagtacccatcctcaccattgtcatttaatgagtgcctactgtatggcaagtattgggttaagcccccaacaagtttatctcctttaatcctcacagcaacctgaggacataggaacacctcttatccacattttatagaccaaaaaactgaatctcacagaggagaagttactggcctcaggctacacagctaacaaagcatggtgctgggattggaacccaggtctgttttttggggtttttcttgtttttgtttttgtttttttgagacagggtttcactctgttgcccaggctggagtgcagtggcacgatcccagctaactgcagcctcgacctcttgggctcaagcaattctcccacctcagtctcccgagtagttgggactacaggcgagcatctccacacccagctcattttttttttttttttcctagtagagatgagatctcagtatgtcttccaggctggtctccaacccctgagctcaagccttcctcctgccttggcctcccaaagtgctgggattacaggcccctggcctattgtgttcttaaactccccatgtccagaactcctcccatcctccccttcactccccctcatcctttcctttccttcctccctctgtcccttgctccctgccttcttccattggaaaagctgctgtccctatcctgagacccagagcactttgaacaatgctggagcagaatatgcagtttccacgctttcccatcctgatcaggctctggatagcctgagagctcagtgaaagggtggtccttcccatggctggtccttcccatggctggtccctgctgggccccttcccaggcccagagcagagctagaggctcgcagctgctctccgctagcaacaaagttcctacatgccgggtaccccagccagttggtgctggagctaggattttataaattattatgacaaaaatattagattaccaaagtaatacatcttgactatagaaaattagaaaagatacaccaaagaagaacggagaaacaacccatgatctcaccacccagatcttgatgtgtggcctactgcaccattttcagggcctgttgatgaaactggagtccaacgaaacatactcctctgtagcctttttccacggtggtgtgggagcccttgccagtggcagccagcactctttggtagcagcatttttgttgttgttttgttgttgagacggagtctcgctctgtcacccaggctggagtgtagtggcgtgatctcggctcactgcaacctccgcctcccgggttcaagcagttctccctgcctcagcctcccaaatagctgggattacaggcacccgccaccacgctctgctaatttttatatttttagtagagatggggttttgccatgttggccaggctggtctcgaactcgtgacctcaggtgatctgcccgcctcagcctccccaagtgctgggattacaggcatgagccaccgcgcctgacctgcagcatcattttgaatagctgtgcgacaggctgctacacggattgccatattcgacttcacattccctattgttggacacttcggttatttccagttttactgatatgtatcaagcattgccctcattcatgttctgggatgtgtccacctcatttctgcaccataaagtcctagagacacaaggattttggcaaaagccatgcacatactcaagatttttgacatattgggtagagttaagatttaaatccaggtttgcagcctctgaatctgtgttctacccaccagtccacaccctttcaccttcccctgttctcctcacctcacgcccggtcttgtcttccttttgctgcctctttctgttctttcccaagtcacctcttagttgggatgaaaacatttagaactaggcccttgatcctgggggttccccaccattcatcctgtcaggcccctgagttataattggtaagatctgcatcattcaggtggcttgggaagcctgttacagggagagttaggaagcaggttgaagatgatggttattccatggtagctgtgaaaagttggaaacaacctaaatgtctgtcttcaggggaatggaaaaataagtgatggaggaaggctacatagctggcaaaaagagtgaggtattgagtggggaaaaaaaactagcgtatttgttttacagctgcagacgcgcgtttgtgtgtgtgtgtgagagagagagcgtgtgcacaggagagagagcatgctaacccttattaaaaatttacaatgtgttggccaggcacagtggcttatgtctggaatcccagcactttgggaggccgaggcgggcagatcacttgaggtcaggagttcgagaccagcctggccaacatggtgaaaccccgtctcttctaaaaatacaaaaattagctgggcgtggtggtacatgcctgtagttccagctacttgggaggctgaggcatgagaatcgtttgaacccaggaggtggaggttgcagtgagccaagattgtgccactgcactccagcctgggcaacagagtgagactccatctccaaaaagaaaaaacttacaatgtgcctacgctcttctaagcactttctttgtattaactcatttactcttcagacaaccccagtgaggtaggtactactatcattgccaattacagaagaggaaactgaggcccagagaggtgaagtaactttcccaaggccacacagctggggaacagctggcgtctgaacccaggcaatctggctccctggtttgctcttaactactctacaagaaaaggttagagaaggtggtgtgctccacagtgcaaagactgagtgcctgtaggaagccgatgggctggcagtgatgaacacagtggctttcagctttatcattagtgttttataactttttttagggacaaaatattcatgttagtcatacacattaaaaagtgtttcttttttttttgagacagggtcttgctctgttgcccagtctggagtgcagtggtgcaatcacagctcaggctcactgcttcttcaacctcccgggctcaagcaattctcccatctcagcctcctgcgcagctgctgggactacaggcgcttgttaccatgcccagcttatttttgtaatggggtttcaccatgttgcccaagttggtgtcaaactcctgagctcaagtgatccttctgccttggctttctgaagtgctgggattacaggtgtgagccactgtgcctgacctaaactgttgttattttttaagctggagaagaaagcagaatgtatgtaccaatggtgtatactgctagtactttcttctgacttctcactgcatgctgtgttcccattgtacaaaggaggtatgaggaggcaaaaatgactcacctgccatctcacagttgatggggcagagctgggtggaggccaggtttctccagtctttcctgctgccccagagtggctgagcagggaatccgctcaggcgccatctgggtctgccctaccctctccagcgtctcctctctccccaggatcgagcggtccacggaccaggtcatcaagcctgttaacctggaagcgctctccaagtggactggccacatccctggggatgtggtgcgggacatggcccagatcgcccccatgctggctcagctcggctatgacccttatgcaaacccccccaactatggcaaccctgaccccttcgtcatcaacaacacacagcgggtgagtgtgcacctgtacttgtggaagtgtactcttggggatatggggcttctgcagatgtggaaactccagccacctgaggaaatgttcagtctctcaattcctggtcatctgatttgttcctgtctgatggacacagtgaactacatgattgcttgtatttccattttgcttgggctgcagggaagctcaaagccaactggtagcctgtctctcatactctaacatctaacagcaggccagcttgtacactaatttcatcttatttctctaattttatttacatttttacccctatttccctggctatttgtttatctgtttgtaaggcacctcaagtctttgttgagagggggtataaataaataaactattggtccctttcttgtcttataaggtttaatgtggatttctcagacaaatgtgagtttagggctgtttaaattatgcttaaaattctccttagttaagatggtgaagggaaatgacttttttgttttgtactgttttgtttgaggcatggtcttgctctgttgcccaagctgggtgcactggtgcagtcatagctactgcagcctgatacttctcggcttaagccatcctctcaccccaggctcctgagtagctaggactgcaggtgcacgccaccatgcacagctaattttaatttttataaaggcggggtctcgctacgttgcccaggctggtctagaactcctggccgtaagggatgcccctgcttcactcttcccaaagtgctgagattacaggtgtgagcctccagtgactgacaaaatgcttttgaagtgttaaagtaggctaacacccactgggtaaaagaacagttaacaagttgatggccttatttatacgtttccattacagcttctagtttactttaagtgctgtgttctaacttccttataggcaaatatttgaaaatgggacccaggcctgaggaagagctttcacagcccttacttcattaagacccagagtctttaatttaagctaagctcagcatttctgagcgtgtgctgattttaggaaataaacagttatcgtattgaatcacaacggaaaaaagttaatcgtctcttagttccgtaactcttcagttggctcaagaagaaagtttccatttggtgctaaaaagtcattaccacctctctagcactcactgatctctctttaacaaagagaatttactaacgctgagctttgggggctgtgcccttgtaattgaagtgtaagctttgtctgtgggtctcgtgagttcctcttcctcttgacattagttgattttgcagacatctatttatggaaatactcagagattcaacgtacataccagccgacattgacaggtgaatggctgcaacccagatgtggtttgttatttttattataaatattattaatttttattttattattctttaataatagtaatctttaaaccctacttatgtgttttacatacttttatctgcctgtgggttgtacatgtattatcaaaataaaaaattaattaactggattaaaaagatggtagtgatctcacaatccagccccaggtgcttctcagaagcagaggcgagggccggctggggacactgcagtagtgggctggatgttgcttacttcactgttctcagccaagggcccagcagtggctcctctggggtctccttaaaaggtggctcgctgcccctggcttgccccaggctatgggtcggacgttcctggagtaaagcctgactttatgtattttataaaacacaaataattttcatgagcactggtggttaacatcaactctttggagctttttgtgtttgtttatttaaaatggaagctgtctctcattttcatccaaagagatttcttccctggggcggtcaacaagtcttggcaagtgctagatccctggtttagtttttgccatagcttggctgttactgcaaagaaaagtcctctcactaagccctgtgagtttgcatgcatgcctgtgtgcttctgtgagtgctgtggaccctgtgtgttccaataatggatcctggggctcagtaaacacagtggctaaaaggacatctatgctgatgaaatcgtctctgcctgcagtgtcccatacggtagccactagccatgtgtggcccctgattctgtaacaggaggctagtccaaagtgagaggtcctgttaggtgtaaaatacacactagattttgaaggcttaggacaaaaaagtatgtaacgtttcttattagtcacttttatataaattacatattgaaatgttaatattttacataggctggacatgatggctcatgtctataatcctagcacttttggaggccaaggcaggcagactgcttagcctaggagtttgagaccagcctgggtaacatggtgaaacctcatctctactaaaaatattgaatattagccaggcatggtggcacgtgcctatagtcccagctactcagaaggctgaggtgggagaatcacctgaggctgggaagtggaggctgcagtgagccgtgatcgcaccactgcactccagcttgggctatgggagtgagaccatgtctcaatagaaaaaaaaaaaaattagctatatcaggttaaataaaagatattgttagaattaatctcccttgtttcattttattttaaaatgtgactactagcggaaaggcctgaaatgttgtggttctaacttcagggcctttgctctgttgcctctgcctggagtgctttttcttctgagcttagcctacctatttttccttgtcgtttgggtctcagctcaaaggttatctatttcaagaggccctttttatttttatttattcactttcttagagacagggtctcgctctgtcactcaggctagagtggagtgatgtgatcatacttcactgcagcctcaacctcccgggctcaaccaatcctccagctgaggctggagtagctccagagcagctgggacgataagtgcatgccaccatgcccagctaatttttaattttttagaaatggggtttcagtgtgtttcccaggctgatctcaaactgctggactcaagtgatcctcctgccttggcctccagaagtgctgagattacaggcatgagtcactgcgcctggcccaagagtcccctcttgaccacccactcaaaagaagccccctggttactcctaatcccacctctttactgtacttttttcacaacagttcccatggtttgctatgtccttgtttatctgtgtttatttttcttgtatgttatctggtgccccctctagaatggtagctccaggggaacaggaatttccattatctggttaacatcatgtcaaccagacacaatgcttagaataatgcctagaagaagaggagcttaagcaatgtttgttggatggagggatgggtgggtggcgaggtggatgggtggatgactggatgtgttgggaatgactaaattttattttttggccattttcataatagtgatatttctttttctcttccttaggtcttgaaaggggactataaaacaccagccaatctgaaaggatattttcaggttagaaaccccaaggggaattccgaattctgtctttctcagctataccaccatctggctgtatgcccttagatgtgtcacttctccactctggttgatggttttcccattataaaaagggggatgtgagctggctgcctgtaatcccagcactttgggaggccaaggcaggcagatcacgaggtcaggagttcaagaccagcctgaccaaaacggtgaaaccccgtctctactaaaaatacaaaaattatccgggcgtagtggcacacacctgtaatcccagctacttgggaggctgaggcaggagaatcgcttgaccctgggaggcagaggtcgcagtgagctgagatcacgccgttgcactgtagcccgagcgacagagcgagactccatctcaaaaaataaaaataaaaaataaagggctgtggggatgcgtgctggaccagagggtctctaagcactgatccagctggggccacatctcagtggcccttctgccaggaagcagcctctcacttcgtcttccggcttgaatgcagttggagggacttcgtggggactttttcttgggctttctttcttgttgagactggagtgcagtggtgtgatcatggctcactgcagcctcaatctcctgggctcaagcaatcctctcacctcagcccctcaagaagctgagactacagacacacaccatcatgcccggctaatttttgtgttttttgtagagacagggttttggcatgttgtccaagcttgagttgtattatttataataaacaggtagcagttagtaaagtgttttccctagtgtcttgtgagctgttctagtgaattatcaaaccagagtgggggttgtgggaacctccagatttgaagttggctgggaagaagtgtggatagcctgcgcaccccattgcagctggcatctaaagtggggcagtcgtggaactgggcccttaatctgtggcagctgatgctaagtaagtctgggagctggtgtcagaactgaactgaattgttgaacacccagttggtatccagataatcagagaattggtcactgatattggaaagcacccataagccaatatctgaaggattaaaactaggtctgccacacaaagatctggatagaaaaggcttcccggcagagggaactgtaaacgcctgaaagtggggagtgtggccgaaacctctggagtgcgtatgcacttttgcattcgttgcaattatatttttctttgtttctaccccaatgtgatttacaggaatgttcattgcaattttcatgttcaaactgccttgttttgctttcttaatattttcctatcttttgagtttcaccggcaccattttggatggctacgtagtgttctgtggaatgcatgtgctaccatttactaaacagcttcttcaagaccatttccagtttttacgacatccagaatgacattatgtgcacagtggaggacagtagggagatgagggttggaaatagaggcttgacaaaacttatctgcagggcagccctcctgagcgtgggggtatgccattccttcatattttgttcctaaaagcaacaaaaaccagtcccaggtcagctagacatcttgcatatgtcatacacggcaggaagtataaactggcccaacccttttgtttttgtttttgtttttgtttttgagatggagttttcctcttgttgcccaggctggagtgcaatgcggtgatctcggctcactgcggcttctgcctcccaggttcaagcaattctcctgcctcagcctctcaagtagctgggattacaggcaccggccaccacgcctggctaatttttgtatttttagtagaaaggggtttcgccatgttggccaggctggtctcgaactcctgacctcaagtgatccacccacctcggcctcccaaaatgctgggattacaggcgtgagccactgctcctgaccccaacccttttgtaaaacacttttagccttgttgttcaagagtcttcaaaagatctgaacccttccacctgctcctgctgattcctttttttttttgagatggggtttcactgtgtcacccaggctggagtgcagtggcgccatctcagcccactgcaacctccacctcccgggttcaagcatgattccattttttagaagtgaattctaagggaatgattcagtagagcttcagtacccaacagaagagaggcagaatcaggatgtgatgtcatttaaaatactgcaaaaattggaaccattcttaggtaagcagtcagtaaacggtggtacatgcactccacagaatatctgtagccatccaaaatggtgctagtgaaacccaaatgatgaaaaaatagtaagaaagcaaaacaaagcagctcatactatacaattgcaactaatgtaaaaatgcatattcaggtggacaaaaaaaggcaacacgcaggagttgggtgcagtggcatgcctgcagtcccaggttctcaggaggctgaggtgggaggatcgctggagcccctgtctcttaaaaacaacagcagcaacaacaacaacaaaaacgaaggcaacgtgcaaaaatgagaagtttcagtttgtggataattctcctcatccccactgtgttgttctgcctacatcatctttttggttaaaacaaatactaaattagtgctcactaattctggctactttcttgacgtcagcaaaagatagatctctgattcccacaaagggagtgggacctctccccaaacaaccaggaaatgctcaaaagccatggtccctagctctcagatcgcattaattttttttttttaaattcaaggccaacacagtgagaccccatctccctacaaaaaagagaaagccttagctgggtatggcacatgtggcacatgttcgtgccactgcactctggcctgggtggcagagtgagaccctgtctcataaaaaagaatacaactcaggtacagtcaaatgcaagaagcgtagggtgaggtatgggggatgggtcacagaacatccatgccctttcccggcatgacaccctcccagcctctcaatgtgtttaccaaccaggaagctttccaaattctgtcatttagagatttcatcatagaggcatgactgattaaatcatgggtcatgggtgattgcccaatctccagctcctagcccctagaccctctcccctctcccctcccaggaggtcagggaggggagaaggcaggtggggcttaaagttccaaccttctggctgggtgtggtggctcatgcctgtaatcctagcactttgggaggctgaggcaggcagatcacttgaggtcagcagttcaaaaccagccgggccaacatggtgaaaccctgtctctactaaaaatacaaaaaatattagccattcgtggtggcacacgtctgtagtcccagctacttggaaggctgaggcaggagaattgcttgagctcaggacgcggaggttgcagtgaaccaagattgcaccaccgcactccatccagcctgggcaacacagtgagactccgtctcaaacaacaaaaaaagttccaaccctctaatcatgccttggtctttctgagaccccttcccctaatcctgaagctatctagggacccccagccattagtcatgtcattagcatgcaaaagatacgttttgttttttttttgtttttgtttttgtttttttgatacctagtctccctctgtcacccaggctggagtgcagtggcatgatcttggctcactgcaacctctgcctcccgggttcaagcgattctcctgcctcagcctcctgagtagctaggattacaggtgcccgccaccacacccggctaatttttgtattttagtagagacagagttttgccatgttggccaggctggtctcaaactcctgacctcaggtgatccaccctcctcggcctcccaaagcgctgggattacagccatgagccatggcgcccggccaagatacccttattccttcagagattccaagagtttggggagctatgtgccaggaactggggacaatgaacaaatatttattattataccacagctgaaatgccatcttgtagagtcctttcctggccaccgtttttgaagtagcacagatactgatcactcatagcagcctgtcatattgcccaagtttgacattttcttgcatctgtgtgtgttcagtaggctttttcttcaactcgaacgtaagttccgtgatcctaggtttgggtctgtcccgctcaccacgctatcccagcacctggcacatagtagatgtacagtaaatactacgtgaataagcatgtgcatgactcagtgatgctgaggggtgaccctcaatacagcaaggcatccctcacctggccgtgaccccttcttctgtgtattgtctttctccaggtgaaccagaacagcacctcctcccacttaggaagctcgtgatttccaggtaagcctgtggacttcactgggggttcccgctgcttctgggtggccccggagccacttttctgaaaagccacttttctgtccttccagagcctccctggggtagacatgtccactagggtgggctgacccagccccatcagaggtttccatggtgacagactgggggtgctatttatagaatcaaggcttagttttctagctctggatcaaggacagggagagggattaacgctgaaccaaccagaaaaaggtttgtctgacactggggacagggcaggaagcaccactatgatgggggagggggagattctggaaccatttttgcacagaatgctgtctgccagtctggcttctaaaaacagcatcagcgttgggccagagcaattaatgttctaataacagtcacaagtcgttctgttctaagaataacccccatggccgttgggccaggtactggtcctgtgttactcatttaaccctcagcatccttgggaggcggatgacatgatcattccattttacagaagagaaaaccaaagcacagagaaggaagggctttgacttgcccaaggctacacagccaccaagggacagaattcctcccaggtttgcttttagtgaatgattttaagtgcacatttatccatccatattctactaaggggtcgggaaagggattttttgaacttggtaattcaaagatttaagatctccaggtttaactcccttcagcccctgttttcttcatctggagaatgggcattcatcattgcccacctctgaggttggccatgagatggcgtgagctggcccaggtgggagtgcttggaaaccgtgaagtgctgggccctcgctgtggacttgggcactggagttaaggctgcatgagtgagctcacttccttctgtcccccagcctctatgatcaggttaaaggaaacctcaagagaggttattttacatggaaacaccttccagcttggactcttatttttagtctctgtatctatttttaaacaatcagcatatgttttagtttttctttcaatttactttgctccaacctgcaaggactctgtcattattagggttcccatcttgagttgcactaagatcccagagtttttgtttttgagacagagtctcaccctgttccccaggctggagtgcagtggcacgatctcagctcacagcaatctccaccttctggggttcaagtgactctcgtgcctcagccttccaagtagctggggttacaagtgtgcgctaccacacccagctaatttttgtatttttagtagagacggggtttcaccatgttggccaggctggtctcaaactcctggcctcaagtgatctgcccacctcagcctcccaaagtgctgggattacaggcatgagccaccacacctacccaagatcccatagttctattccaaagaaaagaaccctctcatgaaaaacagctttcctccctgttcctcactaactgttccctcgctgcctttctgcagatcattagtagaatcctggaccttctcattgacaaaagcagatttgttacttgttttactgtttaaatgagataccatatagaggtgctttagctgaatcctgggtacagagttggccttgaacaaacatgagtccttctcttgcctccaagaattcatcagtatttatcacataatcactgtcatttgctctgtgtccataagaaaagtgtatatttgaggtcaagtggatgcaagatgagatgtggggaagaacccaggaaacgtttttaaatttaaactctctctggccatctgggatgcattcttaaaacattacatgcttatgcgaatggatgaagacagtatgttctgcaatcacatgtataaatataaatgatctatttcagaattgttactctgagcctaacacagtcttccccactttcagatctccgcaaatgacttcattgccaagaagagaagaaaatgcatttaagtggaaatcggacctctaatccaagcatattgcttgctattaatcgccaaaacaggactgctgatgaggaatgtatttgcatatgtttgcaaaagctgaatcattgaaaacgtaccttgaaactctctatctctggacactccagggtagagaatgaagggtatggaagtagtccggcttttgaaacttaggtattttatatttttcccctcaagaacttttttttaagagacagatttgccatcctccttaatttgcaggactgccttggtggctttgtttgctgggacaaggcccacaacctgtgcctctcctattgacccttactttgaattcaaagaatctatttaagagtttaatatatgaggctttctttgattcctcctcagttctacctagtttcacagaggaaaaaaatactctttgaataaagtgaacagaggctcatttgtttgtgccttactttactgaatgaatagggttttttttttctttccatactggattttgtcaggtagatttgtgatgagcaaaaagctggagaatataggtgcatgtaaggcacagctgaattcctgtgtcagggtccccagggccacccccaggatcgatgattggctagaagaactcagaattcagaagagctattatccttatggttatggtttattacagcaaaaggataaacattaaaatcagcaaaagaggccgggtggagtggctcacgcctgtaatcccagcactttgggaggccaaggcaggcagatcgcctgaggtcaggagttcgagaccagcctggccaacatggtgaaaccccgtctctactaaaaatacaaaaattacctgggcgtggtggtgtgcacctgtaatcccagctactcaggaggcttgaacctgggaggcggaggttgcagtgagcggagatcgtgccattatactccagcctgggtgacagagcaagactccatctcaaaataaaatcaacaaaagaaaaaggtgcatagggcagagtccgggagagaccggcctcaagcttccagttgtcatctcctggtagagtcttacagacacacttaattttcccagcaatgatatgtgacaacacgtactaaatattaccagccagaaagctcaccctagccttggggtctaggtttttattgcatgtcagtcacatagggcaatcacatgaccgactttagttacttaatcaccagctgctccagaggtcaaaatgatacagcatggcccaaggtccccaccataaatcacattattagcacaaactatctggcctggtatggcccaaggcctgaggtatacaaagacacccctacttgggaggatattccaaggacttagaggttatctcccaggagcccattaaggccagttttttctttgagatgtgctgggtttggacacttcaagcctgctgagttaacccttatagcacagtccccaaatgctgagggaccaactgggcctacaataagtttgtatctttaagggttaaggtgttttacccatacctccttgccttatatctcatgataatatgaggcttttggaaggcagtgacttattgtggcttggggcatgggtttttggagtcaggctgacctactggctgtatggcttgagactttgtctcttcatctgtaaaatggggaagttaaaacttcatggtgtgtatgtgtgtatgtgtgtgtttagacagaatctcgctctgtcactcaggctagagtacagtggcgtgatcatagctcactgcagcctcggtctcctagggtcaggtgatcctcccatcttagcctcctgagtagctgggcatgtgccaccacacctggctactttttaaatttttttttttctgtagagacgaggtctttctatgctgttcaggctgaacttcatgggtttattggggatggctaatggatgacattggcggtggtccttgataccagataagccctcagtgtgaagcagctcttatttttccttgtcttgagattgctctggaatggaaattaggcttttttgaaggtgtgaccctttttgttcatttcttcagcagttactttttattttttaaatgtttgacacacagtctctgataaatgatcattcaccaatcaccgattactctccttgctctgttaagtgtgacactgtccctttgagaatctggcgacagctatgtatcccatcaccacacaccccaaaaaaaaaatttatgtctggttccaggagttaccttttatgagaagtccatctgtgaagaccctggatgttcagagaacttcctgggaaaacactgaaagaaaataaagaggccgggcccggtggctcatgcttgtaatcccagcactttgggaggctgaggtgggcagataagctgaggtcaggagttccagaccagcctggccaacgtggcgaaaccccatctactaaaaatacaaaaa

SEQ ID NO: 12262 - DNA, 117410 bp, Human
agtacctatagtggttgaggtttaaagggagaggttttttgaattaaaacctgaatggcttcttcggagctgttatttttggatgtaaagtaagaagctgaggcgtggggagaggaattctgcccttatttaccttgtcagccaattcccacctcatctgggcagggcttgttgtcccaaggaggaaagacaggcctcagtgtgtgtgagtctagtgattgagtgcgcctcagagccagtgggagggcttggaaaaacaccgattgctgggcctgcctctggtgtttctgattcagtagacctagggtggggtctagggatttgcatttctttttttttttgagatggagtctcactctatcgcccaggctggagtgcagtggtgcgatcttggctcactgcaacctctgcctcctgggttcaagcaattctcctgcctcagcatctccagtagctgggactacaggctcacaccaccacacccagctaattttttatttttagtagaggtgggatttcaccatgttggccaggctggtctccgactcctgacctcaagtggtctgcccacctcagcttcccaaagtgctgggattacaggcgtgagccaccatgtctggcaggatttgcatttcttactagctcacaggtgatgctgctgttccaaaccactgaactagtacctgtttctccctttagatctggtttgggttttgttttaaattaatttttatgagtacatagtaggtatgtgcctttatggggtacatgagatattttgatacaggcatacatcacataataatcacatcagggtaaatggggtatctatcacctcaagcatctgtcatttctttgtgttacagacattccaattcttttagttatttataaatgtacagtaaattattgttgacagttgtcaccctgttgtgctagcaaatatgatgtctctgtttttaagatagtttctctttgctgagattgtattgctgcacacattggcaatcattgcgtaattgattaaccttctgagacagcttcttggcagaaaaaaaataaaaaaactaaactgttgagaaaggtatgagtaatttgtgtgaaaacatattctattttcataatgaccacagaatactgtggcgttctaccagcatagtcgaatgtatgtgaacattctccctttctctgaagattccttctttcaagtgtcttagtctcagtgaattgtatctatcttgggtaagaagttcagggttctctttcaagcccaagcattttacctaaagaaagctgagaaagctaggacaaatgttattctcacaaaaatttaaaagaaacttgctaattttcttatggcctttcttttcttcacaggaagactgggcagtgagcctgacctaaaacatcagttagtcagcaaccgtgcaaaaaattatggtgtcctgccaatgctttagccaccacatccatgcccggaactttccttgatattttaccccattcaaatctgctctaaatgggtcctgaccaaacttgaaatataccctgaacatatttctgttggttacccaccccccgccccggtttagtctcttactataatatttgaatcttatccccaagagcttgcttatctaaaactttcctacatttatttttattaagccattggaataggaaaccagtagcccaagaactcctgcaaacggagctcatttctctgtttacatcacccaacaaataagaggcttctccagtttgaactatgactttgaaccccagcttcactcctttgttgtggtagtgattaatgtatttcctggtacctttttctttagcaagtcattcaaagaagcatatattagccacttagaatccagaaataaatttgctattttgtgagaattattggatggtgaatttttttgttctttaggattttttttctttacttttgagacaggttctttatcacccaggctagagtgcagtggcacaatcacagctcactgcagccttgggctcctgggctcaagtgatccacctcagcctcctgagcagctggaactacaggcacatgccaccacacccagcatattttgtacaattttttgtagagacagggtctcactatgtggcccaggcttgtctcaaactcctgggctctagcgaccctcctgccttggcctcccaaagtagtgggattacaggtgtgagtcactgtgcttggccttggatggtgaagttgtaattttctaaggggttttgtccacccaaagaactcaactataactagcagatttctgggtaagcaaagaatgggaagaaatggagctggatattctgagccttttattttggaccataggttcatataattggattattcatgatccttgattcatgacatattatcatcatagtcttagatgcagaggtccatgcatgtccaacttcattcattatttagttcttttttaaagtggaatttttatttctaatttctaacaaccaacttctctttcctaatttttcaaataccaaagttttatttggaaagtgatcctaggaaagacttagagaaataaagaagagaactgataaatcatgcattatcaaacaagttaccactctgagtagatcttaattgtctggataattctgggaaccaatgtagattacatgaatcagaatttgctctttctagggggaaagtgtgctggagtatttaaagctgataactttaaatattaaagggacattaattctctagcattttcagaccaccacatccaatggcagagggctccctgaaatcttggacagttaaaagttgggctggcatgcatggaattacagagggcaccaattacatctgcctcagttagaagctaaacggtattattaattcatctgtttcaaaggcattcccaattaaattagttctaaatgaattttatgctttcaacatttagccaacaatgagtggttccttcccagttaaaataaagaacttaaatgggattgacattgggattctttatgcctgacaagctttaaagaccattgcatagtttgatgagttttggcaaatgtataaacttgtgtaacctatatctcaatcaagatactgaccagaaattccactggtgtctcctttcagtcactcaccattttctgtaagtaattattgctctaccttctatcgtaggttacctgttcttgaatttcatataaaagtatcatacagtacatggtcctttctgtctggcttcttttgcccaacataatgttgcatgtattatttgttccatctctctactgtagaataatattccattgtattagaataatatttcattatattaattatgtgaggaagcccagggaatcttcctctcagaaatatttatgaggacttaagaaagtctttttagagaccaggggattttctaaagcttttttatttagccttttcatttttaaaaatacgttgacctagccctgaaaattaacatagctttgtcaacacagatgcctgataaattaggctgcctctaaaatagctcaaaccatgggcaaggcagaattttaataaatatggatggtctattcttagtacttcaccacttcaggttggggtgtttcttactcttctgtgtagttctttaaaacccatttgaaatttatcgaaactgattctgtggccttgcatatatcccttatcctggtgaatataacgtgtagacttgaatgtatattctgcatttgtgtgttttgttctataaattgaatttgatcaagatggttgataatattttcaaatcttgtgtgttactgagttttttttcctaccttacctgtcaattctaaagaaggttgtaaaagaacaaatgataggtgggacaaacagaaaagaaatagcaggacaatagacttaaatccaaccttatcagtagatttaaatccaaccaggtcaaccatatctatattatgttaaatataagtggattaaatttgtctaattctcccttaacaccatcagtttttgcttcatgtatttggaagctttgttattagttgcaaaaacatttgtgcttgttatgacttcctgatgaattaacacttatcattgtaaaatatctttctttctagtcatacttcctgatgtgtagtttttaaataaacccgctcctgctttcctgtgcttacatatgtatgttatctcatttttcatccttttactattatatttctttatacttaaagtctctattaacagcacataattaggacttaaaaaactaatctgatgatctctggctcttatcagcgtttactgcatttgtacttaatgtaattttaaaaatgttattttaaaaaattgttatatttcagtagctttaggggtacaagtggttttcagttacatgatgaattgtatagcggaagtctgggattttagtgcttctgtcacctgaatagtgtacattgtacctattttcatcctcacctccctctcactcttcctgcttctgagtctctgctgttatataccactttgtatgcctttgcatacccatggcttactccaacttacacaacacttaatacgattatttatatgcttcagtttaagtctaccactttggctattgatttttctttctcctatgtgtccattgttccttcattactgcctttggatttaataaaatcgtggctgagtctgcagggttgtaggagcccaggaattcaagaccagtcaactggcaacatagtgagaccttgtctcaaaaaacaaacaaaaagtaaaggttctatgaattcatattctccacaacacttggctatgtcaatttttttcactaattggttataaaacattatcacattcctttatactcctcatttattactgatactaagcagcttttcatatttttattggttgaaaacatttctgccaaatgattgttcatatcctcatgcctcctattttttcattgatttctaggaattctacacttggaataccactgaactggacgattttgatttgactacttttaacttattagagaagtctttggcctttgattctaatgccagtccctggctacctgtttaatttgcaaagccttccaaattggacccccttatcctactccatttttccccttagcacctaccaccttcgccatgttacatatgtgtttattacttgtatgtactgtctttccctgactagtacatgtaggctgctacatgatatagagattaaaagttaacgttttgaactttcatagcaatttaacattgtcatcatatttttattaaatgaagggattcgtctccaatgaattggaaatttttaaagaactagttcttcactactttgaaaagcatggtctagattgtctcataccttcatataatagcatttgaaaggctcattaaatagaacagagaagaactcggtaactattgtacctatcggacttgaactgtttatgctctacacaaaatatagttgctaacaaagacgaatatttttttctaatttagtgagatgatatgtttttctaacatgggcattactttgtgttattggtattcccatgtttatagctgagcctggtatgtgtctctttgttttatatagacacatatataagtggttattaaatatgtgtcctgcttctttggatggtgcactggctgagtgtgtgaataaattttttggaatgacctaggttcataacctaacttgttgattccttgtttcctgggtaaccatagacacataccttgagtattttcatgctgtagtatttccagataaatggtagtgatatttttcacctttggaagtgagtaaagttctggaaaatccttaggtgaaatgactttaaatcaaaataatattttacaacaattatatggcattatgttagaatgaatgcataattgggaactcatccaaggagttgataccggaactataaatatatttgtgaaaataaagtggtgagatttggctgcttggaaacagagggcaaaggtttctgggaaacagcatgccctttatttcccaggtatttgctctatcacagtatctataacatagtaagagctttattcgggtctattgggagaatctactgggtgcttagtctggtacctgaaatgcattaatgaatgctgaaaatcacattatcttgactttttcctgccaatgaccaaagtttttgcaagcattatctcaatatatcttttaacagataaaccaatgagtagattgtgatgtaatttcaggataaacccatcttcagataggatcaggtaaacagaaattatgtattatagtggaagttagacagacctaggttagaaactgaacttcgctatatttactttgctgtgtttccatgcaaaaatcaaacatcttttatcctcatttataaaatggagatgaatttacacattttatagagctgttgactaaggattatggataatttatgtaaatgtgtaggaaacactataggcactcaatatgtgatagctatggctccactacaaaatgtttagtatcagtaggggtgtatgtgtgtgtttgtgtgtgtgtgcacatacatttagtatatgtgttagtgaatccttttcttagacaaatcttaagcccttgtacagaaagaaaaaacaaaaacaaacaaaaataaatgaaattaagagagcagagattgggtggggctggtaaagggagaaaggagtcttgtctggccagtgcttgtcatggccctcagcaagcttccatggccatccctgttgccctttacagaggcctagagttctagagaacagcatggaaaccatgctagtggattttaaacacctcaagtgcaagaatggaatcttctttattaactgatacaggtatcgcatgtggtcttgtgctacagtaggtgattggccacagcttgctactccactactgaagttcttcttccatatttgactacacagcagagttatcatttgaaggtgaattagaaacccactagcaagcctatgtcatttaatggatgtaatgataaccttattttttttcagatctgggttggaatttgcccctgacaaataataaaatgatgagtgatgcaagtgacatgttggctgcagcgttggagcagatggatggtatcatagcaggtgatctgcatcctgtgaaagacagaatcacaacatttactctcctcacttggctttttcactacaactttcatattatcttttcactttattttcattttttagacctatgccttttgcttccctgtaatttcatctttgttcctcttctccattttctgccagcattattctcaaacattattttaaagtatcaaaaatttcagttccatcctaggtttctaatcaaggataaagaatctgcatctcaggtgattctggtgtaggtggtctgtggaccatactttgagggacacttctctacccagtgaacatgaatgttctgatctgttttcttgaattcaaaattcactttccaccaatgactcccgtatcttttttttttttttttttttgagatggagtctctctctgttgcccaggctggagtgcagtggtacaatctcagctcactgcaacctccgcctcctgggttcaagcagttctctgcctcagcctcccaagtagctgggattacaggcacccaccaccacgcctggctaatttttgtatttttagtagagacagggtttcaccatcttggccaggctggtcttaaactcctgacctcgtgatccactcatgtcggcctcccaaagtgctgggattacaggcgtgagccaccgtacccggccatatctttttttttttttttttttttttaagagaggaagtcttgctatgtttctcaagctgaagtgtagtggctatttacaggcatgattacctgtgaataacatgcatagtgcagccttgaaatgctgtgctcaagcaatcttcacacctcaagtacctgcgattacaggcacacgccactgcacttagctcgttcgcatgtgtttaccttcccaattctttgctaagcttccagttcctatctctaatttccaaccagatatctgtccagaaatgtcctatgggcacaccagtataatcatttaatgcattgagctcattatctttcctcagaatttactctgatagtcttcatctgggttcatttcataacccttcatccacagtttttctaagccagaaatcatttggtccaatattggtccggaatggaccaggtctaatatttgtattttctgatctgccactttcttatccatcatcttcatgaggccagcacacctcacaccaaagcccaccaggctctttttctttctataccccatgattggcctcctagttacgaactggaccatggatatttaccactaactacatggttttaatttttgcaccatgtaactctgacttggagagatttatgtgattgaattctcttttttctgtttcttttgattgttccttactgtgactagactggtttaccgccttcggctttggtatttttatctaacataaatcccattgctctctctgtgattttgtttaacttaggttctaaggctctggaatattccaatgggatttttgattgccaatctcccacctctccattcatgggaagtttgcgagctctgcaccttgtggaagacctgcgtggattgttagagatgatggaaacagatgagaaagaaggcttgagatgccagatcccagattcaacagcagaaacgcttgttgaatggcttcagagtcaaatggtagggtctgcctgttccaaattctgttataaatcctttgttgcttattccaaaatttagaacatagaatagctgattagaacaagaaaagtttagggcaacacatgtgctccgattttattacttaagatatcttaattttcttttgactctaaggataactttttaaaaagtgctattagtgtacattttgtaaataccaacaacaggtcacctgattctgcccataaaaacagactggcttttagattgtgcctgaatgacctactgtggcttaaatcaaatagtcctgtaagggaaagaatcttgcacatgatagatgatttctcagtcatattgggttattcaccataaaggatccaatagcaattctaaatggaaagcatgatgaaagactttcaaaaagcaacaggatttacagcagtatttgaccggaagtgccatctagtggtttatggcaatcatttcagttccagttcccgaattaaattgtggagttgggcctttaacccatttatgcgcagtgttccattattggaacgctaagcttgtgggagttatttatatcctgctcaaagtcatcgccaaggtctcatttaaaaaaaaaaaatcacaacctccagcataaatgggttaatggtgttactcactgaacaatgaggccgctttctaggcatccttctcaaaaattgaagatgtggcagagctaccctttgtctgggcacggttggaaatactgtggttttaatctgtgatgaatacataaaatctaaagaatgtcacaaaaacagattcagtggaggacagaggaaaggagatattttgtgcttaaaggatattcaattttcagtaagatgcactcatatgcttatgagttaactgtgttgatataaaagctaataagaattgtatgaaagaatcgtgatctactttatgatctgtggtagacatgaaaaccgcttgctttgggaaccttaagagtacatcctacagctaaaacattttcatatgatgtgacacaaatattagagctcccagccagtcctgtgctgaatactctgtgttcccacctggtttacctctgcgtttctgagagcgaatagtacaatctatcctttagtgggggtgcagctacacaaactggagttattttacttgttaaaacacataatgccttactattatactttctatttgctctacagatttctcctccagagacttaagggtccaggtttgctgatttctttggggattgcttcatgctctgtacttggtgtttcctgacatattccttagtctatttcaatgtcctatctcaccccttctttactccatgttcttctgaccatttagcatgcagtgaaaaaggaatttactattgttagaagaacgtatttctatcccacacccagaggccaccaatggcaatagtagccgaagcgtacctgtagttcagcttttgacatgtgtctaaaacatgtccattaacatgtgcttaatctgttctgtgaaagtattttcagaaatgataaaaagtaatgatggttacatctgaatataagttagatcatgacactcactccttttttcagaaactaccagtggcatcacatcttactcagagtaaaaaccacagtgggcttactgtgggctgcaaggcctcgtaggatttgccccccatgactttctgacttcatctcttgtcacacatctccttattcgctccacgccaagcacagtggctttttcactgattcttaaacatgccaggtacactggcctcagagcctttgcactggcttttccaggcactggcttttcactctgcctggaaagctctttcgccagatatttgcatggctagctccctcacattcttctggtatttactcaaaagttgtgatctcagttaggccttgtatcaccaccctaactaaaattatacccatttattctttgtcttacatctccctgctttattttgttcttagcattcaccactttcttatgtgcaatgtatttgtaatgtttatatcatttattttctgtcttttcaactggaatgtaagcatcatgaatccaatttttgccattatttttaaaaatttactgtatccctggtgcttagaagaatgcctggctcagtagttatatttgtaatgaatgatgctccatgaatgataaagtggattgcatgtttgaatgaatggaagttgttttaaatttattctttggatgggtaatggcttgttgatctgtgttttcagttgctttgtgtcttattatttgacattttaaccttgagaatccacaaaatgacaaatattttacagaactaatgaagattccgtttttatcctaaaagtaacaataacaaaataaactagatgtagatccagagagataaggaatttttgttgttgttgctaaatttatttttatccatctaacttatctatatgaattcctcaccttgcccccaaccttccaaattaagtgtgttttctcaagcacacagagaatgacaggatgaaagaagaaagacagcaaaaggcaaaaaacaaagcaagaagaagagaggagggctggctgtttggaaccacaaaagcataggtgtgaaattaagttgtcaccacacacctaccacgatagactttattttagaaccaaaaagcaacttgggccagcattgggaatccaacaagtagaagattatatacttataatttagtaatttgctgataatattaaatttttccaatttaatatttcagaagttgggatgtgttttatgatcttaaaatgggtatatgtatacattttagctcggatccttcctcccttcctctctcccttctttcctttttttattaataaggtacttagaatagtcaaattttagagacagaaagtagaagggtgactgccaggagctgaggggagtggggaatgggaagataatacttactgcacatagaatttcagttttgctagatgaaaagagttaattagatggatgatggtgatggctgcaaaacaatgtaaatgtacttactaccactgaactgtacactttaaaatggttaaaatgctaaattttacatatatattttaccacaataaaaaattaaaattgatagcatcctagaatttaaggaacacagaatcctagcaaattcccccttcatattgaacatgggaaaactgcccaaataaaagagattatgatgttttaaaaaaggaagcagtgaatgataaggcaggattgtatctaggcagtttcaaatgcaggctgcagtgactgcagacctgaattttaatgttggccctaagtctttgaagcttatatgaccttgtgaaaatgtctgaagctctgtgtcttggttttctggtctgtaaaatggggatgatggttactgccacttaggattgtaaggaccctgtgaactaacatatgctgagcacttattgatatgcctggtcaaaggcttgtcagaaaggtaatactgaagagcagagcatagagagtagagggaaaatgtttaagagcaaccctttgcaatgagggaaggagttgggtccagttgcaatgggagttaggttacaaaccacccatacatagttcacttcttgcaatgaaagagtacaaacattcctctgactgaagagaagcttctgggatattttagaaaaacttaaattcaaaaatttttggaaataattatgtatctgttaataataacagacatataattaaggttccattcatgtttaatgatggccaacttgagaggccctgtactttaagatggatactaaccttttcattagtgcaactgggcatttgcagttggaattatcattttacctgggccagggagatcccctggtttcttgtaggatgcaggttatttctttgctgctaattgctcctgcctgtttgtttcatatgatgagacactgaatgtgataaaataccaacactagtagcctgttacagtgaggggacattaaatctataagaatgaatttattagtgtagctctaggcttctggaaatgaacaaatttcttttaaaattcagaagtgcgtctcctgtggttaaaaaaaactgtagactatgacatatttgtttaattactgagggtgaattttctgtttcaattatgaaatataatgtgttaacacagatattaataatggagaattacttgctttatgaagctccagatttaagaaggaaaatggaaaaatacgtctaattgtttgagttaagcaagtagttacttactttaggtctaacttgatgagttgccctagaacattcttataatgtttttttaactgaggatcatgaccttgatccatgtcaacagaggatcaggtggtgaaatcccgaaggtgtctggctatttggcagttttaattatgaggccatctcaaagtcagcagaaattacaaaaatacaattttcaacaaagtgagtgaaatactaatggtgaatactaatggtagtaacgccaaagcaggcatcatcacccatgagataggtaaacaggtgaagtgaggtgttctggactggcttctgacctgttaaatcatcataatacccttctctcttatttttacattaaaagtgagataatattaatcccaaatgtatatttttaaaagttgctataaaaataaaaatactcataacttaaaagagttcagccacgggacatgctctctgcagggctgctggctgttcttcctgagtccctgactcccagccccacgaagcagtccccgtcctaccaccctccgatccctgctgctttctgaccagctttgcttttcatctgtgcctccaggaaatgttttctcaggccttggcaaacaaggtacatcttaagattgtatcccatatgtgatcacaattatctgagttatgcggtgcctcactgagacatcctagctaaaattaaggcagttttccccttagtcttcaagtaaactcccacagaaagtgttcacagacacagaaaaacaaattgatcaaatcggcagaattcttagtttacagaggtaaaagatgtgcttttcatggaatcctaggccactggtatttgttaggactgaagggaaagaggtttccctgttcctttgggaaagtgagttaagaaagaaaatgtgacaagaacaatagggactttttcttggtctcatgttatccttcccaaagtggaagagagattcctcctctagatcttcgtatcctgtcacacattgctggctttcaacaaatattgaataaatgagtgaatcacgatattgaatgaatgaagttgctgctatactgagataggagctggggcttcgcttttaggaacactgggaacttcttttttctctgtcctccccaaattcaggggacttaggtgtgtacctatgactagggtaatattatagtctaaacatgtacccgccccccacccccgggttgcccactgcgaagctcatgccctcattccaccacacccagtgagaggacaggggagcggagtactgccactgcctggttgcttggtttccagcatcactgatatcatgttctttgactctttggacagtagtggtgtaagatgccttattatggtattgaactcaaatgcaatatgactgtgctcttcatggctgaaagattcaagtcttatctcaatctctcctcatagttcagagtctagtggagagcaggcatgcaggaaatgtttgcatgcgtggcagaggtataattctgagtacaaaatgctgtcatagtaattatttcttttggtaactagagataatgtttacttaaaggagatttcatggactgagccttactcttcctttcttgatcctgaatgtttaaaaacagagttatgaaatcaagactgcgtgacaattttaataactagttttaaaaataagtataatgactggctggaatgtggtgtgtgcgtgtatttgtgtatatgcagtgttactaatccagctatgctttaacatttgttgaccttaaaaagggggctgttttcttttccccattttaatttagatacttaccattctgatttaggaatcttacactcaaaattagtttctgttttataaaataaataagcattattgtggcaaatcactgcttgtatgttgattttggatttagacaggacagcagagctcaggaaagaacaaagcaaaacaaaggggaaacaggaaagacaactgtagaccaatgcaaaccaatagaacccagaaaatcaaaggaaaacacagcatgatgttataagtaaaaacagtgggtgagactcctaccttccgtgaagtaataactattgaaatggaatggcaagtgcatggggtttcatcacgtgcatttctctactttaaatctatttgaaattttctgtaataaaaaacattttttaaacagacacaaaggaaagatgttaacatttattatgtctttatgcttgattgtaatacttcataattaaaaggaagttgatataaaaagaaggctttctagctggggaaggtgaccacacccacctctaaatacggggcttgtaactgagctcacacccgaccaatcaggtagtaaagagagctcactaaaataccaattaggctaaaagcaggaggtaaagaaataatcaaatcatctatcacctgagaacacagggggcgggacaatgatcgggatataaaccaggcattcgaactggcagtggcaaccccctttgggtcccctcccgttgtatgggagctctgttttcactatattaaatcttgcaactgcaaaaataaataaataaataaataaataaataaataaataaatagaaggctttccacttagatggtgaagggaaaagtagatggtgttctaatgttatgtgtagcacctgccatgtagagtcagggaattcgttttccgggtgaggttcctggctagctctaagattctgtaattctatgagggataaagcgttttagatgtgtttctccccattgtgccaggaaaacctggcagaggccataagttccttaattaaatcaaagtaccaatgttacagttgagttatatctcccccactgactctgcatacacactattggttggatactgtactgttgaagtccccaagttgactccaatttcgacttagctggattgaatgcggtcaataaggggttgcaccatgagctaaagtagaaaggtaaagtgatttaggcttctctaatatgctgtggaagtcagatcgactcaacaagagtttatacttaaatacattttaagttacgtgctcaggattttacaagcaccatggaagaatcaaaagaaacgtaagacagttttgcactgagaaacttaggctgagtgaccaactcacataaaattattagtcatctacctgaggcagaatatgatgaaacactaaagagcacagtttaagacaagacccagaaggtcagcccgtagatggggaaaggagaatggcaccatgtaaagaggaggtagacatgggttatgaaagacagattgatctgagagggaggagtgggaggtgagtggagtgttgggtacaaaaccttgggatagttgttgtaaaggaaaatggaagaaagctcattaaaaggaagaaatggaaaatgataagtagaagtggtgattacaggtcccagcaaaacaggaaatcaaggttccaaagtagaagtggaatgatgagctttcaggaaggagttaagaatcagttctcccaagcctgcaggacgaaagaaaggaaagaaataagaggtaatatatattatactattacgcactgaggaagaaggtgtctaagggagctcacacaagatggccttaactattgtccattacaaaggctctgagatcaggcggtcggttagctcagttggttagagcgtggtgctgacaaaggctctgagatcacctcctaaacatagtgggaagagagagtacaggaggaaaaaggagccagtctagatagaggtcaaccatggcgtgcataccagattatagaggacacataaataaagacccactgagaagcaagaagggcagatcaaaaccaaacctgcagtcatcttgtattcaactagtgtttattgaacacctatcgtcattcttccattcaacagacatttagttatcgcccactgtatgtcacatgccaaggcaaatctacttgcaaagaatgcagagtctattagaagagagagacatgtatgcagtcaagtctaaccttagtgcattcagagtaatgcctgctgtaatgaaggttcatgtagatactgtcgctggcatatagcaaacagtgaattcaaggaagacttcacagaccaagccctgatagaggtggaccttaaggaatggggaaagaagaagaaagggtgggaaaagacggtccgtgcagaaggaataaaagtagtgtgtgaaagagcatgccatatatggggaggttttgagtgacctggtaggtagaacgtgggagttgaaggaagaatagagacaatagggtatttacctaatggatcttactgccaacattcttaatgcaaaggaaacaaaattggcagaaatataaacacaggtggacagaacagtctttacctacttaagttaacacaaggatataacattgatcactcttaaattctgccttatgttcctatagtgacttttaatatactaaactacccttgagcattatgagtgcttgtaaatatcaatacagtactgagaaaaataaatatgctaattttgagccaattttcagtatctgtttctatttggggctaattttggagaactggttttggaacacctcacttccatatcatacaaagtagcttgggaggaaacattgctctcatcttgctataatttcctccaaccagaagaaagatcagtttgtttgtttgttttcttaagacagagtcttgctttgttgcccagcctggagtgcagtggcgcaaacatggctgactgtagcctccacctcctgggctcaagtgatccccctccctcagtctccagagtaactaggaccacaggcgcacaccaccaagcttggctaagtttttttttttttttttttttttttaagagatagggtcttgccatgttgcctatgctggcctcaaacttctgggctcacacaattctcagcctcccgaagtgctggaattacaggtatgcaccaccacccttggccagttttactttttgtcctcactaaacagcagtttttttctacttactgaaatgtatctgtttccaaactattgttacttgtatgggattttaaaaacagatggctgttaatgtccataatcaaaataaggaatttaaagctctacagggcctgtcttggcactttcttaagattgagaacatgcgttattcatcctggctcttttccaaaaaactgcccttgagaagttgtgcacaatttatttttatgttagtccccaggaatggaagttgtccaggccactccatcacactcttcataatacttgtaatttaatgctgggcacttcagttaacaatatgagcagaattatgccgtggtaattgtagaggtatgtggcaaagcagctgattttaaaattttaatccactctaaatatgcattgcacccttactaaattagcctctgattcttagtggccttttggaaaatgtattcagtatgctaaagtttttagaaaaaacattctgaaattttccttttcattcaagccctgttttttttcttcccccttcccagcacatgacttttattattccaagaattgatactagaaactgcatttattggaaagatagaacaatggtatcagttaattctggaaaaacagtagatgtcacatcagatgtgtcctgggcagtaaagttatacagtttgtattttttctggttctaaatctgaaggtattattttctttttcagttgaaccctgggtggccccatctaacactttcggatttcagctggcttttatttctattgtatttgaatgaagaatcaggaaattctattgggattacattatcttatggttatgttgagattatgagagacaccacttatgctactacgtacgtttcaaagtggtgcttttaggttttctgttctttgtgagcctctttgtgtgtctttttcatgacttgcatgtgaggcagctgaggaagaaacaatctatacatcgtttctcaatctatacttcctttggcatttataccacgcataaatatactgaaacatgatttttttttaaaaaagtgtggggggcaggagggaggggaagaaatagtaagcatcaatatacacagagcactgagccagatgctggggaggttaccaaacgaattataggctctgccctggaatagaaggtaacgttatacaaagaagcaaactcacaagttaataagatcaggacaaaaagtgttaaaatggagataagtgaggctagtctgcgctaccaggggaagtcactgtggcctgagtgtttaagcttttggaggaagagagacagacctcaacaactcggggtgccccctacatactcacaaagctttgcctgcccctgggtgtgtgtctgctctcagtgaagaataccagtatccactgttccttgtgggtcattattttctgcttgataagaaattgtttactttggcaaaacatgcctatatgcttaacatgcctgtcttacctcttttgtggtaaatgaaccaaattgcattctcgtattttctgtttgacagtgacagctgtgcagattcaattcaggccccttggactaagaacacttgtgattttcatttatctacgatatatcattcttagagaagatcagccttacccatattacttcctttttcagacaaatggacacctaccagggaacggagatgtgtatcaagaaaggctggcacgtttagaaaatgataaagaatccctcgttcttcaggcaagtgatttttaaatactgttctttccttgcagcatacttacaaagccttttaaattggggtggcaaattcagattgcttgcagcaatcagactgctaatagaaataagcctgataagccatctgtacacaatagggagtggtgaggattggggcagaatgatggtgtttacacccagtttaaaaggagctaccattaatcatcctcagctcttgcaggaccagtctgaatacgggcacaatgttgtctgatctgttcttttttttttttttttttggaggcagggtcttgttacattgcccaggctagtcttgaactcctaggctcaagcaaccctcttacctcagcctcccaagtagctgggattacaggtgtgcagcaccatgcttcactggatctgatttttaagtatattttaatatatagcagaaattcagatatatgaatatagcataacatctgaatatatgtaagtttatatttctgaatctgaaatcagaatatatatatttaatttttcaattttaaaaatgttaccctgtgtgagacaaaacaaaacagtgactagaaccctccttgtgggctaaatttgagtttgcttcttcataatgttttaaatgcttcacaaacatttttctttggtatattgagcaaaatgaattgaagtatatttactgagtgatgattattgaggaaaaactcaaagatctgctgtaagcactagagttgaaggactagcccaacagctcctcaggcacctttgggtatattgagttgccccccctgactttgaacacatctatgatctgtgtcatcttcaaagagctcatggaatttgaattccctgggttttgtttttgtttttgttttggacggagtctcgctctgttgccgagacgggagtgcagtggcacaatcttggctcactgcaacctccacctcccggatccaagcgattctcctgcctcagcctcccgagtaactgggattacaggcacatgcccccacagccagctaattttgtatttttagtagagatggggtttcaccgtgttggccaggctggtcttgaactcctgacttcaagtgatctgcccgcctcagcctcccaaagtgctgggattacaggcgtgagccaccgtgcatgctacctctcccccctacccctggccaggttctttttcttattctccttgaagtatcaaatttttgataatttctatttcaaacattaactttgtttcctctcttatactatctccaccctgctccctaaaaagataacttctgcacatgctgtctctcataaatggttgaagtagctttaaccaaaaagtattgtacattcctaatctacacgaactttctccaaattgtataggcctccttaaatcaaatagcaacatataaataggaatgcgagggaccactgtcttcttggtacttctcagatttttttttctttataaccgtatgaatggtaggatcattcctttttttgttccatttagagaaataacgtatgcagtgggacccaaattctttttcactcattgcattattttgctctaaatacaggtaagtgtgttaacagaccaggtggaggctcagggagagaagattcgagatttggagttttgtcttgaagagcacagagagaagttgaatgccacagaagaaatgctgcagcaggtatgtgcagaggccagaaccaagatgggatttccctgctgaactatgtgagatgctgcatttctatgttgtgtttgctctgatgcagcagtaagtttcttgattcatttagaccagcacattaaaaaaaaaaaattgagagtagtagagtctcaaaacacatgcacacaatataaagtgtttatgtaattagaatctggaacaaaatgtcaataggattgtggcttattttaattttctttttttgcattcagatggtttcctctcacccatagcatgtgttttataattaagaaaaaatataatagtaaaaaatctaataatccagtttaaaaatgggtaaaatatttgaatagacatttctcaaaagaagacatacaaatggcaaacagacatatgaaaaggtgctcaacatcattgctcatcagagaaatgcaaatcaaaactataatgagatactatctcaccccagctaaaatggcttttatccaaaagacaggcaataagaaatgctggcaaagatgtgaagaaaagggaacccttgtacactgttggtgggaatgtaaattcatacaactgctatggagaacagtttggaggttcctcaaaaaactgaaaatagagctaccatatgatccagcaatgccactgctggatatatacccaaaggaaaggaaatcagtatatcgaagaaatatctgtgctcccgagtttgctgcagctctgttcacagccaccaagatttggaagcaacttaaatgtccatcaacaaatgactggataaagaaaatgtggtacttatacacaatggagtactattcaactataaaaaagcatgagattcagtcatttgcaacaacatgaatggaactgaaggtcattatgtgtgaaataagccaagcccagaaaaacaaacatctcacgttcttacttatttgtgggatctaaaaatgaaacaattgaacccatggagatagagagtagaggggtggttaccataggctgggtagggtagtggggatgaagggagaggtggaggatggcgaaggggtacaaaataatagtttccatgaataaggcctagtatttagtagcacgtcagggtgactatagccaataataatttaattatacatttggaaataagaatataactggatagtttgtaacacaaaggataaatgcttgagaagatggagaccccgttttccatgatgtgattattacacattgcatgcctgtatcaaaacatataccccataaatgtatattcctactatgtagccacacaagtagaaaagaaaatatctaacatataggagaggctctgtaaggtcatggatggagtatgcacttgagcaaaacctcgtaggtttccattcctgctgtgtttttattttttctttttccctgtatgacattaggccagttcctaacctctctgttactatgtttcctcatcttttgattaaggataataagaatttctacctgataagttttttgtgaggattgaaatagtatttgttacaaccggtgcctggcacatagcaaacatagtatcaccatcatcaatgttatcatcagactgaagtatatatatggtttatgcatgtgtatctacacaacatatgtctccctcagtaaactgacatgtgcttatttctgttcaaaggagggtaactaaagtgaatagttcttttttattttattttattttatttttgagatggaatctctgtctgttgcccaggctggagtgcaatggtgcgatctccgctccctgtaacctccgcctcctgggttcaagtaattctcctgcctcagcctctcaagtagctggggttacaggcacccgccactatgcccggcaaatttttgtatttttagtagagacagggtttcaccatactgtccaggctggttctcaaattcctgacctcaagcgatctgcctgcctcggcctcccaaagtgctgggattacaggcatgagccactgtgcccagcctcaagtgaataattttttaaaagtgtgtagattcagtaattatacttcactatatcctctacttgataggtgctgctttgtgcgatcataaatgaggtaaattcacgtgcctgtttataataaaagacttcttgaatgtatctgttaaattataataggagcttctaagtaggacatccttagaaactcagaagttggatctgatggctgaaatatctaacttgaagttgaaactgacagctgtagagaaggacagattggattatgaagataagttcagagacacagaggtgagtgatacagtctctcctccctctctctctctctctgtcactctgtctttgtctctgacacacatacattcctagggcaaagttgaaattccctggaggtgtgcaaggaaggcagttaattactacgtaccatcatcctacttcattttaagaataatctttcattgcattgactttttatcactaaatgctaatggcaatttttatttttagacttttgatatgaagtattaatctttttattaacctttagaaatacttttgactttacgatatttggagcatccgtccatccatactgtttttcttaattttgtaaataatgggcttaaatacatggtttcactagtagttattatttaggcacactgattatttactatgtaattggattttgaaaatctgtatagaaaacatgctaacattctatactcacaaaatcacagacagagcttttttgaggtcttttaatttggcattctacttttggtctgttccacatgtaaatcattccaattaaataagactcactgtacttctacaaaaatcagggtacattctgtaacttgaagtatccattttagtggcttaacaagctttattgtttgttctattttgttaattcaggcctcctagtttgtttgctttgtgacatttggcaagttcttaacctctctgttggtttttgatggagacagagagcatatccatttgaaacatacatttgaaatgaagtataaagagttgcagaaatttcttttctctgagagccatctcccctcctttttgcttcctattttgtttccttggttggagtatggaagggtgtcatgctggattagaaaatgggtaccaaggagagaggagagaaaatggtttacttatttttcccttctgtttttatttcaatcatgtatttcacgctgactataagccagcatgataccaggcattacatacattatccaccataggaaagttctttatattggaaataacaagttttactccactgctattttcaaaattaaattttctgtcaaagattcaattacagtggaaagtcttggtatatgtcttgcttcctccatagcaaaaggaagtctttcatttggttcatgttttaatctttttttttttttttaagagataggatcttactgtgttgcccaggctagtatggaactcctggcctcaagcaattctcccattttggcctcccaaaagcactgaggttacaggcatgagtcaccatgcccagccatgttttaattttaaaactctttgtcagttgcctgtgtgagcatgtttctcatttgatagaagctggggctcttaaaacaggacttagaaagttacccaatttaaaattcttggttttgtattttctctaaaaatctctttgatattttcctctttcccctctttttgtcaggtcctaaccccatagtcgcagggtaaagtaatagtaaaactcagtcaacagatgggcaacatggcagtggagctagctctgctgcagggaagaattgatggtagatatggatagaggtggtcttctacattgcgtccacaaagtcaaggggaaatattcacctgttgttaacttaatttgtatatgagatgttaaccaaatgttggggctaaattgcagtagatgtgttacttattgttgtaagcgcctagggtaatatttatatcccttgagtttggctgctttttttaatcaaatctcttttccccactttttcattgtttcactcatgcactctcaatcacatacaaagtgatcttgtcatcaaacttcctgtacactcaatccctgataatctaataaaaattcagtgttatttctaaaacgtatgcacagacccggagattagagcatatgtggtaaactttgtgatgttacatatgaaaataattaaaataatcttcaacattaaactaacttgaatattctcatgttcttgttatcgtccccttaataaaaatatttttctgggtgtttcatgaatccataatatttaactttctcttagaattttagatttatatttggatattaatttccaagaaaatattggcatggggaagaagtataggcatttccaaaggactgagggtacaagtctttaaactttggaagattcaggacttgtccctggaattgctaatgggagatgattagcatcattcaacagtgcccccttgtggtaagagcatacatgtcagagactgagttcctgcaggagccctgaattctctgaaagggaaaagagaaagggaacaggaattttcttttttaaaaggactgaacttctgataagaaattgattgaaatagtttgtattctgttttttaaagttttacattagggagccatttccagattttccagcttgtgttgtcaggggaagatgtgatttatttcaggttggaaatttagaccatatttaaagtattgccatgaaatatagttgagtagttttttgttaaaacagataaattatcccagtttacaattccatttttttcagtggtttcttctttgcacgagcaaagaagaaaggaagctgtaaaatacaatagcagataagaattcaatggtatttcttagcaatgagaaagtaggaaaatatatatttagaaagatcatattgatgaatatcactaaggactcatattatgcaaggatgattagcttagataactgggaaaagctgatttttttctttagacttgaattctgacctgttagttgaggaatcacaaatatgttgctgaataatgtcaaacagttcatgacctaattcataagaagaaaatagatatcatctaagtgaaatattgtgccattattaaggtgtaattgtataactatgataggtaatattttgccccattttataagagaccacaatttaaaagcctaagggtttactgggaagtgtattttattgtagcatcccttctcttagcctttgtgaacttgaatcattacacttggaagcttaaaataatttctatttacaaagttttatttcatatagcattgttctacttgtaatttttggcattcgtggataattttgtcctgtagtctatgaatttgtgatgcaggaatacatgcatgtctttgtaaaaagagagaagctggccgggcacagtggctcacatctgtaatcccaacacttagggagtccgaggagggcgggtcacttgaggtcaggagttcaagaccagccaggtcaacatggtaaaacccccgtctctactaaaaatacaaaaattatctgggcatggtggtgggtgcctgtaatcccatctactggggaggctgatgcaagagaatcacttgaaccctggaggcgaaggtcgcggtgagctgagatggcggcactgcactccagcctgggtgacagagtgagactccatcttaaaaaaaaaaaaaaaaaaaaaggagagggagagagaagcaaaaatatagtaaccattgtagggatctttgtggcttgtagtaaaataagtcatctcccatgcagggtatttgagtgtctcttttggaggagttaatattgcttaacactctaatttcctttcctactctctgggctcttggacaagttttgtgagcaaattggtcctttaaaaagtagcactaaaataaagtggcagtagaaaaggtgcagaattgtgttgtgtcatataaacactaggattggtttctctttcattttctaatgataaaattaggtgaactgcagggccctcatccactttccagttgaaaattgtcattaaacttacagtaaactcaatccctgataatctcctaataaaaattcaacactattgctaaaatgtatgcacatacccagagaatagagaatagttgagaaactttgtgatgttatatatgacgataattaaaatagtcctcaaaattaaaactgatttgactattctcatgttcctgttattcacttaataaaaataaaacatttccctggctgtttcaggaatcttaaggattcatggcttaaaggatttaattttcatttcattctcccatattgggttgacgagcaatccatatttttgtggacaaaggaagaaattacaaattttttaaaatagccatgtatcattgagaaggttcaaaaggtaaatggctttactaaagaatgtggtatatttaaaatatgaaatagcattctatgaaatagaatagaaatagcactctgtgaaatagcatagagtcatttttaggatagaaatatctgacaaataatagctattacactacctttcttaatcaaaattatactcaccttttattttcataagcccatcactttagggcagacgcattggggatttaaaggaatgttttaaatggaaagatgctttcgttcttaaggaggtacatttatttccatttgtctcatctgattcatacaactttaaccctaggagctggtgacttcttaagatttccaagctgctattttataggtataggtaactgtgttaccactttcctaatgtactttcttgtttcttcttggacaggggctgattcaggagatcaatgatttgaggttaaaagttagtgaaatggacagtgagagacttcagtatgaaaaaaagcttaaatcaaccaaagtaagtttttctcacaggttaacattttcaaacaaatggcatcactattcatctatgcccaataatataaataagatgttttctacttaatgtatgataaagaaggtattttaaaagtaaatgaagatttccccccaagctggaaaccttgaatttaaacaccactgatctgaatttaaaaacaaggcttaactcatccgacagaacataacctgccctttctctgagttgtatctaacctcctttataaactgatactgttttctcggttatttagcttgtctttttctatctgtagttttctttcactcctctgtctctctaccagtctttaatggccaaactttctagcatgaaaatcaaggtgggtcagatgcagtatgaaaagcagcggatggaacaaaaatgggagtcactgaaggtgtagtagacgttgggtgatggggtccatggcctgttgctttctggcttgtgttgttttgctgtgatgatgtttttagtggcatgtgcattcattctgtgtgtgtgtcacctgttgattacaaatcacctcaagctgattgaagggacaatgggatccctgatgttgttttcagaaatacatgaaataattggtgaaaaataataaacaggtaaaaagaaagaatttataaattaatctcttagactatctgagacccaagcctagtaaaataattgtaaacattcgcttgtgaaagaattctgtttcgtatccacagtagaggtcattttcctctttagggactttcttgatggtaaatgtacagcagttgatattatcatggctgtgaatagaaatgactgctgagaagcagcacggtgagaacaggttcacacttcctgccagtgctactgaagactttttgtacttgtccactctgctcctaccagaagtcaaaactatagggccaagtgcctcacttcattggagaactacatcttctcatagtactaaatgtaataaatatatctttagagattctgaaagcaaaatgtgatgttgaatataaagctgtacttcttagcattgcatagctgtattttctgtgttaagtacagccagcaaaatttgtttgctaaaactaattctttactgaaaggaaactgaaaatttaaacatgagtacatagaaggatggacttgaaatcttatacacagttgtatagttaaaaattaaaagagggctccactatctgttttcgaaatttattttttcccattgttgtaggagattctgtccttttgtcttagtgatgagggtgaattatttagttccctgatttggctaaaattgttcatgacttgctaccttacccatgaatgaaactctgtgcttgtcaaggaagcatgagtgccaacttgaaatgctgaataaatgtcaagctagtcttttccaatttgcattttattttgcttttatgacactaagtatctaatttgattatcttccttgattaacttggttatatttttaatttaatgtaaagatttaaaccttagggctatcccatccctaattactctttaaaagatctctttttaatttgattacaaagaaacttgaaataattataccataactattataaacaggacttctactaatagtcttgctttttgcttttcattgcccttgtctgatttctgatgcttgcatctaaattctagtagatttgtttcattcataaaacctgattattgatttaaagagctaatatgctctctgaatgttccttttcagtcatgatctgctatttttaaatgaatttgtaacttgtaggatgaactggcatctttaaaagaacaactagaagaaaaggaatctgaagtaaaaaggctacaagaaaaattggtttgcaagatgaaaggagaaggggttgaaattgttgatagaggtaagaagatatatttcacatttatcatctcattttgttaaagtcctccaaaatctgtaaaggaaaccaatgaaaatcaatgtgtagttttagcatcaaagaaagagcagcagaatccagccaggaccagaaccacaggggattctccaagactctttactgtgactgggaatccattaatttcctcttcagcagctggaaaaggggaattctgtactttatttggtgtttaagattgctagactgtaaattctcatcacaaggatggacttgtctcaattgcgatgcaagggaatttgtgccaaaggagttaaaaagaaccatccctgtgtcccgggatcgttgccctcagaactgaaattagataaagtaagggacttagaaactgttctgcccttttgagagaagagaaaaatggttctgtatctttggaaaaattagtaaaaaatttataccagggattgagccctccaccttttagaaaaataggctaattctgtttttggaaaaaatgcatgaatttgtccaaacttttttcataacagcagaggtttgttctgagtattatatggaccataatttctaacaaagcagattgtgcatgatagaaaatagcccgaatgaaatacatttttaaaattatatttggaaatataatgtgcataatatctgacaacactaggttaaatttaacctttctttgttattacgaacgatgactgtggccctacgagataccaaagcaatttctgagtcattcaaaacagtacaaattccagttagcgtagctttgttacatttttatccattttatgaacattagtaacattgtctgtccaatgagggacttgagttagattatctctaaagtccttcttggctctagaataccatggccttatacccctgcaggtatcacaattccctgtccgtcagaaaattcatcaagcctgaggaaaatggattctcaccaccaaccgcttcaccgccccaccccatcacctactgtttggcatatatataattgtgtattgataagggacattcagaaacaggtcatactgatcatgctttcagggttttaagaataaaatgggctggtttcagtggctcacacctgtaattccagtactttggaaggctgaggaaggaggatcgcttgaggccaggagttcaagaccagcctgggcaacacaatgagaccctgtctctacaaaaaatttctttttaagatttgaaatttttaaatttcaaatttcaccaggcatggtggctcactcctgtaatcccacctacttgggaggctgaggagggaggatcacttaaggcccaggagttcgaggctgtagtgagctatgactgtgtcactgcacttcagcctgggcaatggagcaagatcctgtctctgaaaaaaaaaaaaaaaaaaagaataaaatggcatcacaggacttgtgggctagaagatattagagtatgctccccaaagtctgatctgaggactcgaaccaacctgggaactgcgtgttaccagtgcccaccagctaactacggggattgagaacaagtctttagaaagctcatgtcagggtgatattgggatagcatctaactgcatcctcactggactcatcttactggacaggagatagaccctttcagtgttgttgaacttgagtggtgagttgcatgtgacacaagcagtgttctagtcacattcaggaggaccaggtatcaaaccgtgatggaaatataaaaacaaagtgacactaactaggttttcatcatttatggtataagaagtgcttgtagtccataaacctaattttaatgtgagaaaatcaaggtccagaaaaatgaagtgacagaggtagtaactcaaatttaggtcttctgttctctttctaacctcacatagagcattattgtactaccaatcctgcagtcacaaaatagtgctgaaaaagtttttatgaggttagatttcctttattttaggtaaaaagagactaaatagtagtgatttaaaaatattacttattgttgtaatgtatgctaacttccaatccaatgggttttcctgcacagatgaaaattttaaaaagaagctcaaagaaaaaagtaaggtttggtgcatttccatcagcctttacattcaccaaaaatactaccttggactgttctttgcatgtgttttaaaacatttctctcaccaaagatgtaaagttgcttcatcaataagccctccatttcttcagagtgtacacaatagagggtggataataaaacaataaggtaaaagattattttgaagattttgtctgattcaacctttccgctctacagtgtataaccgggcacacagcattgtggatgtaagaaaacattttccctgcagtctaggtgattcagggtcagaggagaaaataacttttatagtacgaaaactcacgattttaaaggtttaccagagttgaaagataattttgaaatttgcttttgcttttcaatgttttgaagtccactatttgtctgggatctattagaagctcctttgaacatattctgttgttacaacagagattgaatccagctgattcatggagcctgaatatttaatgcaacattaaggtaaatcctgccaggcatggtgggaggatcacttttgaggccaggggttcaagaccagcctgggcaacatagtgagatcctgtctctacaaaaaaaaaatttaaaattagctgagcatggtggtgcatgcctgtagtcccagctactcaggaggctgaggtggaaggatcacttgagccccaggcatctaggagtttgaggctgcagtgagctatgatcttgccattgtagagtttgaggctgcagtgagctatgatcttgccattgtaccacggcctgggcaacactgacaccccatctcttaaaaaaaaaaaaattaactccttaggggctctttcccccagatgttaaattctcaattcctatagaatatatcttaattgaaaatgttacaccaatgctgaatgatgcaccactgttttataacttatcttaagaagactggatgtggtggctcactcctgtaatcccaactcctcaagaggttgaggtgagaggatcactggagcccaggagttcagagctacagtaagctgtgattgtgccatgcactccatctgaatgacagaggaagatgctgtctctaaaaaaaagtattatcttcagtaattttttttttctcagaagcaggcaactttagctgattttttttttcctgtttgaattttttagtttgtgatttcattttggagtgacttttcatttatttatttatttgagacagggtcttgctatgttgcccaggctggtctcaaactcctgagctcaagcagtcctcccaccttggcctcccaaagtgctgggattacaggcatgagccaccacaccaggccctggagtgacttttcatctttaaaatatataagttttttattattcaagtaacatgcttttgtatttgaatatcaaattttaaggagaatcacattcagcttactttggcctttatgtcttgaaatctatcttaaggtagtattggaaatgaagtttatagatgaagcaaagtacttattatccttacgtatggaactacaaccagcttcttagcatgactactcatgtaaatactacaagccatcaggcacttaccgttcattcatgcctctatcttggttataactatcattttctctgcttttgtcattatatataccattcatggctttcacgcactgctttatagattcctgttttagaaacgttatgtttttattactatagcactgaaatttcatcttcagtgttctcatgaagattctcttgttgctttaagagaggatagctagttctcacacacccttgttttctttctagagtggcaactgttcaggtgaggtagaagatgtccatcttttcagatttttccaaaagagaatatgggtgttaaatgtgccctttttaaagaataaatgaaagaaatcattaacatctttaccttaaaatatttcagtctggagagtaagtaacttcttatcactgtcacacatgtgaactgaactgacttctgatttgatgttattttcagacatcgaagtacaaaaaatgaaaaaagctgtggagtccttgatggcagcaaatgaagaaaaggtatccagatgaaatttaaatatatgtgtggatgttttttaacaccattttgaccattccatgcaatttcatgagctatgccgttttaaaagaatatgcccacaacactgctaggagtgaggggcaggtgtgcacactcccaggtgggctgtatgcacaggaatagggaggagctgcactggctccactgagaactcctgcccccatgaattcagaaaatgttcaaactctctgatcagttccgcatattcacgtgacatgtaagagagaggatacattccatagtacctcctgtatgtgggcactgaaaattctgggctaacttttgggccctgaaggagctagcttgacagcctcagcttcatggtcatgttggttttgtcctccatttactcattatttcctttacactcctggcctgtttcacatgtgtgattgtctctgctctcctgagagattaaataccagaaaacagcggcacgggctttacgttagctacactggctgcattccaaggtttccacaggtttcctcccccccagttggttcttgttatccacatgtgatgtttcgtcctgctaagggcagggatgcagttactgcacgaaagcaatgggtttcttcgtggcttacctgaccacgtatctagcaggcagccgcagctgtgttcagctgatgtcatcagaacttctctccccttatctgcctgaatgaatagaaccagaggacattttcctaaaaagaagagtcatttcaaggaagtaaaaaacaacaaaaagtcaaagaactttagcttgatctttttctcccatcgtaagtttctttctctcattcttgactcttctgtttttcttatctccttgtttatttttgcctcgcattctctttatttgctctttattgcctggaagtaaactgattgtcatgtctactcatataggttcctttttgctaatgtttcccactattgaataaaaaaaaagtaattagcaagctgcccactgtaacttttatttttttttaaatcactgaaattcattttgttttcatttctgtccctcaaaaagccacagcaaacaaaattcccagtgttgaatgagggcttatgagatgctcaaactgttagaggggcacccagcataacataacttcctcgtggggtcggggattcagaagacttcaaagaggacataatttgagcaaattctggggaagagcaagagttgttcatcaggaaaataaaggcttcttaggcaaagggtccatgaatcaaaacttgtctcgagaccaggtttgaaacagcgcagtgcatgctgggattgtgctggaacatgaagtgcaggtggagtaggggcgtggggctgaccacagagctaagtcagtgggcaggctacttcatacaccatggtcttgatttagggtcttagcttgtaaaccttaggcagtgacatgattacattgccattttagaaagctaactctggtagcagaatgggagagtgaagacagacaaacagttaagagtcagttaaaataggtgagaaatgaagagggcttgaagtaaggcaatagcagtgaagtgataaggtgggaagagcttttagagaaatttacgggttgacaagatttaagatctctggatttgaaaaacgagagaaaatttctggtttgggcaattgggtgaatggatgaatggatggttctcttaaggagttaaggaaatccaagcacagactcaagtactgaagggaaagaatgagcttaattgtagatatagtctattcaatatgcttatgggacattctaaaggagatttcttacagaaagttggaacataaatctaaattttaagattaatgtagaactatagattagtggggagtgagacccatcaattttaggagaaatgcagagttgtagattggtggggactaagccacagttgatgtgtcagttagcttttgctttgtgacaggccacatttattatttctcatacttctgtgagttggctaggtgattcttctgatctcggctggcttagctgatgtctacagtcagctggtggcttagatgagactgcatgcataatttaggatagtgtcactcacatgtccagtgattgacagcctagtttaggttggccccagctgggaggactagcctcttctccagatggtctcccatcctccagtagactaggctggacttcttcacgtagttcctcagggttccttagagccacaccacagggcagccacaaagggcaaatgttattcaagcctttgcttgaataacatttgctgatatctctttggccaaagccagccacatggccaggcccagaatgagaatgggaggcgctagggaggccattttcataacacagttgagcacatgggaaaagcaaagagggtcatggacagaacctggaagctctagcattttatagtccaagaagataatgggggttatggaagttcaacagctatctggtcaaaggattgagaaataaaaatcgaagaaaagaaagagtggatggataagtgaaaggagaaggaaagagtggggtcagtcaagtgccatatggaggtcaaattagaaaaaggttggggccgggcatggtggctcacgcctgtaatcccagcacttcaggaggccaaggtggacagattacttgagcccaggatttcaagaccagcctgggtgacatggtgaaaccccatctctacaaaaatacaaaaatgagctgggcatagtggtgcatgcgtgtactcccagcaactcaggaggctgaagtgggaggatgacttgagcccaggaggttgaggctgcagtgagccaagattgtaccactacactgcagcctgggtgacagagcgagaccctgtctcaaaaaaaaaaaaagagaaaaaggatgaaaagtgttcattgtttttaatagataggaggtcaccttggtagagtgttttaagaggggagaagccagatggtgattaatgatggctaataaagacagaagatgggggtctttcttttaaggtttgacttagagaggagagttattgaagctgacttttttctttttttgttttgtgtcttattaccttgttttgtttttgtttgtttaaagatggcagctaaaggataggatctctaaatttagaggtactttgcccatatgtttaatgtatgtaggaaacatagtctagttattaccagttctcctaaagcttagaagtattctttaaataaggtaaataattcacatctgcttattcttttttttaaatgctctctcggcagaatcatgcgtattctttatgtaattactattctttatgcaattctttatggaattactattactcttttaagaacataggattaaagattacaatttattttattcctaggatcggaaaatagaagatcttcgacagtgcctgaacaggtacaagaaaatgcaagacacggtggtactggcccaaggtaaaaaaggtagagtgtagctctaaaagtttttctacttggttgactctaagtggctataaacttacacatttggcctcaatttctttcctggatcatacccattgtcccaaattaggtagctaattcgttaattgaacaattaggcaactgtactctgccagaaagtgtccagcctgaggagtgagtgtactgtagagtcattggtcggggagtgcctctctaaggagttgatgagatagcattccagagagagaaaaacgacagtatatgcagagagcctagggggaaaagaatatggcatgcttaagaagaagaacaccagtgcaactgcaaggtggtgggcagtggggagaggggatgagatgagaccataatgatgagcaacctctggtagcgcaaggggtggagttaagctcttgctcaagtgcagagggactcactgaagggttttaaaagtcagcagtggtcaggcgtggtggcctacggctgtaatcccagcactttgggaggccaaggtgggtggatcacccaaggtcaggagttagagaccagcctgaccaacatggtgataccacgtctctactaaatacaaaaaaattagctgggcatgggggcaggcacctgtagtcccagctactcaggaggctgaggcaggagaatcgcctgaacccgggaagcggaggttgcagggagccgagattgcgccattgcactccagcctaggcggcagagtgagactcagtctcaaaaaaaaagtcagcagcatgacctttgtaacacgtgggccatggagggaagtgagcagtattgagagccgcagaaaccaattcagagatttgcagtattccaagtgaaaaaatctagtagttgctgattgggaatatgttatggttggattgacacagtggtgtaatgagatagaggaggagagtgaagaagggggaggaaatcaagaaagacgtttccaactaaagcaactgggtagatgatggttccattgactgatatggggaagcctagagaaggaacattgggctgggtaagggggattgagttcagctttgaacatggtgagttcagaaaaaccctgtaagacaggtacataaagagagttgtgcattttgttgtgtttattattattttatctgcagatgggccaattggccatcctcaaatgtggaggaaatttgaaagtgctcttgttttttagcaatgcataaatagagttatttgctcgcaacgtaagcactggatataaacaattcttttggaaggtccccatgaaacactcagattttgaagttttaattttgatgagttcacagagaaggaaaatcctgctttggatcaggatttttgaaaaaaaaaattttgtacacaaggtctggcataatcgattttataaatatctgagtgagcaaatgaacctctaataatcagtgttgactagcaattctcatcactcagcattttccatgccttcagaagaagagtctctatcctatggaatattgcaaatttgtaagtgattaatttttacatatgcctggcatttaaaatgttgtttgattttatagaatttcaactgtccaattcttacgtttaaaaccaaggcagaaaaaattaattcctgtaattagactatatcgtaaaacatttggaaaataaagaaaagagataaaaatcactcgtaattgcactggcatgatcactattggcatttttgtgtattgtttatttctagctttttttcctgtgcatacaaacgtgtaaatacaagaggtagtttttaacaatgtacagcagcacagattttcttaaacccttgaaaactatgttctgttccaataaagagttgtataaacagtgatttctcactaggagttatatttagttaatcctcatacaattctaataacactaaattctaatagaattagaataacattctagtgaaacctaaattaagaagctgtggtctgattaagatctttaaacaagtgtatgatttaccatgtcatattatttgtagattagcgtgttaagtatcatttttttctgtttttaaaaaagaatatctggcactgcgctgttcaccatttaatcccttttgatttctagagatgtaaaaaaaaattctcaagtttgcagctttggtgaatatgtggttggttttttccatcagacattttttgctttaaaatggcataaaaggatcctcttgagagatcaaagatcatctgtctttttgttttttctgttctcctatgttttttcaagagcacagcagtgatgaaaactaagttgtttaaatgggactttgttgctattcacaattcgttttttgtaccaggtattcttcagtttgaatatttctacactaaaatttgtaagcccctgattttaaaacaaagttacaagagagttgttggaaaaagttaacttttaattttctttcaatctgatgagtcaatgtatcgagtatgactttgtctgttaatatcacaggtagccattgtggcccaagagcccttggccttagtttcaaatgctgtttcctaggtcctatgttgttgtttttcaagggctgccaggagaagctgactctgatttttgaggatcagaaaaaattttatattcgttataattgggattcttatcttcttgtaaaagtgaaatataaatcaaaagctgctgttgtcttctctttgttttatcttttcctaggcaaagatggagaatatgaagagctgctcaattccagttccatctcctctttgctggatgcacagggtttcagtgatctggagaaaagtccatcacccactccagtaatgggatctcccagttgtgacccatttaacacaagtgttcccgaagaggtattaatagactttcagtatttcctttatgttgaagagactgtgttattgaaaagttaaaacactgctcataacatgaaaaacatgggttcctttctcagttccatcaccaactcaagtgaggttatataaataaattgactttggccacttctgatggtgactctgaaagataattgaataaaattttcttctgacttctttagacttggaagaagcaactggagaggagtaaacagttatacactccttactttgcatcaaactggcaggaaaatctgtttgctgtctattgtacaccacaccgaaactttgtggcttcaatgacagcatttcttttgctgatgactctgcactttagcagggttcagcatgagcatctcgtctctgctctacttggcatcagctggagtggcgtgaaggcctgggcctgagtcatctgaaggctaactcactcatatgtctggtggttgaggctggcctttggctgggacctcagctgaggccccatttagaacaactacatgtgaccgcttggcttcctcacaatcctaagggtgagcattccaagaggcccgggcaactttgcatcgcctgttatgatttatctcagaaatcacatggcatctcttctgctgtagccacaggcctgcagcccacccagatacaaggagaggaaacatagaccctacctcttgatgaacaactgacaacattacattgttaggacacgtgggatgggaaatattggtgcaaccatatttggaaaatataatctaccctctggctacaccgctttacatccctctcccatgcaaaatacactcgccccctttccgaagacccctaagtcccattccagtgaggcgtcagcatcccaggatcttgtcacccagaccaggtcgagatgtgggtgaagctcctcaggtacagttccttgcgcatagcttcttgaggactctttcattgaattaaagagctgtggatttcaaggacagttatctgccctccacacacccatacgatggttggataggcataatgtaactgcagtagccactcccattaaaaagggggagctggaaggctcacaggtgtcaccagtccatagcaattccaaaatccagccaggcacatgttgccaatcctctgggctattggctcttccctctaagtcatgcttcctttgcctatatttgcagatgagtagttttctcagttttgtgcctgcagaagtgcccaaagatatccaaattcatctcttcattttccattatctctgttcctttgagtctaatttagtgtaatactttaaacatttagaatttcatacgaatcatgttataattcactgcattacagaagaacacatccacagctatcttcaccataagcctatctctagctaagtttccctgtaaggctgcagtgggacatcccattatttttagagcctttcatcatttttcagaggttcaatgagaccgcactactgtaatcttcctaaggtatttttttttctatttttatttgattctagtctagtccatcctgaggtcttagcaaagggttttacagccacatccttggctcacctgaagaccatgttttcctgatagcccttgtgcttgatctttgccctgaaaccatttcttaattttagtgtaatttttttttgtctagaaagaccgggaatgggaaatagtttcattgtttaaacaatcttggcttccttattttagcagttccttttttggtcatttctcttctcacattttactataggtagtgagaagaaaccaagtggcatttttacttttatatctgttgctgataattacacaataagaagatgaaatttgaatggaatgaaaatgaattcaagaagaaaacattgaaaatttctcacttaaatgtaggagagggctgaaatatttcattaatcaaggaattagttaaggaataagaaatactttggtggaaaatatcccctaattgttagatatatatttatatcgaaagcaaaaataatatttgacagtcaacgagtgtgctgcagttacagaactagtgttacatgtagggtatatccaaataatcccatatccttttagaaaaagtctttgctatgtgaattgtagttttaagtttgtaacaagaatggtttgatgagggttgagggagttcagcgacatttttaaagaaaagccaggagggagatctgagtttggagttaaagtcttaaagtttgaaaaagatcaagaaaattgatctgttagtatagttatattttccccatgattaggaatctcaagagacaaatgaacttcaggaaacagtgatgatggctaaataagttgcccaggattcatcataaagattcaaactgaaaagattgatagttaaataatctgctactttataataattcgacttcacattttataaccttttattgtgttaaaggatgagaccaccactgaataacataaacaaaaatcacaaagctgaatgtattgcttacttaagtaagtgagtgttcccggtccagtacattctcttctagctgatcatatgtagggtttttgagatggttggagctcaagggttggtggactttctgaggcaagtgagagtcgacatccactgtagatgtgtggttactaaggtgagactgttgctgactggttggcgtgtagaagggtgttcactggtgtgagtctttatcaggcagctttcagaggtgaagaactgtcactggttgactggcaggagttcattgtggcaaactttgttcatttttttttttactgaaatatttttcatttattcatttatgatgtggcctgcaatctaactgctctacagttgtaaaaaattattgaaaaccgaagtattaaaattatttcacagactccttccttaggatgcacaaagcatttgtttgagaaaatgtgttatgcattttatatgttgctgtaatattattattatcattaagcaaagtgttttaagtggtagccacaaagtccattgtaattggttttaattacacttttcatcaattatgttaattgaaattagtcaactagtacacacatagaataataattaactggcttgaccaatgttccatataagattagtagtagaaattaaagtaaaaatggagcttttcgctgggcacagtggctcatgcctgtaatcccactttgggaggctgaggcaggaggactgctcgagcacagagttccagattagcctgggcaacatagggaaaccgtgtttctacaaaaaaattttaaacattagccagctgtggtggcgcacgcctgtagtcccaactacttgatagggctaagttgggaggatcactttagcccagaagttcaaggctgcagtgagccatgatcgcagcactgtactttagtgtggatgacaaagtgagaccctgtctcaaaaaaaataataataataataataataataataataataataatagagtgttgaaagcaaaacgtgttacccaaatcttacaataaatcattgcaacctgcaggggtaggcattgtcattcttattttacagagggtgaaactgatggatgcctagcgaagttatttgctaagatcaccgatcacttaggcaagtgtgtcagaaccaacatttcatccagggcttaaggttgttaggatttattattactagctgggtacagtggcacacgtctataaccttagctactcaggaggctacggcaggagactgcttgagccgaggagttcaagaccattctgggcaacatagcaagacgccgtctcaaaaaaaagaaaaaaaaattactattaacttacttaatggtataccgtcttattcacaatattcagtgtcttattcagaaccaagttaaaaagtttccttcctccagaatgatttccttgattagtactccttctatatagatgtttatattctgaaatcattttatacagttctgaacactgattatgagattttgtcaatagaccgtttaattttcttatgtttatttaaattactctgtggcttgtgttttgttttgattgattgattgattttttgtaattacattacagttccatactaccatcttgcaagtttccatcccttcattattgccagcaactgtaagcatggaaacttctgaaaaatcaaagttgactcctaagccagagacttcatttgaagaaaagtatgtcatttattaacagtgcaatataaatgttcaaaaaagtagatcagccaaagacaaggatgtattgcatttatttacagacacaatttttacctagagaagcaagaaactgcaagatgtccactgggggatctgtaatcagttctgtattatggaaataaaaggtgtgaagcaggaaataataagagatcaggctggggaggtagggttgtcaggttagaaagagattttaaggaacttggccaagtgtggtggctcacgcctgtaatctcagcactttggaaggccaaggtgggcagatcacttgaggccaggagtttgagaccagcctggccaacatggcgaaatcccgtctttactgaaaatacaaaaattagctgagtatggtggcacacgcctgtaatcccagctactcagaggctgaggcacaggaatcacataagcccaggaagcggaggctgaagtgagccgagatcacatcactctactccagcctgggtgacagagcgagactctgtctcaaaaagaaaaaaaaaaaagtttagggaacttggatttttatatccgaggtcataggtaactgtcaaaggattgtaaactaaatagtcacagtcacgggctgtaagtgtgtttgaaggatgggtctgaaggggacaggaaaaggatacagtagtttgtctctaagaaaatagaatgttttgccaacatattcccagattgtctagtcttattttaggccaaataaaataggacatttaaaaaaatagaaatagcttcctttgcataattttttgtttttgacttatctgttcacttagaacatatatggtcttttattcgtgaagttaataaataccttttgttctttacattttagtgatggaaacataatccttggtgccactgttgatacccaactgtgtgataaacttttgtaagttacattttattgaatgtgaaaaatgtgattgaggctagagaaagagagttctgttatactaacaattactaatattaacagcaaatgaccgaggctgttaaattactgaataaatcaatgtagctataataattgggtgggggtgaaggtggggagctgtaagtttacaaagaaataatttctgatttgctattatctcatgccagggttttgcagatctcatgccggggttttgcaggtctctagccttgcttcatcagttttcatttgaagttcaatgcttttaattcatttttgcactgacatattttgagtccagtgggaaggcatcacagggaatgatgtgatgcttggaaagctgagatgggtttttttgcactttcagttttatgaactgacctaatatctgtgtttatccaagttaaagtctggattaaattaggaaagtctattttcagagcagtactcaaaaatgagatcttttcttttctcactattatcttttactttatttggtagttgatacttctggcaatacacctaaatacagaagaaatgccttttgaaagtttgtaaatgtgcatatttatattattctgtttcgtagaggcaaatacattacttctctgtcactctctctaaactggtcacatatctctaccttcaagtttttagtaacaccagctctatataattgaatattaattatgtgaaagagaaagtctctggatgtttatagtgtctctttgccttcactaggatagcaaatgaattattatgggcagcattagggattcctctactatgctttaattagaactataaaatgaattgctttgccagactcagaaatgtgattcccttgtgaattgaaaagtgaaacttccattctttattttaattagaaggattagatataaatagtacgtgagtatttttaaagttcctagtacatgcagaggatgcagcactagtccatggaaaacactgctttattttcgaatattgacatcacaaggctagtcctaagtgcttttccagctcttctaacatgtgcagaacagttagaattattggcaggacagttaatcacccctgcttttaaaagaactaaatgttgtcatttagtgaagcacataagtgactgcctgattccagattttcttttattgccaggattcaacccacacgcaattttagtttctttccaagatgttttacttagaaacagtggcactggagccacttattattaattgttattactgttatttttagaacttcaagtctgcagaagtccagcagcctgggcaatctgaagaaagagacatctgatggggtgggttctgtgttttttggttttttttgtctgttatcctgagaaaaaactatttagggatcttcatcttttccctttttgcaaataaaactcttatgaagagcttgtggtttttagtggaaaattattagatgttaggtttaacagtaaatattaagaagtatgaatatgaaggattgaaaatagtatgtaaaaccaaaaatggagactttaataaaacattttggaaaataaacaatactaagattttgtagcttagaagtagatataaaattattttaacttatggagttgtatgtgacaaattcagaattatacaaaggatttccctaacaaccttaaatattgttattgctttgaacaggaaaaggaaactattcagaagacttcagaggtaactttttgtccaaattacaatgcaaaaatatttctacttccattacatgtaaattgcttaaatgtctccagtagataaaaactttcagaacctctagaacattatgctaaatgaagccagacacaaagttcacatattatatgattccgtttatgtgaaacatccagaacagataaatctatagaaatagaatgcagaccagtggtaagaggtgggaaaaatggggagaagctgtttaagggtaaggggttttgctttcgaatgatggaaatgttttggaagcaggtagaggtggtggttgcacaacatcgtaacatactaaatgccactgaattgtgcactttaaaattgttaattttgttatgaatttcacttcaataagttattaaaaaacaaaaccatagtctctcagtcatgctacttaatgttcctaatgaccataactgagcttccttagacctccccaaaagcccttcttagattaccattagattatacacccggtgcccatctaaagcaaacattttggtatgtttaaagatgtcgtcaacatgtgctcaattcttctttcccctgattttttttttttttttttttttttgaaatggtatcactttgtcgtccaggctggagtgcagtggtgcaattataactcactgtagcctcgatttcctgggctcaggtgattttcccacttcagcctttcaagtagctgggattacaggcgtgcaccaccatactcggctgtttttttttttcgtttgtttttttttttattttttattttttaagtacagatgagatcttgtcatgttgcctaggctgatcttgaactcctgagctcaagtaatcctcccacctctgcctttcaaagtactgggattacaggcatgagccactgtgcctgttctgtcctctgattttctgtcattaaccttgtgaagattacagcctgataggctacctccagatccagtctcttgactgttggctcttagtgcctgagtcatatgtggatagaattgacaaagcagccagtggtgacagctataattaaaatccttgttgtcttttcagttcaataaatggttaaatgattttgacgtcattgttgagccatggatgataatatcactaaattgtgccatctgtaaacttttggtttctatgagctgtagatatatagagtaaaataaccacctaaaatacctatatcccctcacccttttctctgcttctgtaaaaaaagaagcagagggcaagaattatttctacttctgcaaaaaaaagaagcagagggaaagaatagagaaatgaaaacaagaagacaaaagtatctttgtataaaggacacccacttcaataaatggtgctgggaaaattagatatccatatgtagaagaatgaaattggacttcacctgtcaccaaatcaacaaaaatcgactcaagatggattaagaacttacatataagaccagaaactataaaactgctagatgaaaacataggggaaacacttcatgacattgatctaggcaaagcatctttgtataaatactaaaataatatactgtgttacagctggctctaattgcccattcaaagaaccaaaaagctcaaaataaagttgctcactgtgccttcattttcttattctttgaggagaatatttaaaataactggaatagaatctccttatactgctggtatagaagtttgaactaatgcctgctttgtagaataattaatattatattaggcttctattgacaaagttataatataagaatatgaactgtattatagctaaatccgtgacataattgttagaaaagtcagaaatctgctgctattattctggttatgtaatgtctccatgtcttttgaggaatgaggcaaacaaaatttaagaatttttgtatcctaaatatttaaagccctagacatatcgattctagattagtgatgaacatgttttccttgttgcttttgttgttgtttcttaagtagctttcagaattgattttttttcaacttctgataaggcatttgacattggtgatcaatgtattagttcagttattcttttgaataaactcatggatgtggcgtgagtgagtatttgctgttagcctggcatgtgctgaggatgctgcacctgagagctgtttcactattcttatttgcctctcaggacagagctccggcagaaagcaggccatttgggacccttcctcccaggcccccagggcaggacacctccatggatgacaaccccttcggcactcgaaaagtcagatcttcctttggccggggcttttttaaaatcaaaagtaacaagagaacagcaagtgcaccaaacttaggtacgtatgaccaaaatgcctttgccctaattcttccacaaggaggaaaagagcagtgtcttcccttcccttactctttcattcattgattcatttctctttctcagaaacgaaggtgaatgacttaggggaatttagcaaaaaatgcctccgtggatttaatttagtgttgtgaagatatatagactctcaccctgctctctcctgtggtataaacttagcggaaagacctaaaatcatgattccctttgacttcatcatggagtttcccatctgttgtgatagtggataaattaacattgacgttgagcctgtgtgtaacatcagaagcactgtgtgccgcatgcctctcctccacggtgtgtatttggcgaggaggagtctgatctgcatttcattttgtcatctctgtgttctctccattgggctgcgtgtgattgtgtgcgttgttgggatatctgaagatcgtaaacgaagtgccagtgcacccaccctaggtattgtacccctgcatgccagccttcaccagcactgtgctccaaaccaatctaatccctgctcttggcatctgtgatctctagaaagcgatctgacagcaatcagaaaatgtagttctctattccggagtgttctttccaccttctgctaaaaaggactctgtagaggctttgcttccaagcctaaatgctgttttaaccaatactagtaacactcactgtgtgaatagctttgagaggacctagacgtgtgcagcatccctcagagtgcagggcaggaatgtcctggcattgtacattgcagctctttcagccttgaagtgcatattaccacacactaactcccaggtccttgcagtccgttctccatgcttacatttcccccagcctccaaaaagaaatttttttggccatatagggaggtttatagaagacattgaatattatagttttaggcttacttctcttaggggaacattcttctgacgttttattactttgaagatggagataatatttagtgatgacagaagcaactttacttgatatctgaggcgttaccccccaaagtgattttagaagaggggcagctcagttttcctctttgtaaggcaggggacaaatggggaaaaaagttctcaaaataaaaaagagaaatatggtagttttaagatgaggataagctaggcagcattttcaggggcacctgtagccatcgtggttgaaggatttgaattgggaaagttcctttgggtttttccaaaaggtgctgttaccttgtatagatatccacctatctattcacatggaccagcaaacgggacttctctctctatcgatataaatgtctagaatgaacactggatgcataaaataaactgatctgttcagacaactattttcaaatagtttttttttgcatctttcttagaagaactgttttgttaatgctaagaggtaaatgctgcttattataacctataatcacagctctgctttgtagaaaaatcaactttctgcaactcatagatcttgctgaaacactgttcttgtgattttagtacaacttttactttcttttataaagtataaaatctcacactgaagacaacagtagcccttgtgtttgctagtatgggattgtccactaagggacagctaaaagaactgaaatagttaatgcttggagatctgagagtggcaactgtggatgtgattcttttaaggtaaaatcaacaggcacttactttatgtcaaaagaaaaattaggcatatccagttcattcttctctcagtgcctaggatttaatagattggaatacatttcaaaaataaagaattgcttgaactgggtaactgatttgatgtaaatgccaaaggagaaggagtaaaaggaaaatgacatagagtctgagctagagtaacagggacagtattaattaatattaaccaaatatcaaataagaacatttaagagacgaggccaggcgtggtggctcacgcctgtaatctcagcactttgggaggccgaggtgggtggatcacgaggtcaggagttcaagaccagcctggccaagatggtgaaaccctgtctctactaaaaatacaaaaattagccaggtgtggtggcgggtgcctgtaatcccagctacctgggacactgaggcagagaattgcttgaacccagtaggcggaggttgcagtaagccgagatcatgtcactgcactccagcctgggaaacagagtgagactctgtctcaaaaaaaaaaaaaaaacatttaagagagaaaaagactctcggggaaattggatgagtttgtgaagtcccagatgtcccgacacactgaattgggaatatcacaggcatttagatacagagcctagagagagagattaggcccagagattctgatcctctagagggcatttagaatataatcttaaagtggcatgggggaagaaaaaaaagcaggggtgctacagcaaagacactatcagatgacagatgtaggagagtggtcatgtcaagaagcaaaaggagatgattttgaaggatgtagcaggtaatcaacagtaccacgtgctatggaaagattgggaataattccattatgaattgaaatcactcaaggaaagaatgtggcaatcctatcacactcttttaatctccaaagggcttgtaattttattaagtttacacacagtaaactatggagcagaacgtatatgtgtgttccatttctaatatttacaaggtgctctttgtaaatcactgattatagaccaacagaagaattcttaacagttctagaaccaagaagattaacatcatgtttattccatattttaaaattcattgtctgcattctgctcttggagtagctgaaacagaaaaagagacagcagagcacctagatctggctggtgcttcttctcggccaaaagattcacagaggaacagtcccttccagataccgcctccatctccagattccaaaaagaaatccagaggtatcatgaaactctttggaaagtaagtaaagcagtaaacaagtggaatgggccctgtcttacatgttgcttaaaagtggctggacatgggtatggactttgtaaggcctttgtattcctcttatggaaggaagtttggattgtgatgtgggatttattaactcattgggtcttagttaaagtttaaatttaaatgtctatgttaacaacacaaagaggattagttccagtaggtgcactagttaaaaatgttctgattaacaagtctaaggcctcctcaggtctaatactggccatgtgtgttgtcttctttagacttaggagaagtcaatcaactacattcaacccagatgacatgtctgagcctgaattcaaaagaggagggacaagggcaaccgcggggccccgattaggttggtctcgagacttgggacagtctaacaggtaagaagagccaactgatagacttttgcatctctaccaagcatcatagcctcatgagtcctgcagtattagtactgtcattgggttaaacaaagtcattgcttaatgctgtgcctaatgaaaggggccatcatctttagagccgtgcaatttgtcaatggttgatgaacaaacagaaggtgagggctgtgcgaactaggggagaggccagagctaaagtgtcagcagcatctgtgttagaatggctctcagacttaaattttacgtagatggtaattacaagtactctaaagcataactttggaaagatgggatagcatagtggttaagagtatgttctagaatcagaccacttggatttgctttctggccttaccactttctaccagctgggtgaccttgagcaacagcttccacaccctgtgcctcagtctcctcatcatcataattagtacctaccccaaaagctgaccatgaaggttaaataagttaatatgtgttaaatatttggcagataataactactcaagaaacattagcatgtaacagaatctatgaaagcacttaaagacaaaaatgctatcagaatccttgtatttatcaggactatataatattttatccattaagattctaagaactgctctgacactcttaaccaaagtttagggctggcttagaactactacattgactcactgtgcataagagggtggggttggcaaacataaagtacaagacattgataccaaatcttttaacagtataatagactgactagaaaccctttacatatagcccctcccatacaggtggaacactggacataggttacatcaaggaggaaactctctttggccttcttcaaataccaaacagtttcatttgccatatgttgtctttgaacacagtagagctccttgtactatttaaaaaaaaccattcatcttcccctccgcaccctgcccccaccccggaacaagaacactatttgtgtatctaagtaaaagaaaacaggaattttgctttgattgtttcctacactcagtgacaacatattgccctcttctcattggttaccatatggaaagaaaccataattctgctaaagttagttcaaattagacttaagtttctttcagtccaactgagtttcctgtttgggaatccaatcttcaaacaacattggttaaaactgatacagtgacttgtgtttgtccaatttggtctttttctgtagcacttgttcttgctctatcacgttaaatcttttgtggtttcatttgaaatgaagacagtggtcttagaagataactttcaaccagttgttcctccaatgtatactaaaaattaagcttttcatggtcaaatgtgtatcaccagggaatttccatgtctattgaatgtatagttgtttaaaactaatgataagccacaggattggctttggattatttttcatgcaattactcattttcctgtagtgacttggatatgccatttgccaagtggaccaaggagcaggtttgcaattggctgatggaacagggcttgggctcgtacctgaattctggcaagcactggattgcatctggccaaacgcttttgcaggcttctcaacaagatctagagaaggtgactgcttctctgttttgttcacacaatggatactgagaagaaaacagtatgaatgtagggttgttttatagtccagaaagggccatgagtgaagccagtaaaaactctgtaaacaaaagtttgggttttcaattgcttcatgcttcttttttctggtggtcttgggaggacctggtcttgatgattccttatggaacacttaagccattgggcattttaatgaaaaagaattacataagcataattcagttcatatttctcgaaatcattgtttggctttatcattggcctgttttctcagtgtaagatatgcaattaacttcactttgcaaaagaaaaaaaaaaaagcaccctacaatttgtgtctaattatttaacatttcttccaaattatttaatattttgtacaaaataagagtcaaattctttttatgcatgctacagttcctagcttacaaagaaaatgagtcactagggaatgcctaacacacccctaagataattgtggtggtcttggcttttcagggaccttttgttcaacaacactttactagcccaagttgggattgtaattcagtattgaattgggtctttaatgctagcttcattttggagaaatttgcatcctttgccagtggcacccagcctatacagatagaattataaagtcaatgtttattgtttcaggaacttggaatcaagcattcacttcatcgaaagaaactccagctagcactccaagccctgggatctgaagaagaaaccaatcatgggaagctggatttcaactgggtcactagtaagaagtttttattctaacaaaatgaaataattatatacatagttgctttttctttttaatcacaagaacagatgttttgtggcatggtagcaacactggcctctctcttttaggatggttggatgacattggcctccctcaatataagacccagtttgatgaaggacgggttgatggtcgaatgctacattacatgactgttgtaagtgactcactcctggggtttgggggaggaaaactttttttctctgaaaaacacaggaattgagtaagccaaacacagtgttttcagtgattccaccagagtttgaagctgttgcttgaacttgaggagagtggcaggcatatttcccatgaggctgaagttgtagcatttggtgattgtgattgaacaggcttgggataatttgaaaccccaatgtaagctaagtgaagcctaatttaaactaagctctccagaaggttgattttatatgtaatacattcaacaaagtaaacactgaagtgtacactttgaatgggtacattttatggtatgcaaattatatctcataaagattttttttgtattatttcttttgagatggagtctcgctctgtcacccaggctggagtgcaatgacgtgatctcagctcactgtaacctctacctcccaggttcaagccattctcctgcctcagcctcccgagtagctgggattacaggctcacgccaccatacccagctaatttttttgtatttttagtagagacggagtttcgccatgttggccagctggtctcaaactcctgacctcaagcgacctgcctgcctcggcctcccaaagtgctggaattataggcatgagtcaacacgcccagcctaaagatattttttaaatagaatgtagaatttttaagcccaagctatctctaagttatgggtttctatgtgcaatgaccatttggaagaggccacccttttgacctgacatcttcaaggacttgtcttctcctttccactctggacaactgttacctgaaaccctatcacccgtctcacttcagcctagttctgctacagcaggagttactggggttaaaggaggagggaggaaggctagacttctactctggttccttcattattgtacatttctagccctccagccaatgtgtaggactattccctgctttacagcagtgagaaagatggattccaggagaactttgttttaggttccataccactattaatgttctacttaaaattctctttatttatttatttttatttttatttttattttattttattttattttgagacggagtctcgctctgtcgcccaggctggagtgcagtggtgcgatctcggctcactgcaacctccctctcctgggttcatgccattctcctgcctcagcctcccaagtagctgggactacaggcacctgccaccatgcctggctaattttttgtatttttaatagagacggggtttcaccatgttagccaggatggtctcgatctcctgacctcgttatccacccaccttggcctcccaaagtgctgggattacaggcgtgagccaccgagcctggccttgttctacttaaaattcttttatttatttatttattttggagacagagtctcactctgctgcccaggctggagcgcagtggcacaatcttggctcatggcaacctccacctcccaggttcaagtgattctcctgcctcagccacccgagtagctgggattacaggtgcacaccactgctcctggctaatttttgtgtttttggtggagatggagtttcgccatgttggccaggctggtctggaacttctgacctcaggagatccacctgcctcggcctcccaaagtgctgggattacaggcgtgagccactgtgcccggcctaaaattcttttatttaaacagctttttgtgaagtaggctatagacctaactaccctaagtataatctttttcaagtaagtagcaagttttaaacagccaacttaagtaggcatttctcaatgtcaaaaaaatttggagttcagttcatggatttttcttctctgtcattgaacccaagccccttaccttgatgagcacatcacataaacctgcgtgaaataatactaatatgtgtagtatgttgcacatttgctatgtgtcaaacatccttttaagcattttgctcatattaatactggattctcaataacccttttagttaatattactaatattattatagtgtgtataatatatattaaaaagtttttaaaactttttattttaagataattttagatttacagaggagttgccaaagctagaattctgtatacctttcactcagcttcctctaacgttaacatcttacgtaatcatgattacattcatcaaaattaagaaattaacgtagatgttaatacaatcaactaaactgaagactattcacatttcaccagtttttccagtaaggtcctccttctgttccaggatctaatctaggacactacattaaaacacacattttgtgacttacgacttctggggtcaaattttccagggtcatttactcttttatagccatttcacatacgctgcttgtgattttaagcttgaatttgttcacatatatactatataattatgtaatactgtatatacatagtattatacacacatatgtaatactgtagatacatagagtatgtatatatatatatacacacacatacacatatatgcatgtttgtatatatgtgtgtgtgtatccatatacacacacacacacactctgtgtatctatagtattataatactattattatccctacttttttacatgtataaaggaaggaatcgagaggttgggtaacttggtaaccaagtttccacagttagcaatagaaagtcatagagagtttgaactcaggctgtttcaagatccctgcttttaatagctcacgattatgactagaacacattcagtaaatatttgcctccctctctaagtgtgagtatgttccccctgagaatgtgaacaaattcaagcttaaaatcacaagaagcatctgtgaaatggctataaaagagtaaatgaccctggaaaatttgaccccagaaatcctaagtcacaaaatatgtgttttaatgtggattagatcctggaacagaagaaggaccttactggacaaactggtgaaatgtgaataaagtctgcaatttagtcaattgtacattaatttcttagtcttgacgaatgtaatcatgattatgtcagatgttaacattagaggaggctgagtgaaaggtatacagaattctattctatctttggcaactcctccacaaatttaaaattattttaaaataaaaagttttaaaaaaattgggaagaaaatcactcagaaagtctgttttgatataaaataaaactttctttttaaaatccttcgaagtataaagaatttcaaaaataattaacattttaatcacactgtaaacattgtgcattcagatatttttttaagctgacagactagttagatgaaaagagtccagactgaaatgtttggaatgggtgtctcaatcctagattaaaataagtactctttctaacatgtcttaagacactacttttaaggaattactccagaaaaacttcaggaaataatttttgcctggttagtagcctcaaggatttaaactgattaatatttttattaaatatttctgtagtagattacatttttttctttctttcatgagaagtgttttatcagaaaggtgtgtctaaaatggatgctttccttgtttattttctgggtgtgtttggaagtagactgttgcttatcttcatactgctcccaatatcaccttcttctgaaataatttgttttggtgtgtttggtatatttgaaaatattcccaagagccacagactggtgaaaattcttccttgaaggggttgattggtaatatatatatgtgatacttataacttcatttttcttctctccttgactctgaccaaaacctttgcactgattgattatagttgcgccaaaattgttcacaatgtctgctagataaaccataataatctagagctattcaatagcagacaggtccttactaaaaaataatttagaactagagaattattaaggtcagggaatagtataataagagcactgttctgattttccccaaaattatgatgtgccttagttcagaaaacccagccttgctaggagcggtgcctcacgcctgtaatcccagctttttgggcggctgaggccgggggactgcttgagcctaggagtttgagatagcctgggcagtatagtgagatcctatctctccaaaaaaaaaaaagatgaaaaaagaaagccaactcttgatcatgttcaccaatgagcatcattcgctcttcactatctgctgaaaggaaacagagagggcagtttatccaaagcctaagtactttatccaccgataaagttctcaaaactaaagaggaaacaaataaattccctgtttgtagtatgtgcagatcaagtcaaagcagatcaccttttgtagtgacccagcaagtgcttttctaactgtgtttttcagagccctggggttctacagatctcagagcatctggaagagagagaaacaggtggaagtcagcttcattggcaaaaaatactaatctggggtttgggggaagattttgttccaaatgggaaagtgggttctgacaagaccttggggcatattggtttgaggggctcttctccttttactccagttttctgagattccctaagaaagtcctcctgctacaggccagcacagtgagctcctccttttgttcttttttgcaggatgacttactgtctctgaaggttgtaagtgtgctacaccatctcagtatcaaaagggccatccaggtcctgaggatcaataactttgaaccaaactgtctacggaggcggccatctgatgaggtagtgttttaagattgaggtttataagcatgcacttcccaggcatgggactgtccatgtgtcgaaactaagagccatttttcttggagcctgcaggaaaagccttaaaatccagcctcatttacttcttaggctttttctgtattccttccttttctctccatgacggttccccttgtgtaactaaagccaagggttctttttcagttatgcttcttccttttcttgggtgtatttttttttcctgactctaatcaacagagataaatatcactataaagacttccttttctggccaagtatagtggccaatgcctataatcccagcactttgggaggccaaggcagaagaatcacttgagcccaggagatcaagaccagcctgggcaacataggaagaccctgtctctacaaaaataataataaattagccaggcatggtgggtgcacgctggtggtcccagctactcaggaggctgaggtaggaggatccgtctgagcctgggagatggaggctgcagtgagccctgattataccactgcaacgccagcgtgggtaagagaattagaccctgtcttaaaaaaaaaaaagacttcctttcctaaagcaatgctttattagtatataagaaagcttgaaactcaaactatgacagaaattctttaaaagagaatttttccctttctttttgcatttagtgggttgttgagtaactgtactccatggagcagactttttagacagaaaatgcaatttaatatttaggatcctggttgtgtgttcccatagaataccatcgccccatcagaagttcagaagtggactaaccatcgagtgatggagtggctgcgctccgtggacttggcagaatatgcgcccaatctcagaggcagtggtgtccatggtgggctcatggtaaagctctgatttaatttaaaattgacttactttgcttcctttagtctagtcagtaggatattatcaatttttgcttatcataatcctaaagtcatctgactcaaccctcctgccctatttctagtaaacctttactttcagagtatttgtattgatatcttataactctagattgaatttaaagccagttctcttttattgtcctctttcatgttgaataacatgtagctgctttctctcatatgatcatgtttgaaaacccctgcaaggatgcagattgtatttctgcatgttaatgttgcttaaggaggtggctcccacagacagcaccctagagaggcagagcactgatattgggatgcctgaagcctggatttcaggaccagctctatcactcactaacttgggagaaatggagaaaagatatgtaaattaaagatcaaagtccatattgtgtctacctcaccgggctgttgagaggatcattggagataacctaagagaaagctttgcaaattataaagcacaatacaaacatgtatgatttgtggtgacttttgacaagcttttttttttttctttaaacaggttctagagcctcgttttaacgtagaaacaatggctcagttattgaacatcccacccaataagactttgctgcgaagacatttggccactcatttcaaccttctgattggggctgaggcacagcaccagaagcgagatgccatggagctgccggattatgtacttctaacagctactgccaaagtgaaggttggttcaggctcatacggtttaataattgcttggcgcaaaggcaacgttttgtcggttacctggttattctgttttctggggtttactaagttttgtgggtgggttccttaccagcagatgcaggaatcctcagcgcttagttgtcttgggagaaagatgttggccaatagacagttgacagatagagagctttattgaagggaaatagggagcaaagagcttattgtaagaataaaaaaaaaagaagaagaagtacaggggctgatcctgcagggaaaacagcagggtcgcagtaacaatgtttatttaaagggacagtacactccaaaaaccaaggcacagcgggctgctgaaagagaatgagcccaagagttctgcattgggtttttatgatgtccagttttttcttgaagctctcaccactgtgttaagtctctgccttttttatctcgttttcccgctcctgccttgagtccttgccttctccctgcctagttcccaacccaggcttgtgggaccctcccttaactatagttggtgcgcatgcgtgggccgggtgttggctgcacttccacctaaaggctgcattgctcattcccgccgccccaggaaggttgtataccagtcaaatctatacgtactgtacctgcgtttctcttaggaattctcctttaccttcttcccctctttatcagcatgcagctagctacattctggcaggtgatctgcagagtgagtgattactgggcgtcttaaggggcgttcctttctgcataggtatttcccctcctctctgctcaaatggagcatgcatgttttgggtggtttctggggtgcgagattttccagacctctcttttctcaggggcttcccctcatgtctagctatctgcccactctaacaagttgaaggaacagttgacccttgaagaacatgagtttgaattacacaggtccactcctactcggatttttttttttcaagcaaatgtggagggatgcaaaccccacatatagggaggcccaactttttaggtacacgggtactgctggacttgagtatgtacggattttggtatacatgggggtcttggaactaatgctctgtgtatactgagggacaactgagtatatatcttttaaaagtataataattaagagaatgcacccagatagctcagtcagtagagcatcagacttttaatctgagggtccaaggttcatgtccctttttgggtgttccctcttaggtgggcatggtgcctcatgcctgtagtcccagtgcattgggaggccaaggcaggaggatcacctgagtccagtagttcaaggctgcaatgagctctgattgagctatgagcatgctactgcactccagcctggacaacagagcaagattctgcctctaaaaaaataataatgaacagcataatattggcttccataatccatgtattggcaatgcagacagcccataacttgggtccaaatattgattgcagttgttctgtttttataaatcaagtacagaagagaggtttctcttgtacagatttagcttctctggcttatgattgaccagcctcgtaaataggaaaatacactttaaaaatgattgaaggtgggccagaagagaatgggtatttcctagtttacctggatttatggatcataccaaattcagattactttttcttctttaaaattaatcctagattaactcttctaaatatgttatcccaaccaacttgatgggttactgggtcctccagaaatttgtgccgaagttctttttaatttttttttaccccctctatctgcctgagtatccagtgaccaacccagtgaccatcatggagtttctcttctaagtatcactgacgtttcctctccaaaaaattcttttagcagtcaccagtcctgttatggaagcagaataggcatacaagataattatagcctcacccaaagaaaaaatatagtgaagtctattctattttgctaatcttagattgaaaaaccttgcaaaattggattcagctgtgagaaatctcattgcattaagtcctgtctaatcaaaactatgaagctaggtgcagtggcttgtgcctgtagtttcagctactccagaggctgaggcaggaggatcccttgagcccaggagtttgaggccagcctgggcaacatagcaagattctgtctctaaaaataatagtaatgatgtaatcaaattattcttgccatattttgtttatcacggtgactattcagctatttggcgtgaataagaagaataaggttaatttcctgagattcataacaagggtcatttatcattgcatcatttatatgcctaggatgcccttttgtttttatccatatttaaacatccagctacttttctctctaccatggggtaaataattaaattatacatataggagggagggggcaacgcaaaaaaaaatcacatgttatcaggccttgattatatgaattttatcaaatcctttggatgtttttgtttgcttttcttttaaagccaaagaaacttgcctttagcaattttgggaatttgagaaagaagaaacaggaagatggtgaagaatatgtttgtccaatggaattgggacaggcatcaggaagtgcatctaagaaaggatttaaacctggtttggatatgcgcctgtatgaggaagatgatttggaccggttagagcaggtaaatccaacactgtataactttttgcgagttcttccatcattcagacactaaatgggaactttgtatactgtgtctgatcaaggacattttcttcaaataactaaaaatacagataataatagtgaacacttagagatcacttatatcttccaggtaccatcctaagcacttaatgcatactatgtttatggtaaccttaagacatggagagcattgttattctcattttggagataaggaaactgaggcacagagagctaagtaacttgcccaaggtccccaacctgtctctttggctccaaagcctgtgatatttaccaatattttgccatctctgtattaaaacatgttaggaatggacaggttattctacctagccttttcagattaaagtcgtgggaccgcatatttcccctctaatcaacaatgctttgctactattagcaaaggcattagactagctgtgtcagtaaagtgtctcttctaatttttcacttccagttgcagtggtgaaaggagattatcaccagaagtgttctgttgctcttaccccattcagtgctatttgcattatttcttcttagacttttgttcctcctgctgcactttccctgaaattgtgaaaacacttatgtcatgttatggtttgttatttgcagatggaagattcagaagggacagtgagacagataggtgcattctctgaaggcatcaacaatctgacggtgagtttgtgaaatgaattgaaaatgttattctataaatgtcttttataacaaccccaaaggaccacatgtctcttggagaatgtgtagctctgagctcttggctctcagtgtgactccctgtctccttgttttccagcacatgttaaaagaagatgacatgtttaaagattttgctgcccgttcccccagtgccagcattacagatgaagactcaaacgtttgaccgtagcacctggatgaacattaggagtgcttagtcttttttctacttgcttttccaaacactcacagtatatacaacaggcagcggattgtctattgtttgttgttctaacttctgctgtcgagaagtttaaacagaaagcaggagtaatgtgccgattctgaagttgccacaaaaaataagacactggtgaatgagagtataattgtttttcttctatttaatgtaaaaatctgtgatatattatatttaaagtgttgcatttaagatgagtattttaccagagtgtttccattcatatccgcggtatggaggatttgaggaacagtaaccaggatgtgaatgattttgttacatcagtgttcactgtagccacctaagtaggacattatatgatttcagaatcaatatgtggaacttctttaagcattcagtgtgcccactaaatgccagccacacctccacttgcctcttattgtcttatttttatatatttttctaaatatatgtatatatacagtacatagaaaatagaacttttattttgtgacctaaggacgatggtgaaaagatcacgttttcaaaacaatctggtgatcagaatgttcatataccagctggtttctgaagaggtcagaatgatctttctccatactgacttttaacaatgttgatcattgaggctaaattaatatatatgaaatattcctttttgatgacaccacaaaattgttgaacagtttaagaatttcaaccttaatcttggatccctttacctcatatggaagaacttgagggacattagtatacttttttttaagatggagtcttgctctgtcacccaggttggagtgccatggcatgatcttggctcactgcaacctccacctcctgggtcaagccattctgcttcagccccaagtaggtgggactccaggcatgcaccaccatgcctggctaatttttgcatttttagtagagacagggtttcaccatattggccaggctgggactcgaactcctgaccttgtgatctgcccgcctcagcctcccaaagtactgggattataggcatgagccaccacgcccagcctgttatttttttattattattgtttttttttagtgacagagtctcattctgttgcccatgctggagtgcagtggcgtgatcatagctcactgcagccttgaattcctaggctccagtgatcctctcacctcagcttccctaatagctaggattacaggtgtgtggcctcccaccccaccccacccttcacacctggctgatttttcaaaaagtttttttgtagaaacagggtctcaccatgttgtccagcctggtctcaaactcctgtcctcaagtgatcctcccacctcagcctttcaaagtgctggaattacaggtgtgagccactctgcctggcctaccactaacttgaatacattcagaatcacctcctctccccaaaatttgtagaaatagtttttgaggaagccaaaagcaaagcagaaacctttacagtattgtttcttttctctttgttaactgtgtcattacagcaaaatactagcagtctgcctaaacatgttcattgtacatttctcaggctatcaatgaatggaggtttttaaaaagttgaatatttgtctgaacattttatttcaaagttcaaaaaaacagaggctgcaaaattcattttataatggctattttgtgacgataagatgtagttcatgtttttctgtagcactgggcccaaatattctttgtaaagaaaatcgctgcagcaaaaactgttactgtgtttattatatttgtagaagtattagaaaaatattctattttttattcagtgctgcgtaattacccatggtagccaaccctacaaaagacaggttttcacaaattgaggtggaggtgggcggttcagtatctgccactggacttgattataaactgtatttgaatatcagtggtattatcttttaagttgtcagcaagttaccaaggtattcattaaagaacttgtaatatcaaattactatttattcataacaattgatttgatgctaataataattttctttaaactctaccattcattatgtggtaactgtattgaacttactttatttggattttattttaatgtgactagatgtcaccacttcaaaaaatcaatttgttcttagaacctggttgaaaataccaggaaactgttacagacgccatttttttttttttttgagacggagtcttgctctgttgcccaggctggagtgcagtggcacaatctcagctcactgcaagctccgcctcctgggttcacgccattctcccacctcagcttcccaagcagctgggactacaggtacctgccaccacgcctggctaattttgtttttgtatttttagtagagacggggtttcaccgtgttagccaggaaggtctcaatctcctgacctcgtgaatcgcccccctcggtctcccaaagtgctgggattacaggcgtgagccaccatgcccggcccaaatattttttattcaggatggtataacctaactgataataggtaataaggttaaatttttttatgacgtattttatttacaaatatcatacactgctggtgttaccatatgaaaggaaataaagtcaattgataattgcctcatttttattgcccttatttcattttccgttgttcatagtaacaggctttgtttctgacatagaaaataacacaatctctttataaactgccataaatttgttcgaatggagtttataatgtgtatcaacagataggaatttgaggcctttgtttgagaagcttttgtaggaaaagaagcaactgagctggggaatgaagaatcatggcagaaggtaaaagaaacaaaaacaaacaaaaaaagaaaataggaaaagcaaatggaaatgactcacctagagattggaagaagttagttgtagaaagaggtgtatggatatttaaaaaactaacatagggctgggtgcagtggctcatgcctataatcccagcactttgggaggccgaggcgggaggattgcttgagcctaggagattgagaccagccaggacaacatggtgaaaccccacctctacaaaaaatacacaaaaattagccaggtgtggtggtatacacttgtagccccagctactcaagaggctgaggtgagatcacctgagcccagggaggttgaagctgcagtgagccatgattgcgccactgcactccagcctgggtagcagagtgagaccctgtctcaaaaaacaaaaacaaaaagaactaacgtgctatttttacttcaactaaaacttggaaagaggaaacatgttggaagagattaccaaagattaaaagtagagtgaatataacctagatagaacagatgttttgtgtgaaatttagtatctttaacttaataaaccagcaggaactgtatgaacacaacacacccaactgacaaacagagagaactaacatgtttatttagctgtatgtatatatgcttaactacacccgaggaagctgtagagttagaaaaacatgaaccattaacagatgtggcctccctgcagaacttttactttgaaaaagaagtacgtctgaaccagattcacatgtttgatatttggatgcagagaaaatggggcagaaagcatcgcaacagttggctctgaaggacagcaaagaggtgcccgtcgtctgtgaggtggtcagtgaagctatagtccatgcagctcagaaactgaaggagtaccttggatttgaatatcctccaagtaaactctgcccagctgcaaatactctgaatgagatcttcttaatccatttcatcactttctgccaagaaaagggagttgatgagtggctgaccaccaccaagatgaccaagcaccaagccttcctgtttggtgcagactggatttggaccttttggggatccgacaagcaaataaagcttcagctcgcagtacagactctgcagatgtcttcacctcctcctgtggaatctaagccttgtgacctttccaatccagaatcaagggtagaggagtcttcctggaagaaaagtagatttgataagctggaagaattctgtaacttaataggagaggattgcctgggtctgtttatcatctttggtatgccaggaaagcctaaagacatcaggggagttgtcctggacagtgtcaaaagtcagatggtgaggagccatctgccaggagggaaggctgtggctcagtttgtcctggaaactgaagattgtgtgttcatcaaagagctgctcagaaattgtctgagtaagaaagacgggctgagagaggtgggcaaggtttatatcagcattctctgacttggatatgtattatgtgagtggcctgtaagaggaaaagaaaaaaagattctaataagcaagctcacctatttgcatcattccagcatgggattttttttcatttgttttcccattgattgaaaatgattactgggatcaaagtacattcatgtcgcaattacagagagagagagaaaaaaagaaaaccctggctctgcctatgatttaaaaacagttcaggaaaagttataatttagtttaatatttcattcacttattcaataataaaaatggaagagagataataaagtcacatttaaagtttgatttgcaaaaaaaaagtgtctgtttgaaataataagtctagcactcaaaagtataaaatgtgtttttgcatctgttggtgggagatgggtaggataaagtagtgggtaaggctacagagcaggtttaattacatttgtaatgccagtttcaagccaggcacagtggcttatgcctatggtctcagctactcagtaggctgaggtgggaggatcgcttgagcccaggagtttaaggctacagtgagctgtgattgcaccactgtgctctagcctgggcaacagagtgaatcctcatctttaaaaaaaaaaaaatagtttgggttcaggactcctgcacaaaactcacagcgttcttttcctctaacacttaccttattctgtcttctccctagctgctgtctctgcactgagaggactttgatgggatttactttgagattcactttagtgttagctctgcctatgatttaaaaacagtgacctataaaactattccttttaataatacttgtttagcctttgcagtaaggaaggtgtattcacatataataaccatttttacttaaaagccagtgtggaattataacagtacaaaaaggaatcaccattatttattgcacttgtaagtcaagtcagatgctttacatatattagcgtgatttgcatgtgtcttccatgactctaagaggtttctatttgccaaatcaaagaggctagataactcataaatctattaagtggcttgtaacaaaaaagtaaagtctgcccagttacaaagcccatattctacagtcgtgtaaagaaaattccctgtaagcctataaattaggttaagtaaaaatcaattaaaaaaaaaagaagaagaaaagaaaattctttggccaggaagagtagctgtgatcccaacactttgggagtctgaggcaggaggattgcttgagcccaggaattcaagaccagcctggacaacatggtgaaaccccatctctacaaaaaatacaaaaagtcatggtgatgtgtgcctgtagtcccagctacttgggaggctgaggtagggggactgcttgggtccgggaggtcaaggttgcagtgagtcgtgatcgtgccactgccctccagcctaggcaacagagcaagaccccatctcaataaatacataaaaagaaaattctctgattttaaactactggaattgctgagacaacaaaggtgttcacctgcaaaaatgctagctggttactgttgctcatttttcctccatttcctggccttaatctgtggctacttttcctgttgttgaaccacctgttcactgatacgcagccattagaaacatgggctgaatcctttcaactgcatccaacctcttaaaatcgtttctgtttctgacagtcttcttatggccttggccttttctgtattttggaatttagggcatgttcctgtgaggctgaattaagacatatgagcgcaatgtggcgtcatgcaggtattccatagtaagaaatacatttgttgctgtgatctgtataactgaagcatgttgcagtgcactctgatagtttctcctacatcggtttgtaaaatgctgactgcaagccaccaaattgatatcatgaccagcaataggccacaatgcagagtcgtaaaaactttgtcatggtagaaggagtgagagctttcgagtttagttgaggacaaacctgcttaaaatcccagctcttttatttacacgtatccaaccaaacctctgtgctggttattctcatttcaacctccacatctactccccaccttgtctgccttcttctgggctctaactgcatcactctggcttccatccagtggagagcacgagatcagaaaggggacaggtctggaatgtattagcccaactttccctgcctcactacgacgcttggttccagacagctcctgtccagctggcccttctctgagactccagctccctccccttcccctctcaggccattgtcccttccggggtgcttcatcattctttgttagttccttgcaccctgcccccaccctgtagatgtactttttccttaggtagacttgagggtgccatttgatttcttctgtagccctaatgcctcctgattttcctatctaaaaaccggagatgacaatacccacctcgtagaactgctattcgttatagaattaagaatagccaagtgcggtggctcacacctgtaatcccggcactttgggaggctgaggcaggcagatcacgaggtcaggagttcaagactaacctgaccaacatggtgaaaccccatctctactaaaaacacaaaaattagccgtggcacatgcctgtaatcccagctactcaggaggctgaggcaggagaatcacttgaacccgggaagtggaggttggagtgagctaagatggcgccactgcactccagcctgggtgacaaagagagactccgtctcaaaaaaaaaaaaaaaagaaaaaagaaaaaaaaatcaaaagtgcttagtacgataatccagatccactctttgattctttatccagcccagtaaacaggatccacagtgaatctaaaggcgcgtcattaacttcaatctagatttaggcttaagtgcatgccctgttttctttccattgagcctggttgttcttcaaattaaaatacgccttgcaacattggggaacaccaacccccaaatcccttctcttcaactttatctcccaaagaagtcctgggggaaagcgaggaaaggagcattcataatccccatgatgcctgcagcttcaggaaagaagaaagggatgtatattctcttcagcctcaagaaatggctttgttttccctcccgtcaatgtttattcacccccatagccctctccttgaggaacctggaataggaagaacatatctgtggccttgtagttgtccttcattagaagctggcatgaaagagtgtttaataaaatggagtattgatatacacaattacttgtcaattaaaaaggacttttttaaaagaaggtgagtattggcagagacatctgtttcttctttttggtagtgaagtctccaatagcatagagtcaagcttagcttttgcaatttgggttaatatattgcaaaaaaaaaaaaaaggcttaaaagtgtaaatggaagatagattcattcaaacataattgctgagtgcctattacatgtcgggcttgttctgtgccctgccaatctagcagtacaaagaacaaagttcctagtctcagggagtttatatcttaatggtggaagacagacaaacacgtgcagatgtttaaatgcatattttcaaaacatctcacgcctgtagtaatcccagcactttgggaggctgaggccggcggatcacttgagttcaggaatttggaaccagcctgggcaacatgatgaaaccctgtctctactaaaaatacaaaaattagcctggtgtggtggtgtgtgcctgtagtcccagctacttgggaggctgaggtgggaagatcgcttgagcccaggaggaggaggttacagtgagcccagaaccagccactgcactccagcctgggcaacagtgagaccctgtctcaaacaataatcaattttaaattacatcatgagtaatgtaaagaaaaagcatgatcagggaataaagaatgttaggaggtgctattttatattgggtggtgaaggaaggcctcagcgaggagggggcaattagctagaaatctgaaggaagacactgagcatcagtgcagacatttgggaaagggtgttctaggcacaaagaactgcaaatgcaaaggacctggaatgggagtagatgtgaatgtggatagcaaaggaggctgacgtggacggagcagagtgagctggaggcgagaggtgggagatgagtttgcagaagtagccagcaaactcatcaagctggtcaaacttgtaagctgaagtaaggactcaactattctgagtgatgggggagagaaatgtcttgactgacctgtacgttaaaagcctcacttgaagccaggcatggtggctcacacctgtaatcccagcactttgggaggccaaggtgggtgaatcacttgaggccaggaattcaagaccagcctggccaacatggtgaaaccccgtctctactaaaaacataaaaattagcctggcatgatggcacatgcttgtaatttcagctactcaggagactgaggcaggagaatcgcttgaacccaggaggcggaggttgcagtgagccgagatcgtgcctctgcactccagcctgggtgacagagcaagactctgtctcaaataaacaaacaaaccctcacttgattactggggggagacttgatggtagaagaaaaagaagagaagcagaacccaggtaagcagctaggaagctgtagtcacccagatgagagaaaaaggtggcctggaccacactcgtacaagaggaggtatgaagaggtcagatttagaatgtagttgaaagtaaagtgtacagcatttgctgatgattggatgtggggtttgaaacatgtaacaattagatgctgtatttccaaatgtcttgaataataagaatatatgcaaggacagaaataaatttgtctttgactttcctttatccaaagaaatcagaagatggagaaaagcattttagagaaacagtgccagggtatgtgattgccaggtgggcactgcatgactgggtgcctcactgaggaaaaagtaactcaacatgggcaaaggagatcccaagaggcaaaaatgtcattatacgcattctttatgcatacttgtcagaaggagcacaagaaacagcacccagatgcttctgtcctcttctcagattgttccaaaaagtgccagagaggtaaaggaccgggtctgctataaaggaaaatttgaagacttggcaaactcaggcaaaagacccattatgaaagagaaatgaaaacctatatccctccagaaagagaggcaaaaaaaaaaaaaagcccaagaggcctcctttggcttttttcttgtgttctgagtattgcccctgagtcaaaggaaaatatcccggcctatacattggtgattttgcaaagaaactgggagagaggtggaatgacactgttgcagatgacaagcagccttatgaaaagaaggctgcgaagctgaaggacaaatatgaaaaggatattgtagcagactgagctaaaggaaagcctcatgcagcaacaaagggaattgccaaggctgaaaaaaaaagaaaaaaagaagaggaggatgaggaggaaggagaagaagaagatgatgataaacgagttggttgtagcagtctttctcttgtctataaagaatttaacaacccctgtatacaactcactccttttaaagaaaaaaaaaattgaaatgtaaggctgtgtaagatttgtttttaagcattacagtgtcagctgggcgcggtggctcacacctgtaatcccaggactttgggaggccaaggtgggtggatcatgaggtcaagagatcgagaccatcctggctaacacggtgaaaccccgtctctactaaaaatacaaaaaaattagccaggcatggtggcgggtgcctgtagtcccagctacttgggaggctgaggcaggagaatggcatgaacccgggaggcagagcttgcagtgagccaagattgcgccaccgcactccagcctgggcggcagagcgagactccatctcaaaacaacaacaacaacaaaacaaaacaaaaacagaaacaaacaaaaaacattacagtgtctttttgtacaattaacagattacaaaatgtctcttaagatagccctgtcctggtgatatttttaatagacactaaccttgcctgatacagaatgggggttgtaattggcacggaaatttaaagcaggctttgttggggcacagcacagattagttatataggaggatagttttttcatcttcatttgtctctgatgcagcttatacgatatagttgttgttctgctgagtaccactctgtaattgaaaaaaaagaagttgcagctgttttgttgacattctgaatacttctaagcaaatacaattttttaaattaaaaaagcattttagccctttgccttcagtaaactgggcatgaataagcccaggtggcatcttttaaagtgttaagtaataacggttcccatgttcaatgcttctgggaggttatagtcctcagtcaattaatgtttcctcggtgtatagcgacccctgtctgcaggaatgctgtgtggagtacactctcaagaaggaggtgatgtaaagaacatgcaacttggaatcagatgcggatttgagtttcaatgctcataagagcagagtcaagtggcttaactttttgcttccttatttgtaaaatgggaatgacttcaactacaatcatgcattgcttaatggggatatgttctgagaaatgcattgttaggcaatttcattgttttgtgaacataagaaagtgtacttacacagacctagacagtacagccaactacacacctaggctatgtggcatagctcctaggctacaagcctgtacagcatgttactttaccaatactgtaggcaactggaacacaatggtaaatatttgtgtatttaaacatatctaaacacaaaaaaaggtacagtaaaaataaggtataaaaggtaaaacatagtacacttatatggggcacttacaacaaatggggcttgcaggactggaagttgctctgggtgaatcagtgagtggtgagtgaatgtgaaggcctaggacattactgtatgctactgtagacttcacaaacactgttcacttaggctgtgatacatttataaaacaataaagtaattgtgctatgatgtcacaatagccacaatgtcactagggaataggagtgtttcagctccattatagtcttatgggaccaccatcatatatgcacagtggttgactgaaacgtctttatgtggcacatgaccgtaactcaaagaagacaaagcttgtgaaaatattttatatactgaagtgtaagcttacgaaaatttcagagaacctagtataaattgtaagtattcatgttataaacagctgaaagccataaatcagactcaccatgtttttttttcaagtgaaaattaaaatgtgaagcttttgttgatttttaaaatactgcatactcatttaattttttcaagctgtatgcttggtgtaaaaattcaagtacagaaatggagaaagtgaagtcttcaggagtgtctcctctatcctcatatccactgcctcaaatttgctgttgacccttccagaatttgcattgcaaaaaaataaaaataaaaatataatacacaaatgagattacataatccataaatgccttataacctgcattttaaaaaaacttaacaatatattgtggacaattttctatgctaatagatttatatccacctcatccttgttaaggctgacaccagtggttttccatcttgcctcaatattagattcacttgaagaacttaaacaaaaaacaaaacaaaaccctagtgctccaaacacatctagaccaattaatcagcatctcagagggagtccagataattttttttttaaatcttctgaggttattctaatgtttaaccaggattggggcccaggtatcttaagtagtgatgcaggatttttctcggctcctttgctggactcccagcaggggcgctctgtctactaggcccaccacactcagccccttgtgggagggagcacatgagtgagtgagtccagggtccagcctgccacttcgccaccgcaggagaaagctttgtgcagagcccgcagccagaccagtggtgtcgccttgaggggaatgcagtggcacccaggcaaggatgcctgagaccccaaagccccagagggggtggtagtgtgctgatgagcttttttagttctgccatccacagcccgatggatggcagcatgttagcagcccggttggcccctggccccctcacatggggtggctgtcctctgctgaccagggcaaagggtcagtgtgacagcctttctgggtacccacacttggatctcaagctcttgtccagcatccaagaaaaattaggtcacccttgataattgaacgatagtgagggcagagaattttattgagcgatgaaaaagctctcagccgagaggggagctggagatgggatgggaagggctgttcatcttcccctgaggtcaggaggtctcttccctgaagtcaggccatctcccacctctaccaactgagtctggggtctttacaggcacaggatggcggtggggtggactgtaggtaatactggaaaaggcaacatttgattggttaaaatacattattcagaaagaaccaatagggagagagtgggcaaacaggaatagaagttctcactctggtccatgggcttcacactgtttttggcttgaaggtcgggtttcaccggagacccacctctgtctgcctaggatttctctgccacctgcctctattagtagtactctgcattatatgaatacaccataatagatttaacccatactgttttgatgaacatttaggttgcaaggtctctatacctattccttatatttgcatattgtctaccatacttgtgaatagacatactttgttcacctactataaagcaagttagttttgaaggccgggtgtggtggttcccgcctataatcctagcactttgggaggccgaggcgggcggatcacttgaggtcaggagttcaagaccagcctggccaacatggtgaaaccctgtctctaccaaaaacacaaaaattagttgggcatggtggcacatgcctgtaatctcagctacttgggaggctgaggcaggagaacgacttggaccccggaggtggaggttgcagtgagctgagattgtgcaactgcactccagcctgggtgacagagcaagactccttctcaaaaaagagaaaaaaaaaaaaagaagttagttttgattaaaagtagctttttaatacaaaggataaacgcttgaggtgatggataccccatttaccctgatgtgattatgatacattttatgtctgtatcaatatatatcatataccccataaatatatatacttcctatgtatccataaagataaaaaattaaaaagtagcttttattgaattaattcaggtttaaatataataaaaaccaattgtaagacagcttaatatttaaaattgttctacacaggaccagctacataatttgtaggttccagtgcaaactgaagatgcaggactccttgttaaaaaaagtattaagaattttaagacagcaacagcaaagcattaggccaagcgcaggcacgttgtatgtctatgaagccagcctagcttctatgatgtgttagattacatggtcacaaagtttgaagaaaatattttttttgtttgtttgagacaggtctcactctgtcgcccaggctggagtgcagtggcactatctcggctttctgcaacctctgcctcctgggctcaagtgatcctcccacctcagcctccccagtagctgggactacaggcacacatcaccatgcctggctaatttttgtattttttgtagagacaggctcttgctatgttgcccaggctgggcttaaactcctgagctcaagtgattcccctatctcagcctcccaaaatgttgagagtacaggagtgagccactgcacccagcaaagaaaatatttttatcgtgagtgaatgattgcacctctaagatcactgccaagtgaaaaattatgtaatcttagtaacccctatgtgcaagatagtacatgctttactctttacactgcacaagacagatatttttgcttgttgatagcattaatagcattatgaatgaatttttaacttttactatagaatgaaacttactgtacttgatgccacggaaaacaataagtatttttctggctcctctagctctggtcatctatccactttagtcttagggagagagtacaacaaaagatagaacgcatagcaaggtagaatggggacctatgtctttaatatcttgctcagaaattaagaaatattgttagagtaggtagctagtcatgaatgagcagggcaggagagggctccccttatacacacacccccctccacacacacacacgcacaccccaggaatttcaggcgaccatcaggtgacggtcaggtggttattaactgtctttctaaaacaataattggttgcagccagcaccagggaatagcattctcccaatagatacaaaaaacctgaaactagtgatcagcaactttccagtaagatctcaggagctgggtgagtgtgcgcaagcgtgcacattaagaagcaaaatggcagaatttaactggtatttgatcttctagggacgtgcaactgctaatggaagaatgcctcaagtaagcatgtatacgactccaataaacacactatgcatgctcccctcccaagtcctggcaagccactgtgcatgcagacagcccaccccaagggaaaaatcaggggagaagggacatagaccccagaagtatgccaacgtataaaaccctaagtcaaaggtcaaatggggtacttgactttcaagtcgcccacttggccctcttcccagtgtatttccttccttttgttcctgctgtgaagctttttaataaactttcactcctgctctaaaagtcgcttctgtctctccttctgccttatgttcctcgatcaaattctttcttctgaggaggcaagaattgaggttgccgcagacctgtacagatttgccgctggtaacagtatgaatatgatcatactccttttgtccctaaatttctatggtataggacttgcactttactaaaatatacaaacttgcaagaaaaggaggctgttgcattgaccctacacttaatgccaatgcccaccgtttatatttatgcctttaatcacgactgtcgtaagaaaaatattattgctgtcattttccttgaaactgaaactcagaaagataaggtagatttgcccaaaatcataaagaaccagagcctggattcaaacctcacctccatctgattaaaaaggccatgattttgatcttaaaaatagtccgaggagaggagagaactccattggaatatgggggcagaaggtgatgtgatgtgatgtgtctaccagccaaggagtgccagcaaccattagaagctaggagggaggcatggaacagattctccctcagaacctccagaaggaaccaaccctgccgacacctggattttggactttccagactccaggattgtgagagaggaaatttctgttgttttaagtcacccagtttacggtactttgttccaatcccctaggaaactcatacatcatgcttctattttggaacaataacaggatggtaaaagtccagaaaagatgaagatgatgaatattacaaatacttgtccatctcatgctatttgtccccctcccataccttactgattgatgtccatggcgcactgaatgttcacagctagaatattcttggacacctgcatacctctgctctactggttgtatgcttaccaagaatcggttttgtttatttttagttgtttttactgttataattttgtcactttgagacaaaatagggaaataggccagacccatgcctgtaatcccgacattttgggaggccaaggcaggaggatcacatgaagccaagagtttgggaccagcctggacaacatagcaagacccccaactctacaaaaaacttaaaaatagaaaaaataggccaggtgcagtagctcacgcctgtagtcctatcacttttttgggaggccaaggcaggaggatcgcttgaacccaagagtttgagaccagccctggcaacactgtgagacctcatctctggaaaaacaattttttttttaattagctgggtgtggtggtgcgtgcctgtagcctcagctacttgaaaggctgaggtaggaggatcacttgagcctgggaggtcaaggctgcagtgggccatggtcctgctaccacattccagcctagcaacagagcaagactctgtctcaaaaataataataattaattaattaattaaaataatttttaaaataaagagaaaatagagaatttattttattttattttatttttgaggcggagttttgcttttattgcccaggctggagtgcaatggcgcgatctcggctcatcgcaacctctgcctcccgggttcatgcgattcttctctcgagtagctgggattacaggcatgtgccaccacacccggctaattttgtatttttagtagagaccaggtttctccatgttggtcaggctggtcccaaactcctgacctcaggtgatccacccgcctcgggatcccaaagtgctgggattacaggcgcgagccaccgcgtccggccgagaattgttttattaaggcttgtatgttaattcatcctaccgtagaaaatttaagagtgttcattaaaagtttattttctaggtcctgatgagttctgactttctgtaattctaagctgatctaacaacaagctaaccatatatagctaaaagttataggctacgtacacgcggtgttcactgtatgccaacgctgtacacaaatatttgtctatgctaacttgtctgagatcatacatcccagaagtggtgaagtcaagtttgaaacccaagcactctggctcgggatactgcttctctccccttagcgcatattactggcattagttgaagacttctttaatccaagtaaatgtagaaaagcaacaattataaataacaagagtccctcgggtagaccgcctgactctcggatcaactgaggttccacccagagcacgcccgccttcagtgagccgcaacccctatccctacggtctttatctgcaattctctacgaactgattcactcgatttttaaggattttttttgttttcttttcattacttctttcagtttgggggaatcttcctgcacatttgactcggctctgagtgcgcagaccaacgtgtttcctctttctccagcctagggcggtgccagcccagggagcctgcgcttagcggccccaggcccgcccctgacactgaacgccgcttgtcccctccggcttgccgtcctcgcagccatggcggccgccgcgctcccagcatggctgtctctgcagtcgagggcaaggactctgcgtgcattctccactgccgtctactcggccactccggtcccgacacctagcctgcgtgagtgtctgtctcgtcttctctgggctttgggggaggtgcaagagcggaataccggcctcatgaagggtgccgcggtggctgagccagcgccgcccgggggaggccagtgcgtccgctgccaggcccgtctggtaggaaaaccatggacgtgggtctgtgctctgcacccgcgttgcccggcttctagccgcctgtttctgccctgggtgctctgggagtttgctcagaaagcttacatcccccttccccgtgacctgctcctgtgttgcccccgtccacagcccctggcacaggttactggtgctgtgttgtttatcgggcatcggcgctgttgaaccatggatctccccaaacattaagagagtcatacggctgtgctaggacaaattgctgctctgaattccaggccaccaaatgggcggccttcattcaacaggcgttgatgacctccatttaacagagattgtagggatgcttgatagcgtgcttaccccggaggactctagtggaaaatacagatttattagcggagaagtgctatgtagggtgagaggcgctgtgatagaagtgtggctagaatgacgggagcgttgaggaggagctggcgtgagtctaatcaataggcggatcctacctgtgctacttcctgttatatctctaatttactctcctcatactaccaactatctagttcaggtgaccatctcatttctacaagttttttttccgtttcctgtttcccctcttgctctcctacattgaattctcaaaacagccaaatgaggttttcaaaatttagatcttgtcttgctgctctcatgttcaagatctacaaatggtttcccattgttttcagataaactataaatacattaatccttcatactggctcttcataggtctaataattgtctatttttaaattttcattcttaaattcttggaatacttaactcctattgtataccatgcagtgttctagacactcaccggagatacggcaaggtggggaagtcaatagtataaacaaccaaacaactaaataagatgtcagatagggtttaatgctttgaagaaaaataaagtagagtattgagaatgatggatttggggggagtagtggccacaggatggtcaggaaagatctttctgaggaagtgacatttgaacagggccccaagccatgcagagatatggggaaagagcctttggggtatggggaactataagtgcaaaggccaaaagttgagaacaatctgaggggtgtgatcaaggaacgggaagaaggacaatgtggcaggagctaagtgtgagtagaggagagagtggtagtatacgacgtcagagagttagttaagtaataatctgatctctcaagagtttgtagacatttcatttggatttttggcttgggttttatattgaaaggcttggaacagggaactgatataatgtgatttacgtttttaaaagatcactggctgctttactggggtaagagtggaagccaaagatctgtttggaggctgttgcagtaatccaaatgaggtgatggtgacttggattaaagtaatagtggagaaggaggtgtggttgtatttgcgatatattttgaaggtaaagttcataggatttactgatggatttgatgtggggcttgaggacaagtctcaaaaaaatcctgttacatttttgttctgagcaattggatgaatgatgattccatgtacacgaattgggaagactggaagaagaaaatcaaaagccctgccaaggggctgagtgtgggggctcattcctgtaatcccagcactgtgggaggtcgaggcctgcggatcccttgagcccaggagtttgagaccagcctgggcaacatggcggaacctcgtctctattgaaaatacaagaaattagccagacgtggtggcccatgcctgtagttccagctactccagaggctgaagtgggagaatcacctgagcctgggaagtcgattacagtgagccgtaatcgcaccactgccctccggcctgggtgacgggagtgagaccctatctcaaaagaaaaaaagttctgccaaggatgcattatagttaagacgcctgttaagtgccttcagcctcttttctctctgtctctctctgttctgttcttaaatttcagccatattgaatttgttcactttgattttccatgtgctctcactctgtcaaaacactttttctcacctgcttgtcttcatggctacgtcctgctcatctttcaggttttagcttaaagttcactttctcagggagattttccccaactgattagagttttccagagagacagaacgtagatgtaggataggatagatgtagatgtagatatatagacatatgatgggattttttaggggaattgactcaccccacaataggctgtctgcaagctggaagcccatgtcagtccaagttcagaaacctcagaaccacagaagccatgtaattttcaggccaaggctgaaggcctaagaactcagggggctgcgtgtgcaagttcctggagtccaaaggctggagcacctggagttctgatgtccaagggcaggggaagagtgtcccaggtccagaagagagagagagagaatatattcttctttcatctgcctttttgttctttctgtgccctcagctgattggatgatgcccacccacattgagagcaggtattcctcactcagtccactgactcaaatgcctgtctctcctggaaacatccccacagacatgcccagaaataatgctttaccacatgtctatgtattcctcaatccagtcaaattgacacaaagttaactatcatggctgggcacagtgactcacccctgtaatcccagcactttgggaggctgaggtgggtggatcgctggagctcaagagcttgagaccagcctggcaacatggcgaaacaccgtctctacaagaattagccgggtgtgctcatgtctttagtcctagctacttggggtgctgaggtagaaggattggcttgaacctggtagttcgaggctgcagtaagccgagattgcaccactgcaatccagcctgggcgagagtgagatgaccttgtctcaaaaaaaaaaaaaaaaaaagaaagaaagagaaaaaagaaaaaattcaccgtcatacaaactaattgactaggtttcgttccctgctatatgtgttcataatatttatcactgtttattgaaattatttgttaaaaagttgtcttacttgacagactctgtaagagtcattttttagataatgaattcactgtatctgcaattcaaataactgtagaattttccttactggggctaggcacagtggctcacacctgcccaccgcactttgggagactgaggcaggcggatcacttcaggtcagcagtttgagaccagcctggccaacatggtgaaactctatctctactaaaaatacaaaaattagccaggtgtggtggggtgtactggtagtcgcagctacttgggaggctgaggcaggagaatcacttgaactccggaggtagaggttgcagtgagccgagatcacaccactgcaatccaatctgggtgatacgccgagactccctctgtttccagtttttagtcttcattaagatgattttggtccctgagcttaccaaaaaaaaaaaaaaaaagattgtttcattgttatgttactaaataccttaaattgtgttagaataatgggatcatgattgatgttgaacaactaacttgacatgataaaattctctttaactactgtgttatcttttatgtacagcggaaagaacacccagaaatgaaaggccaccaagaagaaaggtaaaaagttcgtatactctactatcttaatggtttctggagttctaaaatgaggcagatattcattataaggcagaagggtgttaccagagaagacttcacaaggtcatgtttactgggtgattgccatagccctggcagaggttagtctttgttttttgtcagtacccagagaatagatgatctttgagaggttgacttactgaggaactcccaggaaacaggtgtataaaccagaatatggaacaatttctaatgctatcttaagtcctgcagcctgggacttatgcattaatataactagtttgtttatttatttattattatttatttgagatagagtttcccacttgttgcccagctggagtgcagtggtgcagtcttggctcactggtacctctgcctcccgggttcaagtggttctcctgcctcagcctcccaagtagctgggactacaggcacacacctccatgcctggctaattttttgtgtttttagtagagagaggttttcaccatgttggtcaggctggtcttgaattcctgacctcaggtgatccacccgcctcagtgctgggattacaggcgtgagctactgcacctggcctcccaaagtgctgggattacaggcatgagccacggcacctggccgtattctaactagttgagtctcaccctgtggacatttggattccttacttctatggaggaatctaaacgataaggtcagttggtgagcaatagtgtcagaacaaagacacattagttggaagttaaatggtatcaaattacaatcattaagagcagtcatttcctcaggactattacctgcttctaggatattgactacactggttttgatattgcgtaggcggggcatggctgaattttgccactataaaccctacttttgtatgtgggccatcccctcgtatttgatgccattaaaaataaatgttaatgtgattgactaagctatcaagtactagtttttctctgggcctaggagacatataatttttcattatatatttattcaatcagtttaaccctaattattttttccttttctttttacttccaagtacttaacgccccctcatgtactactgacttccatcaaagaagttcgaaaaattatttcaaaatgtattgttaattcaccctttcataagcaaaatgtaaaaattttgctaaaagtccagttaaagaaatttttagtgaagaaaatgtgatattaaaggggatccttgccagagggtttgaagaaacagtgcagagatatttaggtagatttagtgttgtttttaaaatttggacagcagcagcattgtgggaggtcagattttacatatgttgcaattttgcttctatttcttgtaattgtagctttttgctttaaaattaaaattctttaagaattaaagaatgtgtttatatttaaaatactaaacgattttatatttcttaggcactacctcctaggacagagaaaatggctgttgaccaggactggcctagtgtttacccagttgcagcaccatttaaaccctctgcagtacctcttcctgttcgaatgggttatccagtaaaaaagggcgtgcccatggcaaaggagggaaatctagaacttttaaaggtaagacaaattgctgattcattggctcagacttacatagaaataaatgctgatcttcccccctatttctgctctcttatgcttcaccgttcagtgtatagcagcttagtgtattttaatttaaatgttaaaaataatataataggtttattattatacaacaccagataataataggtgttgtattttgattatcaatggtaaagaatactcaaagaatcctaggcatttaataatgtaattagttggctgggcgcagtggctcacgcctgtaatcctggcactttgggaggccgaggtgggcagatcacttgaggtcaggagttcaagaccaatctggccaacatggtgaaaccccatctctactaaaaacacacaaaaaattagccagacgtggtggtgggcacctgtaatcccagctacttgggaggctgagaaaggagaattgcttgaacccaggaggcggaggttgcagtgagccgagatggcgccactgcactccagcctgggcgatagagtgagactctgtctcaggaaaaaaaaaaagagtaattagtcaatcttgtggcttcccttgtgacctttttctgttgtatctcttctttttggagatgggggtcagtatgttgcccaagctggtcttgaactcctgggctcaagagacatgcctgcctcagcatcccaaagtgctgggattacaggtgtgagccaccacacccagcctatcatatcttttctatattgcatctttccagtggaattaagaaaaatgaaataacctaatttgagattaagaattgggaggtgaaacttccagtttaaaaagaggaatttaaattttttctgtccataaaggtagaatattatttagtattattattatagtctaccaaatttaactttattgcttgaagcaaaataggttaaggcaaatgctttgtttgatagcatgtataattatttatcatgggtgttttaaagaaaatataaatgcttagtctgggaatgcatatcttagatggtttcttaaatacaatgaaagttatacaaaggacaatgaactgttttccattagatgagagtctttgaaaaacaaaagtttgctaaaaggtgatgagaacagggagaatgggtactctgttgctggagacaggggtaaatgaaatttggaaatgggaatgtgaagacacaagaaagcatacatcaaggaaaacaaatgttttctttgaatgaaagaagataattttgtttaaagaggtctttggagaatcactgggtgagagagtagcggtatatttgcaataatgctaatggttgtaaatgacattttaataaacataaaaatccaaacatttaatgcatgccatttatttgtagtaatggtgtcattgaataagcttattaactgagctaatgtatgcaaagtgcatagaactgtgcctatgtaagtccatgcaaattgtctattgttttttcctttcatgatatttgagttttatatgttcatgtttcaaaaataaaagtctatcactctgatctgttaaaagtagcccctcaacactagggtttataatttttaaaatgtataaaaaggaaaaaaccaaaaagtacagcaaatgaagctgcccatccccaaatcccagttttcagtgcctattttctcttgattaaaacaatattttctggccaggtgtggtggctcacacccgtaatcccagcactttgggaagccaaggcaggcagatcacttgaagtcaggagttggagaccagcctggccaacatagcaaaaccccatctctactaaaactacaaaaaaattagccaagtgtagtggcgcatgcctgtaatcccagctacttgggagactgaggcaggagaatcacttgaacccagggggcagaggttgcagtgagccggggtcgtgccactgcgacagagcaagactccatctcaaaaacaaaaaacattattttctgatcagccctcaagatacttggcataattcgtggagtaactttcggcttgtttaaattttctttccaaatgagcctttaagctctttcagatgtttaacattattcaagaaatgacctaataaatgctaattatttatttgaagaaatcaaatctctgacctttcctgaattttcattcacactatgaatgattcagtagccttttaatgtgtcatcataaatatattcctaacttcattaaactatccagttaagatttgctaccttcacttattagttcataaaatgtttattatgtacaaagttgaaatactgtcatgctatgcagcccaggggaattgggatgattaaacaatgatccatatcctggccgggcacagcggctcacacctataatcccagcactttgggataccaaggcgggcaggtcacctgaggccaggagtttgagaccagcctaggcaacatggtgaaaccccgtctctactaaaaatacaaaaattagccgggcatagtggcacatgcctgtaatcccagctacttgggaggctgagggaggagaattgcttgagcctgggagacagaggttgcagtgagctgagattgtgccactgcactccagcctgggtgacagagcgagaccctgtctcagaaaaaagaaaaaaacaaaacaaaaatccacgtccttaagtcctttcagttttataaaggaaatatacatgtatacctgtagatttgtggcaggaagaatactgtaaaaatgatgtttagtttttttcatcatgattgtcattataagatgcttggtaaaagacaaaagatttatatgatctgaagacaaatccaggtatcactgtaaattacttggtgctgaatctatattttaagaagtgtatttcttgaattgacaacatccgtgacagaaaatcaatattgtaaaaaaacagattttgggcgcggtggctcacgcctgtaatcccagcactttgggaggccgaggcgggtggatcatgaggtcaggagatcgagaccatcctggctaacaaggtgaaaccccgtctctactaaaaatacaaaaaattagccgggcgtggtggcgggcgcctgtagtcccagctactcgggaggctgaggcaggagaatggcgtgaacccgggaagcggagcttgcagtgagccgagattgcgccactgcagtccgcagtccggcctgggcgacagagcgagactctgtctcaaaaaaaaaaaaaaaacaaacagattttatttactacatgttttattgggcctgtgatttagttttatgagaagattatctttttcatgtttttaagacatttagctaatttatcttttaaatttctctatttaagattcccaattttctgcatttgactcctgtagcaattaaaaagcactgtgaagcccttaaaggtaagtggttattttcttatatgaattttatattgactttgaacataaatttaagaatctctgttctgatatactgtatagccttatattcaagttgttttcagtgaattgttacatgtcaagtctgcaaattgtttttgctaaccactacaaggtattaggaataataattagaaaccatgatccttgttcacaggtaagttagggacttactgttgagttttagaaaacatgcacataaggctgagtgtggtggctcatacttgtaatcccagcactttggaaggccgaggcgggcagaccacctgaggttaggattttgagaccagcctggccaacatagtgaaaccctgtctctactaaaaatacaaaaaaattagtcctgcatggtggcaggcacctataatcccagctactctggaggctgaggcaggagaatcgcttgaactcaggaggtggaggttgtggtgagtttaaatcgcgccattgcactccagcctgggcaacaagagggaaacgccatctcaaaaaaaaaaaaaaagaaaacaaacatgttccatataagaagactaaagtaaatgttgcagatacttcacagagaagaattatcttgaagaaattatttaaaattttaaaaaattagtgacacatgcatgtggtaaatcaaatagtaaaagagcttatgatgaaaaagcactagccttatgtgctttctttaccatccccagcccctcatttatttatgtatatatgcttatatttataatactctgtagtatatatatttatatatacttgtatactctctgtagtgtgtatgtgtatttataaaataacagaagtaatcactggaatatgattacaccttcagttctggatttattgattttgaaaacctattgatttctaggtataaacatagatttcatgtacttacactactacttctccttctccttctttctacatgcatggaggtaaaggcaaataacattttttaactcatggttctgtgtatgcttttataattatgtatatattccaatttaagttctgattgatagttatgattgattagatttatttaggagttggtacctttggataaagtcttaatatactcatgctgatttaaaggtgttgtatattacatgctcagtatacttactaaggcttttcaggaaagaatatgaaacctagaaacacttcacaagtatcctgattatgttgggaaggagatgtggaatagtaaacataattatgattaaatttgagcttttgaaagggccttccgtttaaaaatgtaaggaagactatataaagaggtcctaaaacataggaataataaccttactcttgaaatgagggaggaaaaatctgttgcctcttaataggtcttctactttaggacattgggatgcttttctatccctttagagtgtgtgtttctctatgcatttgtgcctggaattagactaaaactgatcacttccaaatttgtgtcccaggctgggcatggtgcctcacacctgtaatgctcgcactttgggagtctgaggtgggtggattgcttgagctcaggagttcaagaccagcctgagcaatgtggtgaaaccccatctctacaaaaaacacaaaaaattagccgggtgtggtggcatgtgcctgtagtcccggctactcgggggcctgaggcaggaggattggaacccaggagattgaggcggcagtgagctcagatcacgccattgcactccagccggggtaacaaagtgagatcctgtctcaaacaataaaaaaaaataaaataaaataacaagtttttgtcccgtttgccacaaatcatgtattagtatttgatcatctgtaaagacagttaacaaatggcattgcactgtgaaaaattccatgtttcttctttttaaatgtgacagggcgtggtagctcatgcttttaattccacagtacagcactttgagaggccaaggaaaaaggattgcttgatcccaggagtttgagaccatcctgagcaacatagtgagatcatgtctctacaaaaatattaaaaaattagctggggtgtgatggcgcatgcctgtggtcccagctactctgtaggctgaggtggacgacagagtgagaccctgtcgcaaaaaaacataaaaataaaaaagtttaaaaaaattaaatgaaaggcttttatacagcacattcggaagagtggcattatattttatagtatttaaatgagtgtcttaatctttccttaattatccctttacacttgctgctggcctccggattcagattgcgtcttccgtataactcaaaggcttttcaagtacttcttctcagttttctttcaaagtaggtcagttcagattttatatctaacttgcaaatggaaaatctgaagcatgggaaagttaggtaatttaccaaaactttaataatcagtggcagaagttaaatacaaactaaggtcttccaaagtctcatctattgctctacctatcagatgagtaaaggctaataggagtctattatgtgttttccatttggctgtctttttttagacatataatttaggtaatttaattttaaaactgtaattatcatttgatgattgaaatgacttattcacatttttttttttaagtaaaagaaaaaagagtcagtgcaaacccaagagctcacaaaattccccaaactagtctctcttataaagtgcttggaagtgatgcatcttatagtgcaggatattggagtaagttcatgatgggaatgaaattcagcctcaacaatcttgctctgttcatattttttcaatgttacaatgatgttaattgcaaagatacttctttcccctcaaaacgaccgggtattgattttttaaacagtgttcaaggaatggagtgaactatgtttaatttgttaacatgtttagtcccagatatcagagagtctttgtaatccagagtgacattttgcagactctgattttaaagcctaaatgagagcaaaatattgttcctattataagaaaatcgttagcccaaggaaatgttattggcaaaatagttctcactgccccttagactgtcacctagaagagctcccacatctgcctgtgattatgaccagccttttctgcagttgtgcttttttggaggaagcatggatctgtgcagtctaatatgtttgacccaagaaaccagttacttttagctgttcttagagtgaggctgtttaagaaatgagatttccattgtggacagccttatagtgccagaagttttcatctcaagctgaaagttctctgccatgctaacttgattgaaacaggacaagatgaaatcagctctgatacctgggggaagctgggagctacctcttttcctttaagtttttttttttttcccattaggggcctgagtttatgcttctgtgttatgaagatagagaggcatgttcacagtgcttggagctcctgttgtggcctaggtctcagacccaatcccacttcctctctatgctctcttgcccaaatatgaggacaaggctttcttctttccatttaaccccattggcacatagaagtcacatagaaaaaatatcagttcttataagaatccatttaagggcttaggcatttgtacctgtttgagttgaggttctattcagccaaatttctagacgactgttgactccatctcagtttcttcttagggctttttgagagctttcaattcctttcagctgatctttagtaacctttagtaattaatactatctgttacttttttgaaaacagtaatgctgtgggcactatgaactgtttgcttttagttggtacagaggaagtaaactgtccagtaacagatatgtgcaaagcttataataagcttccatcaaggcacagttcccttttaactgaaaataccattaccaccaaacctgaaatatccaaagaattccctaattaaattgcctaatttaggatgtacctgataggaaaagggataagggatgatgctatatatgtaaagtgcagaagagaatctgttctttcatgtaacttggtgatgctctcagtaatttggtattgtctagtagtatgcattacaatgagaatttacttgcaaaagtgtaattgaaattatttcttttattctcagatttttgcactgagtggccagccgcactggacagtgacgagaaatgtgagaagcattttccaattgaaattgacagcactgattatgtttcatcaggaccatctgttcggaaccccagagcacgagtagtagtcttaagagtaagagtttttttcattttttttttttaaataagaatcattctaatacattatttaaagatgtctttggtggctggcacagtggctcatgcctgtaatcccagcactttgggaggccaaggtgggagaattgcttgagcccaggaatttgacgccagcctgggcaacatagcaagaacctatctctaaaaataaagaaagaaattgatatgtgtgattataaaactgtaatatttttcacagaaattttggaaaatacaagtttcaaattatacaccaggcatggtggctcctgcctgtaatcccagcactttgggaggccgagtcaggcggatcacctgaggtcaggagttcaagaccagcctggccaacatggtgaaaccccgtctctactaaaaatacaaaaattagctgggcgtggtggtgggcacctgtaatcccatctactccggaggctgaggcaggagaattgcttgaacccgggaggcagaggttgcagtgagctgagatcgctccactgcactccaacctgggtgacagagcgagattccatctcggaaaaaaaaaaaattacaaaattgcccgtaaatctactatttgtaaccactgttaactatagtagctcattttagtatatagtcacagcctgcctttgtgtatattaatgggatgatactgtatgtgttcagcagtctcttaacaagaattaaacatttcccaataatattaaacattctttaatttaatttgaatttttttgagatgagatctgacaggcagagagtagtggcactaacatagctcaatgtggcctccaatttctgggttcaattgattgtcctgcctcagcctccaaagtggctgggactacaggtgtgagacactgcccagcccattttcttaaattttttgtagatacaggatctcactttgttgcccagcttttcttgaactcctggctcaagtgatcttcccacttccgcctcccaaagcactggaattacaggtgtgagccactgcacccaatctaatttaattttaatggctgcatagaataacgtataaatgagagattgttatgtaccaagacagtgtttgaatctgggggtgtaatgttgatcacttcaaacttagccttttttctgagactgaagtgtgatatataaataatttcataatacagggctaccataatttatctgtattatggaacctttaggctttttaatggttttctttattagaaaaatattttaatgaatattcttaggtattaatatttgtatgtatttctaatgatgttcctaagataacttcctgaaaggagaactatgaggtcaaaggatatagctcttgaagtttgttgatatatattataaaattcctgcaggaaatgtaaaaaaatataatcccagcagaatgtgagaaggcctgctttcctgtgctctcaccaacctacatattacctgtcaacttgataggtaaaaaatttgtcttatatttaaaatttgtatgtctttgaatactagtgaggttgaggatttattcctttgcaaaacatgtattttttgtcatttgctcattttggtggtgtattgattccttgtatacctttttttttttttttttttttttttgagacagggtcttaccctgtcacccaggctgaagtgcagtggcgcgatcttggctcactgcagtctcttccatccgggctcaagtgattctcccatctcagcctcctgagcagtagctggaactgcaggagtgtgccaccatgcctggccaatttttttgaatttttgtagagacagggttttgccatgatgcccaggctggtctcaaattcctggactcaggcgatctgcctgccttgggctcccaaagtgctgggattacagatgtgagccaccactacagggccgttgtttctttttaataatggctttattgagacatagttcacttgctatagaattccccccttaaccatcctcaagccccttttagccactaatctactttttgtctctggatttacctattcttgatgtgttacagaaatggaaccatgcaatatgttttctttcacttagtgtaatgttttcaataggtttcatctgttgtagcatgtattattttatcatttctttttattgccaaatattttattttatgaatataccacattttatttatccattcattaattggtggacatttgggttgtgtctactttttggatgaataatgctgttgaacattcacatacaggtttttgtgtagatatgtgttttccattctcttgggtatatacctagcagtggaatgactgagttgcatggcacctccatatttaacattttgaggaactgccaaactgtttttgaaaaacaatttcaaagtggcttcactattttacaatttcaccagcaagtttgaggctttctatttctccacatcctcactaatggttattacctgtcctttagttttagccattctgataggtatgaaagtatcattgtagttttgatttgtgtctccctaataaccatcttttcatgtgcttgttgactatttgtatatgtttggagaaatgtctgttcatatcctttgcctgttttttaattgggttgtttatctttcgattgttgagttataagtgtattttatatattctggacaccagtcccagtcccttctcagatatatgatttgtaaacattttcttccattctttgggttgtcctcttactttcttgatgatgtccttttttttttttttttttgagacggagtctcactctgtcacccaggctggagtgcagtggctcgatctcagctcactgcaagctccgcctcctgggttcacagcattctcctgcctcagcctcccgagtagctagaactacaggcacccgccaccacgcctggctaattttttgtatttttagtagagatggggttttcaccgtgttagccaggatggtctcgatctcctgaccttgtgatctgcctgcctcagcctcccaaaatgctgggattagaggcgtgagccttttaagcacagaagttttaattttgatgaagtccaatttatgtaagtcatgtgctgcataatgatgttgtggtcagtgataaacacatacacaacagtggtcccaagagattataatactgtattttcactgcactttttctatgtttagatatgtttaaatacacaagtacaattttgttacagttgttacagtatttaacagtaacatgctacacaggtttgtagccaaggagcaattgactataccatgtagtctaggtgtgtagtaggctgtaccacctaggattgtgtaaatacataatgatgtttgtacatgacaaaatcacctagccatgtctttgtcaaaaaatattgttaagtggcgtatgacagtatttttccttttgtttcttgtgcttttggtgtcatatgtaagaaatcattgtcttattcaaggtcataaaagattcactcttgtgtttcctcctaaaagttttatagttttagctcttacatttagatctatgacctattgtttgttaattatcatacagttgttcctcagtatctgtttgggattggttccaggaacgcttgtaaattcatagatctgtggatgcctaagtccctgatataaaatggcatagtatttgaatattgaatataacctagtacatcctcctatatactttgtcatttctagattacttataatgcctaatacaacgtaaatagttgttatactgtattttaagaatatgcagtttaaaaattgttatattgttattttttctgaatattttcaatccacgttccaatccacggttagttgaatccacaaatgtggagcccgtggagacaaagggctaactggatatggtgtgaagctggggtccagcttcattcttttgcattccgtttgcatgttgatccaataccatttttgaaaagactattctttcccattgaatggtcttgacatccttgtcaaaagtcatatagttatcttttaacttttcatttggctactttaccaaattctcttttttaaattttttattatgaaaattttcaaatgtatggacaagtagaaagaggctaatataataaatacccatacacatggcatcttgatttagtaattaatattttgacaaatttgcttcatacacatacatacacatctaagtaccttaacatttctgacacctaatgtttcacactaaaatacttcagtgtgttatctctaagaattaaggagatgtttcctatttaattccaatactattaccacatgtaacaaaattgtcagtaattcccaaatatcatctaaaatatctactccacattatatttcccctattgccttacaaaatggtattttttaagctctgttattgaaaccagaatcccgccaaagaccattgtatttggtaatgatgtatcttatgttatctggaatggcaaacaaccccacctccctcccttcttcctgatgaatttgacttgttaaagagacagggtatttatcttgtaacatttcctatcttctgaatttgccccattgcatctggatgtcatttaccttatttctttatctcctgtatttcacataacctggaagttagatttaaagggctgataagattccagttaaatatgtttggcaagaatactttatagatattgctatgtattttatattgcatcaggggcacgtaaagtctggtggcctcattctcagtatgctgaaattgagcacttggctaagaagctgacaacctaatcattcctttgtgaagatttttgttttgcttttcccttgaacaagtaatctgtgggtggatatcaagtaaaatcattattctttttggtcctcgaagtatatctatcttacctttggccagtgggaactcttttaagttggttcctgtgtccttttgttacaatcctttagcatttgaaagtttccttgtattttgacacaagatggttcaggctcatttttataaatttcttatcccggacctggaatcagccatttttcaaggagccctaatacctgccagtggacaatggtgtttacagaccatgatctggatgctaggacttctcagctgattctttcggaaatttctcaagacataatagataaataatggtagttttaattccccttttcaagtaaccatagcttgttttttctttttgtcttttgcattagataaaatttctgaagtcatatttctgtagttccttatgctgttgcatactttaattgtctgtgcctctagtgtttaacctcaagtatgaggtaggatttcagtgagataatagtgtttattatgttaatggtgtatcctattcttagattactagcatttatgaaattacctcctttgaattattgaagtcataaattacatcaataggttttcaatatactgatgcatttctgaaccctggtcagttcatagtgtatcattcttttattctactgctgatttgctgtgctagaattttacttagggtcatttgtccggatgccatattgctttggagaaacatgagatccctactgttactcacctggaccacgccacgtgccattgcacttccaagtgtctgccctaggaacttctaatttagtatttgaagtcactgtttgtttcctttgtcaaagaaatcttggtacacatggcatatctttttcacacagcagtcatggagcagttacctgatatactttttaaaattaaactttttattttagaatagtttttagtttacagaaaggttccaagaatagtagagaatttcagacccaggttcccctgttgtaaacatcttaaaatatactatggtacgtttgtcacaactagtgaattaatattgatactgaatcaatattgaatttattgttattaaagtccctactttgttcagattatcttagtttttttctaataccctttttctgttccagaatcccatccagtttacaaatcacatttagtcatcataatttcttaggtttatcttgggtgtgatgtttctcagacttgacttgtttttgatgaccttaacagttttgagaagtactagttgtatatttggtagaatgtctttcaacttgttgtgtgtttggggagaaaaaccccagaaataaagtgccattctcatcacatcatatcgagagtataggctattaagatgatttgttttgtttgtttttttgagatagtgtctcattctgtcacttacgctggagtgcagtggcacaagcacggctcactgcagcctcgaccttcccaggctctggtgatcctcccacctttgtttccccagtagctgggactacaagcgcaagccaccacggctagctagttttcgtattttttgtagagatgaggttttgccatgttgccagggggttttgccatgttgccagggctggtctggaactcctgggctcaagtgatactctcacctcagcctcctaaagtgctgggattacaggcagtgagccactgtgccggccatgatttgtcagtgatgatgctaatcttcatcacctggctgaggtagtacttgtccattttcttcaccataaaattatacttcctcccctcttacccatactgtactctttagaagaaagttactatgcagagcccacacttaaggatcaggaggtatgctccacttctttgagaaagaagtatcacataaattatgtacagtccttttatatggcaaatttgttcattctcccctatttattaatcatttatttatatcagtatggactcatggatatttattttacactatgtgtcataatccaataaaacattatttttttgctcaaattgttctgagtttaaccattgggaactctttccagtgactcttctgttcctttgccatgcccctgtcatttgtttttaagcaatttcttattttctggcactacaaaatgctctgggctctttccctgtcccattcctagaatcagcatttctccaaggagcccttactgatgtgcttttgatttgtctggagggtgactactacctctttgaggtgcctcctgggaccctcaaaatattaacttttatactctgtgtagcctgtactttaagccagaacattcaaagtacactgaagaaatgtgttgaaaatctatgcaaccattttcgcattatgtactagcaaataaacaatctttaatttctggaattttccattttcctcagtgatattgttgattgatttgtagttttctttctttgctaggtttcagtatcagggctgtaccaatttttttcttaatttaatataactttatttttttgagacagggtctcgctctgttgcccaggctggagtccagtggcgcgatcttggcttactgcaacctctgcctccatggttcaagcgattctcctgcttcagcctcccaagtagttggaattataggaatgctccaccacacccagctaatttttgtatttttagtagagatggggtttcaccatgttggccaggctggtcttgaacacctgacctcaagcgttcctccctccttggcctcccaaagtgctgggattacaggtgtgagccaccgcacctggcctgtaccatctttatgaagtgaattatgaagctttccaatcttttttattttgtagaacagtttaaatacacaacaatatactaagttcttagattgaagctgtttttaaatcacaaagacagtatatgtttactgtataaaatttcaaaaatcccaataaaagaaaaaaaagaattgaaagttcagccatgcttgtaccattccacaggttcatatttttaagaacatattaaatgttacctatttttcataataatggtaacaactacaaccaacagttgttgagctctgttgtgtgttgaaaaatctctgaactgagagtcagaaaacctagatcttaatttacgttattcacctcaagttttgtgggcctccgtcttcagtcctagaattgacatccaatgtccctactggttctaagtttgcttattttatttcacacaaaaataatctcattgctttatttgaaggatggcaccagatttcatttcttgtatcatgcttttcctcttgtcctctctgtgccttgtgctagcctgtgatgccttcattgctcccttgtaccccttctgctgacttcatgtctgccctgctagactctgcaccccacctgctggctgttgaggctcagtggtggtgtcctggatgtgccatgtagttcaagggtaaacgtaggtcaaacaggtggactaaagcacatgcagtccagcatgattaaagcaatatcgtgaaggtagtcaactgttagaaactactattggacatactcaaatgttttaatgcacagaaaaaaaaattttgatagtcataaaagtttaggattaaaaacaacttatatataactttacttcaaaagtgctttattctattaatctcatttatttctgacaaaaattctggaattaagtgttcttgaggaaactgagtctcagggaggtaacatgatttaaggtaacattaaatggcaaatctacaaatcaaaccaattcttgtcttttatgtaataccagcattctttaactaaccacatcatacttgcatatagagaaaatatttcacaagtttagacatttccgaatttatgtagctctttttgtgttaaaatgtagtcatttgaagatatatatatatatatatatatatatatatatatatatatatatatatatatatccagcacctcctgtgatttgaaatatcagtgttattttggggataatgttaacagtattatatcgattctttgaaatgtagcaactgagggcaaaatatctaagtactttgaattttgataaaagacagtgaatgccactcagcccaggttaaagtattagcccagattaaagactacaatgttgcagtgcctttgagtgctaccaggtggcgtgagtgcaccacacaactgttcctgaaatatttatgatttttggcataaactccatatagttattgaacattaaaatgttaatgttaatgtgagttttaaattaatgtgaatgtgatcttacattacacgttgcagtaatgatcagctttgctgcctttttttggaccacttcttatataaaaagctagaatactttaagcttttgaaacttttaaatttattgttagacattattatgatttcattgaagggaggtttaaaaaaggcaaaatcacaacattctcactatcctaatgtaaaaactatttatttttctctccctgttccctcttatacatgcatatgtgcatatatttgtgtattcataatcataataaaggtatattttattttttgtaaaaaattcttcatattggttttaatcagagtataaaatggcttattttatctgtcaagtcagtaacctggtagttgatacattctctttccagaaaactgtggtgattcacattgtctaattgagagttaatagtcagtattcatattacttgagttgtttttaagagtgcatttatatttatctattttctctacttcaaatacaaaatacaaaaattcacagtgctttaaaaaacaatatatcctcccttttaaaaatttatgtattcattcagcaaatatttgttgcatgcattttaagtgttaagccattgccaagaacgagatagcatcattcttaccctcaagggtttcaaatcagtggggaaaaaatgggaaaataaataggctactatactgtgatgtcttgagggaagtgtacagagttattgaagctacagaaaaccaaatagatttcaaaatcctatttagctttttttcttcttgatatagttacagctcttttttattcttaatgctctccatagaagattaacctatactttaccttatttaactgtattctggtgtgtaacctaacctatcttcttttttttttttttttttgaggcagagttttgctcttgttgcccaggctggagtgcaatggcgcgatttcagctcaccaaaacctccgcctcctgggttcaagtgattctcttgcctcagcctcctgagtagctgggattacaggtatgcgccaccacacctggctaattttgtatttttagtagagatgggtatctccgtgttggtcaggctggtcttgaactcctgacctcaggtgatccgcccgcctcggcctcccaaagtaatggcattacaggcatgagccaccgtgcctggcctatcttcttgtatcaaatgtattcatctctagataatacctttagcccatgcccttattctctgcaaattaaaaagtgtgttcatttgttctagcacttcccaaaatatgtctaaggaagactactgttgtgaaccgttccttgaaaagtggaatctgacgtcaaataaatttgagaatcattgcatattaaccctgcattttgaaatttcaagatgcttattagcatattatctgttctaaaaaatgctaccttaaaaaacccaatttacctcggcatttcctaaacattttcaacagaaagagccttttaaaaaaattcttcttagcctgtgggagtagtgttaacattttgagaaacgttgagctaaatgaatttttcaattgttttgatccttccctgatgctgtattccagcttccatgagatatctgtagcttttaaaaaaagcttgttgcagtgatacaagtctcataattgcatggtagaacttgtaatgatgcaagtctcataattgcatgatagaaatttcttaaagcccttatgttttatctatttatttctatattccaacttaactaacgctaattgagtttaattctattagtgctactcgtaagcaccataatttcatttatttaacagatatgtcgttagttctttcagggaaggcattaatgcccagaactttcaaagaacttcaaacagtatgttgccttccctttttctgtttccatgagtaagatcagggtttataatatgtcccaactgcttgctctgtatagaaaggagtttggaaagctttctttttagtggatttaatgttaataggaataacattgctacctttttttcactaaacaattatatgaaattattttttcaaataacttttcttatttttaaggtaaagctttccagtttgaatttagatgatcacgcaaagaagaaattaattaaacttgtaggagagcgatactgcaagaccacagatgtgcttaccatcaaaacagataggtaatggaaaaaatgttcagccgactggtcacgtgtgtttcctcattgtcctccaattccttggcagtcctttttaaagaaactatattgaagatgggggagggcgtagccttttcttattaagcagagttctctaattcatatttttaatatcctcacactggcctactattgctgtgatctttatgcagcggcatgcttagctaatttaatgttatttttaaccttgattttaatatttccatgtatataaaactcaagagagagattagaagaaaaaagtgtggtttgctagtgattaatgcttaagcaggcttttacacattcaaagcatataaaaatcttgtagttcaaaagtaaaattattaaatgatctatggatctatttggaaattgatgaaggcacattcgtaaataatcaaaatctcagagccaggacagatgtttataaaggcaatattaaatttatcatatatgaatttataaattgcgtcattttttatttgaagtaaagaaaggttattggtatgttttcactaaatggctattttatttttagaattatactttagctgtttccaaattatgtcaaaatataaaaagacccacttttagagataagttaagtgggccgatctgctgtcttcctgctcatccctgtttgaaagcatttggaggtgtcagtatcgattaggtctcatgatttgcagtggtgggaagaaggagcctgacacacatgcagagattgcaacagtgtggaggcagaaaaagctcaggaccatggtttgtgattattaccatatgggagaaagtagatttgaaatatattaggaatagtctttttactatcttcagataatgttggcttttctagttcatgcaactttaaaaaatgcctttaaaatgttattgtttgaaattctgtgagtatccaataatgttgcttttttttttttaggtagttttacaagtgttagtgtatggatatgttttatggtaactatttagagtagaggacttaaataaatataagtacagaataagcagtatagttgaagttatttgtcatatgatggttttatttgatatttaaagaaattggaagtaatcgtatctttctgtatattattttattatccttaaagctcaatgtgtcatctcatgtatgtagaagttttacctaattttaagttattagttccattttaaatacagcagcaacagcacagcattgtatagtgtaactcatttttaaaagaatcagctctaggaaaaccaagattaacatctatcatctttctatatctacttcttatttttatttttaaatttttttagagattgagtctcactctgtcacccaggctggaggtcagtggcacagtcatagctcactgaagccttgaactcctgggcttatgcagtctcctgcctcagtttcccaagtagctaggactacaggtgcgcatcaccatgcctggctaattttttaatttttgtagaaacagggtttttgctgtgttgaccaggctggcctcaaacttctagcctcaagcaaccctcccacctcaccctccgggattacaggcatgaggtacatgcctagctctatgtctactttttagatgaactcatcagatatgttcatgctatctggcagattcttagcactgagatggtgaagggaacttatattggacacaatcctagtaaaagtagcgtaagctattgttacatacagataactccattagtaatgaaaacaaagagatactcgaaattaagttaaaataacaccggtgtttagcttcctcaagtaatgaactacaaagactatttttattccaaaaacagttttcctaaagcagaaaaggaatacctgaaaacattatcttctgtatttagtatattgcatattttgcaaatttttctgtgtactgagtttttagaattttgacttctcccgctttctctttaataggtgccctttaaggaggcagaattacgattatgcagtgtatctactaacagtgttataccatgagtcttgggtaagtgtgtgtgaatatttaatgattttgtcattgtaatttagatgatgttaacctttcaaaatactctttgtggcaagtactcaactgagtattttgtgaactgctgaataatctaagtatgtatgaaatgtcataggtagcttctactgactttaaaagtaaaggtcttgaaataggattattcagttcatctcaggaccttgctaaaatcatattcctaaaatgccttgaaacttcagagtttttgactttgtttttctttttttgactttgggtgaaagttgtcagctatgaagagaataataattatctgtataatttgagaatttataattcatcctctttaaataaactgcagagcaaaactttatagaaaggtattttaaatgtttattgaaatttttagttaacacataacattttgtgtgaacatttgactgttatgcattaggtagaactaagggcaattaattatagcttgagtattctttttccaaaatgcttgggaccagaagtgtttcagactttagattttttcagattttggaatatttgcatattaatatataatgagatatcttggggaggggacccaagtctaaacaggagattcatttatgtttcatatacactttatacacatagcctaaaggtaattttacacaatactttcagtaattgtgtgcatgaaaattttgaccgtgctccatcacatgagatcaagtgtaaattttccatttgtgtgtcatatcagtgttcaaaaagttttggattttcaagcatttcagattttagattttcagattagtaatgctaaacctgtatttaaataatattaaaaatactcgagtctgaatttagagagttttcatgtaagtatgtacatttataaggaagattttgccatgcttgagcaacacctcatctgatttgaagttggtagccaatatgtttaggtaactcaaagtttgaaacagtaatttttaaaattaaaataattataggtatgcatttaaattaaattttttgtgccttacccaacacaggggactcaatagcatttcatactaggaacattcaaaggaataaagttagctggagaagggggtcatgttctttagaaaggacttcatatgtcagtgtctacagaaacagtgaaaaaaggaaaaagaagtaaagaaaaatagaaaaaataaaagttttcatatggaagagggcttacatttgtttttaatgactcttagagatacaacaaggtagcgacaatagtaagacagagacagactttggtttactgagaacttttttttttttttttttaaagtctcactctgttgcccaggctggagtgcagtggagcgatcttggctcactgcaacctccgcctcccaggctcaagttattcttcccgagtagccaggattacaggcatgcaccactaccgcctggctaatttttgtatatttagtagagacaaggttttgccatgttggccaggctggtctcgaactcctaacctcaggtgatccacccgcctcggcctcccgaagtgctgggattacagttgtgagccaccatgtccagccctcccaaggggaactttgtgagagagccatcataagatgcaatgagctacttcagtaggtagaaaacattccatccatcggccacttagtgaagataggcaaaaaaaatatactccttgaataggtagttaaattccatggcctttggaacctcctttcagcccaagttactgtgattctgtgaatacatgcagctgttctctaaactgctcacagcttttccttcatattatgataaaagagttttcacacaagaggatgaatggaaagtgaaagaaaaaaacttggttgtgagatgagtaaaagacaaaaagtagctggtaagctcttctcttctttacaattatttccattattataatttatctggattttctagttctggctttaagagcaacatcagaatagcagttaatctctttcctacacaattgattttagaaatgctgttggcttaagataattaagttttcttttgaaccagcaacatggctgaattagctacagctttatggctgttgctgcttaaagatttaataactaacaataaatacaacccgttttgactttcttattttgccagtatctattagaatgaatttgcccagaaggaaatgataggcataaattcagtggaagttgatttatgggattctttctgtggttccgtgacttagaatccaaacagggttgcattctggattcacacagaagcctttgatctttagtgctgattactttgatgccaggataagtagccacatacaactgtccaaacaagtatacttgaagaattctatattaccgttgtttcttggtgctttctaaacaagtaccatcagtgaagaagattttgaatacagatgagccgtgaaattttgcggagctgctagaaaagaatttttattgaattgaaattcattttccctcaccaacatggaattcatacttgaaattgatgttatcaccgttatttaatcaaatagagagcctctttttaatccattgcttgattttttttataggctagcttctgagcatttaatacccaaatatatgcttcctttggcttttttttttttttcttcgagtcagggtcttgctttgttgtccaggctggagtgcagtggtatgatcatggctcactgcagccttggcctcctgcgttcaagtgaccctcccacctcagcctcctgaatagctgggactacaggcgcatggcaccatgcccagctaatttttgcattttttttgtagagatgggatttcactgtgttgtccaggttggtcttgaactcctgggctcaggcaatccattcaccttggcctcccaaagtgttggattataggcatgagccactgtgccctgccttcccttggctttttaaccttcccctagaggttacctctaagtagcactgaggggaaagtagctgctaattttatgtagcttgtagtactgaaatccctctggagaagtgatcacctagactccagtagaaggatattactgttgtatactattcaaaacagtttaactatagaagtgtcaaagtagatttcagtaagcatagacatcgcaaagcctaagcttcaggcataaaggcttaatactgcctcaaagaataattatttcagtgctgggaaggtgataagagacacatattcactggaccattcatttatccttcagcagtttaaagaagcaaggaggctgggagcactttgggaggcaaaggcaggcggattgcccgagctcaggagttcgataccaccctgggcaacatgatgaaaccccgtctctactaaaaatacaaaaaattagccaggcatggtggtgggtgcctgtagtcccagctactcgggagactgaggcacaagaatcgcttgaacccgggagtcggaggttgcagtgagccaagatcgcaccactgcactccagtctgggcgacagagtgagactctgtctcaaaaaaaaaataataataataattaaaaaataagcaaggagagttgtagagatttggtgtcctattttagtattacgtattgttagcattggaatgaatttttaacctttggagccagacagacatggatttgaattccagggccattacttagtacctgtgtaatagcctcgactatttaacctctgaggttcagttttttcctaaggatttttggatggatcagggagaatttgtgtaaagtgtctggcaaatagtgggctctccataagcatctataaataatgttgatattaacaataataaaatgaggaaagatttttttcttagaattttaaattcatggtttcccaatttctattaatatatacagcttatatttaatttggcagagtttgtacaagtaaagtcagatctatactctttaggatgtgtatcctactcacaatttgacataattgatgataacacaacttccttaattttaactttttagtgattttttaataattgaaaccttccgtaaatgattaggttgagaaataatgagtcagtttgcaaagtgacttgcacaaaagatgagcacaaatactggggaagagaaaaaaaacagttgctttagaaaagttagagatctgaaatcaaatttcagagattcatgggtgattttgatattgaattactaatggttgcttttttacattttaaaatttcggctgtcttatttggatttcatgatagttttattgtcagaactatgtctagctttgtaataaaatggttctgaaaagtcatgtaacaaaaatttctaatttagccaagcagtgttgcattcctgtagtcccagtttctctggaggctggggcaggaggatctgttgagcccaggaattcgagtccagcttgggcaaatagcaagacccccaataaaaattaaaaatttctaagttggagaattttatacttactaagagttcgttttaaaggggacattattgcagatatttctgataaaaatgaatacttttgcagagccataatcaccatttaatctgtcggatttatgagttcattttgattgtgtatgcctacacacctgcatttccactggagaatgcttgagcaatgtttgctatgtttgttctcttttgcattcaacaactatttagttcttgtgtacaagatatgttgctaggtgccactatcaaaatgaatgaccccctgccttaggtaccttgatttctggagggaaaccgttggttataatataatctgttgagcttaatggaagtaggaacacagtgctgtgagagccacagacaagggttaactccccctgaaaacgtcacaggaatgatgatgggttttagaagatgaacaggagtatgtggtacagagtgggtgaagaactttctaggccttgtgggtttaaagagcaggcagaagtttggtgtagccagggtatagaactaacagggccaagaaaggaggtgaggctagcagtaagtcagagacaggctgtgaagctcgtcgtagtgcttatttgcaaaatgtagatttgtaaccagagggcaacattgagctgatacagtattttactagttatttgaaaaagtacttctcactatttttgtttcattttattttattttgggggcttgtgtgtgtgtgttttactagacaattttaaaagtttattttctctttgaagactgagttttgctttgtcacccaggctggagtgcagtagagcaatcatagctcactgcatgcagcctctacctcccaggctcagacgatcctctcacctcagcctcccaagtagctgggaccacaggcaagtgtcaccatgcggagctaatttttttattttttgtagaggtgaagtcttgctctgttcaccacactgttctcgaactcctgggctcaggtgatcctcctgcctctgcctcccaaagtgctggaattacaagtgtgagccaccacatccagccccctctcactgtttcactgttcgtgaaagagtaaaccatcctgtgtcaaatatcaagtgcactttcattaaaaatggcaaatgttggctgggcacggtggctcacacctgtaatcctagcactttgggaggccaaggcaggtggatcacctgaggtcaggagtttgagaccagcctggccaacatggtgaaaccccatctctactacaaatatataaattagccgggtgtggtggcgggcacctgtaatcccagctacttgggaggctgaggcaggagaatgccttgaacccgggaggcagaggttgcagtgagccgagatggcgccactgcactccagcctgggcaacaagagtgaaactccatctcaaaataaataaataaaataaaatggcaaatgtttattaattgtctatttgcttgggttgctggatatgaaagttaataaatcgtggggaaaccatcgtctccaactgaagaacactctagtg

SEQ ID NO: 12263 - DNA, 34276 bp, Human
ctcactgcagcctccatctctccagctcagtgatcctcccacttcagcctgctgggtagctgagactgcaggtgcacaccaccatgcctggctatttttttttcttttttgtagagacggggtttcaccatgttgtccaggttggtctcgaactcctgagctcaagcgatcctcctgccttggcctcccaaagttctgggattacaggcatgaaccaccacacctggccaccagtatcactctttttttaaaaaaattttatttttattttaagttctggggtacatgtgcagaatgtgcaggtttgttacgtaggtaaatgtatgccatggtggtttattgcacctatcaacccatcacctaggtattaagctcagcatgcattagcagcactcttaacacacaattaaactcacatgtaatgagattacttctcattactccacaccatagtagtctattttacagatgaggatactgaggctcagggaggctgagagatttacctggagtcaatcaattgttgatctggaagcatccgatcaccaggtcttctgaaataatgacagcagcaacaattaacattatgcttactatgccaaatgctatgcttagcattttacctgcatcacaatcgcgattcctttgggcagttaggtaggttccattttaaccgaatttaaagaggaggaagctgaggctcagagaggtaacttgccctaggtaacccagggtagtcagttaaaaagtcaagactcagacctcgatctgactaactccaaagaaacccgtgccactctgcctctcggaaaacactgcttccagctgcacagttcaaaaccccacccaaggcggccctgaatcgcggtcagtcggcttcagccgaatcgcactttgttttgaacaaggatacagagggcgctgcctgatgttagtctgggggcttgggggagaagatgggggtccagggtggaaatgtaggtgctggggctgtgccagagggagagtgtccgggaccagcgggcgagtcacgtgcgcgtgaaactcgacctaaggggaggggaaaagaagggagcccccgcccccacctcggggcgcagctccggacgcgtgtaaatacaactatcaactccgcagatccacttcatccaagcccagcttcgcagacctctggcgcccggcgggttcccagttcccccgcttcttccgaggagacagcggaggcgaggccaccgggctgtcaggctgaagctccgtggcggccgggtcctgcacgcagagaagaccccagcgccggcgcggctcagggctgggcccacgggactccggacgcgccgcgaaagcgttgcgctcccggaggcgtccgcagctgctggctgctcatttgccggtgaccggaggtgagcagcgtgggcggggagggggcgcgcgtagggtctccggctatgcgtcggctgagagacaccgaggccggctcccgccgacactgccaggcttcccaaggaaagaccgttacttgcgcccgcggtcccgcggcacagtgtcccatctcgccaagcgcgtccttcccttttcttttctctgacccctccgactcttctcttcctcccgggtccccgctcgctgcacttcctctgcttagagctgcgcgtttgccagagttccagcggacctcctggagcgcttgaacccaaagccccgtttcacagatgagaataccgagtccccctggaagaagtgactggtacttcctcccctctctctgggtctttcttgcccttctcctctccgctttcctcggtctcatcccagttgtcgctccccgcccccgcgctgcccgcgttccctctcctcccgccgaggctgcagcggccgcggcggggggagctggggctctttccctccctttggtaaacacacccgcccgccagcccatccgccaccgctgcccttataaagtcagcagccgccagacttcctgccgaagtccgagccccctcccggggctggaggggggcaagcgggttccgaggtgcaaagcctggtgccccgagccctgcggagtgagtgaggggcgcgcgggggaggagggaaccgaggagagcccgtcctgggtctccctccacgtggcagctgttggcttggcccgagagactgtagggtcgtgggtcacctgatacggaaagggggagggcttgctgtcgcccggccccagagggaaggagaggtcttggaggggcaactggaagatggggtcgtagggtagccttgaacttgcccttcttcctgccagcttctaggggtctttcctggcgcgagagtccggacatgggcccgcggtgcttcagagcgcgctctgccccttgctgtcctctggggacctgggcagatgcggactttctccccagcagcccggccctgagcgccctggcctgggtgagagaacccggcagcctgctaggaagctgcagcgcgcagacaggaccttccttgtttccgatagtggctcagcgggagccccgtgccgcgtgcacctctggcactgctagtgcgcgcggagccagctccttggcaccggctgggaagcccagggctctatggggcctccatgaggggctcctcgcgggctggcccgagaggtctcgggtgccaccatgatgcaggacccttccctggggccactggggggcccttcacccagcgctctgtttctgtgcaggctcggggccagcatggcccccacgctgcaacaggcgtaccggaggcgctggtggatggcctgcacggctgtgctggagaacctcttcttctctgctgtactcctgggctggggctccctgttgatcattctgaagaacgagggcttctattccagcacgtgcccaggtatgcctgaaaatgggctgggtgggctggggggagggatggcaaaggggcaggtggaagccagaaaaggttaggtggccaggtggacagaaagcagggtcagcagttggacagcctcacttctcgacctcttcaaacttcagggggagattgggtggcactctgcccactgtttcatttatctaatccagtggtcactgaatgccaggtgtcctgctggtcatccagaccctgggactaataggcagagtcctaagcctctgacagcctcaggtctagagctctttgaaggagacgtgctgggagaggaatttcttaatagggctatcataagacaagggagagctgcacaaagtggagtatgaatataaagggccccacatccttcccttttcaggagctgggagcccccaggttttcaaattactcatttggacaaagttacatagcctcatttactctaggagggcattgtggagagtctctggtttccacttcaatcaccttgtgtgagtggccccgaagctgggagtgggaattctaacactctttgggagcagtaactacagccataggctgtctgcagctgccttggggcagggagttaccactgctggtgtctaggacttgcctctgatgggtatcttcctattctgggaaggagagagctgtgctgacaagctccgcctcaggagctgggtggaaatggaattgggctcccctctctttttatcccctttccccaacctctgtgttgtggagtaagcttggaaggaagtttagcttggatttgaatcccagcttccatcacttttatcagttggtgacttcggtgagttccttaaacattgagcttcagttgcctggtcttcagaatggggataataatatcgattccgtgggagtgctgtgagagtctgcagtgcttaataaatgttagtgtccttctcgttgctcctggcttctcgtttcaactccttcctgcacagcacctgatgtggctatggaagaaaaccgattccttgaggggtggagatggggaggtcttgatcactgctctgaacagcggctgctccaccccaggatctgccgcatccagccatggttatctgtaaagatgcaacagatggcaccgagagatggcgactctcccatgcctcctggccccaattatggggtgacaggggctggaggaggtggggttggcagccaggctgggatggctgggtgggttgggaagaagaggcctgacatgaaatgatacacataagagtggctgcaagaaccaagtggagggctattagggacccacatggcatctaagtcccctatgagtttatcctggagataggagagaccctgcctgcccttgacacctgccactgtcccctatgtaacttttttttttttttttgagacagagtctcactctgtcacccaggctggagtgcattggcatgatcttcgctcactgcaaccttctccccctgggttcacgcgagcacgtctggctaatttttgtatttttagtagagacgggctttcaccatgttggccaggctggtctcgaacacctgacctcaagtcacccacccggctcggcctcccgcagtgctgggattatagacatgagccaccactcttggcctaccccttgtgtaacttcttcctgccttctccacctggtgctggtggtgtttctttaaaatcaactttcttgaagattacatcatacattttgatgaggtctgacaaatttatatgcctcagtacccaccacacaatatttagaacctcctcaaactcctgcttctctttagagggctcatccctccacctgcatttttaaatatgtaaaatatgtaaaacagctttattaagatataatttccatgcctcacaagtcacccatttcaagtatataatttaacagttttagtatgttcagagtagtgcaaccatcaccagagtccatttcagaacagtttctttatccccaaaagtaactctgtaccattagcagtactcactcgcctcacccccacctctgcccccaagcactaggcaaccactcatctatttcctgtcatagctttgcctgtgataaaagttagatttacctattctgaacatttcatttaaatggaatcttgtaatatgtagccttttgtgattggctgctttcacttagcataatgttttcgaggttcatccttgtagcatgtatcaggacttctttttattgctgagtaaatactccattgtatggatcaaccaccattctatttatccatttgtcagttgatggagatttgggttgttttcacattttggctattatgaataatggtctggctgggtgtggtggctcatctgtaatccaagcttatttcaaggctaaggcaggaggatcacttgaggccaggagtttgaatgtgcagtgagctatgattgtgccactatactccagcctgggccacagagtgagacccaaatgttcttctggactttttttttttaatttttttgagacagggtctctcactcagtgacccaggctggagtgcagaggcacaatcacagttcactgcagcttcaacctcctgggctcaaatgatcctcccacctcagcctccagaatagttgggactacaggcccgcatcaacacatccagctaattaaaaaaaaatttttttatagagactgggtcatgctatgttgctgagactggtctcgaactcctgggctcaagtgatcctccctcctgggcctcccaaagtgttgggattataggtgtgagccaccccgcctagcccttgtaaagtttttaatgtcgaggtatgctttcatttttcttaggaattgctggtcagttgcaagggtaactatgtttaacattttgaggagctaccaaattgttttccaaagtggctacactatttcatattcttaaaaaaattttttttttatttttgagacagaatttctctcttgttgcccaggctggagtgcaatggcgctatctcagctcagggcaacctccacctcctgggttcaagcgattctcctgccttagcctcccaggtacaggcgcccgccaccatgctcggctaatttttgtatttttagtagagatggggtttcaccatgttgtccaggctggtcttgaaatcctgcctcaggtgatccacccccctcggcctcccaaagtgctggaatttacaggcgtgagccactgtgcctggcctcctttacatttttttaaatttaattttaattttttaatttttaatttctcatatatatatatttttaagactagccaagtgaagcagtgggagtggaaaaggaactggttttgatcaataggtgtaaacaccactgcactgggaccagcctattttacattcctgttagcagtgatgagggttcactttctttgtagcctcaacaatatgtgtcgttgcccatctttttttttttttttttttttttttttgagatggagtctcactctgttgcctaggctggaatgcaatggcatgatctcagctcactgcaacctccgcctcccaggttcaagtgattcttgtgtctcagcctcctgagtagatgggattacaggcgtccaccaccacgcccggctaattttttgtattttcagtagagatggggtttcaccatgttggccaggttggtttcgaactcctgacctcaagtgatccgcccacctcggcctcccaaagtgctgggattacaggcatgagccaccgcgcccggcctgcccatcttttttttgttatagccatcctagtggatgtaaagtttttttgtgattttgatttgtgtttccctactgatcaatgatgttgagcatcttttcctgtgcttattggcttttggtatatctttggagaaaggtctattcaggtcctttgcccactttaaaattaggttatctttctattactgagatgtaagagttctttatgttctagatataagtctcctacatatgatttgtaaaaattttccttccattattgggttgtctttcactttcttttggtgtcctttagtgcacaacagtttttaatattgaagtccaattttctatttttctcttttgccacttgtatcttggtgtcatgtttaaggaactattgcctaatctcaggtcacaaagatttacacctgtgtttccttctttccttccttccttccttccttccttctttccctccctccctctctccctccctccctctctccctccctccctccttcccttcctccctccctccctccttccttccttccttccttccttccttccttccttccttccttcctttgtccttctgacggaatcttgctctgtcacccaggctggagtgtagtggcacgatcttggctcactgcaacctctgcctcctgggttcaagcaattctcctgcctcagcctcctgagtagctgggactacaggcacacaccaccatgcccagctaatttttgtatttttagtagagacggggtttcaccacattggccaggatggtttcgatctcctgacctcgtgatccacccgccttggcctcccaaagtgctgggattgcaggtgtgagccaccatgcccggcctgtgttttcttagagttttgtagttttagctcttatagttagatccttgatccattttgagttgattttgtatatagtgtgagatatccacctggtgttgtaaattgcccagaagtgggtatgcttctaaatctggctgttagggattactagaggtgaccaaagtgaattttttctttgtttctttttttttttggagacagagtctccgtcacccaggctggagtgcaatggcttcatcttggctcagtgcaacctctgccttctggtttcaagcagttctcctgcctcagactcctgagtagctggtattacaggcgtgtaccaccatgcttggctaatttttgtatttttagtaaagatgcagtttcacctgttggccaggcttttctggaactcccggcctcaagtgatccatctgcctctacctcccaaagtgctgggattacaggtgggagccaccgtgcccagtccttttctcagaatttatttgtttttttttgttttgtttcatttttgagatagggtctcactctgtcagctaggcaggagttcagtggtgtgatcattgctgcagccttgaacttctggactcacgtgatcttcccacctcagcctcctgagtagctaggattacaggcatgtgcttccacacctggctaattttttaattttctaggacttatttgtccattcttgcaaagcagggtacaacatgcctatctctacctacctctcttcccttcaagggactccagccaaaatccttgaggctctcgggctgactgtgggtgctgttgcctgatctgcctcagtcatgctgcatgatcaaaagtgtccgttttctgcttcttggaactttattcactttgggtgtcagtcttcctctgcagtgtcccaagaacacagaattagaccaggaatctgtgttgccatagtgtgtggaaagaggcagacttccaactccgctatgtgctgttgggtgattgaagcttaattttctttctatctttctttcttttcttttctttttttttttttggagatggaatctcgctctgttgcccaggctggagtgcagtggtgcgatctcacctcactgcaacctccgcctcccaggttcaagcgattctcctgcctcagcctcctgagtagctgggattacaggtgcatgccaccatgcccggctaatttgtgtaattttagtagaaacagtgtttcaccatattggtcaggctggtctcgacctcctcacctcaggtgatccacccgccttggcctcccaaagtgtcgggattacaggcgtgagccaccgtgcctggcacttaattttcttaatacctcaattaccccatatggtaaaatgggactagtaatccataccttatagcgctgttgtgaaaatgaaatgagggtaagcagataaaatttcagactacggatgggattgttactacattctgaacctggctttgctgttatttgctatgtgaccttatcttctctggatctccattctttccaagtctataaaacaaagtggacaattgtcaacctttcttccaaagagcaatgatttaaggatcaaatgatgtcatttaacaaaaatatgaagagctcaacaaatgaggaactcattattattattacaattattattattttagaaatagggtcttgttctcttgcctaggctggagtccagtggtataaacacagctcaatgcatcttcagcctcctggatacaagtgatcctcatgtctcatccccctaagtagctgggaccacaggcatgtaccaccacgcacggctaattttttattttttatttttattttttgagacagtcttgctttgtcgcccagactggagtgcagcagcgcaatcaccgctcactgcaacctccgcctcctgggttcaagtgattctgctgcctcaacctcccaagtagctgggattacaggcctgtgccaccatgcccggctaatttttttgtatttttggtaaagacggggtttcaccatgttgcccaggctgatctagaacccctggcctcaagtgatccccctttcttggcctcctaaagtgctaggattacaggcgtgagcctctgcacctggcctcggctaattttttattttttgtagagacaggttctcactatgttgccagggctggtcttgaactcctgggctcaagtgatcttcccacctcagcctcccaaagtgctgagattacagatgtgagccactgtgcctggcctggaactcattattgaagcattcactagtatcaactttggggttacctggccacatcctctgacctacctataagggtatcacagctaacggagcctctgtttctcagaatttaggcagaagcagttcaatttatcacaaactactctatatccagcataagtgcccaaataaaacaattgctaaagttctttaggcatttactgtttgttagttagatatttagtcctcactacaaatctgtgatacaggtattatttttattaaccccattttatagaagagaaacctgaagctcagagatgctaagtaacttgtgcaaggtcacacagctagtaaataaagggcagagtaaagatttagtttcacattggactccagaacctttctactgggactcatgggaatagtgtggatgtccctgaccttcagtggcccagggctctcctgggggaatccagccatagacaagacaccagcgagagcccaatcctaagattttgtttgtttgtttttgagacaaggtctcactctgtcaccagactggagtgcagtggcatgatcaatgctcactgcaaccttgatctcccaggctcaagcaatcctcccacctcagcctcctgagtagcttggactacaggtgcacaccaccacacctgactaattttaaaattttatttaattaattacttactattattttttgagacagggtatcactttgtcacccaagctggactgcaatggtgtggtctcagctcattgcgtcctccacctcccaggttcaagtgatcctcccacctcagcctctggagttgcagggactgcaggtgtgcgccactatgctcagctaatgtttttattttttgtatagatggggtctcactatgttgccagggctagtctcaaactcttggactcaagcgatcctcctgtcttggcctcccaaagtgccgggattacaggcataaaccaccacacccaacccctaaggtgtttttgctgaatgtgaccatgtcagaggcaggaaagggaagcatcatggggttaggaaaggaacactgagcagggagacaaagaaaatgggatcattttgtgagtgttcgctgtgtgtgtatgtgtgacaattctcagagccagcctctcaggtggttgagaccacagtccccatttcccagatgagataatggagcctcagagagtttctgcagcacagctagtggaattagaatttgaacccggctcttccagactccaggtgcttcacaaccatcccaaacctagtcatttgcagtttaccttcatgattttaccatttccctttgccatagctagtgttatttacttaataattccttttgaatcagtctgcttaaaaaaaaatagcttcattctaaagtgtaatattcttggaatatcgggtttgctgttacccacccccacacgttatacatatacatgtatgtttctaatacatatatatgtacgtatatacgtgtatcgttttttgttattttttttgttgttgttagttttttttagatggagtctctctctgtagcccaggctggagtgcagtggtgtgatttcggctcactggaacctctgcctcctgggttcaagcgattctcctgcctcagcctctggagtagctgggattacaggcacccaccactacacccggctaatgtttgtatttttagtagagacagggtttcaccatgttggccaggtgggtcttgaactcctgatctcaagtgatccacctgctttggcttcccaaagtgctgggattataggtgcgagctactgcggctggccaatgtatgtttttaatacacattcaaataacgaataactatgaaacctgaaaaactgctccatgttacttcctgaacccatcttgagtgctcacatgctgtgcataccacatattgggaaacactgctttccctggcttccaagcccagcttaatcactgtcccatcctatgcttcgctttatttgtctataaatgttggggttgggggttgatgccaaagaccttttctgttgtcattaacatggacacagctctaagaggtcttggcatcttgggctggctctccttttagttcagaatttggatttttatccaactactcagagtgatcaagccttccttatgaatgaactcgttggtcaaactcataaaaggctgatcgataaaacaggaatgaatgtatgaattgacactaagtcattagcatttcacgggaatggattctccgttagtggaagagcacatgtcctttctggcactgatgtgtgcttgggaaacttactgagctaactggcccatgtaacacagaggccctttggtgcagtggaaaactgttgactttggagattatcttgagtttgaatctgagcctgcctgtaagaagctggctaactgaattgctttgcttcttggacccttaccatttataaaatggggaccattgtactcaccctttagggttattgcatggattaaatgggattctctatagaaaatattggcacaaagtaggtgtaaatttgcacgctagtgggattgtttgtgagggaaattgtcatttgattatcaaagacttaggagcaggaacagtgtctaattcagggactgcaaatggaaatgccagctgaggccaggcatttgctaataattgggtaaagcagggcaggtgtagaatagcaatgtctgggaattaaaagagaggtgaggacgtgtatgaccttgagaaggcaagccctggcaaaaggggatggcctccactcagctacagtcatgcctagatcttctaactttttatttttatttttattttttgagacggagtcttgctctgtcacccaggctggagtgcagtggcgcgatctcggctcactgcaagctccgcctcccgggttcacgccattctcctgcctcagcctcccaagtagctgggactacgggcgcccaccaccatgcccggctaattttttttttgtatttttagtagagatggggtttcaccgtgttagccaggatggtctcgatctcctgactttgtgatttaccctccttggcctcccaaagtgctgggattacaggcttgagccaccgcacctggccgatcttctaactttttaaagagaagcaagacatctggatttttatgtgataactcctgattttaaactggcacccaattataatttacaacactataagggtcaacattgccagcagagcaaaacatgggtgggggcaactgctggtcaccggtgtgcagcctctggtctaaaatcatctttgtatttcttcttgctttacgcattgtcccagcacagtgctgttgtatagtaaatatccagtaagtgggtgtagaatgaataaaccaatgcagataaacctgtagagaggccgggcacagttgctcatgtctgtaatctcagcactttgggaggcccaggcaggcagatcacttgggcccaggagttcgagaccagcctgggcaacagttgaaacctcatctctacaaaaaatacaaaaagtagccaggtgtggtggcatgcacctgtagacacacctactcaggaggctgaggtgggggtatcacttgaactcgggaggtcaaggctacagtgagctgggaagtcaaaggtgcagtgagctataattgcaccactgcactccagcctgggagacagagtgagaccctgtctcaaaaaaaaaaaaaaaaaaaaacctgtagagaaatgacagtgatcataaagatcactaaattatagggctagcctgatccccaaaggctgtgtggtccaacccctaagtgcttcctggaggtgtctgagcactttccccacctccttggcagctggtactgaagaagactctctgttgtccaggacagttccttccatggctggtcaacactcaggatctgccaggcctttgtgttcttccttatgtcaacacacagattcctttatctttactcttctgccacctgcatgacctttggatatgtaaagtcaggggtcattttcactactgagggcagatgtcctctaccaccccctagtatccaggcattatcacatccccttgtccccttgttggtttttttgtttcctttttcttttcttttcttttctttttttttttttttgagacagggccttgctctgtcacccagactggagtgcaatggtgtgatcatggctcactgcagcctcgaccgcccgggctcaagcaatcctcccacctcagactcccaggtagctggaactacagacatgcatcgccatgctcggctgatttttaaaatttgttttgtaaagacaaggtttcccaatgttgctcaggctggtcttgaactcctgggctcaagagatgcacccaccttggcctcccaaagtcctgagattacaggtgtgagctactgcacctggcctggtttgttcttttagcagcacctgtcactctagagctgagaacttcctgtctcatgtagtgtggatgcccagctcctagagtacgtgcttaccacatgacccaccaggagggtcagctaccccttcctcagatccttcaggagcactttctctgggccaggcactgtgcaaagctctttgtttactgtctccaatttaatcctcctaaggaggtcgtgggttaggcattctttggtccggtttacagacaagaagaaagttacttggtcaaggtgcacagctagtaaggctggtggtgggaattcagaccctggtctgtctgcctgctccaggtgcaccctgagtttgcccttggcagtgctgccaagtgacaacttggaggcctgggggcagccacctcatgactcactgagcattgagtaaagcgaagcagccctttgtctcctatcactagcttttctccttaacttgtcacaactccaagttggcagtttaccgttaaggacaagtcctccaagtggacttctagaggggactggagggcagtgcctggttctcattctgtgcctcagcttcatcacctagggaacgggatactttattaactgacttataacagtgcctggagcatagttaagtgctcaataagtattagctattattttatcagactatcatttatcgggaaagcttcctctaagttttagtgttctttctaaatttcttttttttatttagagatggggttttaccatgttgcccaggctggtctcaaacttgtaggcttaagcgatctgcctgtctcagcctcccacagtggtgggattacaggcatgaactaccacgccgggccattttaatgaattcttgttatagccattagagtaccactcactgcctttgcctttgcctctagatatgggggcacttcttgttgggggtccacaaccccctaagcttggacactgagtgcatattacaacttagtaaatacttttatgtccagtatttcatttgagctagttgaagcctcaggctgtgtgtgcacaagactctcccagggtcaggtactaatggctgccatttctggagcagccccatcagaggagatgtgactctagggtacccccaaaggcacttggcatgggatttgaaagcaggccgcctgactgtgggctgctgtctcctgtgcccagctgttcctggtgtcatgtgctgagccctcccttccccctcctcagctgagagcagcaccaacaccacccaggatgagcagcgcaggtggccaggctgtgaccagcaggacgagatgctcaacctgggcttcaccattggttccttcgtgctcagcgccaccaccctgccactggggatcctcatggaccgctttggcccccgacccgtgcggctggttggcaggtgaggtggctgggctatggggaacgggaggacagggaccgtgctgcagggggaggggagggggggtgctcacaggccaacccctcgcccttccctgtgtctccacagtgcctgcttcactgcgtcctgcaccctcatggccctggcctcccgggacgtggaaggtgagttgtctgtcctcttgtggccccacaagaaaagaataggtgggatgaaggcggatgtttaccccagctcccgcccttggcttcccacagctccccaaatgccctcatctgctgctttcccctttccagctctgtctccgttgatattcctggcgctgtccctgaatggctttggtggcatctgcctaacgttcacttcactcacggtgagtgtcacaggcctggcctggcagcagagttcccccgagtggggtgagggcagagtgagtggggtgagggcagtatgaatgggctgggggaggggcctgtggacgcagatcactagatcaagtgagtgtgtgagaaactgtgcaggtggctgcaaagagcaggtgtgaggctgtgtgtgtgtggatgaggctgtgtgtcggggtgtatgttaatgtgtgtgtttgtgtgtacagagcccatgaatgtccatggagctctgttctaggtcctggactacagcacaatcaggactgaccgagtcatcctccctgctggaggttacattttgggggtgaggggcacagataacccaataaacaagtaaactaataaattatgtcagtcgtcataggtgctgggaagaaaataaaactgggtaacatgatcttgagggggagggagcagcttgagatagcgtgtgcacgcttgccatgtcgtgggagagtgggtgtgtgaccccgtccctgtgaaagccatgagttggtaggtgtgtttgtgagtgtactaggttgaaccatatgaaattgtcgacacctcgtcgtgcacatggcttgacctattacatgtggtgagtggtgtatgtgtgttgctcaaagtgtgtttatttatgtgagtgtgtaaacgcgttaaaggcttaggagtgttaaaggcttagggaggttggaggggaaggttcctggccgggctggctcggactgtttatctctgagaagggctgcctgactgggtggttttggctgaatttcacctctccccagcagccgcctttaattccaaccggggacatttcacagctctaaaggaaggaagcggatccctttctccccgcccctctgcgcagccccttctccctgctgtgcaacttggcccagggccctaaatcccttctctccggcgcttgacctcagaccctccctggcggccgggtggggcttgtccagcggctcctccctgctatgtccccgcctcctgtaatctccagccaatggcagggtccggcgctggcaccgcccctcagcctctccccgctccctctggccggccccgccccctgggccgctgctcttggcccagacttggacgaggacgtcccgtgctgagtcttgcgggcccagctgctgttgccacgcacgctgcaaggccgccagcccggggttagccggccggcctcgccttacccacggtactgggcgcagacagcgtttgtggccccttggaggggagggggccctgcccctctccaggcctggcagccttccctggcgtccttggcagtggtgcctcacggatgcagggtgcaggaaaacctctgcctgagtgggtagaggtttttcctgagccagccacttcaggggaagggggaaggataatttagttatatgtgtttaaacaccatttttttttttttttgttgagacggagtctcgcagtgtcgcccaggctggagtgcagtggcgcgatctcggctcactgcaacctctgcctcctaggttcaagcaattctcctgcctcagcctcccgagtagctgggactacaggtgcacgcctccacgcccggctaattttttcgtattttagtggagacggggtttcaccgtgttgctcaggctggtcgcgaactcctgagctcaggcaatccacccgcctcggcctcccaaagtgctgggattacaggtgtgagccactgcgcccggcctaaacgccttttttaccagagctgttgaggcctcccttcagagtctcagtttccccctctgtggagtgtgtttaggctttgtacggatcctaaggtccttctcagctgtgggatctagtgacttggggaggatggtggggccagaggagggtgtgtgcgaagggcatcctgactttgccttcccctgccctgagggcttggctgaggcaggtgagtggaacacatgatcaattaaattctctcctggtgtgggttctgaccctgctctgcgtcagagccacctcctctggagactgtctgccctggctcagttccctcccttatttccaccctcacctcccaggatgtgatttgtcctgattaggcagaaactgggctgggacgtcaaccgagagggttaagaggcactgcctattaccgggacacagccatggtcacagccttgggttagggctgggacaacgacaatggggagaaagccattaatgtgctctgtgaacttgagtacacttttcctccctgggtctcaattgtctcatctcaaatgggttggacaagatcactgtttctttcttttcttttctttttttttggggggtggggacatagtctcgctctgtcacccaggctaaagtgcagtggtgcgatctcggctcactgcaacctccacctcccaggttcaagcgattctcctgcctcagcctctggagtaggtgggattacaggcgcatgccaccatgcctagctaatttttgtatttttggtggagatggggtttcaccatgttgtccaggctggtcttgaactcctgacctcaagcttcccaccagcttcggcttcccaaagtgctgggattacaggcatgagccactgcgcccagccaagatcagtgtttcttaagcacctattccatgtgtttttcagaggtgttacgtaacaaacttgggaaacctggaattaaacaaaattaacaaaatgtctctctgaggggtgtctgggagcctttttgaagctaaagggcactgtgactgtgtaggcagggggcagagtacagtttcccacattgatttttctgtttgttttaccttggggcttttctgctgcgtctcctggagctattgtatggagcagggctgggaatgctgggcaagggtcacggtgtccccacctcatgggtgctgctttccctcctcagctgcccaacatgtttgggaacctgcgctccacgttaatggccctcatgattggctcttacgcctcttctgccattacgttcccaggaatcaaggtatgaggccacctgggttttctttttgtcttgacacaagaaccgggtggggccgagtgagcagcagctagtgctgacccacgggtctgacttctccgctctcctttctctgtcatcatcccaatgcaggccttccccctctctcctgggccacagcaagctttctcagctggtctccctgcctctgattctttttctctgtactctgtcactcacgtgacttccagaaagatctcagatggggaactggctcacacactgctgaaaaaccttcagtggtttagcttcacctacagaatcaagtccagccccttcacatgcgttcaaggtccctgactctctggctttattcagcctttggggccacatttttccacaccttccagagaggatgggtggtttggtccaaggtcacaaagtgagtttatgccaggctggatcctggacaggtcaacctggtgtacctcgaagccaggggaccaaagttttagctcagtgcaagatgggggcctcaatttcctctgtcaaatatcaaaggaccctttgactgagccatgccatgctcctcaacctccacggtgggcagtaccaaactgcataccgttttgcactttacaaagagtactaaagaaggtacttttgctcagtgtctccaaaggagtttgagagagcgcatgggtgggggggccatcagttgttctggtgggcaggcatggagggtgggcagttctcccttcttttcaactgaagtagtgtttgaagagccagatcttacctccacacatttgggggtgtggccctttgaagctctgtcctgcccctagggaggaaaaggcaccaaggtccaagactgcagagaaaaaggtttgagcaggagcctgaggggagagcagacattaattatcctggtcagatggtatggggaggacaagaggacagatggtgcatcagcttcttccataagaagggctgacacatttgcacagaatctcattcaattgagaacttacctgccctggggttgagagcccttgggcagagcacttgcacctccctctccccaacccccccagttgttgcacgtgggaggacctgggaaaggtgagaaaaggctgagcatgagcagtctgggtttgccttttcccctggggaatgtgccaggaaggggcaggataaacacgattaggcccggtaaacctagagcactaagtttcctttgtacgtactatgaaatggacatttttgtgcgaacatgaacatgaatgtttgtggagtcataggcaaaaatgtatgtatttttttaagataatggaaatttcagagatattttgagccagtggccagcaacttcaggctttgtggagactatttcatagctctctagggggcctcaagtgaaaaagaaaaaggaatgatgggtcttctgagtctgactctaaacttctggtcttggtttcctcatctgcaaattgggcacaaggacaaggggagaagagaacttctttaaggcctctgaggcctgggatctaccttggtggggtctggggccaggcagtctcccccacgggcctgccccctcctctcacagctgatctacgatgccggtgtggccttcgtggtcatcatgttcacctggtctggcctggcctgccttatctttctgaactgcaccctcaactggcccatcgaagcctttcctgcccctgaggaagtcaattacacgtgagtggctggagtgggcagagactctccctggggcagagagggctgtggtgatatgatagacggaattaactttggattcagagagacctcggcttggacctctgcttggcaaatcgcttgagccctccaagctctgctttctcatctgtactatgagcctgttcctacctacccacaggtcgcttttgtttgtttgtttgtttagaggcagtgtcttgctctgtcactcaggctggagtgtagtgtcttggtcctggctcactgcaacctaaaactgctgggctcaagcgaacctctccctctgcctcccgaggagctggggttacaggcacacaccaccatgcccagttaatttttttattttttgtagagacagggcttactgtgttacctaggctggttttgaactcctggccttaagggatcctccccgcttgcccttccaaagtgtccgattacaggcgtgagccactgtgcccagcctcccatgggtgtttttaagtaatacagttggcacataacaggtggtcaaaacatggtaaatatttatttatttatttatttatttttgagacagagtctcattctgtcgcccaggctggagtgcagtggcatgatttcagtgaactgcaacctctgcctcctgaatagctgggattacaggcacgcgccaccacacccagctaatttttgtattttttagtggagacggggtttcaccatgttggccaggctggtcttgaactcctggcctcaagtgatccgcctggctcagcctcccaaagtgctgggattgcaggcgtgagccaccatgctcagctcatggtaactatttatgtgggtgcaaaagtaattgtggtttttgccattaaaagtaatgggccaggcgcagtgggtcatgcctataatcccagcactttgggaggccgaagagggtggatcgcctgaggtcgggagttctagaccagcctgaccaacatggagaaacaccgtctctactaaaaatacaaaattagctgggtgtggtggtgcatgcctgtaatcccagctagtcaggaggctgaggcaggagaatcacttgaaccctagaggctgaggttgcggtgagccgagatcgtgccattgcactccagcctgggcaacaagatcaaaaactccgtctcaaaaaaaaaaaaaaagtaatgacaaatactgttttcatcctttctgggtttggaggagatctgagtaggaggcacctcagcaatggcactcgatgccatgtggtcccaaaaagagggacataaaagaatcaagcaccccatcttttgtggagccacctgaatgccaactttttccagccccctgtcagttcagcagaggcaagaggtgatactccacaccaagcacataaggtgacattacagaactgacagttatgccaggcactgtacttagcccctataccatcctcaaacagctgtatgatgtagattgggtattaaccccattaataacaaaagtacagggaacaaagtgactttccaaaggtcatgccattcaaaggagggtgaatcttaggttggacgcaggctgtctgactctggagtctgaggtgttaatgctgcctcctccatgggaacagcccaagtgaaaaacagctgatccactcttcatttacttggcatctgtgctaagctggtccctgagccaagctctgagcaacagaaacagaagctctgcattaggagcttgtgagcatgtcaatgccgggtaaaggagtgctggaaaccgctgggatggccgccgagcactaggccgttgaaggtgggctctgtgtgactggttcctctacactctggcctggctgcctgcaggaagaagatcaagctgagtgggctggccctggaccacaaggtgacaggtgacctcttctacacccatgtgaccaccatgggccagaggctcagccagaaggcccccagcctggaggacggttcggatgccttcatgtcaccccaggatgttcggggcacctcagaaaaccttcctgagagtgagtgtctggtcaaggtgccggccttgggggatagtgatggtgggtcctcatattcagtgagcactcatggttgagtatttattcgcacccctcttcagtccttacaacaccccatgatgtaggtggggcatgctcctcatttacagatgggcacatcaaagctcagctaacgctgggaagttcagattcagggttaccctgctggattcctgggattggggagggaggagcttccaaaatggggacaaggtctctgggcctgtcgggtagctggtttcctcagggccccttgcaacctctgagcttattgcatcaggtgcagccaggcccgtgagcctcctggcaggggtcctccacacctggctgtcttttgccccctgctggtcacaggaggagctgcagcacctgcctgggctgcttctcaggagggtacatgaagatcccaggaccgccagctccatgataagtggaaggagctccttggagtcaggagcgggagttgaggagtttgagtcctgctctccagttataggctatgtgacttgtgtagatcacctaaccttgctcttgatttccttacctcttaaactagcactaaaagcaccccacaaactgtaaagttagttgtgatgattgaatgacaccatgggtgtggaagctctttgtaaagtgcaaaacggtgtgcagtttgagggtggttacccccagtgccgattctcagagggcaacatggctaagggcacgagctggagttaggctgacctgctgcttccagccctgtgagcttgagcaagtcatttaacttcctgagctgcagtttcctcatcagtaaaatgtgataaggatagggttgttgtaagattttattaaatggggtaataaatgtcaagtatgtagcccatagtgagtgcttcagagtttttttcttttgtttctttcccccccgccccgagatggagccttactctgttgcccaggctggagtgcagtggcatgatcttggctcactgcaacctccgcctcccgggttcaagcaattctcctgcctcagcctcccaaatagctgggactacaggcgtgcaccaccatgctcggctaatttttgtatctttagtagagacggggtttcaccatgttggccaggctggtctcgaactcctgacctcatgatgctcctgcctcagcccccgaaagttttgggattacaagtgtgagcccccgtgccctgccaggttttttttttttttttttttttgtaaaacacccacagggtattgctgttgcctgggctggagtgcggtagtgcaatcatagttcactgcagccttgacctcctgggctcaagtgatcctcctgcctcagcctcctgagtagctgggaatacaggtgtgcacaaccatgcctggcttatttttatatatatatatatatatatatatacacaaaattgtatatattatattattatatattatattatatattatattattttttatatataaattatatatatatttatattatattttatatatatatatattttttagagatagggtcttgctatgttgaccaccaggctggtcttgaactcctgggctcaagcaatcctcctgcctcagcctcctgagtagctgggaatacaggtgtgcaccaccatgcctggcttatttcatatatatatatttttatatatatgtatatttatatatataaatatatatataatttctgtatataaataaataaatatatatatatatatatttttagagatagggtcttgctatgttgaccaccaggtcttgaactcctgggctcaagtgatcctcctacctctgcctttcaaagtgttgggattacaggcgtgagccatggcacctaactgagttatttttaccacacgaagcataggacatacatccaaaaatgttctgagctgagcaagagcctggaggcaagtgaatctgaactttcccgtctttgaagaaaccagtctctctccaaagtcacatagttagtgtcactccccccaagaactgcatgagctgggacaatcagagggcagtggaaggtctggggctcaggggcgccccctgctgtctccccagggtctgtccccttacgcaagagcctctgctcccccactttcctgtggagcctcctcaccatgggcatgacccagctgcggatcatcttctacatggctgctgtgaacaagatgctggagtaccttgtgactggtggccaggagcatggtgaggcaccgctgaggcccctgggggttgggggcacaggcgggtcaccctggctgagctcccctcaccatacgtttccctacccacagagacaaatgaacagcaacaaaaggtggcagagacaggtagggctatgaaagcagggccctggctcacgcccaccccactgcaacccgcttctcagggggcgggactcctctaggcctgggcccacccaggtaacccttttgtgggatgtaagagtctgggttcagaggaaggctattttggtgctctctggcctccgctggaaggggtgatagtgtccactgagtgccagttcctgaccccactgcccttcccatcctgcccagttgggttctactcctccgtcttcggggccatgcagctgttgtgccttctcacctgccccctcattggctacatcatggactggcggatcaaggactgcgtggacgccccaactcagggcactgtcctcggagatgccaggtgacctgcctgtacagggatggtgacagcaagtggtcaggcagtgcttttcattttctctgtgcgtttacatccagcagcttgttgctttctcccaagaaccctaggagatcaggggtacctccccattttacagatgaggaaactgaggctaggaagggacctggcttgcttaataataagaatagctaatgcagagtgctgactgtgcacttggcaccttgccttgtttagtcctacaacacctctttgaggtagatgcgttaatatcttcattttgcagttgaggaaaccgaggtacagggttgcacagttaggtcattcacccaagatcacacagctttcagtggcagcctccagaacctgtgttataagggtacacgctaaagtcttgttagggctagaataggtagagttggtatattagatatttattgctgtataacaaatcaccccaaggcttggcattttaaaacaacaaacacttctcatctcatacagtttctgacagtcagaaatcagggagagactcagccggctgattctgagtcacagtctctcatgaagacatagtcaggctgtcagccagggctgcagtcatctgaagggctgactggggttggagaatctatgtcagttcaattacccccatggcctctccatagggctgctcaggacacagcacctgctttcccttgagcaagagggctaagcgacagagaccccgtatcttctctcacataatctcagacgtagcataccatcacttctgttacgttctattataggcacagagcaaccctgatatactgtggaaggagactggacaaagcaggggaataccaggaggcaggatccttgagggctgtcttgttggctggagaccaccattgagggtttttttttttttttttattgagacagtcttgctctgtcgcccaggctggagtgcagtggcacgatctcagctcactgcaacctctgcctcccaggttcaagcgattctcctgcctcagcctcccgagtagctgggattcaccatggagtcttgaacccagattctgtgactgcttttgctctttttgtgttcatccaaacagtccctgtttatcctaagaggatgggagaaagagactgggagagaaggaaatccagtggcctccctccctgctagcagagcctggccctggcactgagccttcctcctctaccctctgctcctaatggtgagggtcccctagcagggcccttctgtccaggacacatgggccgcctgtcctcaccccagcctactgacctctctcctgggctggcctcagtgcccttgattgtgccggagagaggaagcgctggacagtcaggccaagctgctgtccccaggagggcatctgcttatgtctagggcagggacaccttcctgaggacttctgatgagagacggtgtgagagcttcccacttcccaccttccttcccatccttggttctcaaaccttcaagtgtgcatgagaatcacttagtgggggatatttgtccaaatgcagatttgcagatatccccgctgagattctgagggccgagatgaggcctgtgaatctgcatgttaagaaagcacccgctttgatgcgtgtgtcattgggtaggggagcaacactttgagaaacatggagctagagaacgtgggtttctatgggtttcccatagaaacatggatttctgtgttttctgctgccctgacatcgaaggcacatctgaagggggaggggccaggccaagaaccagggagtcctgggaacgtagaggcagcagccagtgacttcccgtactcctcagggacggggttgctaccaaatccatcagaccacgctactgcaagatccaaaagctcaccaatgccatcagtgccttcaccctgaccaacctgctgcttgtgggttttggcatcacctgtctcatcaacaacttacacctccaggtacccaccttcatccttcccctctccctgcctcccgaggctcctccaaagggatggtccatccagcacctgccttccaggaagcgcagttctggtcttctgatctggatctattttccgggttctccaggaagtgtttctagtagattgggttggcgagggggtgggaattgaggcccagttggcctcttcgccctacccctccttcctccagcctccacacactctcctaacctcttcactctctctttttggttttagtttgtgacctttgtcctgcacaccattgttcgaggtttcttccactcagcctgtgggagtctctatgctgcagtgtgagtctgttgggctgaaatgccttcctgagctttgcaaccgtgatcagagaaccccagggaagggttgggagggccccaggcatcccctaatgcacctctctctgagaccctctgatggcagggagctcacttccttaaaggcagcctatcctgctgtaattgactccccctgttggagtcttcccttagaggaagctgaaatacctggcttgatgacactttggttctatgtctgctgtttgaaacggcccccagaatggcctcccctccatgcccaccctgaagaaatttcccaagggcagccatttgccttataattttcctcttcatgttggacagtccccacttgcatctctctcctggtttcccctgctgggcgctgctgagggactctcccctgtgtatgtgatggagtaacaggacattacaataatgatgacaaaatgacaaccattatcaagtgctccgttggtgcaggcagcaggcaggatccttgaccatcactccctgagttcagcctcactgcagcggtctcggcagagggcagctctctttccttcatctgctcaagccagaaccctggagtttccttgatgtttctctccctcacactccatgttcactccgtcctcagtacagccagcagcagcttctacacaccccaaatctgacccttcttgtcacctccactgctgcctctccagtcctagccaccaacatctctagcctggattattgtggcagcctttagtctcccacatctgccctggccccgctgtctcagtctatttttaacacaggggctgcagtcacctgtcaggacataagtctcttcacatcactctgtggtgtcctgtctcatctgtctcagagtaaaagccaaaggctttactatggcctaaaaagccctgcaagctctggccccagcacttcactcccctctagctccccctcctccattgttcactctgccacagccacagtgcttcctagtgctccggaagtctcaagtgtgttccctgcttggcatctttgcatgtactagtccctgtttctagaacattcttctccagatatctgcaaggtgcccaatcttaccttctctccttcttcaggtctttccctgactgtcctcttctcagtgaggcctcccttggctgtcccatgtacaattgcaacctccctactgcccgcttctctgcttggtttttctcagcgtttatcactaacactctgcctatctcttgcttattgtctgaccgccacctgctccatgggaatgccacctcctcgatggcaggaatctgttgacttgcttgatcgtggtatctccagcacctagagcagtgcctggcacatagtaggttctcagctaaatgtttgttgacagaatacagtggacagtcctgcgaggtcaatgccatccctgttattagtggaggaagtggggctcagggagtttgagccacttgccaatatcacacatacaggaggtgtgagaacccagctcagtggccctgaagttggagcatttgccctcaaggctggggaccaaagagcccatgcaaagagcccgaacgcttaagcaccaccctgcctggccagcggggaccatggtggggaggggataggagaggtgctggcctgggctggagagggccacacacccctgatactccccgtctcgtggacaggttcccatccaaccactttgggacgctgacaggcctgcagtccctcatcagtgctgtgttcgccttgcttcagcagccacttttcatggcgatggtgggacccctgaaaggagagcccttctgggtgagagcgagggttggtgtggggggagcaggagccactctcctgggggcaggggtagggccttgtatgtggtgccatccctcactcatctcagccagaggcacctcagaggtctctaatctgcaggtttccaagttgtctgccttttagaacccctcacggagtgttaaaaatacagattccccagtcccctgaatcaggatatctcagcctgaccgtaggagtctgtttttgtttttaatttattgttattttatttatttatttatttttatttttattttttgagacggagtctcattctgttgcccaggctggagtgcagtggtgcgatctcggctcactgcaagctccgcctcccgggttcatgccattctcctgcctcagcctctcaagtagctgggaccacaggcgcccaccaccacgcccagctaattttttttttttttttggatttttagtagagacggggtttcaccatgctagccaggatggcctcgatctcccgacctcgtgatctgccctcctcagcctcccaaagtgctgggattacatgccttagccaccgcgcccggccctattgtttttttttttttgtagagaaggtgtcttgttctgttgcccagtctggagtgcagtggtaaaatcacagctcactgcagcctctgattcctgggctcaagcgatcctccggccccagccttctgagtagctgcaaccacaggtgatggctaccatacctggctaattttttaaaaaaaaattttgtacagataaacagggtcttgccatgttgcacaggctagtcttaaactcctggcctcaaatgatcttctcaccttggcctcccagagtgctggggttacaggcgtgagccacagtgcctgacctcctaggagtctgtttttagtaaactccaggtgctttgtgaagtggccagtcctgactcttgggcctgtgttcaggcaccattggtccaatccagttctacctagtgtgggatcctgtctccagcacccctgaaaggggacccttccctcttagcttagataccctcagtggtagggcacccactcctgcacgaggcagccctgctgctgttagtaagtcttttccttacattgaactcatctgcctccctgacgctgatctttcatctgccctgtggggccacccacacgtaaaccctcctcccaaagaattgtgatgaaataactgcttctatttaccaagcactcactatgtgctaagcatgatgcatacttttttttaacttacatcttcgccacaacagccctgagaaggaggcactcagtaagaattgccattatttgcccaaagtcacacagtgagtaatgcagagtgggatgtgaaccgagtcagagcccgcgtgtcctgggccttccaagccttctgtccaccaggctgtgcatcccagttccttgaactgtgtctgagagcctcctctcgccaccctgaacgggatcccattggttaacatctccaaaggtcagaggggtgagcccagaaggccccatttcgggagcagcctgaccagcccagactcctacagtgctgtgccttcctcatacctacctagtgagtgccatatggtgtgggcacccaccaggccctgccacttgttatacctgagaagtctcatctcagccactttgcagaattgctgaacattaagtgagatactggtggaacaatgactacacataataagtactagctgtatttattctggctcaggacctggagaaaaatggccgccttctcctccctgtgggaggctaagggcagatgactacctacttgactctgtttctctctccttgccctaaaggtgaatctgggcctcctgctattctcactcctgggattcctgttgccttcctacctcttctattaccgtgcccggctccagcaggagtacgccgccaatgggatgggcccactgaaggtgcttagcggctctgaggtgaccgcatagacttctcagaccaagggacctggatgacaggcaatcaaggcctgagcaaccaaaaggagtgccccatatggcttttctacctgtaacatgcacatagagccatggccgtagatttataaataccaagagaagttctatttttgtaaagactgcaaaaaggaggaaaaaaaaccttcaaaaacgccccctaagtcaacgctccattgactgaagacagtccctatcctagaggggttgagctttcttcctccttgggttggaggagaccagggtgcctcttatctccttctagcggtctgcctcctggtacctcttggggggatcggcaaacaggctacccctgaggtcccatgtgccatgagtgtgcacacatgcatgtgtctgtgtatgtgtgaatgtgagagagacacagccctcctttcagaaggaaaggggcctgaggtgccagctgtgtcctgggttaggggttgggggtcggccccttccagggccaggagggcaggttccctctctggtgctgctgcttgcaagtcttagaggaaataaaaagggaagtgagagactggctggtgtgcgcctgtctttggcggttggtggggggtgtcttcccacacccccatccttcttcacccaggctcagctgggcattaactaggacgcttggcatgccagcccgttcgcctctggctgtctggctcacctccctgttcccaaccatgccctgcccttagtgcttggagggagtccagctcctgccccctacttcccaggatttggggtacatccaggaagctggcttttctccatacagaggattaggacagaatgctttagaaagaatgctaaggtatgactcaaacttcccaccatagcatccctagggcctgccgaaagtaacacttttttggagtctcctattttatcttaaaactttatgcaaattttgagcttccttgttatactatatttacatttacctttaacattaaagtgaggctttaaagtaaataaataaataacgtgaagctttaaaattatctatatcaagagaagacaccatcagtgaggacaagagatcctgcagaaagacataccttatttatccagccctgcacctgcttgtgcctctgggacataagccctggaggttagagcaagtccccaaatgaagggaaaactaacattggtttaggatctgtctgttctacacagctatctcattttatccaaactatagcctaagaggttggtgttgtcattctttcttgtcgctgtaggaaacaagcccagagaggttaaggcacacacccaagggcacacagtgttaggtggtggagctcaatttggaacctcggcagtctgtggaaaggatagctctgcagaaaggaggtcccaagcttctttccggttctcagctgctcctggggccaagagtgacctcagaggccttggccatctcccccacctccaaaggttggctctgtaagacagcattccagctaagccattttccctccctttgtctttgtttctcttgagaagttaataagagagactgtcccctccgttttcagataggaaaacctgtcctcaggggtctggagacttggcaaagtcacatcgcagatccctgctgctctgagcccagactcccgacttccaacactgactttttttgtttttgtaaagtacaaaatcagaattggctagcacccaccagcgggttcggctggctttcagtaggcttgccggggtctctgcactctgtgtccgggatcctcaatttgcgaatagtctggggaggctgagcgcgagccaggagcggacccgggggtgggggtaagcgccacgtgcgcgccaggtccttggtgtgcccggcaggcggcgctgcgtggctgcggctggctccgagggtgcggggggcggcgacccgggagggaaaacccctgcctcttcccggggcttgctctgcccgtcctttaaactcgccctacaccctccccgactcccgtccttgcaagcgttatctgcagcctcaccggccctcgcaacggtggtggtggttggtggggggtctcgaagcttgcctctggccagccggaccccggtgggagatggaggcagaaattccggcctcctaggagaagggcgtctgctcactcccccactccccggggcttggggagggggctgggcaggggcggaagcgagctggagccgtgtttgtcgcggcgctgcggagtggaacagatggctggggaggggagagggtgcgtggcggggaggaggaggggtgcgggggccggaggatagggaacgaggaatttcgaagcctggagtctcccaggagaagcccccctccccgtcttttcccagaaaggggggcatatatgcgcctgcctttttcccggagagccctggcctctgccctgtggcagaccctgccgcgcaatcctctgccccagggcgcgcccctcacccccagacccccgccgcgggacggggtggcggggtcaggaccgccaggagcggcccgggtcgcgagggttaatggggccg

SEQ ID NO: 12264 - DNA, 94855 bp, Human
  misc_feature (1)...(94855): n = A,T,C or G
ttactctatacccagtccatatacattttgactgtctgccctcaggaactgtctcaactcagggcatctttaaggaaggcagaaccaccttaggaggtagagggtgaaacgtggcaactcttccataggcgaatcaatatagcagacatgctcaaggtaggaggttttgctagggcttaaatcaggctgtcaactcaaacacaatgggctttgttactcctgtgtaaagaggaaatggagcagtttttggcctcctcagactgtattgtagggtatacaggatggcaattccaggcacaatcttcaggagacacaaatctgcttttagctattcagtgttccccagcaagttaattagctgtttctgaaatgcatggaaatattcagcattttcatagtgaagccaatctcccagatttaagctttgggggtgggaatgagtatgtgaggaagagggtctgtcagggaaacagaatagagcccttttggtgagagattccaacacctgtgacttatcttagaaattacacatgcactgtaattccaagactttttttttttttaattggtttgagcactcgagcaggagggcttgctgagacctctcactattttaggcgtggggagttacctctgggttcaaaagtctttgggtgggaagcacagaggaactgcgaaatgcctccctcagaaatgtccaattgctcaaggggagaagcagggagtggggtcaggtagcagccaggaaggttgcaggggccacgggcacatcctctccctgagtggtaaggtggcaagtgggtttggggaccattgctttgacaacttgtcaagggtgcggagagggctgtcccagcaaggtgaagaggtctgtaggaaaggagtctccccagagacctcctaaggaccagaagagcgcgcaccccgccaagtgacagaacgtgccccctctgtgtccgctcccttcccccgcggccaatcaccgggcagaggcgtctcacgccagcaggtcctccctggctcctctccttactcgtccgggcggaccaagcctcagcaggagccccgcctgtctccaggcagtttgagcccccgagcgctcgcccagcctgtcagtaaccgccgtttgcgttttcttccttcctttctttcttttttttcctcctcttttcttttccccttctgcctttgtcccgcttagtaactgggctctgaccaatcgccgccttaccggccggcgccggctgtctcctgattggcccgcttggggcgcgcagccgtctcccgctccttcgcaggagcaaggcagacaaaagacgcaggctccaggctccggcaaccggcctcagccaatcaccacccaccttgcctctcttccctcgccccactccctcctcgcctggctcgcgtgctcccggcactgactcctggagtgcggccagcgcccggatcgtaccattctgattgaggctgggggagagcgcggatggctgattggggagccgaagcctagagagcggtggggagacgtgaaagtcgagatggagagcagctttttgaacatgttctcaggcacttgacagaatcccggtacatcgaggcgggacggcgtggaaggggcggtggtgatgcctgctgtcccccctcccggcgcggttgggtggcgcctcagcgggtgggcagcatggggcggggagggtgtcccctccgcgccgttaaaatgaaactctagtggctggagtccgggcagagcttgagggcagttggtgcgggcgggttggttcttacaccccggcgggagcgcccagacaagccgagctgactggacttctccggccggccccattcccgaggctgcggcagcttcggttccgagaccgaccggagaggagcccgagtcccggcctctgggggattcgctctctgcagaccagtgggaccccgaaacttgaacgcaatctccagcccccttttttgccttcctttgtcacttgcccgggtttctcccaacgtgttcttttttttcctcttcattctccctccttcgaaggacacaaaagtggcttccgcggaaagatttggaggcggtgggagcttttctccccggagagcgactgtgtagaaaggatttttgggaagccgctttttaacacctctgctctccgtcccccaagcctctgtgtaatcctctgaggagaaaagcccatagcttgaaagttcgggggcattttgttgtgttctgtaggagagagggggaggaccctgttcgggtagtttggccggactggtactggccgttggaaaacccgaagtacatttccgtgtggaacttttgcagatatatatttttagatttttaaataccagataaaaaatatatgccttctatatatctcctggcgacctgcccctgacagcgcgatgtacaatacggtgtggagtatggaccgcgatgacgcagactggagggaggtgatgatgccctattcgacagaactgatattttatattgaaatggatcctccaggtacttgggagaaaaaaaaaaagaatctcgtgatgggtctgatttgtatttaccaagagcttgctgatgttttcagggcagaagtattcctgggtgcgctaggttcgggatgaggagatttgcagttacagctgcggtaaaactgcttctggtttacacgtttaaagtttgcagttaggaccctgatcctattgtcctgcgaaggtgggggtgggggctggaagtgggggtgggaggagagaccccctttttaaaattatcattattttttactttgcctttgcgtgtcgttcaggtttttcttgtgcccgccactttattttatttttttctttttcaattaaagactcttctacctgcaaaggatgttttatatcccggggttaaaaccagtctttcactttgggcgaattcttgaaagcttgtcctttcatacatttgtctaatttggttcgttgtgttttaccccggttaacttctgaaactgagttatgtgattattcattgtaagactccctttttctcttgcagaaacaaatgccggttagtgattttttttagggattgggcgttcgtattcagccatggtcttagtctgaggttttccttctcagaagatagtcgctcagagaaatctacgtgcaatattttattactctttaatttaatgatgatttaacttaatttatgggatagggtttaatgtaacttcaattcctagaataaagaaaaagcaaaaacaaaaacgagggaacctttctgtttcctgtgaacgtgtgatatatacatatgtgttcctatacacgtaatgtaaagtatacatatatagcactatatttttattttaaagctctgtctgacgctattacagacattttgtgtatctggtaggaaaggaaaaggaaagcaaaatggaaaagttggcttttttttcctttaaagtctaccccattttatgattattagctgtcagattttctcaaaccctgtttgcagttacagatggtgttttatgtaatgattctgaataagtagagagcctttgtgactccttgtttctgtcgaggatgaattctttatgtattttaaaacgtgttatggctaagtctacagaataaaatgtgtgtcattggggaacctcgtttattataagactgtatttttggaaacgtttgaaaggatttgagccatgcaagtgtgaagaagtgtaactgtcttatagaaggtatgtagaaattgtttcctgtgtccttgcaaacggtgaattatcctgttttttttttcaattagtcagtgttaaatggtgctgtactaaaaactagtattgaataaacctttttcactcttgatgatcacttagaatttttttcttttcctttatttcagagctttatttgcttttataattgtgactgcaatccagatgcagcttttcagtgttttgtaaagtttgtaagatttgccacccatctattgtgtctttccccctttgtttccccctaacggtaaagcatgttagatacatttgtcatacatatgaatagaaatttagtacatcactggtacttttattgtaaaaagtaaggttaataattctagattcctgttataagaattatatattcaaactgccttagaattatactgcattgtatagtaccttgccttgcagacatacaaagggaatttgttgggtgggaggtgagtagggaggaggggagaaaatgaagaatgcacttatggttgaaatatattagcctagtagaaaaatactggtcaagttgagttgagttgtccaaaaataattttaagaaaagttgactattataactatatggagacgtgggtcttataaggttgtatagaaaattctgatccaaactttattttccatggaaataaacttttgagtttaaaatgttcatccttgaatgaaattgtgcatactgagattctattgagaatactgaaaaatacatatgctgttctttattaccccttttgtagctttaatgtagaatatggttagttattcctaacagctttttgaaaacgaagcacacttgagtatgctgaaacattgcctatgaagtgaatggtttttcatggaaatagtgtgaatgtcaaccttgttttatgtgataaattaagttttcaaaacatttaaaactgtatcattagtgaagtggttgcagcatgttttgtaggtttttcctagctcccaccccacatcaagctcttattatttccttcctggactgctgtgatagcgtactaactgctctcccatttctatcctgttcaagccacggtaatgttaagagtatcatctgatgatttatcttacaatgataaatcttccaatgggtttaaaaacctctgaatggcttccctttgcctacaaaataaataaataaataaataaataaataaataactaaaaaaaatcccccaattgcttaccctctcatataagtccctctaatttttgcttccaacttaattttctagttaattctcctcctggagtgcatcataaattctatagaagcaattttgtatttgctgttacttgaatgtatgctttttttcctcttcctgggatgcctttcactcacaatagttacatgttgaaatcttatatgtatgtgtttttaggacccaggtcagatacctttggtgtcagaatatgttctctaaacccttctgttaaaagtcatccctccttcctcttgcctccctcttctagcacttcttcttctttttttttttttcctgaggcagagtctcactctgttgcccaggctggagtgcagtggcgccatcttggctcactgcaatctccgcctcctgagttcaagtgattctcctgcctcagcctcccaagtagctgggattataggcatgtaccaccacaccagctaatttttgtattgttagtagagacagggtttcaccaggctgatatcgaactcctgacctcaggtgatctgcctgcctcggcctcccaaagtgctgggattacaggcgtgagaccccgcgcctggcctactcttgtagcacttctcagatgaaattttttccattctgtctagagaagctactgtactatttatgtatgcttctccctatgaaattggcttcccacctggtcatgagctgcttagcttgcccagggtcttgcaagtagtagacaatttagtcagtatatgtttaattagtaaataaggaacattgtttccttctagtctttaggtgcctttctacttaaggtccttgctcaactcattgcttggctattgtagtagcctagggctaaataacttttgaattagacatttgttgacttagggcccttaactgtaatggtgccaatatttttatatgttttttcatctttattttattttcaagacagagtctcgctgtgtcgcccagtctggagtgcagtggctctatctcggctcactgcaacctccacatcctgggttcaaaggattcttgtccctgagcctcccgagtagctgggactacacaggcgcatgctaccatgcctggctaattttagtatttttagtagaaatggggttttgccatgttggccaggctggtcctgagctccttgcctcaagtgatctgcccacctcggactcccaatgtgttgggattacagacgtgagccactatgcctagcctttcatcttaattttagactgagccataaatgccaagttttatctattattgcttctagtggcctcaaaaactatttttcaaagatgtttccctctagcctatcttttcaataactaacattgttgtgcatcctgaaggttcctaataactgcatggattggtgtatctacagtcatagtaatgtaaaagttgaatccaaatgggagtttaatgtcttaatgtttgtgtatttcctggcagcagtagatatactgaactgttcagatgaaacataaaactttttatttttggctaggtgtggtggctaatgcctgtaatcccagtgtgctttggaagcccaaagcaggaggatcgtttgaggccaggaggtctagaccagaacagctttgtagagatgccatttctacaaaaaacaacaacaacaaaacttttattgtagaaatgttaagattgtagtacagagaatcgcctataagcatcttggttagtcttgctatgacttcgggaattgggattattctgtagcaaagctggatagaggcctctcaaagagcgtcacctttggtcttttgaggattacctatacacaactgattataactcatacacaaaaggttgtagctagtggtctgttagctcagcactttagttttgacgttgttattgttttcattttaggaaaatgtaataaataacttcctttttaaattaatggacaattcttttttaaaaattgttggcttttttttgttcttatcaagacagacttctgaaattatgtatatatatatatatttttttttttttttgaggcagggtctcacctttgttgctcaggctagagtacagtggcatgatcatggctcactgcagcctcaacctcctgggctcaaatgatccttccacttcagcctctctaggagatgggactgtaggtgcttgccaccacacccagctaatgttttaaaaattattttttggtagagacagggttttgccatgttgcctaggctggccttgaactcctgggctcaagtgatctgtctgcttcagcctcccaaaatgctgggattacaggcatgagccaccgtgcccagcctaaaattatctttagggcagcaacgtctcttccttagataattagaaaatgaaaagttttgttttgcaaaacatgaatataggaaagtctagaaaagtggttctcaattttttttggtctcagtaccccttttagacttaaaaaattagaagacctcaaagggcttctctttaagtggattatatctattgatatttgtagtattagaatataactgagaaattaaaatatatttaattcattaaaaaataataaagcattatacatatggcttttttttttgagacagggtcttgctttgttgtcccagactggccttgaacccctgggctcaagtgatccttctgcctcagcatccctctgcgccaccatgcctggcaaacatgttagcataatttttctaaatgaaaaaataactatattttctaaaagcaaaaagagttagtgggaagaatggcattgacatctttactatccagcttcatagaagacttatttggtttttttttttttttgagacagggtctcactcttttgcccagagtggagtgcagtggcgtgatctcagctcactggaacctccatctcccaggctcatgcaattctcctgcctcagccacctgagtagctggggttacaggtgcctaccaccatgcctggctaatttttgtatttttagtagagacggggttttatcatgttggccaggctggtcttgaactcctgacctcaaatgatccacccgagtcggcctcccaaagtgctgggattataggtgtgagccaccatgcctggccaatagaagacatttaaattctcatgtctgctgctgcattgagtctactgagatattacaggttataacctctggaaaacacccctgtacagttataagagaatgagagtgaaaatggccaatagtatcttagtgatactatgaaaatagttctgacctcttggaccctctgaagggtcttagaaactctagattgcggcaaagcgcggtggctcatgcctgtaatcccagcactttgggaggccgaggcaggcggattacgaggtcaggagatcgagaccatcctggctaacatggtgaaaccccatctctactaaaaatacaaaaagttagctgggtgtggtggcgggcgcctgtagtcccagctactcgggaggttgaggcaggagaatggcatgaacccgggaggcggagcttgcagtgagccaagatggtgccactgcactccagcctgggcaacagagtaagactctgtctcaagaaaaaaaaaaaaaagaaactctagatcgcattttgagacctactagtctagaaattagactatatagtttggtggacaacctagtaaagtatcttctgactttgaagccagacacaaaggtggtttcgaagaagcttatttgcttaccttgacatacttggtattttcaacctggcacaatttagattaagtaacattttggtggaaaactggtacactggccctatggttggggaaaatatctgctgagagctacatagaataaataggtcatctgccacttcatgatccttactgttaacaggttaagcagccttatgtggttgaatttttatttttaaccctgcacatttggattcatcttatataaatacttctcctgtgtgtagtaagatgtttcttttatgatctagttgtcagtttttaatgatattgtcgtttgggacaaatgcttatataatcaaatgatgtaaaagccatgccagtttttttgtcttcttattgaaaaagattagtcattgctttcatttaatatattataatgtatagtgtatccaactatgtttcactagaagtatggtgattctcccatttgataatgcttttaaaatttattctcattgttttgatgctgaatgcttttttaattttaattttaatttttaaaattttttttgagacaaagtctcgctcttgtcccccagtctggagtacagtggcatgatttctgctcactgcaatctccgactcctgtgttcaggcaattctcctgcctcagcctcccgagtagctgggattacaggtgtgtaccaccacacccagcttatttttcgtattttaagtagagacggggtttcaccatgttggccagactggtctcaaactcctgacctcaggcaatccacccgcctcggcctcccaaagtgctaggattacaggtgtgagccaccacgcccggcctttttttttttttttttgaaaaagagtttcacccttattgcccaggctggagtgcaatggtgcgagctcggctcaccgcaacctccgcctcctgggttccagcgattctcctgcctcaggctcccaagtagctgggattacaggcatgtgccaccacgcccagctgattttgtatttttagtagagatggggtttctccatgttggtcaggctggtctcgaactcccaacctcaggtggtcttcccgcctcggcctcccaaagtgctgggattacaggtgtgagccactgcacccagctgatcatgaatacttttatatttttcttagaatgtagaaaagataggacgtgtttatgattgccatatttaacaagataggtagaaaaatataaatgtatctatgtgatatgatataattttttattggtattaaagggggagacagcctgagtgtagtagaaagaacacaggctttggaaatagatgacatagattacaaaactagctttgcttcttatcctgcccagagaaaacctctctgtgcatctgttttctgtaaaattgaactcttacctttgtagagttgtggggattaaatgtaccatatcaatatctagtatagtatttgacatatattgtgtaccaaataagtgtagcttgtatttagagcttcttattgaaaacatgtaattatcccatgtctacctctttgggtactcttgcagtcaaaacctttgagctattttgccccattcttttcttccttcccagtgtttactggggccacattttatccattttgggttttggaattgttctctagggtcttttctagttataacgtttcatgagtctatggaaatgtcaacccaagtcatcttttccttttagtttctattgcctcttgtccagttcctcaatacctcaccttagaaatgatttgtaatgaaggtaatagttgctaacatttgttgaagaaattattatagtccaagcactatgttaaatgcttttatatgtattcttttagccacacaacaaccttataaaattggcattgttattatcccactctacagacaggaaactgagacttaggtttagtaacttaccaagtagcagagcaggtccatctgcctaactaaagcccaggttcttaaccagtacctctaaactggttgctctgtttccgatttcttctacccctcactataagtttgtcccaaattcttcagacaggttagttctactgaaatgttattttcattgttttactgttcttttcaaaaataatcagctcttcatttcttttaagtagagataatattcttaaacttggtatacatagtctttagtaatatggcacctaacttacatatttataactttattactaattttctattcatacttctagtcgaattccttctagcccaataccctgattgctcattcctatctcaagcttttgcttaagctgcttcctatgtagaatatgcccgtctcacctccatctttaaatcaagagcctgtctgcgtcccctttccttcttaaaactttctccaaaaattctagcactgtacccttttatatgtagggctgtctctgttattttgacttggaatcatgtgttatattatgataattatttcatgaatataattcacctcccaaacaagataagtttcttgaggtcaggctgttgtatttccttcatatctttttttcttttttctttttttgagacagggtctcattttgtcactgaggggtgcagtggctcactgcagcctaaactcttgggctcaggtgatcctcccaccttagcctcctgagtaactgggactacagtcatgtgtcaccatgcccagcttgtatcttttttccctaaacatccagtgcccaagtattttgttaaattttaggcccatggatccaactagcttcattttgtgacttaagctttaaaatgttaatattatttattatcagcatgtgacctctaaacttatgaagataattggctgggcacttattgtaacaaagggaataatgaaaaaaaatgcaatacttaatgttattagcaagatttatatagctctgagtaaaattgtgtttgaaactttgaacaattagaaatgaataggccgggcgcggtggctcacacctgtaatcccagcactttgaggtgccgaggtgggtggatcacttgaggtcaggagttcgagaccagcctggccaacatggtgaaaccctatctctactaaaaataaaaaaattagccaggcgtggtggcgcgcctgtagtcccagctagtcaggaggctgaggcaggagaatcgcttgatccctggaggcagaggttgcagcaagctgagatcgcgccactgcactccagcctgggtgacagagcgagactctgtctcaaaaaagaaatgagtagtaagtttttcacagtgtattaggttagttttaaatagcacagggccaaacggagagttttaagttatccagtgtgttattataccacttaattttactgtgtgtaagacttgacttttaacaagtaaagtgagccatcaagccttattaaagatcgatttccacattgcttgcccatatatgttgtatgtattgttccttgtgcatatttgtaaattcacataaagtaaaagggttatcttattgttttctttttcttttatttatttattttattttattttattttatttttgagatggagtctcgctctgttgcccaggctggagtgcattggcatgatcacaagttactgtagccttcccacctcagcctcccaagtatctggggctacaggcatgcaccaccacacctggctaatttttaaagttcattattttaataaaagaggcagtaggctacgtccagcctgccaaatcataccattttgcatgtcgcatatcagtatgaaaactgccctatgagttggtattgatgagccaacacaaagccaaagtcaataccatctacccttatccatacttggacttcctgtttcatgttctgtttgtgggccagattgcctatccttacctgaggatatgtaacaacaaatccagagcatgcaactgtgtaatcttaaatattgtgataatttttatttattaactatttatttttaaatatttattattttttaaatagaggtagagtctttccaggttgcccaagcttgtctcgaactcctgggctcaagcaatcctcccaccgcagcctcccaaaatgctgggattacaggtgtgagccaccgtgcccaacccgtatttatttataaacttaagaaaaattcaattatgaatcaaaattaaaaatctgaatgaaaattgctctgaaaaaggtcttgctgaaaggaattgttgtgctggaaatatattgctttagattctgttcttacatatgtattaagcttttttttccatagaggatagagtgacctttttacaacagggtcactcaatatggtctaatttatgttgaacttctaatagacatttatagaattaaccacaacctttttttctgatattagttctgggatgtattttataaaaagtgtttaattcatatgttttcagctgcaagcaacagaactaattcaaaatggctttaaaaataataaattttatcttctcatttaatagagttagttgatttcagtagttcaacaatgtcagtataaacccatattttgcttagccatatattgctcaattctgccatccttgggactggcttcatcctcaggctagtagcaaaatggttgcggtgattccaggcatcatatcatatccataaataacaacttccaaaagaagaggaaaagtatctcttcctgtgccactgtttttggatagaggaaactttctacaaaaacctctagcaaacttctttcccatctttttggccagaattgggtcataggctagttcctgaaccagtcaccagtaaataacccttaggttaatcacgtttctcaatctggaatggtgttggcttctactgaggtatatggttgtattggggagagattctgttaaagaggaagagggagagaattgatgctaggaaagtaatttggaaaaccataactctcttcagtgttattgtctttgtcaataaacagtattagcaagttattttttactttttcaaagttaaaatctagctgtgggaaatgcattctcattttctattttttttgagacggaggctccctctgtcgccaggctggaatgcagtggcacgatctcagctcattgcaacctccacctcccgggttcaagcgattctcctgcctcagcctcctgagtagctgggattacaggcgcccaccaccacgcctggctaattttgtctttagtagagatgtggtttcaccatgttggtcaggatggtctcgatctcttgaccttgtgatccacccaccttggcctcccaaagtgctgggattacaggcgtgagccaccgcgcccagccacattttcattttctaagttggacttcatagggtcacatagtattgagttaatataagacagacctttttctatcttgttggttgcttactagaagatgaggaagctaacatctctggtttacagttaactaatttgaggaatataggcattggaatagtgttagtgtagcaagtaaatgagtgtaagagaacattttgcaaaactatacacttaaaattctaaagttcagtaaattaagtaaacttgggacctgtggaatgatttatgatttgaaagctagcctgaaaaattaggagccgtccagactgggcaacatgaagaaacctcgtctttacaaaaaatacaaaaattagctgtgcatggtggtgcattcttatagtcccagctacttgggaggctgaggtgggaggatcacttgagccctggaagtcgaggctgcgctgagctgtgattataccactgtactccagcctgggtgacagagcgagaccctgtctcaaaaaaaaaaaaaaaaaaaaaattaggagttggttacaatggcacatacctgtagtctcagctacttacaaggccaaggtggagttttgcttgagaccaagagttggagatcagcctgggcagcatagtgaggctatctcaaaaaaaacaaaaaaatggaatactactttaaagtaacctgtagattatatctttcaattaaaatgtatgatgtgcctaagtattgatttttctcagtatgttagaaatctagaggcagtatagtggagtagttaagagaggggtctctggaatcagaacgcctgagttcagattgtgcctctgccacttcttaacatgtgtcctttggcaatttacttaccttttctgtgttgtggtttcctcacccaaaaagtagggtgataatggtcattcaatagggttatgaggatttagtagattaataactgtcaagtacttagtgtggtacctagaacatagtaaacacctgtaaattttttttgtttgtgtgttaattcatgtttttcaacaaatatttgactgccaggcactattctaagtgtagtagtgaacaaaacagcaaaaatgcttcatggactgtacatttccaagggagtgaggagagcagagaataaacaaattcataagtaaaatacctagtgatggtgttaaatgctgtggagaaagaaacagaggataaaaatagagtacagggtgagagatctgctattttaaataggaggccagggagggcctgacctaaagcaatgggagagcaggtcatatggaaatataacaggtgtgaggatgggggttccaggtagaggatatcagatgacctaccctgaggcaggagcatctctgtgatatattcagggatcatctaggaggccagtatggctagaatggaatgaggggaaagtagtaaaaaaagacaagtggctgggcgtggtggctcatgcctgtaatcccagcactgtgagaggtcgaggtgggcagatcacctgaggtcaggagtttgagaccagcctggccaacatgacaaaaccctgtctctactaataatataaaaattagctgggtgtggtggtgggcgcctataatcccaggtacttgggaggctgaggcagcagaatcgcttgaacccgggaggcagaggttgcagtgagctgagatcgtgccactgcattccagcctgggtggcagagggagactccatctcaaaaaaaaaaaaaaaaaaagacaagtaatggtatgggtggtggggctttcccaccatgtatgccattgtaagccattgtaagaactttggcttttaaaactcgtataagatgagaagccatcaaagtgtattgaacagtgatgtactatgattcttggcttaaagaatcattctggctgctggtggaaagagggaaaggtagaattagagaaactggttaggaggctattgcaacagtcaagctgagggatgatggtggcttggacaagggtagaagctgtgaggttgtaaaaagtggttgcgttctgaatgttactagttatatagcttgtcatttccaaactgacttactcactttattttctaatttcttagctttgtatttctccatatgctatatatgctttaataattaataagtctaacttttaaagtaatgccaaagctatttatatatattttgatgtatttttctgtgtgggtttttttgtgtgtgcgtgactgggtcttgctgtgttgcccaggctggagtgcagtgtcaccaacagctcactgtagccttgacctcctgggctcaagtggtcctcccaccttagccttctgagtagctaggaccaactacaggcgtgcactaccacacctggctaattaaaacaaatttatttttgtagagacacgatcttgctgtgttgtccagactggccttgaactcctggcctcaggcaattcccttaccctggcctcccaagtgctggggttacaggcctgagccattatgcctgacctatttttctctctttctttctctttctttctttctttctttcgagacaggtttcactctgttgcccaggctggagtgcagtggcatgatcttggttcactacagccttaacctcctaggctcaagcaatcctcttacctcagcctcccgagtagctgggactacaagtgcatgccaccatgcccagctaatttttctcttttttgaagtgttaagtgattcagatctctgacatccagttgccaactaacagtatatgtggccttagttgtttgatgaaagcttgttcatgagttactttttaaataaacattagttgataaatttagattgtactataatttactttttttttttggatacaagatcttgctgtcacccagactggaatgcagtggcacaaacatggctcactgtagccgtgacctcctgggctcaagtgatcctcctgccccagcctcctgagtagctaggactataggtgcgtgccaccatacctagctaattttttgattttttgtagggatgaggtcttactgtgtggcccatgctggtcttgaactcctgagctcaaaggatcctcctgccttggcgtcccaaagtgctgggattatagatgtgagccaccacacccagccaatttactttcagaagtaactttggaaaagaaaatttcctgatgttcttaatttttttggtgggctgtgaaggggagaagaaactaaagagaacgaagccatgccatacatgtttcattttactttatgtgctgaagttcttgctttctgagaataattaatagagatttatgttattttctttttggcataatgtttaagtgcttgagtatagatagatattgatataaaatgggtaaagtatctgtgtttaagagctccagactcaggttgttgggatttcctattctagccctgcctatttctagtttgtgaccttgggcagttttctaatctgtatagcatagaaaagaatattaatcctgctgtagggttattgtgagaattatatggaatagtacacataagacacttagggcaggtatctgttattgttgttgttatttttattatttatttatttatttaaaacaaaattttttttttttttggatggagtttcgctctgtcacccaggctggagtgcagtggtgtgatctcggctcactgcaacctctgcctcccgggttcaagcaattctcctgcctcagcctcccgagtagctgggactgcaaaaacacatttttgaaaaagagataaggctttaactctgtcacccaagctagcatgcggtgccctgatcatagctcactgcagccttgagctgctgggttcaagggatcctcctccctcagcctcccaagtaggtgagactacaggtatgcactaccatgcctggctaattttttttatttttaatttttgtagagacggcgtctcactgtgtttcccaggatggtctcaaactcctgtcctcaagtgatcctcctgcctcaggctcccaaagcagtgggattataggcatgagccactgtgcctggcctattttcattattattgataaaactgggatgctttgtggctcatctccatagcgtcccattcagaggaagaaccagcctaatattcaaattaaattgaaaagtaatttaagtatttattccatcctctcaaaaatgccaaaggggtttacattcataaaactacaatactacttaaaatcctatttcttcatgtttggcatggttaatcccaaactttcttctctcttaaaacttaccaactcatgacaacttgagcagtcttatttttgcgtttcttttgtaacccttctcaaacctattaagtttctattccgtgagtacctgtctcccattaaactctctcctttgcccgtgtcattattctgatctgtacaataagggccaggaaccaagagagcaaagaaaagaagctatgaatactcaaatatagcaacatttttgtttctgtcacacttgtctgtggtagaggatataatatgttttggcttttggaaaaaaagtctgtttagttttagaaggacaacgaggtggttcagacctgttgcaggacattaattcgggacttggaatttagtttttctccagatagtcataaactatataagagctgctatcatatctctctaactgggactggttcctagtgttcagcccttgaaatttagtattgccagataaaatatatgcagtatggaccatgcagtattattcattgtttatttgaaattcaaatttaactgtgtgtcctatatttttatttgctaaatctagcaaccttaatttagagagaggatgctgactaggctgtattttctagtacattttctatggtgtttaagagtacatgtgtaacttgatgtggtggatatgaggatactttcagttttgataacagaaaatgcaactcaaattagttaaaacaaagggaatttgaatttgaattacatacgcttatgtaattgaaaagaccaaagggagtgagggcccctggcatggtttgatgaagggtacaggctttggccctgtttttctataattctcttggctttaccctgtattagcttttttttctcaaacgggcttccccagtagtacaagatggctgcctttgtatgtttcctcattcctggagagaaagtagatgcttcctacaaatacagtgcaaaatcctaagcttgacactaattgaaccatcttgtgctccaaaggatcactgtcttaaaatctgggtagctttctgtgtctagaccagtggcttttaaacttgagtgtgcattagaactacctggaggacttgttaaattacagattgcagccaggcactgtggctcatgcctgtaatcccagcactgttggaggaccaggcgggaggattacgtgagtccaggaattcaagatcagcctgggcaacatggtgaaactctgtctctaccaaaaaaaaaaaaaaaaaaaaaattagtgaggcttggtggtgtatgcctgtagtctcggctacttgggaggctgagatgggaggattgcttgaacctgggaggtcgaggctacactgagctgtgattatgccactgcactccagcctagatgacagagaagatgctatctcaaaaaacaaaaacaaaacacacaaattgctaggtcctacccccaaaatgtctagttgagtaggttccgtaggcttggttccaagaagttatatttgtaacacgttcccagatgttactgattttgctggtcacaaaccacactttaagaaccactgttatgtcaaatcagggcctacttctggagctgaggaaggggtcaatcccacttaaactttttaccagtgaggggaggcggtaagatgttttggaagataacaacaatgtccactgaagagaggactgctggtttttttgcatatctactttctcttccctcttccctcttatttaggtaagaacttcctgatttttctcttggaaccactcctccttcatttggaatgatgtggcttgggtggttggcctaacccattggtttaagggtgggcacgtgatctaggcctcgtcaatgagagcacttgcatagtcacagtgatcagcccaggagtgaatagggcagtgatctttgtagtttagtcagtgtacgttactatacgttgctgtttactgtcctggctagggatatgaagattacataatccctgtcctcaagaagctcagactgtaattatgaaagacatatctgtaaatatacccatgcatcgctcctctttataattccttctctttctcctgtcatctaagatatatttttaatagatactgtactacctaccacctttataatccttaaccatacttattatcgtttagtgtctttagtcctcattaaattataaattccatcaggataaggactgagtccataattagttgctggatcttcaatacctagccctgtctctggcacatacaaagtattcagtaaatattgattgaatgaatgtcaaagtatagcaatagaagaatatataaatgaaatagggaatgattggtttactggtggagtaggagacgtaacagcctgaataaatgcataaagttattaaaacaccttaagttttgttgaagacaatgtatgagataggacgtggcctgcgcatggtggctcatgcctataattctggcactttgggaggctgtggtgggaggatctcttgagctgaggagtttgataccagcctgggcaacatagtgagacccccatctctttaaaaaaaatctggctgggtgtggtggcacatgactgtagtcccagctacttgggaggctgaagtgggaggattccttgagcccaggaggctgcagtgaactatgattgggtcattgcactccagcctgggcaacagagcataaccttgtctcaaaaaaaaaaaaaaaaaaaattgagagataggaagtggtattagatgaatctggaccactaggtgcggtccagatcatgaaaggccccgaaggctatatttaggggttgaattttatcctgcaggcatttgggaagccactgattggttttaagtagggaagagagtacagtggctgtaaggtaaaaaatagattggaggagaataagattaaagaaggaaaactggttaggaggctattttagtacagaagaaagatgttatgaaagcctaaggctaagattgtagcagtgagaatgaatagtagagttgtttaaaaagtaggattggtgggcttcgaggctattctgaggaaaatgaaataatctagaatgacttttggttttctagcttggtagatggtggtagtataaaccaagagaagcaagttgaggaagaaggacagatttggattatatggcctcttacataaaaatgagggaatggtgaaatggcccaggttctctccttttggtgggattctttttctcttaggcttcacttgggcaggagaggagagtggcttctgctacttctaggtttggggactagagcggatgatagtaaatcagatattactgagttcgtagggtgggggagagatcacagtgagaatggaatgcttccaggttttagttgctaaagtaatttttagttttcagatgtttaaactgcctcatcctttttgaaagcaagtgtataaattataagaaaattaactcttaagattcatgaattagcttcactattggtggagatgtgaattgctgcagctgttttggaaagtttgtcaatatatagtaaaatagctcttctgggaatctgttctgtagaaataaaagtatcaacatataaaggtatatgtatggatatttttataatgtttccaatatttgctactaaaaacagcctgaatatccatcaatagtaggaagtataaattgtcatttacctgtactgtggaatatttcgcaactcagagaatgtgttataagtctgtatgtatttacctggagggatgtctgtaatagattgtagagtaagacaaacaagttataaagaaatgtgtataataagatcccatttttataaaaaaccaaaaacaatgtttcacattcttttttaggattataggaacctgaagaaaggtgtaaaggtgtattttatttcaggttctctttccatggcatatcacagtgaacaaaacaaagtccttgttttacgtaggaggacatgtgacaataaataagaagtgaatatatagtatgttaggtggagataaatattatagagaaaacaactactggcttaagggggatggaggacagagatggaattgctattttattttgggtagtcagaggaggcctcactgatatggtgacttaactttctttttgtgaaatacaataatactaaaaagtgtaggaaacataaacatacagtttgttgacttcatataaattgaacagctacttaaccaccacctagataaagattttatagatagccagcttctcagagacccaaaacatgcccccccacccttttttttgagacagagtctggctctgtcacccaggctgaagtgcagtggtgtgatctcagctcactgcaatctctgcctctgggttcaagcaattctcatgcctcagcctcctgagtagctgggattacaggtgcacacagctacacgcggctaatttttgtatttttagtagagatggggttttatcatgttggccaggctggtcttgaattcctggcctcaagtgatctgcccgcctcagtctcccaaggtgctggggttacaggtatgagcactgcgtggagcctaaaacatgcccttttctaattatattccccttcttacccccagaggtaagaaggcagcggtggggcatgttttgggtttctgagaagctttgtgtacatgctgccttgagaggaagaagtattgttagaagactggtttgaatttggtctgcttaccaactatgtgacattgaatggttgtcatataaaatggaagtaataatacttaattcacaaggatttttaaataagaattataatatttatgtgcccatatatatatattcacatatatatgtaatgaaataacacccagtatctggcatatagcaggtactctatacatcttttgtgaaggtcagtgttttcgtgatatagtaatagggaaatgtgtagagcttgtgctagagattttgttagaggcagctacgtatcttacttgctagaggctacttggctctagtatgtttggctctaagatcaggatgggtaaaatcttgggacaagagaagcaatgtagcaagtgtgagtgaccatctttctttttttatgggtcatttcaactttttctatgggaaaattaaaaaaaaaaaaccaactttttctgttcccaggctgaccctcccccctccgctttttttcattttgtgtctcagtaaaattccactgctgttcagcataattacttcttggatcttcacttcctctctatggtaagcctaaatgctgaccatctcaagcagtaattcaacaaatatttattgaatggcttctatgtgtgaaacacttggcactggagatacaaagatgggtaagaaaatatgtgccctaaaggagctcatagtctttgagtacaaagatagggttcaacaactaaactataatcactaaactttagattagaaggttgagaagagctctgtagaatcaaagaagaggtattacttaacaaggcctgagaatatgagggaaagtttcatggaaaaaaacatgcataatttgagtcttaaaaaaaaagtagctgggctgggcgtggtggctcaggctgagcctggtggctcacacctgtaatctcggcactttgggaggcaaaggtgggtgcataacttgaggtcaggagttcgagaccagcctggccaacatggtgaaacctcaactctactactaaaaaaaaaaaaaaaaaaaaaaagccaagcctggtggcatgtgcctgtagtctcagctactcgggaggctgagccaggagaatcacttgaacctgcgaggtagaggttgcagtgagctgagatcgtgccactgcactccagcttgggcaacagagtgagaccccatctcaaaaagaaaaaaaaaaaagtggatgaggcaggttggtaaaagagatagggatgggcattttatgaggtacaggatatgtgcaaaggcatgagaaagagttgtgtgtttggatgagctgcaggtattggtgtatctagggtgaaaggtgcctgtgggaaagtaataggaaaatgagcttggaagagtaagcagagactggaccatgtagggccttctatgccatgctgaagagtttgaactttatcctgtatgtggtggtggaactcttgaaacatagtgtgctaaaccattatggttagatttgaaactcaaaagaagcagagaagggtggaaaagaaccaggagattggtcgggcgtggtagctcacgcctgtaatcccagaactttgggaggctgaggtgggcggatcatggggtcagaagttcgagaccagcctggccaatatggtgaacacatctctactaaaaaggcaaaaaaactagccgggggtgttggcgggcgcctgtaatcccagctactcgggaggttgaggcaggagaatcgcttgaacccaggaggcagaggttgcagtgagctgagattgcgtcactgtacttcagcctgggcaacaggcggagactccatctcaaaaaaaaacaaaacaaaaaaccaggacattggtctctggtaagccgggtagagatttttcaagaaggaaaaaatggctaacagtgtacaatttaaagtgattaagtgaaataatgatacaaaagctactgctggactttgctattgagacaaccttaacaagatacatatttatgtagtgattagggtagaagccaaattccaatagaagagtaactgggaggtgagaaaacagactgcaaatgtagaccatttttagaaaacttgctgtgaagcaaaagtaagaggtagttagagaagtagagcagagaaacatattttttttttttttttgagacagagtctcgctttgtcacccaggctggatggagtgcagtggcgtgatcttggcttactgcaagctccacctcccgggttcatgccattctcctgcctcagcctccccagtagctgggactataggcgctcactaccatgcccggctaattttttgtatttttagtagagacacggtttcaccgtgttagccaggatagtctcgatctcctgacctcgtgatccgcccgccttggcctcccaaagtgctgggattacaggcgtgagccaccgcgcctggccgagaaacataatttttttgaagatgaaagttaagcatgtgttatgttttggtggagtagaatagagttaagactgaatatttagggctgtgtgatttgatggaacaggaaggtggtgggtgtggaagcaagaagggattactgtgctagctcagggaaggaggagataaacctttgcctaacatttagaatgaaggatatgggtatgacgaagagtgtaggctggaaaatggggtgaggtcagatttattttttctggtaaagggcaattgtgagagaagagatgtatagagtgtttggcttgagatttagagtacccattgattactgtctgggatggaaaaggtcactgatcctgaggcatgtggatgaattaccaacaggatagtaatctcagttaggattagaaactgtaaatttgtagtggaatgaattcctaacctgttatgattttcttcagcaggactcagtagctgtggtatgggaatagaggaagcaggcagttggattgatcctcctcgttcagagatttactggctagtgtggcaaaagaaccatagggagctggagagatcctggcaagagagtgggtgatgttcaacattaagtgaataattaagtaaatgatgatacattcatataaaaagctgtgtttctgctattaacatttatgtttatgaagagtttataaaagtacttattttataatgttaaggtaataaaagtgctgtatattgtacaaagggttagtaataactgtaatattcaagagattgtttagggcataatgatgaaaagatacaaaaccattgtattggtcacacctattcacatgaagacaattatttgacagagattattagttcttctttataggtgaagaaaatgagctttagtaagggtgaattgttcagggtcacagatttggtaaatggcaaagagaactattataatttatggaatagttactgtgtcaggcattgttttatctatgtagtattaatatttttctcacatattgctctaattttaatttttagttaaaaaagcacactcaaaggagagtaacaatataagcaatagataactaagtatgaattatctaaatagtggattccaactaactttgcaagttgcaaagagtgataccaagtgctagagaagttcaaaagaaagatgtaggctagagtcgaagaaagactttggagataatcatatttgaacttggactgtgaaggataggtaggatggtctttttaagtaaatgatgatacagtcatatagaaagctgtgtttctgtttttgttttgttttgttttgttttgagatggagtctcgctctgtcacccaggctggagtgcagtggcgtgatcttggctcactgtaacctccgcttcctggtctctttgatttattcctttccatattaaaaaaataatagtactctgtaatagtctagtatctcatgtatctggagcctttgcttagataaaaagtcttgcttttttattttatttttttgagacagagtctcactctgtcacccaggctggagtgcagtggcatgatctcagtggtgcaatctaggcttactgcaacctcccaggttcaagcaattctcatgcctcagcctccggagtagctgggattacaggcacctgccaccatgcctggctaatttttgtatttttagtaggctttcaccatgttggccaggccggtctggaattcctgacctcaagtgatccactcgccttggcctcccaaagtgttgagattacaggcatgagctgcttattgtttttaaaagactaaggcagccgggcacggtggctcacgcctgtaatcccagcactttgggaggctgaggcgggtggatcatctgaggtcaggagtttgagaccagcctgaccccgtttgtactgaaaatacaaaattagccaggcgtggttgcacgtgcttgtaatcccagctacttgggaggctgaggcaggagaattgcttgaacccaggcggcagaggttgcagtgagccgagatcacgccattgcactccatcctgggcaacaagagtgaaactctgtcaaaaaaagaaaaaaaagactaaggcaatcaatctgtggatatcataaaggactcaacattatttgctgatccctggggtatcatttaagattgctttggaaggaatggaagaaatatgagttccaactaactttccaagttgagtcatgaactccttgataggccttctagaatatatttaaagtgtaaatataatgtatctatccatccattatctaaagttatttttctgctaagtcgtttatatttgattattattttttactatggttagtggaagaaaagcaatttgaaataactactaaaaaccattgaaaccaaagattgagatttttgagggggcagggagataatcatcaagaatatatcagaaaggatttaatggttgaggcttggtatgatagcttatgcctgtaatcccagaactttgggaggccaaggtgggtctatccacttgagcccaggattttgagaccagcctgggcaacataccgaaaacttgtctctacacacacacacacaaaattagctgggtgtggtggcatacacctgtagttccagctgctagggaggctgaggtgggaggatcatttgagcctggaaggtcaaggctgcagtaagccatagtcgtccattgtactccatcctgggcaacagagcaagactgtgtctcaataaataaataaataaacaaatgattgccctgtactcaaggttaaaatagggaatgctgtatgtggatttattattcatcagtttttatatttgagatgcctataattgccatgtgtaagttaatttccacaagaagcagtcatcattgtaatttttttgaaggtttcaaatatactttatttcttcatttatgccatatcttaatgggtacacagtgcttttacttggcttcaattatgagctgttttttatttaattaattaatttatttttttgaggcggtgttttgctcttttggctaggctggagtgaagtggcgcaatcttggctcactgcaacctctgcccccacctcccccttccaccccagccccggggttcaagcgattctcatgcctcagccttctgagtagctgggattgtaggtacccgtgaccacaccctactgatttttctatctttagtagagatggggtttcgctgtgttggccaggctagactggtctcgaacttctgacctcaggtgatccacctgcctcagccttccaaagtgctaggattataggcatgagccactgtttccagctgatgagctgttttttgttttgttttgttttgagacagagtctcactctgtcacccaggctggagtgcagtggcgtgatcttggcttaccgtaacctccgcttcctgggttcagttcgagcgattctcctgcctcagcctcccaagtagctaggattacaggtgcaagtcgccatgtcagctaatttttgtatttttagtagagacggggtttcaccatgttggccaggttggtctcgaacttgacctcgtgatctgccctcctcggcctcccaaagttctgggattacaggtgtgagccaccgtgcccagctgatgagctgttttttaaacaattcagtattacaccagctgggatgattactgatctctccattccttcggagtgactctcccatcaggggacaggttccattctattccaatttgagttgctacataagtccatacagcaatagagaaagtggctccactagctaatacagcattactgtatttgtcatgaaaatcaggtgtatgtttctggtggctctgccttgcgattgtttgcagaatgctttgaacttggagatgacttagtgtgtgtttttttttttttttttttttttttgatggagtcttactctgtcacccaggctggagtgcagtggcgcaatcttggctcactgcaacctccacatcccgggttcaagttccctgccttagcttcctgagtagctgggattacaggcgcttgccaccatgcccagctaatttttttgtaatttttagtagagacagggtttctccatgttggtcaggctggtctcgaactcctgacctcaaatgatccacctgcctcagccttccaaagtgctgggattacaggtgtgcgccactgtgcctggccattagtgcattttcaaccaagggaaacattgtgaaggtgaagatagaactgtggtaatgcaactgctgctttggtgcaaattcttatgattgtaatctgtctcgtttgtagatgtttcatttaatggattatggcttcaaatgggtatttgatactttctgataggatttacatggtaactacacagaattaaatattagacaatttagtgagctatgaaaagatagctttaatagggaaagcactttttaaaaataactaagcaaatcttaccaaaactgacttgaaaagaagttgaaaatctttttaattttgtcaccataaaagaaatttaattagtgatttaaaaaatctaccagaacaattctaggcccgtacgatttccttttttttatcattgcagttttaaaaaacttcatgtccaggcgtggtggctcacgcctgtaatctcaacactttggaagtccgaggcgagtggatcacctgaggtcaggagtttgagaccaacctggccaacatagtgaaactctgcctctactaaaaatacaaaaaaaactagccaggcatggtggtgcatcctgtaatcccagctatgcaggaggctgaggcaggagaattgcttgaacctggggagcagaggttgcagtgagctgagatcacgtcacttcaccccagcttgggcaaaagagtgagactccatctcaaaaaaacaacaaaaaaaagaccttcacataatataaaatataccatcatggccgggcgtggtggttcatgcctgtaatcccagcactttgggaggccgaggcaggtggatcacaaggtcaggagtttgagaccagcctggccaacatggtgaaaccccatctgtactaaaaatacaaaaaattagctgggcgtggtggcaggcacctgtaatcccagctacttaggaggctgaggcaggagaatcacttgaacctgggaggtggaggttgcagtgagccaagatcgtgccactgcactccagcctgatgacagaccgagactccatctcaaaaaaaaaaaaaaaaccactcaattctcctatcttgccaaatatatcttcatgcaaacttagaagactgggttgaggctgggcacggcggctcatggctgtaatcccagtactttggaaggctgaggcgggtagatcaccgaggtcgggagtttgagaccaacttgaccaacatggagaaaccccatctctactaaaaatacaaaattagccaggtgtgatggcgcatgcctgtaataccagctactcgggaggctgaggcaggagaatcgcttgaacccagaaggcgnnnnnnnnnnnnnnnnnnnntggttcatgcctgtaatcccagcactttgggaggccgaggcaggtggatcacaaggtcaggagtttgagaccagcctggccaacatggtgaaaccccatctgtactaaaaatacaaaaaattagctgggcgtggtggcaggcacctgtaatcccagctacttgggaggctgaggcaggagaatcacttgaacctgggaggtggaggttgcagtgagccgagatcgtgctattgcacttaagcctggacaacagtgcaagactctgtctgtaaataagtaaataaataaataataccatcataaactttttttgaggcggagtctcgctcttgttgcccaggctagagtgcagtagcacggtcttggctcatgcaacctccacctcccgggttcaaacaattctcgtgcctcagcctcctgagtagctgggattacaggcacctgccactgtgcctggccaattttttgtattttagtaaagacggggtttcaccatgtttcccaggctggtctccaactctggagctcaggcagtctgccttcacaaagtgctaggattacaggtgtgagtcaccgtgcctggcccatcataaccattttcaagtgtattgttaagtgatactaagcatattaacattgttttgaagcagatctccagatttcatcttgcacatctgaaactctgtacccattaaacagtgactcgtcgtttcccctatcacgcaacccctggtaaccaacctttactttgtttctatgattttgtctacttcagttacctcgtataagtaagtgggatcatgcaatatttgtctttggcttatttcactcagtataatgtcttcaagtttcagttatattgtagcatatgaaaggattttcttcctttttaaggctgaataatattccctttatgtatataccacattttgtttatccattaatctgttgatagactttgggttgcttccacctcttagctattgtgaatggtgctcctgtgaacataggtctgctactataatgtctctttgagactctgctttcaggttttttttttttttttttttttttttttaagatatatacccagaataagaaggattgctggatcatatggtattttaaaaattttttttgaggaacctccatactgttttccatagcagttgcaccattttacaatctcaccaacagtgctcaagggttccagttactccacttccttaccaacactcttcttttctttcttttttcttttagtagccatcttaatccggcccatatagatttataaatgagttctaccaaacatttatagacaatcataatttcatataaattcttcctaaatcaagaaaaagaagaaacattctcattctcatttaagtatttaatgggttattctaagataaatactgtataaaaagctaaagataatttgctgatatatatgaaataaggttgttggatccaagaccactatacagttggattcctttatacaagtagcagataacaaatgtaatttttaaaaagctttattgagatataattcacataccatacaaatcaccaattttaagtatacaattcaggccgggcgctgtggctcacgcctgtaatcccagcactttgggaggccgaggcgggcggatcacgaggtcaggagatcgagaccatcctggctaacacggtgaaaccccgtctctactaaaaatacaaaaaattagccgggcgaggtggtgggcgcctgtagtcccagctactcgggaggctgaggcagaagaatggcgtgaaccccagggggcggagcctgcagtgagccgagattgcgccactgcactccagcctgggcggcacgagactccgtctcaaaaaaaaaaaaaaaaaaaaaaaagtatacaattcaatgttttgatacattacattgttaattttttaaagttataaaatacgaatgacaaaatttttcattttaactgtttgaagtgtacaattcagtggcattaattacatttacagtgttgtgcagctgtattcatcttccatatagaaactctataaccattaagcaataactccctcattctcccttcactttcagctcctggtaaattctgttcaacttcctgtatgaatttgcctattctagatatttcatgtaaattgaatcatacaatatttgtccttttgtgtcttcttatttcatttagcataatgttggtgttcatccatattgcggcatgtatcagaacgttactcatttttatggctgaataataccgcattgtacatatagaccacattttgtttattcagtcatctgttggtggacatttgggttttttttgtgttgttgtttgtttgcttctttgaaacagagtcttgctgtgttgcaaggctggagtgcagtggcgtggtctgggctcactgcaacctccgcctccaggttcaagcgattctcctgcctcagcctccctcagcctcccgagtagctgtgactacaggcgcatgccaccacacccagttactttttttgtatttttagtagagatggggtttcaccatgttggtgaggatggtctccatctcttgaccttgtgatccgcccacctcagcctcccaaagtgctgggattacaggcgtgagccaccacgcccagcgcacttgggatgtttttacaaatttttttttttttttttttttgagacggagtcttgctttgtttcccaggctggagtgcagtggtgtgatctcagcttgctgcaacctctgccttctgggttcagacgattctcatgcctcagccacccgagtagctgggattacagatgtgccaccacacccagctaatttttgtatttttagtagagacagtgttttgccatgttgactaggctagtcttgaactcctagcctacctcagcctcccaaagtgctaggattacatgcatgagccacagttcctggcctacaaaatatatttttaaaaagatactcattatagcagcaacagctacaatgacaacaattgaaaggtaccagtgaacaaaatcagcaaaagatgcacatgactttttatgttgaaaagtatacaatttccattaaaagacatgagaagagatgtaattgggataccatattaactgataggaagacccagtgacataaacatgtcagttctttccaaattaatttataagttcaatacacttctgtttaatataatgacagggtatttcatataacttgacaagctctaaaatgtatgtaggagagtaaactgtcaagaaaaattaggaaggagcacttagtctttcacatagcattatttataaagccatattattaatatttaaggcaatgtggtattggcacaggatagaccaacctctgggaagaataaagagcccagaaatagaacccccgaatataaagaaacttaatacatgacagtgagcattgaagatgagtaaggagatgatggactgactaaacagtaaatgataatggaacaattggttatttatatggaaaataaaatgagatttctacttaccatattaaaaaatgtatgtgatgattaaagatgttaatgtgaaaagttaaacttttagaaaaaagtgggagaatgtttttatgatactagggcagggaaggtagaaaggatttcttcaacaagacttgaaatttgaactgtaaaagaaaaagattgataaatatgtctagattaaaataaaaaatgtacagttattgaaattcagcatgagatagataacccatctgggagaaaatatttgcaggaaaaataactaaaaaggattaataatcaggatatatgaagaatattttaccaaccagtaataataataagacagtagattggaaattcatagaagatgaaatacaaatgtcctgcagacatgaaaaggtgttcaacttctttagtagccatggaaatgcaaattaaaacttcaatggaataatattttacactcaccattttggtgaggatgtagaataaggaaaactctcttatacttaagtggacagtggagtatcaactagaacctcattgtagagagcaacttagcaatatctagtaaagtgtataccctagggaaactctagaagatggacaagagtttgtacctgggacaagtaccgttaagttcatagcaacattgtttgtaaaagcagaaaactacaagcagctgaaatgtccatcattaagaaaatgaagaaattatagaatattcatgtaatggtagagaacggtgagaaaataaaaatacctacttgtatcaacataaattaatctaaagatgtaatgcagaatgaaatgctgtggaaagattcctcctgtataaagttcataaagatacaaaatatgttaggagatggaacccctggggaaaaataagggaatttgggaggggtaaaaagcagtggtggaggaagaaaagcctgagggaaaaccaaccttgcattccaaggaatctaaaaaggagcagccagagattagaaccaggtagtttttctgtcatataaaaaattgtactaggttgaagtaagtcctgaattgaaacatctaattctctctgattgatctttgtgtatgtatttttgtgttttattacaacttaaaaagatctgataaaattctgttttaaattaggtagaattttgaaagtacctttgactactttttctgttatgatataattcacatgccatatatccaccttttaaaagtgtttttaaccacatcagtggtttttaatatagtcacatagttgtgcaactattacaactatcttattccagaacattcttatcaccccaaaagaagtcctgtaaccatcaagagtcactctaggctgggtggggtggctcatgcccataatcccagctctgggagactgaggtgggaggatcaattgaagccaggagttcaagaccagcttgggcaatttagcgagaccctgtctctacaaaaataaaaaaaaaattagctaagcatggtgtcgtgtgcctgtagtcccagttacttggaaggccaatgtgggaggatcacttgaactcagtagtttgaggttgtcagctatgatagtgccactgcactccagcctgggtggataagtaagatcctgtctcaaaaaaaagaaaaagtcattccccattcttcttagcctcagtctgtggcaactattaatctactttctgtctctataagtttgcctattatggacatttcatgtaaatggaatgacatggtatatggccttttgtgtttgacttctttcacttagcataatgttttcaaggtttatccaattgtggtatgtatcattacttcattcctttttatggctaaacaatattccactctgtggatatttgttttcccattcaccagttaatggatatttgggttgtttccacatttagctattttgaataatgctgccatgaacattcattgcaagttttcatgtgaacttagttttcagttctgttgcgtatacatgtaagagtagaattactgggtcatattttactttcatgacagcagtgtgttatggtttcactttttccacattgtcaccaagacttgttcgttatgtatctttttgattatagctatcctagtggatgtgaggtagtatgtcactgtggtttcgatttgcattttcctaatgactaatgatgctgagtatctttttcatgtgcttgttggaatgggattttttttacatttcatttttggattgttcattgctagtgtgtagaaatactcttgatttttgcatattccttgtattctgcaaccttgttgaactcttttattagctttagtagttttttgagtatttcttatgattgagtatgcaaatagagatcgtcattttccttttctctctggatgctttttatttattttacttccctaatagccctggctagaatcttttttttttttttttttgagatggagtttccctcttgttgccctggctggagtgcaatggtgtgatctcagctcactgcaacctccccctcctgggttcaagtgattctcctgcctcagcctcctgagtagctgggattacaggcgtccaccaccacacctggctgatttcttgtatttttagtaaagacggggtttcaccatgttggccaggctggtcttgaactcctgacctcaggtgatccacccgcctcggcctcccaaagtgctgggattacaggtatgagccaccacgcccagcccctggctagaatcttaattatagtgttgaatagacgtggtgagagcagacatccttgtgctgtttttgattgtaggggaaagcattcagtttgtcatcatgaattatgatgctagatgtgggttttctgtagatactctttatcaggtgaggaaattccctttaatctagtttttgagtatttttatcatgagtaggtgtttaatttttgaattattatttttttgtggaggcagggtttcacaatgttgaccaggctggtcttgaactcttggcctcaaggtgtcctctcgccatggcctcccaaagtgctaggattatagatgtgagctactgcacctggtagggtgtttaattttgtcacatgatttttctgcatctgttgagatgattatgctggtctttgtcctttattctgttaatacagtgtgttaccttgattgatttttgtttgttgagccaatcttgcattcctggaagcaaatctcgcttggtcatgatatataatcctatttatatgttgctggagttggtttgctagtattttgttgaggatttttttgtccgtgttcataaaggatattggcctgtagttttttcctcctgttttttttttttttgtttgttttctttttctggttttggtatcgggaagactggcctcacagaatgagttgagaagttccctgaatacttatctgatcttagttttcttcagttttgttattgacttcctcttcttttttctttctttttttttttttttaagacagagtctcgctctgttgcccaggatggagtgcagtgacactatctgtgctcactgcaacctccacctcacaggttcaagcgatcctcccacctcagccttccaagtagctgggatttcaccatgttggccaggctgctctctaactgttgacctcgggtgatcggcctgcccgtctccctaagtgttgggattacagacgtaagccactgcacctggccagttttattactgccttctaaaaatatattaatgctgttcttttgttccagttattctttttaagaacacacagaaatactttgttagattctaatttaatttagcttacctgtgaggaatgacttgtggcacccagcagaatattacgaaatttctggtattccagtgaaatctgcctagtatactgtctttcagatggctgaatataaaagtccataaaaattagagatgagagagactatggtgatataatcaaccattttacagataaatggaccagattgtccaaagttacactgctaggttacctggctgagccaggagattttactttggtagtttttactcaccaatgattagtagtgtgtgaaaaggataggttttttaaaaaaaagtttaatttcatctgtgtgtttgtgaacaatgctaagaaacaaatacagtatttatttgaatgacgtaagtgtatatgcgtgcccactcattctatactccagctggagaagccctagaacatataattaatccattgtgtcgggcacggtggctcacgcctgtaatcccagcgctttaggaggccaaggcaggaggatcatttgagtctgggagttcaataccatcctgggtaacacagcgagaccctgtctccataaaaaatgaaaaatatacatataattcattgctatcaggaggaaatttattattaatatcaacagcattttgggaagtcttcaaagcaattaacttttaactgaagaaactatttacccaaattatatcatatgagtgggtggtatcaaaatgaattgaaatcttgaagaaactgtctccaacttggaaagagatatagagggagaatcacattaatgtatcaatctaatatatcaacctaaatgtgtcaacctttaacttttaattaattgttcccttctaattgtttttttccttctacttttaagttcaggggtacatgtgcaggatgtgcacgtttgttacataggtaaacatgtgccatggtgatttgctacacagatcatcccatcacctaggtattaagcccagcatccattagctattcctcctgatgctctctctccccctaccaccccgcgacaggccccagagtgtgttgttccctgccatgttgtccatgtgttctcatcatttagttcccacttataagtgaggataagcagtgtttggttttctgttcctgcgatcctcctgccttggcctctcaaagtttgctgaggataatggcttccaactccatccatgtccctgcaaaggacattatcttgttcctttttatggctgcatagtattccatgctgtatatataccacattttctttatccagtctatcattgatgggcatttagattgattttgtgcctttgctattgtgtatagtgctgcaatgaacatacacatgcatgtatcttaataataggatgatttatattctttttggtatatacccagtagtgagattactgggtcaaatagtatttctgcctttaggtctttgaggaatcgccacactctagttgttgaagtaattgtttattttgattgtgaaacagtttttaaaaaatgtattttcagagagaaatagtagtataattttatgaaaataccatatgtgtctccaaagataaaatcatcgtttaattttgctgagccaagaaactcaactaaaactacctgctggaaatggcacagttttctctctcaacgtcagtaacatacgatccaaattctacgttgtgattggctgttgtaccattttcattcagagattagttttgccaacagtgtctgatttgggattgggatttagctcacaaagcagttggttgttggggtataggaaggggttagtgttactaatgagcacactacagagaaatcattccactggggaaaaatagcatttgtccatgcatgagcaaagttgttgtgtaattcaatgctggatgccaaatagtcagtgaagtttggatttggatgtggcagctcactgatgctggggggatattttgtttaatcattgtcttttaaaatgaacttggtaaaagctgtcagttttttcccttttagaaagatgaaatgttttttgtcttttttctcttttcctgtttccataattttatttttaggctttcaaaaagctgaagatttaattaaaataaatgttttccccttggttagcttgattagtctttttttcctaagcattattctgcatctaagattatatcctaacatccaagatagttctaattcacttcattttttgttcctctaaaataaaatagatttgtgaattttaggaagtatatattatcacattattttgttttattttgtattttgaaccttttataatatctagttatcacaaatagatatctttgggatttttttcttgtttcttggttctttaacagatagtcagaatttaatatctgatggaatattttaggtttgttttgtgtctttgataacatcgttcatcttcgacactttttttttttttgagacagggtctcactctgttgcccagtctggagtgcagtggtgcaatcttggctcactgtagcctcgacatcctgggctcaggtgatcctcccacctcagcctcctaaacagctgggactacaggcacacaccaccatacccggctgattgctgtattttttgtagagacagtttctccatatgttgcctaggatgtttttttttttttttttgagatggagtctcactctgtcacccagactggagtgcagtggcattatcttggctcactgcaaactctgcctcctgggttcaagcgattctcctgcctcagcctcccaaatagctgggattacaggcacctgccaccacgcatggctaatttgcctaggctggtcttaaactcctggactcaagtgatctgcccgcgtaggcctcccaaagtgctaggattacatgcatgagccaccacacttggctgacaacatttaacataataatttatgttcttagtatttaaatgccctcaatactatatagcaaagatttatgtgactgaaacatttttcttaaactgagcattttcatgtcaaagatatttgtagaagattgcatttactatttggaaggtaaatattaagaattttttagaaagcaaatgtgagaagttgacagagaaggagaaattagggggcattgcaaatcccttacagtatttcttttcagtagattgaccaaaatgagtaactaaatatagcttaaatgagttaactgcaaaccagaaacatgaattagtaatagtgtctttatttcttcctaatgaaacttaaaggcaaattctgatctactagtttatgatctctaggatactaaactaccagtaccagctaattaagctggaagtactggggactttttcctaacacaagaataatacttttatgtttgccgtttttggttctacatatgttacttagggctggttcagggaggtagaatatgattttgaagtagcttatagtgaagaatgggagagaggtaaatttagggtaagatttttggattgttttgagggtccacttatggttggagaccattactggtgaaaccaattgaagatgatgtaactttttccctctttattagccgagagagagagcagtaaaagcatgaaaatggattgagctatagtcggggtcttgccagacaggtacagtgggaggataagagagcaaaagagatgatagtattagttgagagagagagaaatgaagaccagtatgggatagaaagaaagtactaagtttgaggaattagaggtcttactgaggtgaaagaacagtggtagtattgctgtaaattggaggtctcattgaggtgaaagaactgggattattggagtaagtggtaaagatgtagagagagggccaagcgcggtggctcactcctgtaatcccagcactttgagaggccgaggcaggcggatcacgagttcaggagatggagaccagcctggctaacatgatgaaaccccttctctactaaaaatacaaaaaattagccgggcgtggtggcacgtgcctgtagtaccagctactcgggaggctgaggcaggagaattgcttgaatctgggaggtggaggtttcagtgagtcgagatagcaccactgcactccagcctgggcgacagagcgagactccgtctcaaaaacaaaacaaaacaaaacaaaacagaagtcaaggagtacgtttgtgaggttaggaatgtgattcttattctagttttataccagaattaccaattgccttttttaaaaaaacatagttgcccaggtctcattctggatcaatggaatcagaatctgtagggagttgggctaaggcgccttcatttaagatgttatacagctgattaaaaaatacttcaaaatttgcatacagtaaagtttatactctttggtgtacagttctttgagttttgacaaatgcatagtggtgccctttatcaggatagggtggataggacaggtgaggaaatatggtgggcccgctgtattcacagattctgcattctcggattgaaataacaaacaactgtggattagaaatattcagggtgtgtgtgaaaaaaaccaataaaaataacaatacaacaacaaaaataatacaaataaaaatatagtataacaattatttacatagcctttacattgtattagatacaagtaatctagagatgacttaaagtatatgggaggatgtgcataagctatatgcaaatattacgtcattttataaaatggactttgaacatccttggattttggtatctgcaggggtcctggaagcaatcctatgaggatactgagggatgattatatatgtttggttttgaataccctcaaatttgctcgttgcactaaagctacagccatagaattcagaagagtggagattattacaatgaattaatattttctctaccatttccttaagtctagatctggaattgacattttttctgtaaagagccatatagtaactactttaggctttgcaggccacaaatggtctctttcacattctctgtgtgtgtgtgtgtgtgtatgtgtgtgtgtgtgtttataaccatttaaaaatgtaaaaatgggccaggcatggtggctcatacctgtaatcccagcactttgggaggccgaggcaggtggatcacctcaggtcaggagttcaagaccagcctggccaacatggggaaaccccgtctttactacaaatacaaaaattagctgggcgtgatagcacgtgcctatagtcccagctccttgggaggctgagacaggagaattgcttgaatccgggaggtggaggttgcagtgagccgagattgcaccattgcactccagtctgggtaacagagtgagactctgtctcaaaaaaaaaaaaaaaaaaaagttaaaatgctggtcacagtggtgcatgcctttagttccacagctactcaggagggtgaggcgagaagatgacttgaacccaggagtttgagaccagcctgggcaacatagtgagaccctcctctcaaaataataaaaaaagtaaaaactattttttgcaccttggaaaacaggcagagggccatagtttgctaaccccaggcagatcatcaataccacaataaatcaagctctgatttgtagtatttgctgatttccaaagtataaatactcccactgtggctgatttcagtctactagtgtgactgacataccaaatgcagaatttgaaagaaatcctcagtagcacacagtatttccattatataaatacaatagatgtttcttaaaagcatagttaaatacagtattaatgaagcaatgagttttgagtatttttaactttatttttaatataatttaattgtgaacttacatggtttaatatttaataatgactgtgtggaggctgggcatggtggctcacgcctgtaatcccaatactttgggaggccaaggcaggtggatcatgaggtcaggagtttgagaccagcctggccagtatggtgaaacccccatctctactaaaaatacaaaaaaactagccgggcatggtggcacacacctgtagttccagctacccgggaggctgagggaggagaatcgcctgaacctaggaggtggaggttgcagtgagccgagattgcgccaccgcactccatcctgagcaatagagggagactgtctcaaaaaaataaataaataaataaataaataaataaataaaaaagactgcgtagaacagcagtttgcaaaattcctgaaaatacaacaatcagctctcactagcctgtacaagttgaattcaacatagcatgaaacttaaggttcagagaggtgagataatttaccaaatctagtttaagtggtggaatcagaataaactctaggtttctttttatttttatcttaaaacaatatgggtttatagtttaaaaagtcaaaaagtactacaaggtttatagtacaaaatcatcagttgcctgtcctaccctctcttctgccactttctagcccctaggggcaacacttaactcttccggccttttcttctggtgttttacctccctattttttgtaatacggtaatactgctatttataatttttcactttttgatgttatttattccttctaaggaagatagtgatttacttctcttatgccatacactctttccttctatgcatttttccagtgtatttatatcacaattataactttcttaaattatcttccaatatttacactattattactgtacagtgttcacagctaagccattagtatactataattgcatcctttcttttttttttttttttgagatggagtctcactctgttgcctaggctggagtgcagtggcgtgatctcggctcactgcaacctctgcctcccaggttcaagcagttctccggtctcagcctcccgagtcgctggaactacaggcacacaccaccacacttggctaattttttacatttttagtagagatggggtttcactgtgttagccaggatggtcttgatctcctgacctcgtgatccgcccaccttggcctcccaaagtgctgggattacaggcgtgagccaccacacctggcctcatttcctttctttatataaatttaaagacagaattttatggttctgacagagccatataacagaaccataaaattcatcacagtatggttaaacatcaaataatttaccatttccattcttttcttaaacataccctctaaactgcccttcatcctcctgtttgaattctaacttgttttcagctgtcatcctagtactgcattcagcattatgctgggcattgccattgcttctctcttgtgttggcatccattttcctgcattttacaccgcctggtttcctagtttatttcttcattttggtggagcacatcattcaggagcttcctaagaaaggatgctgagagataagttggttgagatcttgtatatctgaaaatatctattctaccatcatatgtaattgataatttggcaggatatatcattctagcttgaaaaatcattttccctcagatttggaaggtttatcttcagtgttgctagtctccagtgttgttgagcaacccaaagacattctttagtcctttgtgacctttttttttttttttccccttgtgatagattttaggaccttctctttttccccagtgttgtgaaattccacaggggtgtagcttgatatggatctttttcattcattgtgtggcatactctgtgggcattttcattcaggaaatgtgtgtccttcagttctgaaaattttttcttatttattttaatgtttctcttcctgctttctggaacttctattagtttgatgctggatcttctgagttgatcctctgattctcttatctttctcctattttttcattactttctctctttgttccacttcctgggagatttcagctttacctgccagattgtgaacaacttaaaaatttttctagcataattttaatatataagggctcttgttctttgaatgttactttgatatagatcttgtttgtctttcatagatgcagtctttccttttatatatctgagatattatgctgtctttgtgtgtctgtgaagttttttttccctttaattctctggttactcccaagtttcttcttgttttggtcacctttaatgtaatggctttcctcaaatgtctgttgtttttttattttaagttgtggtaaatatatgtaacatgtaatttatcattttaaccattttatctgtttcttttaaaatatttatttatttattttagagatgggatcttgctctgttgcccaggctggtctcaaactcttgggctcaagcaatactcctgtcttggcctcccagaatgttgagatcagaggcatgagccatcacactcagctgtttttaaccatttaaaaatgtttaaattctgtggcattaagtacattcatactgttgtgcaaccatcaccaccatccacctccagaactttttcattttccccagttgaaactctatacccattaaatactaacttctattccatccttccctcagcccttggccaacagcattctactttctgtctctacggatttgacactttagtagcctcatgtaggaagaatcataatacttgtctttttgtgactggcttatttcacttagcataatattttcaatgttcatccattttgaagctccatgtgagtgggcaggaacttgttaactggaggccttcactgagaagtgataaggtgatgaatacctgccaggtgcagtggctcacacctgtactccagcactttgggaggccaaggcaggaagatcatttgagcccaggaattcgagaccacccttggcaatatagtgagaccctgtgtctaccaaaaaaaaaaaaaaaaaaaaaaagatgaatatgtttttcattgggtaaccctagaatatctgtatttttagatgctttttagggtcctgtcagtttctgtggaaaaaatctcccaactcctgactgggggtatatgcttgacagctcattgtttaggtaaccagaaagggataggggaatctacctgtttggtaaacttttctttagttatgccgttttcaatatagggctcacccctattctcagcgagcttggtgttccctgagtccagagcctttcttttttctttctttttttttttacattctaaaacacagcactgagcatgctgtatctttcttttttttattattatactttaagttctagagtacatgtgcacaacgtgcagttttgttacatatgtatacatgtgccatgttggtgtgctgcacccatcaacttgtcatttacattaggtatatctcctaatgctatccctccaccattcccccacacacgacgggccctggtgtgtgatgttccccaccctgtgtccaagtattctcattgttcagttcccacctatgagtgagaacatgcagtgtttggtttttctgtccttgcgatagttcgctcagaatgatggtttatgtcctttgtagggacatggatgaagagtccagagcctttctgattgtttctctggactggtgagttgacaggcagcctttatctagggtggaggatgggtagttgcctggttgcttgggcaggtagggaggagaactaaggacttaactgctctttctatagattgtcagccaactcttctgtttctggccacatgactcaatcctcccttcagagatgcattgtgcttccagttcctggcctttccagagtacagtggtgtgaatcagattgctttttttttcttagacagtctcactttgttgcctaggctggagtgcaatggcacgatctcggctcactgtaacctctgcctcccggggtcaagcgagtctcctgcctcagccttccgagtagctgggattacaggtgcttgccaccactctcagctaatttttgtatttttagtagagacagggtttcaccgtgttggccaggctggtctcaaactccttacctcaggtgatccacctgcctcgacctcccaaagttcagggattacaagttggagtgcagtggctattcacatgtgcaatcatagcacactgtgggttcgaacttctggcttcaagcaatcctcccatctcagcctcccgagtagctgggggtataggtgcacaccactgcacctggcaccatttttgttgttaaaacatataaagaaaacatatacaatatacatacatacctacagtgttctctgctgttccccatccctattgtattcactattaacagtttgtgtactcttcatatgtttctatgcacacatatctatatgcacacatacacacacttaaaacatctatatgtctctatgtttcttcatatagctacatattaattaaaacggaattgaaaatatctttctgtattgctaatattttaaaacttgttaatataggccaggcgtgagtggcccatgcatataatcccagcactttgggaggccaaggcggaaggattacttgaggccaggagatcgagaccagcttgggcaacgtaatgagaccctgtctcacaattttgaaaaaaacccaaacttgtaatatagtttctaaaaatggaaagagaaatatttttcattgtctactaaatggaaataaaagtgctatatattttatggatactcatttcagaaggtatttgcttaggtgcacctaacttatcactcagcattgcagtgctcacctaatgcaagaactactttgtcaaggagttgaaaagataactaatgtatcctaatcagtttttccctcaagatagtccttttgaactacttaaaagcttaatgatttggaattattttacctttatttataatatcacaacctggaagatagatataaatctgcttatcttcatgcaattaggaggttattaggagataaatttttattcacatttgcccagtatattctacaatctacatgggagggtggggagcaactctcagagaaggtaaaacatttagatggaagattcagtttagtttgatagagctacatttgagtgtactcacaattttaggaacaatgaattatcttgaaatttatccttttggattataaagtccatatgtatggagactgtgtctatctaatctagttcattgttatgttcacagcttctggaacatgggaggtgttcaatacatatttgcctatgtatgtgtggagtgattatagatagtaggaatgtagaaataggccagtattgcattcagttcagatcttatgattgtgttcttttagcaactttatgtagcaactgcctttataataatttcattcttcttacatttctgtagttgagaacagcaagatacaaggaggcagccctctgtaatagatgtgaaatggtcattacatgtttgttggtggtagagctgtctgtgaactatcattatccataaatagcagcttcctcatgcagtctggtcagctcaactcatctcaatatagagctcctccagtgaagggatgtagaaaagtctccataacaccgtttgaaggtgattagagtgtaacccacctgctgatacaatgaagcacattggttcttgagccctgttggtcatgtactcaaatcactaaggactagatttgagaagcttagtgtttgaccttaaagtttcccttttgctgggtttctgttacaatttgctttttaccccattctgatgagtattatagttaggtatttctatgtgtcattctctctggatttgttcttttgagtgcagggaacaccttgtctttgtaacttttcatagctatagtgcagtgctttgtatagcacaagtttacactgttaattcttgtgttaagtgggtaagtagaagaattataaattttgctaagttatagttcaaactgtagctacttttataagtcacataaaatccttttcaaacaagatggttatttagctactttgaaaaaaagtatggattatagcaaatccacccccatctggtaatgtcagaagcctgatatttatttattttaaaacagctttattgagatataattcacatgccatgcagttcacccacattgtataactcagtgatttttagtatcttcacagagttgtacaaccatcatgatagccaattttggaatattttcattaccctgaaagaaatcctttatacattagcagtcactccctatttcccactttactccccagccctagccaaccattgatttactttccgtctctatagatttgcctattctggacaatgggattatataatatttggcctttcatgacaggcttctttcactcagcaaaatgttttcagattcgtccatgttgtaacatatcagtacctcattcctttctattgctgaataatctattgtatggatatatacctcattttatttatctattcgtctgttgatagatatttgggttgttttccatttttgggccattataaataaagctactatgaacattcatgtgcaagtttttgtgtagatacatgcttcttttttcttgggtatatgtaagagtgaaattgctgggcaactctgcatttaaccttttgaggaggttagactgttttccaagcagcagcatcattttacattcccaccagcagtctatgagtattccaatttctctacatcctcaccaacacttgttattatctgtcttttttattatagtcatcctagtgggtgtgaagtggtatttcactgtggttttgatgtgcatttctctgttggctgattatgttcagtatcttttcatgtgcttattggccacttgtttgtcttttggagaaatatatattcagatcctttccccatatttaattgggtcatttgtcttttattgaattgaaaggattcttttatgtatttagatacaagtacaaaaatatatttatagatacatttacaaacatttacaaaaatatattttatcatttctacttacaaaaacgttctcccatcctataggttgtctcttcactttcttggtgatgtcctttgaagtacagaagtttttaattttgatgcagttaatctatttttttcttgtttgttattttcagtgtcatatttaagaaaccattacctaatctaaagtcacaaagatttaagcctattttttcttgtaagaattttatagttttaggtcttgatatttaggtctttgatcaatttttagttaattttggtgtgaggcagggatccaacttcattctttttgcatgtggatatctgcttgttccagaacaatttgttaaaaagaatattctttctctcattgaattattttgacatccatgttgaaaatcagttgactaagggactttatttctttatttgtttatttttgagacaaaatctcactctgtctccaggctggagtgcagtggtgcaatctcggctcactgcaacctctgcctcccgggttctagcaattctcctgcttcagcctcccgagtagctgggattacaggtgtgcaccaccacgcccagctaatatttgtatttttagtagagatggggtttaatcatgttggccaggctggtctcaaactcctgacctcgaactcctgacctcagctgatctgtccgcctccacctctcaaagtgctgggattacaggtgtgagccaccgtacccggccaactaagggacttctctttggggggaaatattcacattgttctccttcccccaaagattgcttacaattttttggttaaattaagaaaaaagaaacaatctcaaaaaagttacaagtacagttcaaagaacataattttttttgaatcatttgaaagtagattgtcaacgtgatgccatatgatgaccatgttgtgtgtatttcccacaaacaagaacattttcctacagaagcacaatataaccatcaaaatcagaaaactaacactgctgtactactactatgtcatactcagatcccattcaagttttgcccattgtcgcagtgttgtccttaatagcaaaaaatatccagtccagaattacacattgcatttaattgtcaggattctttagtcttcttcaatctgaaacatttcctcagtctttccttgaccctcatgacctgtacattgttgaagattacaggtaagttattttgtagaatacccctcaatcatggtttgtctgatgtttctttatgattagattcagtttatacatatttggcaggaatgtcacagaagtgatgttacatcctttttagtgcattgtattggggcccacagttttgccattatttctaatattaaccttgattcttgattaaggtggtatttgccaggctttttcactattattgtttttccttttgcagttaggattttgtgggacagtatattgagataacagtaatcttggtcctcatcgatctttgtttcttttatttatttatttatttatttatatctgcatgaacacatatattcctattttgtttaatgagttatatttctttactattattatttgtattgatatgccagctgttccagatttggtcagtgagagccccttccagttcgctgttttgttcttttaacatagcctctcccattctttgagcacttccttcctttttggcacatgatgatgttcaggctcatttggtacttgctctattctgtccctggaatcagcaatttcttcaaagagccctggttccttttagtagagaatggtattagaaagcaaggtctaggtgctcagtgtacatattggggtgttgttgcccccaggacctctcagggcagcagtccccaacctttctggcaccagggaccagtttcattgctggggtggggttaggctgggggtattggtttcaggatgaaactataccacctcagatcatcaggcattagttagattttcataaggatcacacaacctcgatccctcacatgtgcagttcacagtagggtttgtgcttctatgagaatctaatgccgaagctcaggcagtaatgttcacttgcccactgctcacttcctgctgtgtggcgcttttcctaacaggccgtggaccagtgccagtccgcaccccgggggttagggaatctctgtctcgggacagagctagggaatatatgtattctgtgtatagacatttacatatttatgtttatatacgttgaaattcatgagttgatatctgtagctctaattctagtccaagacaagggggttcattctattacagttgagcaaattattaataacatacccatcatttcatagttacccttttttttggtagtaagaatacctaaaatttactcacttggcagattaccagtatataatacaatgttattaactataatcctcatgttgtacattggtcacttagtggcttttggactgagttgtttggaaaaggggttgcatgttgtcttttgagagatgtgaatgaagttttacagacttagaagtcaatgtttcataagaaggaaaaaaacaaatatcttgacgttttcactttttaggcaatcaaaaggattccttctgttgctaacatttaacataaaataatactcaatttgattgataattattagaatcttaacataccttggttagtgagctgctcctgaggaaattagaaaacagtaaataatttacatctacagagtaatattcatttctcttctagctcttccaccaaagccacctaagccaatgacttcagcagttccaaatggaatgaaggacagttctgtttctcttcaggatgcagaatggtactggggggatatttcaaggtaactagaatgctactgtaattgaatgcagttttttaaaaagtcatttttgagaattagtagttaaagtaaaccattttaagctgggcatggtggctcatgcctgtaatcccagcaactcaggaggctgaggctgaagaatcacatgataccaggagttcgaggctgtagagagcactctgttgcactccagcctgggcaacagagtaagacccccaactctcaaaaaaaaagagcattgtaatgctctactaattgttatttaaagattaccatttaaggccgggtgcagtggctcacacctgtaagccatgcactttgggaggctgaggtgggtggattgcccgagctcaggagtttgagaccagcctgggcaacacagtgaaaccctgtctctactaaaatacaaaaaattagctgggcatgttggcatgcgcctgtaatcccagctacttgggaggctgaggcaggagaattgctacaacctgggaggcggaggttgcagtgagccgagatagtgccactgcactccagcctgggcgacagagtgagactctgtctcttaaaaaaaaaaaaagaaaagaaaaagctcacttaaaaaattttgcatgggaacgcttcattagtgtcttaatacttttcttcccatgaaaaagtgacaagaaaatcttcattatttatttgttttgagatggagtctcactctgttgcccaggctggagtgcagtggcatgatctcagcttactgcaacctccgcctcttgggttcaagcgattctcctgcctcagcctcccaagtagctgggattacagtcatgcatcaccataccctgctagtttttgtatttttagtagagacagggtttcaccatgttggctaggctggtctcgaactcctgacctcaggtgatccacctaccttggcctcccaaagtgctgggattacaggtgtaagccactgcacctggctgaaaatctttaaattatgggtgtgattattacttctaatactatattgaggatggatttctaaataagtgacatgtagacatttaggatagttacatgtgttttagaattaaaaatatttgtgggtacttaacatttctgtacctttctttctcttaagccagtggttccaaagtctttgcatgcacaaaaatcaattgaggtggagcccaggaatctgcatttaatagattccctgggtgaatttgatgcagtctctttacacaccccagtttgataaacaggactctaggacagatttgttttctgggtaaagtgtagttttaggtaattttgaacctaaagagggaattatatacatttaatttgaatattgtattttcttactaaatttttttcttgttaaacttgctttagtgggtctcagatgtattttctttttaaagccctatccatttctgtcaaatcagtttccaggttgatgctgtattcctcagaacacttacctatccctttctcttctctgttctcttcctctaccaaaatggtatttatttaattttttttacccttacaatttcaactattttaagagtacatttgcattgttgtgcagctatcatcaccatccatctccagaactttttcattttccctaacagaaattctgtacccattaaacaataaccccccattctcccctccctcagctcatggcaaccaccattctgctttctgtcttatgaattcaattgtaggtactttgcataagtgtaatcatataataattgtacttttgtgactggcttatttcactttcttcatacgtcttcaaggttcattcatgttgtagcatgtgtcagaatttcattccttcttaaggctaatatatgtatatgttatatatttttttaatccattcatctggacatttagattgtttctaatttatggctgttgtaaataatgctgcaattaatattggtgcacacatatctgagtccctgctttcagttattttgggtatatacccagtagtggaatggaattgccaggtcatatggtaggtaattctgtgtttaactttttgaagaggacttaatatgttttattaaaaaatttttttttttgagatagagtctcgttcagtcccccaggctggcgtgcagtggtgcagtctcagcccactgcaacctccgcctcccaggttcaagtgattcccctgtctcagcctcccaagtagctgggattacaggcgcttgccctgccaccacgtccggctaattttgtatttttagtagagacagggtttcatcatgttggccaggttggtctcgaacccgtgacctcaagtgacctctctgcttcagcctcctaaagtgctgggattataggcgtgagccactgcacccagccattttattttaaaattggttagaatatttctattttaatattgtacaataaaagtctttttttaaattttaagatcatgtggttctgatatgattcaagggtcttttatgccctgccatttcctttaagtgttctagtgttgtgccttaaagtcctaaatcaactctacagaaggaatttgttatcgggacaaattcaaactaggagactatcctattgaaaggttatgaacttagtgaattttcccccttctgttcagaaacagctgccactgttgcttaaatataaccttctttctaaacagccactgtttttttcctgaaactttacaagttcagacctgcctaaggaaacccttaaaggcttgatggaaacagtatctcttacacacatttgaaatctggaagagtttaaaaatcaaatagctcttctgtagattgcgtaacaccaaaaatcaaaacagaaagagcatatttaatgcagggaagaactaaatgacctctaaatggctccgttattctataacctcaggcacacctactgccgaagctgccttagtagtaacatgtaaagaaggcacacctactgccgaagccaccagtgttgacattttttcatttttcttataattctgttcttcagggaggaggtaaatgacaaattgcgggatatgccagatgggaccttcttggtccgagatgcctcaacaaaaatgcagggagattatactttgactttgcggtaagtacttttcagtcttttggctagttctctactgatgttattttagttctgggtatacagatatttctgtatttaaatctttatctatacaatttttcatattttcatttaatttatgtacataatttccagtctggctaattcttttttctatacattaagtatttaaacattttgtataaaaatggcaacttaaaaaaatgtagaaagaaaatgaaaaggttaaaatcccaaaatgtaagggagtaggaagcatactgttgaccttataaaggaagtagaagtcatgggcatattctaagggtaaaaatgaatctatcctttgaataaccctattatcttccttaatgcagactttagaaagcagaactcaacataattttggttgatgaggatatgctgaagataaagcagttcctagcgtatatcatgcttttcatatgggcatatttagagtcttttaagtgatggatatatgattttttaatatttgcacatatttttaaaaggttaagaaaactgcatgagaaatttccacatttaattttaataattaaagtagcccagttacaataaagccttatgattttttttaaaaaggaaatatttaacaaaaagaaaataacagtaacaataacaatgactaactttcttgtactaaggcctttacatgcaatagatcatttattcttcacaacaaccttatgaggtaggtattattactattcccattttatagatgaggtaactaagggttaacatggttaaggaacttgcctaaagtcacatagttagaaagtggtagaggaagagtttaaatccagattcatctggctgtttgctgcctttccagcctaatatctttaggaaaaataatgcctcattttatgctagtatggcataaatttggaggcactattttagtttctggtaaagagctaaagaaattaatacctttgcacttgaattgtgctgactaatcagtgttctacagtaattcattgaacacaatttttcctctactccactcaggcttctgtctccaccactccacggagactgctaaacacttttctcttcttaccttacttgacctcttagcagcattggtcatagacacttcttcttagaagcagtttattgttttggctgttaagacgtcacactttcctgattttcttcctaactttaagctattttgctcaatatctaaattttaagtgttccagggcttgggacctgggcctctttttcttctctgtattcattctcttaaggtgagcttgtcctgtcccatggccttaatatatgtgatgattaatttaagtgtcaatttggctggattacctagagaactggtaaagcattattttggatgtgtctgtgagggtgtttccagagcagattagcatttgagtcagtggactgagtaaggaagatcgcccctcagtgtgagcaccatccaattggctgaggatagaacaaaaagaaagaaaaaaattttatctctctgtcttggagctggagcacactcttattctgtccttggaaatcagaactccagcctttggactccaggacttataccaatcctcctcaccccctatgggttctcaaggccttcaatcttggactgagagttataccattggcttcctgggttctgaggctttaggaattggactgagccacactactggcatgccagcttgcagatggcctgtaatgggacttctcagcctccataaacatgtgagccaattcccctgataaatcccctcatatttatctttgtctctctcctattggttctgtctctctggagaactctgattaacacagatttggtaccaggaatgattctagaggaaggtaattttttttttttttaacacaggttattgctctgtctcctaggctggagtgcagtggcatggtcatggctcactgcaaccttaacctcccaggcctaagtgatcctcctacctcagcctcctgggtagctgggaccaaaggcgcatgccaccacacccagctagtttttgtgttttttattttttgtagagatggagtctccctgtgttgcccaggctggtctcaaaactcctgggctcaagcagtcctcctgcctcgaccttccagtgctgggattacaggcgtgagccactgtgcccagcctgaggaagagaattttaaggatgagtttccttaattaattttggggttcccggaattggctctcttaatttgatgagacttaaaaatgctaaggaccctacttctaatagtacagagagcactgacagtccatgctgtgaactgtttatatagcgatatgctaaatatctgcatttgatacttctaatttaccacctataagaggcaaggaacttggcaaccctgtatttgatactgtcaaacgtttgtagaaaaccaaggttttctaatattgctggacgaagtgatgaaagaaaagggtgagctcagggttttgatttcctggccccagctctgccataaatagcccaagaacttctaaatatgccctaagtcagaatcttctcttctgttgccaaaggtctgaaattgcacaaaatcaaacacatactctcatcatgtgattagctgaattacaatcaaaggtgaaatatcagccttgtaaggtatctgctgttaaaatgagggcattggttgggaaagatggaattctatacgtttggatggggatgtgtgggaagaccctgatgaggctggggacgttgagctcctaaattctgatgagtcttgtttgccagcagaaatggcctcccacccccagtaacagcatcccccctacactggcctttccacctttgtctgaggggattgactctgcattgcctgaggaaaccataatggccttcctctaggcagctgctaagccagaggatgctgagtcttctcaggacccacccccaccacacctctttgcttctagacctatagctagacttgagtcccagcagcccctaaagatgaggtacaaagttttactcatgaggagatgtgctacatggtaaaaaagctacttgaggtttctaatttatacaaggagaaatctggaaaatatgtatgggaatagatatttagggtgtatttagggtgtgagataatggtggaaggaacataaagttgagtcaggctgaatttattgtttttttttttttttttttttttttttttgacggagtctagctctgtcgcccaggctggagtgcagtggctgatcttggctcactgcaagctccgcctcccaggttcccaccattctcctgcctcagcctgctgagtagctgggactacaggcgcccgccaccacgcccagctaattttttatatttttagtagaggcggggtttcacctgtgttagccaggatgatctcgatctcctgacctcgtgatccgcccgcctcggcctcccaaagtgctgggattacaggcatgagccaccgcacccagctgaatttgtttttggcccaccaaacacattctgcatttaatattgtggctcagggagttagaaaaggcaacagttggccggtcatggtggctcactcctgtaatcccagcactttgggaggccaggcaggcggatcatgagatcaggagttagagaccagcctggccaacatggtgaaaccccgtctctactaaaaatactaaaaaaaaaaaaaaaaaaaattaactgaatgtggtggcatgcgcctatggtcccagctacttgggaggctgaggcagaggaatcgcttgaacctgggaggtggaggttgcagtgagccaagatcgcgccactgcactccggcctgggtgacagagcaagactccatctcaaagaaaaaagaaaggcaacggtttatttggttagttggctgaaacatggatgaaaagatggcctactgtgagccagctggaagtgtctgatctaccttggttaacacagaggaagagattcaaaggcttaggcaggagactgggttgctacagtggatttgtcacttaaaatctacttatttacactgggtgagtccagatcacatacttttcagcagtactttgagaaacagatttgtgaggagaaccccatcatccctaaatgccatgattgcccttctctgtaggccggaccttaaaatggaaactgcagtcactcaattgaaaaatttaaatgcaatgggaataactggattccagggtagcagaggccaagtgaagggactcatttgacaaaggcaaggtggacatggttatcataacagacagcagaagcaaagcaacagtcagaatagtctgactcatgtagacctgtggcattgactaattcactgtatgggcagctcactgtctattttcttctcccttcccacctagtctgtcttggcctactacaatttaaattatctgaggttggggattttgtttaatgattgctgtatctccagtgtctagattagtgcctgatactgggtaagcattagagaatggatgcctaatatatatatatatatatttatttatatttgtatttttgagacagggtctctctctgtcactcaggctagagtacagtgatgtgatcatagctcactgaagccttgaggctcctgcctcagcctcccgagtggctgagactacaggggtgtgccaccatgcctggtggctaattttgtaaaaatttctttgtagagatgaggtctcactatgttgcccaggctggtctcacgctaagggtctcaagtgatcctcccaccttggcctccccagtcctgggattacaggcatgagccaccatgcccagcttataaatacttatttaataggtgaatatgcttcttatttatctggaaaatggttttaatcccacactaagttgtggaatttcattccttttaaggctgaataatagtctgctatatgtatatactacattttgtttatccatttatcacttgatagcattagcaagaatgtttgaaagttttcatgtatctatcacaaggtctgacatacagtaggtgtttgataggtgttgagtaaatgtttgaatgaaagaattaatgagagaaagacagagagaaagtttctcgcaggaaatgacagttgagctaggccttgatagatttttgcaaggcagaagagtgatgatcttaattcaatttaataaatagttgcaacttagtgctaattactctgcagggtatctaacaatgagttaaaacttttgtctctgggaatgtataatctagtgaggacaaagggaatgagaaaatggctttgagtgaaagtttaatagcaggagagtttcacaaaatatgctttggtgactgaaaggaggaaaagagatatctttgttaagagaatgtagaaaactgaccttcacagaagagattacatttgcagaatatcttgaaggggataggtttggacatgtagaaagtgggaggggagtagcaggaatagataacaataggagcaaatatacggaggtgagattttatagctgctttctgtgagatgtagtcctgtttggctaaaagataaagtttgtgaagaagaagtggtaggggataggaggtaggaaaggggtcatgtttaagagggccttgaattccaaaacttgggagtttgtatttaatgtatttaatgttgtaggtaggtggggagaaccactgcattttttcggcagggaaattgtgatcaggcgcgcgctctctctctctctctctctctctctatatatatatatatatatttttttttttttttttttttttttttttggagacagagtcttgctctgttgctcaggctagagtgtaatggcgcgcaatcttggctcattgcaacctccgcctcccaggttcaagtgattctcctgcctcagcctcctgagtctgggattacagtcgtgtgccaccacgcccagctaatttttgtatttttggtagaggcagggtttcaccatgttggccaggttggtcttgaactcctgacctcaggtgatctgcccgcctcggcctcccaaaatgctgggattataggcgtgagctaccgcggggatagatgttgacttctagctgctccagaaccgcaaggtaaaaatgtatctaggatatagctagaaatttaggtttaatgcttaggagagagtacaggaccagagaaagagtcaagctaccatatgcataaatgggatttttatggaaaaaaatatataaaatttaaaaggtggaggctgaaggcaaaatttttttttagggaataactagggttggaggagacaggaagagtggtttgagaggttgaaagaaaataataatttcatcaaagttatggaaggatgaaatattaagaagggagagagtgagggagaaggagggcctgggataaaggaaggggacagagtctgaatttgttcaaagtcattggtgactcttaaatgagaggaatgagagtaaaaccagactgcagagagtagtaggtagtgaagaaatagagatttttcagttcaatagctcttattttttaaattggtaaatagtatttgttgtagaaaatctggatacttaacaaatctttaagaatctgctatctgccaggcattggactaggtgctgagatacaaggaggactagcatgaccttcagttcctttccttctctcatctctgcttagagtccatgtacattattattaaaattacccatgtgaatatatccttaacaaacttgctcctctcttcctccagtgtagtcaccagactaaattccaacacggtattaaattcagttctccacttagtccttccctatacttgagctgctgaatgtggagaaggggacgtgaccacatggactggtttcacattaattatgaccactaaccttaagtgacctttaaaactgcccagcttaacttctgcatttccacaatgcattcatcctgcttcctcgtcagtttcgtaaatgacaatttcacatgttctttttttctcttttaaaggacagcctttcttcccacttttaactatagaacttgcttttaatttcactgatatatggacacagtcagacgagaactccttcatgctcctattaccacagctatcaacatatttacacattaatgtgaatagtctgccgcttttctgttccagtggatgactgttcatgtccttgtccagggtctgcttctctgtttgtagactggatcccatcccatccctctaatctactcaaggacatcactctaggaataatcttgtcctctttgttggatcaacaatttttgtctattgagtcattcccatcagcatataaatatactctattatctcccatttaagaatagtaaataattgaccctatatctctttctagatacttccctatttctctgcccttatttatagcagtgttcctcgagacacttgtctatgggcatttctatcttctttcattttcttgaatccattccagtcagggttctatccttaccatttcactgaaaccatttagtcagttcatttagtgctatctactttgccaaacctaattatcattggacttggttgataatttcctctttgttgaagtgcttttgtacgtattggtttttaggatatcacactcttagttctcctctcacttcattaattgctcccttttggtttcctttgctgattcttccttccatgtctctgaccaccaaacattggcataccccagtgcttaggccttggacctctttttctgtccagctatgctcaccatcaaataacatacatcggctggtaactcctgaatttctatctttagcccagacctttctcctgaactttagattctttaagtagcctgctggatcatctgcttttgaatgtttaggaggcatctcaaacttaaagtgtctaaaaccaaactttttccccctttaaacatattcttttttttttttttgagatggcatcttactctgtacccctggctggagtgcagtggcgtgatctcggctcactgcaacctctgcctcctggattcaagcaattcttctgcctcaggctcctgaatagctgggattacaggtgccctccaccacgccaggctaatttttgtattttagtagagacggggtttcactacattggtcaggctggtctcgaactcctgatttcaagtgatctgcctgccttggcctcccaaagtgctgggattacaggcgtgagccaccgtgcctggtctaaacacattctttttaaatagccttcttcatgtcaataaatgacaattccattcttctgattgcttatgacaaaaaccttgaaatcatctttatcttgtctctctgtcatatttgtatccaagccatcagcaaatcctgtcagctctatcttcaaaatatgttaagaatctcactatttctcatgacctctactactgctaccctcatccaagacaccatcatgccttgcctagattattataaaagtttcacaagtgatctttccacttctactgctgcctcctttgaacagtcttttctcaactcagcagctagagtgaatcttttaagccacaagatagattatatgattctactgaaaacccttttgtgcctccccttctcactcagtaaaagctaaagcccttacagtaacctacagactgttattacataatctaagctccttttacatgtcttacctagtctcctattactctcccttttggtcattcaggcccagcatcactggccttcttgctgttcctcgaacatgccaagcatgcccttaccgcacctctctctaggaaacttcccgtacatatctgctgtactagctccctcacttcacttagaactctgttcaaatgtcacctgaacagagaggttttccttgagcagtacaaacaattcctccatcacaagaactcctttccctttactctgctttattttttttcccaacagacttattactatttggtatatttagttgtttatttttgtgttctatcttgagaagtttgttatcttccttaataaactgaaagacagagatatgttccttatgctgttaaactggaagctccatgagagcatggactgtgtctggcttgtttatcatatatctgtagtgcattgtgtaattcctggcacatagatattcagcacataattttaaatgaatgaatgtcttttaactttaacagagaggccagcttgcaattattgtatgtgtgagtgtacacatttatagtaactgtatatgattagatggtccttctcatgtatatttaatagaaataatttatcatccatctaaaaactgacctaaacattgtttaaatcagcttatagggtcaatcttactgtgtttgaccttttacaaaaaggtcatttatataaaatggtcatttatgtaaatgctatttatataaaatggcatggcataaagagagttaggggcataagcctgcgtgctgctgtaagaatggttgaatgggaatggtacagcattttgctatgaatcaacctgctgtggttttagattatgccttatgggacttgcaaaacattgctattttaaactttagttataaattatcttttaagggtccatttagatatgactcagtaaacaaaggtggcctgaactgtccaagcatgaaattacattcatctaatatacatagctcttcaaaagctatactttgtaaaacagttgaatgacttgaatcatttacatgttgtgattgcctgaacagtcatttctgagaattataagcaagtgtaaaagacaaaatagtataaggttctagattaattatgcagctataaatcatagattaaggagctcagttatgtttgtgcattaacaacaaaaccttgagtatgttggtgattgtgtgacaaatgtttatcattcccttcatatagagatggcttctgctccccccacagagacatacaaccacatatctttaggtccttaagagattttttctgttcttcctgataaaaatattgatagaatttaaatttgaaaattcattcagaatataaacaaaaatagaatttacttctgttttatttttcttaagtgattttttttgctacatttgttcatactgaatgctgtgtagatatgttgacctttaataaccaaagtattttatggacaaaacaatgcaaaatgaattatatatatatatatatatatatatatatatgttcacacacagaataacatgccttttcactccttccagcctcattaacatagtaaaacttgtttatcatgtgacaccaagctttcacgtctccatatgaaagcagtagttcagttgaatttgggggaaaaaaatccacagttgttgtcttgttgttcacaggaagggaggcaataataagttaataaagatctatcaccgggatggtaaatatggcttttctgatcctctgacatttaattccgtggtggagctcattaaccactatcaccatgaatctcttgctcagtacaatcccaaacttgatgtgaagctgatgtacccagtgtccagataccaacaggtatgattatggaaatccttgctagctattgagcaagtgattatttaacagccttatttgattttatttaccaggcttatcagttttaaaaaactagccattttgttatttatttatttactttgagacagggtctctgttgcccaggctggattgcagtggcatgaatatggctcactgcagtcttgaccttctgggctcaagtggtcctcctgcctcagcctccccggtagctgggatcacaggtgcatgccacaacttcagggtcttgccatgttgcccaggctagtcttgaactcctgggctcaagcagtcatctcactttgaccacccaaagtgttgggattataggcatgagtcattgcgcctagtgcatacttaagattttagatatttttggaacttattttgtggctacccttctgtaatatcttattgcatgtacttgttacctttatataaaaatacttatgtttatgtctcccacttcatttcttaatttttaaagtattaatcattttgatgtgacttaaaggctgatcttaatattatcaaaggatttggtacatttgtgtgcttgatattaatacagtggcttaaagttgtacagttgaaatatagtttaatagatggttgaggtgatattttcctttaaaaaatagatgtggaaaatctatttccacatatgtcagaattgttaacattctttatttttttctttacctgtataggatcagttggtaaaagaagataatattgatgcagtaggtaaaaaactgcaagaataccactctcagtatcaggagaagagtaaagagtatgataggctgtatgaagaatatactagaacatcccaggttggtatattatgttgtttttgactaatatgtgtgcaatgttttagttacatcaaattttcgatcattcacttgatgatctttagctgttttaatgtcttaaaggcttaaacagcctttttgaaactttaatgatataaattcccctcccttcttaattggttaaggatataatttgtatcagttaatattaactggtcacaagtgacaaaataaaaccaaaggcttcagatagaaatttagttttctttcatgtgtatataggcactacaggggtgttagggtaactccaccatcctcagaacttatagacattttctgtcttgatgctttgctatctgtggaagagggcttactctaatatcagccatcacaaccatattctagtaaacaggaagtaagaataggaaggagaaaggaaggttctctatctttaagacaacttcctagaaggagcacactctgctttcacttttatcccactggctagaactaagtcacatgggcatacctagctacaggtcacagctagctgtaggggaggctgagaaatctagtttttatttggtcaggtgtgttcagctaatgtggggatttactgaggaagaaggagctgatggatggaaattgtgggcttactagtagacttagttagctacacagtttttagatcattaactttaatagccagtaatacttttcatatttatgatatagagcaaaattctgttgaataatctagtttctttcctaggacttcttaggcctgactactttttagattgttttttagctagacttggattggtttaatttgccctaagttgttacatagtttgtcaaaagtgtttggaattttgatgaaggtgaatatcttcagagaagtttaccttttataatatttgggtagaagtggcttaggaaaatatatttaactgtatttctcatgtacattgtcttggaacacaggttattattttgaatatcaaatgatttatagaagcattagtctatgttgattcgacttaattcctagtgaattcttagtgcaacaataacttaccttgggctctttctagtagataacaataatggatttttttagtgtttactttctgtttcatgaatttctgctctttctaatttttttctgcttgctttcagtttaattttctcttttcctagcttcttaaggtggaaattttgttcattggtttaaaaactttctcttttctaaaataagcatttaaagcaatacattttcctttaagcactgtgtatatgcatctcacaaattttatcatactgttttccttattattcagtttttaatattttctattttttgtgatttcttcttttgccccttgtgtttttaatttctaaatatttgggactttcaaatatttatttctaatttaaattagttttgttgttagtaaatatattcattaaagttatattcttttgacatttattgacctaaattttattttattattgatatttttatgagacagaatcttgctctgtcgcccaggctggagtgaagtggcaccatctcagctcactgcaacctccgcctcccgggttcaagcaattctcctgcctcagcctcccgaatagctgggattacaggcgtgcaccaccatgcccggcaaattgttgtatttttagtagagacaggggttcatcatgttggccaggctggtatcaaactcctgacctcaggtgatccgcccatctcggcctcccaaagtgctgggattacaggcgtgagccaccgtgcctggccagctctttttttatttttattttttattttacttacttatttttttgagacagagtctcactctattgcccaggctggagtgtagtggcatgatctcggctcactgtgacctccatctcccagattcaagtgattctcttgcctcagcctcctgagtagctgggattacaggcatccaccaccatatctggctaatttttgtatttttagtagagatgggatttcgccatgttggtcaggctggtcttgaacccctgacttgaagtgatcgacccgactcagcctcccaaagtgttgggattacaggcgtaagccaccggtgcccagccataaacaactctttaagaagcttatctgtgatttgaagagagttttggaataagaatgcttttttttcaaagtgttgttaccagagcttgtttatatgctgctaagaaggaaccattagactgggagagttaatgatgtaaaaggggttagctgatacgatagagtgaagtacccagaaaggaaggggagctgagacccagagcacatgtaaataaagggaggggaaggaagagaggaggtgaacaggtaggtttatagttttggtggcaggtgtagtggtatagtggcattgttgatgggggaggtgctgacttagtagtgatatcaaatacttttccctttgctgttctacttaccaatatatctaccagtgttaataaagtctaaattattagtgttttctttgaagatccagggccagaactttataggtaatttctaacttggcaagggagctaaagctctccactataatttaagagttgtagaattagtaccaagatatttggcatatgggaattctagttactttttagtattaagatacatatgatgtaatcttaactgtatggactatcacaaggttccagcctccctcatctgctaatcctctaatgttctagccctactgggcaattactaatccttgaacatgccttgttattttatgtatacattataccatgcctcctttgtgcagtgctgtattttcttcctctatctcagttctttaagacctagcttaagtgtcacctcctctgtgaagtctctgtaaagcaataaataactagttaataaataactggttgcctcttccatgacatgaaaccaaaccttattagagttcagaaatctgttccacctgtatattctgagtcctggagggcagacttcacgtttcacaaatctctatcaccagatggtaatttctgtatagtggattctcagtaatcaattgccgaaagtgacaaatgcttaagctgggtgtgtggtgccctcctaaagtctcaactagttgggaagctgaggtggaatgatcccttaagcccaggatttcaagtccagcttaggcaacagttttaaaaaaaccaatccacccacccacccaccaaccaaaactgaaaccgaaaccgaaaccaaagccaaaaccaaaaccaaacaccccagcctagtaagtgctagataatgtaggaattatcccataaacatcaaaacttctagaattgtaaacattcaggacagcagtttttctagacccttatgcatatttattgcctttctaaaaagcaaactgaacaaaatttaacctgaagatttttggggaattgtgattcagatgcctttttgtttttgtttttttgagacaaagtcttgccctgtcgcccaggctggagtgcagtggcacaatttcagctcactgcaacctctgccttccgggttcaagcaattctcctgcctcggcctcctgagtagctgggattacaggcgcccgccaccacgcctggctaatttttgtatttttagtagagacggggttttgccatgttggccaggctgtcttgaactcctgacctcaagtgatctgcctgcctcggcctcccaaagtgctgagatcacaggtgtaagccaccacgcctggcctattttatagtttaaatgatgtattttacatacaagtaatagagtaggggttgaataaaagctcttgttttagtcctcctaaacaaggagaagacttttgaaagactaggtgttatatgggattacattaataactggaattacaaaatttgtttaagaccaaggttagaagaaaataataaagataatgaagcctgtgttttttctttttctctcctgtaggaaatacagatgaagaggactgcaatagaagcttttaatgaaacaattaaaatatttgaagagcagtgtcacacacaagaacaacatagcaaagaatatattgagcgatttcgcagagaggggaatgaaaaggagattgaacggtaagtctacttagtacctccaagggcatcagtgagacaggatttcttttcttccccaataatttctgtcttgttttcttttaccccctcaaactgcacagccctactattggaaccacttgctgtttccactaatggcaccaaattgaacttcctctctcctctgctctttgttcattctcccaaacggataaactcctgcttatccgttaggacttcaggttagatatcatcttttctagaaactgttccctgattccggagaccaatttaggggctgtattttgggtccctacagtgcctggtcctgatccctagtgtaacatttactgaatgccacgcccactcaactgtaaactcattgagagtaggcatggtggcttattttccctggtagccctagtacctacttatgtatgggagtacataatgggtgctcatcgaatatttttttgaattgaatatcaactttggcagcagtctgagaataaattgtagtagaacaagactgtaggcaggaacaccagcctgacttgcacatgactgcaacagttgtggtcatcaggttaaacgataatgagggcctggactagagaaatagcagaaaagaagcgggaggtcatgggaatgctaaggacttcatgcctgaccagatatggtaggtgtgggagaagtcaaagattattcctagatttctggtgtgagagactggaagatggtgtttttcaccaaaataagaagtacatgaggagagtttagggttggaaccagtgagtttgaggttcctgtgagaacacaaatggagctcactagggggcaggcagctgattatttggatttggaacttggtatagaaaggatttgggaggcataggtgtgtagttgatggtagatgctaagaatgaaattacacagaaaggatgtggcaggagaagtaatggatttgataactaaaaggatattgaaatcctatcaaagcaaatttagtggagtattggaagactaagctagattatagtgggttgagtgctaaagtggataataaatacaagtaattaatatgcaatggaaaagcaaaattatttctcatattaggaccacagtattagtgtatttctgtgtgcatgagtttagagctaagcactgtgaggcagtgtagcttaatggttaaagtgctgtgagacagtgtagcttaatggcatgagtttagagctaagtgctgtgaggcagtgtagcttaaatggttaaaactatgggcttgaattctgaattagccatttattagctgtataaacttgggtgaattacttaacttttctcagtctgttttctcttccataaactgaataatatcttgttggaatgctagagaattaagtaatatatatcctggcacatgatgtgctttcagtaaatgataattatttatttatttatttatttgagacggagtctctgttgcccaggctggagtgcagtggtgccatcttggctcactgcaacctctgtctcctgggttcaagcgattcttgtatctcagcctcctgagtcgctgggattacaggcaccccccaccatgcccggctaatttttggtactttttagtagagatggggttttgccaaattggccaggctggccttgaactgctgacctcaggtgatccacctgccttggcctcccaaagtgctgggattacaggcttgagctactgcgcctggcctaattataattattattaacgatgaagaaacagaaaaggatttgtagttttgttgcagagggaagtaaagtagcatgataacgttttgttttatttatttatttttgagacggagtctcgctctgttgcccacgctggagtgcagtggtgcgatttcggctcactgcaccctccgcctcctgggttcaagtgattatcctgcctcagcctcccaagtagctgggattataggtgcatgccaccacacccggctgatttttgtatttttagtagagatagggtttcatcaagttggccaggctggtcctgagctcctgaccccaggtgatctgcccgccttggcctcccaaagtgctgggattacaggcatgagccaccgcgcccagcctatttttaattttttttattttttgaggtagggttttgctctgttgcccaggctggaatgaagtggcatgatcatggctcactgcagcctcaacctcctgggctcacgggatccacttgcctcagcctcccgagttgctaggactacaggcaagtgccactgcattggctaatttttaaaaatctttttgtagagatggggtcctgaactcctggactcaagcaatcctccccgctcagcttcccaaagtgctgggattacaggtgtgtgtccagcatatgaagttttaatagtaatataaagccacatattgagtgacaagggaataatgtagacagtcattaccataagggttcagagtatagcaaaacgttgtgtgttggaaaagcttatagctgtcatctgttgcgtgcttaccaagataatgtcagggaatgtttttgtcctttacatgtattgtcacatttaattaacagaaaaacccagtgaagtaagtactgttgtaggtacccatttgtattagtccattttcatgctgctgataaagacatacctgagactggggtagtttacagaaagaagagatttaattggacttacagttccacgtgactagggaagcctcacaatcatggtggaagggaaggaagagcaaatcacgtcttacatggatggcagcaggcaaagagagaatgaggaagatgcaaaagcagaaatccctgataaaaccatcagatctcgtgaaacttactcactacaatgagaacagtagtggggaaaccgcctccatgattcagttgtttcaccttggtccctcccacagcatgtgggaattatgggagtacaattcaagaggagattcgggtggggacacagccaaaccatattattctgcccctggcccctcccaaatcctttatctttacatttcagaaccaatcatgcattcccaacagtcccccaaagtcttaactcatttcagcattaactcaaaagtccacagtccaaagtctcatctgagacaaggcaagtctcttctgcctataagcctgtaaaatcaaaagcaagctagttatttcctagatacagtgggggtacagacattgggtaaatacacctgttccaaatggaagaaattggccagaacaaaggggctacagggtccatgcaagtctgaaatccagcaggacagtcaaatcttaaagctccaaaatggtctcctttgactccatgtctcacatccaggacatgctgatgcaagagatgggttcccatggtctggggcagctccgcccctgtggctttgcagggtacagcctccctcctggctgctttcacagggtggccttgagtgtctgcggcttttccaggcacacggtgtaagctgtcaatgaatctacaattctggggtctggaggacagtggccttcttctcacagtgccactaggcggtgccccagtaggaactctgtgtggcggcttcgaccccgcatttcccttccacactgccccagcagaggttctccatgagagccccgcccctgcagcaaacttctgcctgggcatccaggtgtttccatacgtctgaaatctaggtggaggttcccaattcttgacttctgtgcacctgcaggctcaatgccacatggaagctgccaagacttggggcttgtaccatctgaatccatggcctgagccctatgttggcccctttcagccatggctggagtggctaggacgcagggcaccaagtctctaggctgcacacagctcagggaccctgggcccagctcacgaaactcctttttcctctaggcctccagggcttgatgggaggggctgccttgaagacctctgacatgccctgaagacatttcccccattgtcttggggattaacttttggctttttgttacttatgcaaatttctgcagccgcttgaatttctcctcagaaaatggaattttattttctattgcattgtcaggctgcaaatttttcaaacttttatgctgtttctcttttaaaactgaatgcttttaagagcacccacgtcacctcttgaatgctttgctgcttagaaatttcttccgccagatatcctaaatcatctccctcaagttcaaagttccacaaatctctagggcaggggcaaaatgctatcaatctctttgctaaaacgtaacaagagtcacctttgctccagttcacaacaagttcctcatctccatctgagaccacctcagcctggaccttattgtccatatgactatcagcattttgggcaaagccattcaacactaggaagttccaaactttcccacattttcctgtcttcttctgagccctccaaactgttccaacctctgcctgttacccagttttaaggtcacttccccattttcgggtatcttttcagcagtgccccattctactagtactaatttactaaattagtccgttttcatgctgctgataaggaaatacccaagacagggcaatttacaaaaggaagaggcttaattaggcttacagttccacgtggcttgggaagcctcacaatcatggtggaaggcaaggagaggagcaagtcccgtcttacatggatggcagcaggcaaagagagaatgaggaagatgcaaaagcagaaacccctgataaaaccatcagatcttgtgagacctattcactaccacgagaacagtatgggggaaccgcccccatgattcagttatctattcccgggtccttcctacaacatgtgggaattatgggagtacaattcaagatgagatttgggtgagggcacagccaaaccatatcaccattttaaacagatgaggaaatgaaggcactgagaagttaaataacttgcccatggccccacagcaagtgacagcagagattcagatgtaggtaggctaattgcaaaaccattgttcttaactgttgtgttatgctacctctggaatatcaaatgtatagctttacttgttcagtcattgctggattcagggcccaaacaaggttattgggattctctctcatgttgtattttggctcagtttttctctgggttgattttatcctcaggcaggcattgccggtgaagtgacagtatagctgctgggatgagaactgcatattcataatttagcaatttgtgtggaaagagagaatttattttaacaatacagttctagcaaatgttctagaattgactctcattgggtcagtttgagttttattcctattcctgaaccgtcactgtggcctgagggtagggatgggatagagtggaatattcttattggccagtctgggccatgtgtgtttccatccctggatctgagacgggggaatgaatccttacctccagggaacatcagggtgctaataccagaaatgggaatggatatgggccaggcaaaaacaaatgttcaccacgcttaagatattaggacctcactgggtgcaatggctcacgcctgtaatcccagtactttgggagactgaggcaggcagatcacctgaggttagaagtttgagaccagcctggtcaacatggcaaaaccccatctctactaaaaatacaaaaattagccgggtgtggtggcatgcgcctgtaatcccagctactggggaggctgaggcaggagaattgcttgaacccgggaggcggaggttgcagtgagctgagatcatgccactacactccagcctgggtgacagagcgagactcaatctcaagggaaaaaaaaaaaggatattaggaccgtgctcacccagtaggatctgtctgcttgatttctattttagccttaacatgtcaaatatttttacagaattatgatgaattatgataaattgaaatcacgtctgggtgagattcatgatagcaaaatgcgtctagagcaggatttgaagaaacaagctttggacaaccgagaaatagataaaaaaatgaatagtatcaaacctgacctgatccagctgcgaaagatccgagatcaacaccttgtgtaagtagtctgggagtgtatggggagggagacgttagtgccaggttactaccagcactagagacactagaggtggaagaagagattagagatttgtaattgagaattggccagtaagatggtaagaatttaggaaagtgtccttggtagttgtagggggtaccagagttaatctgaagttaatatgtggagcaaaccagaatgtaggactcttgatccatacaaatgccttggaaatctcagaggctggctgtggcatgagtaaaatgctatatcttaacaagaacagattaatgtttgcctaaaacataaaaatcagaatctttgtttacatactagaactgagtggggaatttctatttcctctgaggggaaataggttctaggctgggcactgtggcttacgcctgtaaccccagcactttgggaggccgaggtaggcagatcatctgaggtccggagttcgagacaccagcctggccaacatagtgaaactccgtttctactaaaaatacaaaattagctgggcgtggtggcacattcttgtaatcccagctactcaggaggctgaggcaggagaatcacttgaaccctggaggcggaggttgcagtgagccgagatcacgccactgcactccagcctgggtgacagagtgagactccatctgggaaaaaaaaaaaaaaaaagatggtgaaaccctgtctgtactaaaaatacaaaaaattagctgggcatagtggtgggcgcctgtaatcccagctacttgggaggctgaggtaggagaatcgcttgaacctgggaggcagaggttgcagtgagccgagatcgtgccactgcactccagcctgggcaacagagtgagtctcaaaaacaacaacaaaaacaaaatgacattctttatttaaataacagaaatgtatctatagaaggcacttgaggtaatttgagtagtgaaacctaattctttagtatgagggaaaactatataatttagccaaatataggcataatagagataatatacaaatataaatggaaagatagtatcagaataaaatgtgtgaattatatttttagaaacataaataactgcttcataggacagaatgcatgagaaaggaagatcctggatattgggcttagttctgggtaacgaatagactgttttgaaatgcatctatgggtgaccttgatgcatgtaacaccactcaattcaaactactggcaggagaagacagagcagagacctctgaatctgggttttccatagacttcagggttctttgtgtgagaaagagggagaggatgaaatatacacctagagattggaactgtggcagaagagtttcagtagaggaagatttaaggtgattttttttttttttttttttttttttgtgaggcggagtctcactgtgtcacccaggctggagtgcaatggcacaatctcagctcccactgcaacctccacctcctgggttcaagtgattatcctacatcagccttccgagtagctgggaatacaggcatgcaccaccatgcccagctaatttttgtatttttagtagagatggggtttcaccatgttgaccaagctggtcttaagctccagaccttaggtgatgtacccaccttggcctcctaaagtactgggattataggcatgagctactgtacccagcctaaggtgatatttcttggggtaaacaattacaactacaccatgctgagtagtttttaataccagctctctcaagagatcattttagtttgctattgtggccaaaagtcaagccaagtgtatatagcatactgaagagctttgtaaacaaggcaaggagggttctcttatctgtaaatggggtgtgtctgctcttggaatgctcacgtggttctggtcacatcatgaagctgaagaaaggctcaaaaaggctatgctatacaccaaaacaatgaatggaagtccttctttgccctgaaaagcaataagaaatacaaggaatataccatcccaaggggcgtgaataagtgtggtgtcttagtctgtttaggctgctataaaaaaaatcataaattgggtagtttgtaaataccagaaatttctcacagttctagaggctaggaagtccgaactcaaggcactggcagatttggtgtctggtgaggggtgaggatctgctttctggttcatagatggcaccttctacctatgtcctggtagaaggagctagggggtctctatcaggcctcttttataagggcactaattccattcatgagggctctgcctttatgacctaatcacctcccaaagtcctcacctcctaataccgtcaccttgagtgttagattttcaacctatgaattttgggaagatactaacattcagactatatagcatgtggcaaaccagaccttggaagtttctttaatgggttgtataaactaaatacagaagacagaaagaaaacaacagcaaaaaaagacaacaaaaaccatacacaccaaaaaaaaccacagaaaacaaaacagtgacaccacaacaacaacaacaaatataagagtttagataacatcatggatgacaaattcataacctacaagtaaggacaactcagaagtgtagggagacacagacagccattacctcttttggaagggctgcttccaggagaatagttcagtgtcccatggtccatgctttgatgtttctaacagagaattgtctctgggcttggtggatttgatctattctaatgctggaatttgtatagtcggtcctgaagaaggctggtagtaaaatacgtgtctcatattagcattgctgcatgatactgagtatgatctctctctggtcttgttttaaaggaatagggtggaattctgtgatacctacctaaagactgtcattagttctttaagccctctttggatgtggtcatttccttgactggccactccatagcccacaaggattctatgtgattgtctgctgagagcttggtgtactactagtaggatattcttgagtgtttaaatacagaatttcattgcttaaatatagaaaaaaaattctaggatattattccatttactggaagctcaagaataggtaaaacctatctatgatgatagaattaaaaatagtgattatttatggtgggggttttgatgggaatatgggatgaggagcctttaagggttctagaaatgttcgaatcttgatatgagtggggttccatgggtttatacataggtagaaatttatcagtacacttaagattaatgtgctttatgtgtattataactcaataaatacattaaaaatttcttaggtatcaattttttaaaaaattccttttcaaaaaaaggaattttgttgttaatatgcaattctttttcctcatgagttaaggctagctttcatgattaccatttaccttttttggtattgtagtcccccttggtccatggttttgcttactgcggttttgctttccgtgttttctggtatccccagtcagccacagtctagataggtgaatacagcacaataagacattttgagagaccacattcacataacttttattccagcatattgttataattgttctattttattcttagttatttattttatttaattttttttttgagatggagtctcactctgtcactcaggctggagtgcagtggcgcgatctcagctcactgcaagctccgcctcccgggttcacgccattctcctgcctcagcctcccgagtagctgggactacaggcgcctgccaccatgcccagctaatttttttatttttttagtagagatggggtttcactgtgttagccaggatggtctcaatctcctgaccttgtgatccgcctgcctcggcctcccaaagtgtattatttgtttttgttaatcccttactatgcttaatttataaattaaatgatcacaggtatgtatgtgtaggaaaaaacagtatatatagggtttagtactgtctgctttcaggcatctatttggttgtcttggaactattccccatggataagcaggggctacagtattcataaaccaaaattcataaatttaaaataataacggccataacaatataggtacataatgatgatgggttttttgatgcatattctgcttagggaattgatgagttttgagtaatatatatataggggagtttgcagataaaggagttagttctatgtggccgggtgcagtggctcacacctgtaatcccagcactttgggaggctgaggcaggtggatcacctgaggtcaggagttcgagaccagcctggccaacatggtgaaaccctgtctctattaaaaatacaaaaattagtcaggcatggtggcgcatgcctgtaatcccagctagtgggaagcctgaggcaggagaattgcttgaacccgggaggtggaggttgcagtgagctgagatcgccccactgcactctagcctgggcaacagaatgagactctgtattaaaaaaaaaagaaaaaaaagttctgtggagggtgctgtgttctggttttattttttgcttttacaactttattgagatacagtttacgtcgcatacagttcacccatttaaagtgtattattcaatgtttttagtatgttcacaggtattttgtcatcaccacatattttagaacattttcatcaccttaaaaaaaaccctgcactgtttacttaacatccctatcacctctttcatttagccctaaacaaccgctaatccactttctgtgtctatggatttgtctattctggacatttcatatgaatgaaaataatgtaaaatgtactcttttgtgactggcttctttcacttagcatggtgttttcaaagtttgtctgcgtatgtcagtatttcattcctttttatggccaaataatagtctgttgtatagttataccacattttgtttaatcatcatcagttggtggacatttgggttgtttctgtctttttggctatttcagtaatgctgctgtgaacatttatgtacaggtttttggatggatgtgtattttcatttttcatgggtatatgctgaggagtgaaattcctggatcatatggtaattatcattgtgtagtggttgcactattttacattcacaccagtagtgataattggggtttcttaaagtaatgaatcattctttaatacatttcttttctttttttgagacagattttcgctcttgttgcccaagctggagtgcaatggtgcaatcttggctcactgcaacctctgcctcctgggttcaagcaattctcttgcctcagcctcctgagtagctgggattataggcgcataccaccacctccagctaatttttgtatttttagtagagatggggtttcaccatgttggccaggctggtctcgaactcctgacctcaggtgatccacctccctcagcctcccaaagtgctgggattacaggcatgagccaccgcacctggcttcattctttaatatatttctgataactaaatttttataagtgatttttctttttaaagtattgtatatgttatcccactttgtttttatgtagagaatatgtctgtccataaaatttggtggaagacaagtttcattcctcatttttttttttttttttttgagacagagtttcactcttgttgcccaagctggagtgcaatggcacgatctcggctcactgcaacctctgcctcccaggttcaagcacttctcctgcatcagcctcccaagtagctgggattacaggcgtgcgccaccatgcctggctaattttttgtatttttagtaggaacggggtttcaccatgttagccagcctggtctcgaactcctgatctcaggtgatcctcctgccttggcctcccaaagtgctgggattacaggcatgaaccactgcgtccagctccattcctcatttttttttttaattaaatttattccaagctcccactggcctggttacattaaaaatatttgatctctgttatcattcatacctcctacacagactgacacttggatcatgtaagaatgtcatcctgaagtagtgccagaaaattagaggagcacaaagtcctttgtgcctccctcttgactgctgtcattgggtgctcctctgcctaatcattgggtcttgccatctggctattttagaaaattccaaggtgtccttcacagtaatctcatcactggctaccaacagatgctgcatcttaaaacctcattctccatccaggatgccctgtgcctgaggcaccgttttctgtcaccccgttttctacttcagccaggctctaagcttctgctttcttccaggacgaaggcgtcagcttcaaagtcgtttctcctgtccttctctctcaggggcttcccagcttaatccttttgtcttagactgaaacacaaactctcttcttaaagtgtggtagttgggctgtaaaaccaattagatctttagaaaggacactatatgatacatattttttcccttacttgctggggtagggctaggaaaagatatgctaacaccagctatttttaatctatggaagtagtattttcctttttttttttttttaagaagagattgctgggccaaagagagatgggtccaagaccatgccaaaaaatatgtatatatagtatcttttctaaaaatctaattggttttacaacccaattaccacaccaacagaatcagagctggatgttaggtctttgaatgttttgcctcagatttttcctgtagaatttattgcatctatttgtgatcagtgcatgattcgataacattaaatgtgaattaacgtatttactaaagctatttgaggtttttgaaaatggtttttaaaatctaatcaactcctggcattgttaatacgtttgtaaggactcagaactagataagtctttgaaatggacttttaggagattggaaaagttgcctaagtcagaaggtaggcaccatcataaatggagggtggagcaaaagcaatttttctttttcttttttttttcaattaggaaagtgttaggaaatgagttcctaacattgtgtgtggcagaaagggaggctcagtttaaagaggttggtggttaaaagaaaatggggattcaagagaaaatgtggtgcattcattcaactcacacttttttacccagtgtgcatatttctttgataaagagaaggtcagtttctttaaggatagaaaactttgggtgataagaatgcttagaggagggcatctggatattttgatgacagacgcgatggtgtgggggagggggtttgttactaaatcagttgtatcaagatcacatattatctattttccagttttgctaagaataaaaaatgaaatccaagttaactaaagggcaattcttactgagaaagactgtgaaatctgtctaacagaactttaaaattaggtgtgatgccaagttatcttgtatacttggggagatacaggatgatcctggagttgtgaagattttgttaaaagcagcccaccagcaaatatttactgacaattgaatgtctatgtgcatgtgctgttttaataattggcaacatagccatgaacaggacagaccactttcattacagcagcttacattttattggggagacagacataaacaaatacaaatataaaataggcctggcacggtggctcatgcctgtaatcccagcactttgggaggccaagatgggcggatcacctgaggccaggagttcaagaccagcctgaccaacatggtgaaaccctgtctgtactaaaaatacgaaaattagctgggcatggtggcgcgtgactgtagtcccagctaccctggaggcagaggtgagagaattgcttgaaccctggagatggaggttgcagtgagccgagattgtgccattgcattccagcctaggtgacagagtgagagtccgtctcaaaaaaaccccaaccaaccaaccaaacaaacaaaaatataaaataatggattttagctaagtgctatgaagatgataaaacaaggtaaagtgtagagagtgactggggactgccttagttgggacagttaggatagtcctccctgaggggatggtgttgatgatgaaacctgaatgataggagccttgcttggtgggtaatgatgaacgaagatgctttccactccactctagttttagactattggccatctgaaaggaacaaagtgtgctggtttacctcattttacatctaaaatactagcacattttaagatactatgattttttcttttctttctttctttctttcttttttttttttttgagatggagtctcgttctgtcgcccacactggagggcagtggtacaatctcagctcactacagcctccaccccctggtttcaagcaattctcctgccgcagcctccctagtagctgggattacaggcatgcactaccacacttggctaatttttgtatttttagtagaaacggggtttcactatgttggccaggctggtctcaaactgctgaccgcaggtgatccacctgccttggcctcccaaagtgctgggattacaggcatgagccaccgcgcccggcttggatactatgattttcttggtaatgaagttcactcatattaattactcagattgccaccctgaatttcttgtggcctgcttaaatgcaaaaatagatcttgaagtttttagttaaaatattaaactcaattcagtaggtcacacaggaagtgtgtcctcaggcttagtggagattgcaaatgtgacaccatgctaacctaatgttttcagaaacaaatgtcccactgtgagtgcgagtatgtgtgtgcttgtggtggcacatcctccagaaaagaaaaatgaaaagtgaagggcctaatttcaagtagccctctatgtttctgcctttttctggaaaagatcagttcatcttgatagtagttgaaagaaaagtaatcgagagactaattttgggaaatctttgcccattctgtgggattaggaaaaacaagaggtgtctagactctagaagtttagttggctcagacatacctactttgtccagtcagagtttgcatggatactgacactggtgtctttcctctggcagatggctcaatcacaaaggagtgagacagaaacgcctgaatgtctggctgggaattaagaatgaggatgctgatgagtaagttctctctatacctttctgtcagagggctttgttatcaatataagacatgcgccttgtttatacgtggtaaatattggttgtcattgtcacttgaggacattgaatctagaactttgactatcttttgaattgaattgcctgaaggtaccctataggcactggagttcagagacctgcttctgaactcaaaatctggatgtgtaagctactttgagtatagctacccaaaatctggctgtaaaagcacttttattcagatgttcatatttcagcttattggatgaaacatgaattctttgctttatgcaccatagcaagtaatgaagttaacacccaaataattgcaattttgctttgttatttgtggtttaaagatttagaagagtgttttatttatgaatttgcttttagatagaagtaacttgttagaataatatactaatatttaatttttaggaactattttatcaatgaggaagatgaaaacctgccccattatgatgagaaaacctggtttgttgaggatatcaatcgagtacaagcagaggacttgctttatgggaaacctgatggtgcattcttaattcgtgagagtagcaagaaaggatgctatgcttgctctgtggtgtaagtcttctctggggatataaccttttgaaatcttttgcatcaattattataaaatcaacccctcataaaattcagatgaaattagttaatgtacagtaacgaggacccatggctcggaccataactattagtacaaaaaaacccagctttatgagaaatgatatctgaaattatcttggagttttaatttacgtggtaagtagattaggccccgcagtattgctgttggatttcaggtgtctgtgaaaggtaatgtgagatcttaaattgaaaaaaaaaaaaaaaaaaaaaaaaaaagcacttaattgtttagtagtatcctatatgtctagtatggtctccagtgtcagattaggaaaagcttgattaaatagaactgtttttacttcagaaggaaaactctatctaaaattttaaattacatattattctgttgatgtagtgacaggaaatgtgggcgtgttttccataagataatcgtgacttttttgagaaaagcctattttccttttaatggaaagtgaaattttggggataactaactgtgcttcagtcagatttttgcctgagtgtggaatatattctttaagaaggcaaacatcttcactgacaaaagccacacttagaaaagagttatgatggtgccagatatactgggttcagctcctggctctactgcttactagctgggtaactttgggtaaattacttaatctttctttgcccagtttccttatctgtaaaataaggataatacctactttagggtttttgtgaggattaaatgagttaatctgtgtaatacaatatgcttttaacagtgcagggacataagaagtaaatgtcacctactaatatgatgatgatgctactgatggatgtggcagaagtcaaacaaagtgacaaaatgattgtgcccttagagggcaaggtggagaaggtagacgaaaggcattcatattaacagactgctcagtgctttatgtgatcatcttgttcatagtgctctacttgtaccatggagtcagagtttgaatccaagtttacctggtttcaaaacccacatttttctattgcaccaggcttttttcatttcaccaaatatccacaatgaatagaaccactgtgaaataagtattattagtaggctgtgcacatgtggaagcattaattttagtggagaaagagcggattgggaggttttgtggaaaaggtatctgagatggacctcaaaaagatgaatgggatgtcttatgggcagaaaatgggggaggagttgaaaagtgcattggattactgttatccaaggatagaactacttgcaacatttcatttctccttgacttgggctgttgaagttatctgagtggaaatgtaggcgagaatggttcttgtaagacttaggatcttctaagaataataaaaagaaggaaggcagtaagcccagtcgctcactgtcactcaggttattgggtggcagcctgtaggttcaggacttggctgcagtccttacataaactgattaatcaaaaactacccttggctgggcgtggtggctcacacctgtaatcccagcattttaataggctaaggcaggaggattccttgagcccaggagttcacgaccagcctgggcaacatagcaagaccccatttctactaaaaataaaaaagtagctgggcatgtggctcacacctgtagtcccggctacttgggaagctgtggtgggaggatcacttgagcccaggagttcaaggctgcagtgagctgtaatcaagccactgtaccctagctttcgtgatagagcgagaccctgtctaaaaaaaaaaaaagaaataaataaacccttacatttgtggttgttttaacacccgtatctgtggccaagtctgtagggaatgggaacgcaatttcacaagctttgcctggttaacaaaaaacacttgtttgcataacaattgctctcagacttctggccatttagtgtccttttatctattgttacctaccttaacatttcttctgtggtttgtcattgcagggccgatggggaagtgaagcactgtgtgatctacagcactgctcggggctatggctttgcagagccctacaacctgtacagctctctgaaggagctagtgctccattaccagcagacatccttggttcagcacaacgactccctcaacgtcaggcttgcctaccctgttcatgcacagatgccctcgctttgcagataaagaggaagtgggaagagaggtggttctctggcatttttttctacagtttttattagactacgatgagggcattctttctacatagactgcttgttttgcacaagaagtgattttgtgaatgtgaagtggagaggccgagcagcagccggccgggatgggggcattagaggcctgaggttctctaggactcagccatgccgctgcactgacatactaagctggaagcagatgttttttttgaaagtctgtttcattggggtttttgttttgtttagccagacaccctcaacagaatattaggcttgatggttatagcgggtggggttgtatttggaagcctctgaagagaccatgtctttttaaaatctaactcttgagagtgcagcaggggcatggctctgctgggagttgtgttttgctttggcagtctctcttccccccacgaagaaggctgtttaggttttgtgatagaatgggatttgatgaaaaagacaaccaaaggaaaatggggaggcttgggatttcatttaaataatctaagccaagatgataaaaaaaaccttcaactgaaggtactttgtttcttaccaacataatttaggcttcagcatctcaccagcccctccctctgaagaagtattatgttcagaagccaacaaaacagtttgttgccagaccaatgtttgatgggaaaacgtggcactcatagttgaatgtatacttctgtaccaaaacttgaacataaaaagactagaatttgtgagttttagcaaacgctaaaattgatcactgtaactaaccccttctgtccttcctgcctgtttctctgagatgaggaatagcattctttttgtggggatggtgagctttgaatcataaaatgaagttggtgcttgtatggtgtttccttagcctaaagaatgatctgttgtttgaaacctttgtaacttgtttgtatgagtaaagaaaaggtgcaatgcagtgcttttagatggcttgatataccaaataacaatatagaacaacattattatatgtgcttccccaagtttaaaggccctgcagaaatagtaaacatggtttaatttcccttcatttccccctcctttgctggatggggttttgggagctataggttgctaaggaggggagtcagattgtggtcaggtgcctcagtaaatcacagacccaggggccctgtggtccagggtgagagtcacaccacattacacatgtgcttccatacagtggtttctgaagcttttgcagggagagaagatggcttagtgtttagactgttagtagaagccatctggaagcttttctctttgcctttttttgtgatcctgccattaaggctatgtgcagtctgccctcctgctccagtggccttgattttaggccaggaatcttctgctccatgtggcttaagccttccagctgagtgaagctaggcaaatggagtgggggcaggcatctattcctgcccccatcatgccccacacccatcagtcaacactcatttgacaaatagagtccagctgcctctgagccaatcctgggaccataataggctcagagtgagtcagctgtttgaacccaaagctgtgcagtcaggcaccctggctgagctagagaagccagtacctgcatcttggtttataaggcttacagctaggaaagctctagttctgggggtgaaagaaaaatattagtttacctgagcacttatttccatgacagggtctaaaatatggaccatgatgtagacacagatttttaattttggaaaaacctccagttactagtgacgaggatagaaagggaagtgcttctctttggctttttcttggttacactgcagtttcaggattgggtgagacagagacaaatgaacccccctctaaagtcatttaactaatagccagcacatcccttccccaaactgtcaattgaaatcttaactgaaagttttactgaataataccaagctaattgctgttgggcacacctggatggctttgcacctggtgttgaacctgctgaagcaggtggatgctcaagattacgtgcaaggaatccctcccatctggtactaaaatttcagtgtgttctgagtgtcttttaaaccaaaatggaaatacagatacagggctgtagtattcagtaatgtgtctgctccttgttgggcagacaccagcggtgtgcagggagagaccaagtaccatctttatctacacttgggctggcttgtggagaagggctgctttttttcagtcctacattccttcattttttttttcattcttgaattcattgttttgtgggatctaagacccaggggtcatttgagaggtttgacagtatcttttctgaccagttgccacatgacttgcttgaccctgagcctgtggaaatggcatagggaccagtctactacccactgggcctggtgtgtagagggggagagggtagcaaggtgcttctctacgcccatgacttgggagcaggtcttggcctccttcatgagagtctagtgccatgtcctgtcccatgatctggaccctgggactgtcttggcatcttaactgcagtttcaatgaggcagagggcaaagagagaccaagatcagaggggttcattatacccctggctagagaacccagctactgacatgcaagcagcttggggctggctggacacaggtactaggcccattgtttccaggtgaagctttcatcacagaacagtgttgtctccacctggccttagatggcacgccatgattcgggcctggatagactgcctgcgtccttaccactgatctggccaagaatgaggccctcccaacactttcactccctctccaagccttgatgggacctccacttatttaggcctcatgtgctttgaagaagctttgagagccaatgtgtcttccacgggtctcttttttgctacaagtaatcagccccatgtgttctcttaaactgagaattgcacctgggcaattcctgttttctaaggtggtctctgctgctatttaacaacccagagtaggcctctgtgaggcttcagtggcctcagaaaccagagggtccagatagggggcctgcttgggccctctgctgccaactgctcaaacctgctttagctccagccacttgtggcaaacaacctcgtttccttacaaattccagcatgtgactttggtgccgttacttgtgaaaaatctattctgttgtctttgatgtgtccaagaaaattcgtgtagtttacgtaaaaatatctgactcacaagaaagccaactgtatgtcttgtgatgggacagttcataatgtagttgctagaccactttacaaattgttcttgtcaccagatgtgttcagacattgctgtgcaattgttggggagggtagggggaaaggcgagaggagatacttattggtctttttgtttaataccttccccaagaggggacagtctggccaacttgctccagtaatgcaataaagacattgcaataaagtaattttttgtcttcatgctatgaagggggtgggctgggg

SEQ ID NO: 12265 - DNA, 43018 bp, Human
tacggttattaaacctgtccttttatatatgtcgcaaatattttccttctttgtatttcctttactttgtatctttttcttttttgagacagggtctggctctgtctcccaggttggagtacagtggcacagacacggctcactgcgacctcaatctcccaaggctcaagcaatccaccttcctcagcctcctgagtagttgggactacaggcacatgccaccatgccctactaatttttaaatttttatttagtagtgacggggtctggctaagttgcccaggctgttcttcaacttttgagatcaagagatcctcttgcttctgccttccaaagttttgggattacaggcatgagccactgcatctggccatgctactttgtatctttttaaacatgtagatgttttcaaagaatttctagacctctctggctttgacattttttgtctcttaattgtattataaacacctagggatgtgattccatagtttacgtcctcctacacaggattaaggaggcagctgcttcttgggttttagcatatacaagtttcttcaaggtcttaaaggaaaaaaagtacttgttaggagggctacatgtcactgggcaacaggaacttttcagcttcattataatcctatagcaccaccgctgtatatgtggtcctataagattataatggagctgaaaagtgctagcgagcttcttaactgggataaaagtttgtttgtaaacgtatgtaaatgtatttacatgtgctagcccagggtcaacctaaaaggtagcgaaagtgtttagcccagaagtctacatagaaactagggttgtctacctccataccaccctgaatgtcccccgatctcggaagctaagcagggtcaggcctggttagtacttggatgggacaatagggctaaggtgagtagatttaatgctccaggataacgacctttaccgacaggtcattgtgtggcacgtggctgtatgtagttattaaaatgtaaatacatatatttacaaacaaactttttttcccagttaagaagctcgctagcacacagcattctgttgaaagccccctttatttcgcagtcctgaagggagtgagggaaggaagtaaaagggcagaggaaataatgaatgaatgcgagacgccgattgtacagggacttgtttccatactgctctctaccagaaacgttctcagtttccttccttctgctggacatgttccaagggccaaaacctcaaataatgtgactttgtagattggagagtgtgtgaccacagaaaggaaagggaggcagcacgtgccagccggcgacagaatgttaagtctgcagcatactccaccgcaatgaaacaaataatttgtgtatttcctccccttccttcgcccagagccactgtgagaatgggctacagaaagtttcgaggcagtaaagccagttgttcacccagaacatctgactgccataaaaattatggtgacgagaaagaacgtttgctcaaatgccggggtcgggttgagggctggagaaaggtcccaccccgcagcatctacctcccgggctcctcaccatgtgcatcgcctcctccatccacttttcggtctcctctgccgacaccgagcacgcgccgcttgcagctggcttgggtgccgccttcgcctccatacccagccaccactcagctacagagcccgcggcagaggaggagcgcgggcagcggaacgcggcgggcccgggaccccgtttccgggggtagtctaatgaaaaggcactcgggagctatttctgaacggacctgggcttgtcggaccagtgagcggcggcggctgcgcggcggcagcggcagaaagcgtagctgctttgctgtagtccacgcccccttgccgctccggtgacagtctctgcggaaagtcacgtttgtgatttcgggagagcacagaacgggacgacggcgctcttgctgggtcatctgggccaggtgacgaagaaacagtttcctggtgaagcagtccctcacccctagtcagcccacacccctagggcctaaagatgctgaggtctgtatggaattttctgaaacgccacaaaaagaaatgcatcttcctgggcacggtccttggaggtgggtgacaacgtgcttgaaagggggcattgggagaagggggtgggagaggtgacttcttctaaaataaggacaggccgggcgatcctagtctgggatatgtagagggagttcgatcaaccatgggatgaaaagggaggtggccaacctccagggttctcccatctctgcagttgagaaatgcctctgtgccctttgccctgtcaccgactcttaactctgtttctcacctatccttttttctcacggacctttggagaactcatcacagtttaagtttctgtttcaaggcaccattctcttacaggaactttttaaaaaaaattctgctttcctgtgagattctgcatttctccttggcactcttgatactttggctctcacccttctcaggagtttaataataatctagggaagttacctataggctgcacttcgggtggtggttaaagtcgatttgaatttttgaaaacagcgcagttgtcctaaaggactgaaagatatggattagataaagaaaaacaaatcaatattttagctctgtttctgccattttagaatacaaactatggcagtaagaaaaatgcttgagggatgttgtgcaatcttcctcaggatcttcaaggttgggatcattgtaatctagctgacataactgagttgcacaggcccagaggagatttagaaacagataagataaaaatcttgagacgcttttccctcatacaatgctcatgtgataatattcagggatttgaaggagggaataaaagttttgtgaattatatgaaaaggacatctaggaactataaaagaggaaatttgttagaacttgagtttttgagaaatagtctcatcacttattacatgctatgtttacaaaagtacttaaaatcaagaacagagtttcccaaagaatttggttggcttttctcttagtattagattgtattctgttctccccaaacaatttgaaattaacagtacgtattagattgtattctgttctccccaaacaatttgcaattaatacctttagcatcaatagttcagattttggtgatgcttgaaagtttgaaacagagttcttgttgctgagccaaggatggtgttttgcatgtctctgaggtctatcacacatcaataataagcatatgtaaattttgaacaccttcgagaaatcctttatatataaaaggtattttctgatatcttcagtcgctagtatctaatgtatatttaaattatcctaagactacagagtccattttatttataaaagctaaaaatatatgtgtgattgaagaaatacaaataaagtatttttgcgtttactgaaggaaggaaaattatctctttagcgatctcagaaggaatactccttcagcttatggaacaactttgtagtagattagaaataatcacaggggaagcaaaagagtatacttaaacttataatttttttaaaaaactaacaagagctttatagttacagaataagaggaatgcaaaaaatagaaaagttcagacggccagaaagagaaaataatcctagtgttttatatcaaaaaaggagtcagtctgaaaagaaaggaagagtagatgaccgtggttggcatttgtttgagtctcatgttctttctgcttcagggagaaagttctacagtgtgttagattttaattagtctaacttaagaaatacctatcaagtgcctgtaatgctgaaggtaatataaatggaaatacaagatttatatatttttaatagtaacagctactatttattgggtgcccactttacgctgggcattgtgctaagctcttcctatttaagcagaatgacaagaagacaattattattatccccattcaaaaatgtggcagcaagaaccctaagaatttaagaaacttgcctcaggtctcagaattagtgaaggggaactggaattcaaacccaggtgtgttggaccacaaagcacattctatttccatattatatcactgtgctttcatggcctttatagtctgataggaaggaaaagcaagtatacatgtaattaagatacagaaaaacaagagaggtgaaaaaatgctgtacagatcacactggcaagtagcatatgcagttgtgaaaaatcaggaagaatttcatggaagaagagacacattttgacaggcttgaaagctgggtagtatatcaacaggcatgcgcagagaagtttgggcattcaatagtgggggaagtaagtaagtaaaaccttgagtagcaggccttcttaagtaacaatttctgtttcctcagattttgggtgggtaactaattggtttacgcgtttgtataatttgaccagtttggggggtttgggtgtgttcgggttttgtgtttttttgtttttttgtttttcagacaggatcttgctctgttacccacgctagaatacaatggtgtgatcgtagctcactgcagccttgttttctcctttgctagctttacaatgtaaggcaagtagaaaggcttccttatgaagatttgcctgacatcttcacactttcctcactcatgcgatcctctcacctcagcctcccaagtagctaggaccacaggtgtgcaccatcatgcttggctaatttttaattattttgtagagacaggggtctcactacattgctcagactggtcttgaactcctggcctcaagcaatcgtcctgcctcagcctcctaaagtgctggaattacaggcatgagccactgagcctggcataatttgaccagtttgtgaaaagactagagaattgactcccaaactttttgatctaaggtctcctttacactctgaaaaattaaggaccctcaaaagctttctaaattttatatctattaatagttatgatattcaaaattaaaatgaaattttttaaaatattaattcattttaaaataataaacctattacatattaacatacataacattttcaaaaaattaatgagtgtcattgttttacattttgcaaatctttttaatgtttggcttaattgaagaaagctggattctcatctctttctatattctgtcagttgtggtatcacacatcatgtaacctctcaattactccactgtatacgcatgagagaatgagaatgaaaaaggcaaataacattttagtattattacgaaaacagttttgattttatagactccctgaaatggtcttaaagaccccaggggtgcccatgccacactttgagaaccattgcactggaaaaagttttggagaacagagagcaaccagattgatatttattgacttactggtttctgaaaacctcagaacattgacttggatttataccttaaatcctgtaatctctggcttcacattttttattcattcattcattcattctgtcattgaacaaacatttgaatgagagtaagtgactgatctcactgtactttactctggaaatacaaaggaataagacagatcctgactttgaactcatggtacagaaatggaaataaaagtagtatgatagtatagtacaaaaatagagcagggtgttgtgggagcattgatgagaagaaagtgtgaagatgtcaggcaaagctccataaggaagaatttctgcttaagttgtagagctagcaaaggagaaaggacacagaaggaaaaagagcaattcaagaggttcagcaacattgctttttatgaatgaaactgtatttcactatggctatgcaaatgagaagtggcaaaagattaacttggaaaagtagctagagtacagattgtgaagggccttatgaagccattctacataatttggacattatcctttgtattggtgcttgctagagtttactatggataaaaaaatcacttagggagcttaataaaacataggatcctttattccagattctgattctttaggtttagagtgcagttcaagaattccttaattcagcaaatatttattgcgttctgagtcccagtcagagtttatgtactggggatgcagcatcatgcaagataagacatttgggggtattttcttttcttttcttttcttttcttttttcttttgagacggagtcttgctctgtcgcccaggctcgagtgcagtggctcgatctcggctcacggcaagctccgcctcctgggttcacgccattctcctgcctcagcctcttgagtagctgggactgcaggcgcccgccaccacgcccggctaatttttttttttttttttttttttttttttgtatttttagtagagacggggtttcaccatgttagctaggatggtctcgatttcctgacctcgtgatccgcccacctcggcctcccaaagtgctgggattacaggcatgagccaccgcgccctgcccatttaggggtattttcaaggagtgtctttaaaggctacatttttaattgtcccaagtgattctaatgtaagtggaacagggaaaccacattaagaaatgatggcaagatgttgaaggattctaaaaacatgagtgatatgagatttatgttttagaaaatcactttgcatatataagataggttaaacaggtgtgtgaccagaaagtgaagagttagggacctattgaaccagttcaagagcattaatttttagagtctaagtggtgacagtgataaagaagttgtagataattggcaagatttagaaaatgtgtctgaaatagaatcagaatactgtagtaggattttgtgatctgttggattgggaacaataggttattttcaaactttttttgaaattattaaccttgtgaaatagttgcattgtagggattttcatccagaaagagaagactaagagatggttttaaaacaactgaattgtggaaagactagaagtcttattttctagtaatgttattaatggaaaactcaaagcatttgacatttattttttaaggtatttagtaaatattttcattgttaatacataaagtcatagctacaaaagaaacattaaagctcatataatcccagtctttcatattgaggatgaagaaatttagacacagagggaggaagggactttctcaaaagtcacataactacttgataccagagccgtcaatatctcctgttttccaggctaggctgccagtcgagtatatagatagtcatgagctccatgttttagctaatgaattacctgtcctcattcttatttttctaagggaacaaatctgacaaaatcagaatttatgagcctggatgaattagaccttgtataagaacttagttcagtgctaaaatcaagaaaaataatggattgtgtgattttagcctgatttccaagtaccacaaaatgggcggcttaagcagcagaaatgtattatcttacaatcctgaaatttagaagtctaagatcaggattggttccttctgcagagtgtaagggaaagatctattccaaccctctcaccatggctcatagataggcatctcctctgtttttgctttgtcttccctctgcaattgtcgatgtccaagtttccttttataaggacaagtcttattgaattaggacccaccctaatgacctcattttaacttgattaccactgtaaagattctatttccaaataaggtcacattctgaggtgttggggctcccatggcaattcattttcttttttagtttagttagaatatcaaagtgtggctaactaactactctgtaatgttcacattctgatttcacgttcaggaaaatttcgcactcaggaaaactgacttcccctcagatatagaccaaatgtacacacttatatcatactgcctatgctgaaatgtgttaaatagcagttcctaaaaaaaatcatcagatttgttgagactctgattaaagcagtggaccttctccccagagaaacacaccaatcaaatttactattgttaaagaaaaaaattcttagctgtgcaaaaagtgtcatcttagtgttgattttacagtataatttgagaaataatcattttacatgtaactttcagtaagctgttgtgcaaataagatacaaacaattccttcagatctattatgtcagaattgcctgtcatagagtaactttgtgaaatgtaagtcagtttcctttgttggtattgtagcactatcatcagtttctttagaatggagtacaggaaaggtagccatgtagccacttatatgaactctcatttcttctttaagcttggttataatacattaattgcatataaacatagcaacagcaatcatactgtagttctaattgtttttagcacatacccttttactgaactactatttttaagaatatgtaatatcttatcagttcacctatagcacctgtattagtgaaaataattcaggatatgtatttgttttgcagttgctagagggctacccactttctacctgtgacagaccaaatctaattacttaggtcatgcacaattcttaggttatgtttagtagatactgggggtcacagacagtgggaggtaggtgagcattagttaattccttacagccttgctctcaggttataatgaaaccaagttctggcacacttaaaaacatctactggcaaacagagattaaaagtaacacaacctgttctgtaagcttattgaagtcccagtgttctgcccttgtttcatgctaccgcagaactgcttataaaagatttacctgaagaaaatgcaacaatattctagctgtaggatttggttggctacctggttaactcagttgactaagaatcctttgaactagcggctaaggatcccaggcaaaggtgaaggacttgcttgatttgtatattctagttcatatgaatattactaaaatgttttagctagtccagtatcttgaaaaccattaatctatgaaaatccattcctgataatcattatgctaatcaaaaatatttggtgctaaatcagtgataaaagctagttgaagagcttaagctttggaatgtggcttttgatcaagtgtggctaactaaccactctggaatgttcacattcccagctaggaaaactgactgcccctcagatatagactaaaatgtacacatatatatcatactgcctatgctgaaatctgttaaatcacaggccacatgacaccacctatattcttatcctgtggtgttagaatttaggagtttctgtaccctcttccctcttttttttccagttaagttactaatttttagatgagagagttgtattttctctccttatctcaaagagatttttctaacacatggatggataaatagacttctgcctgactaactacctttctttcattgttccttttaaaatttttatcttatagttttaaaaagcattttgtgttcattgaagaaaatatagaggacaaaatgacctgttatcccaccattcagcaatgatcattgtttgttatattttagaaattaaaactcacctattttttgtatctgtttccattaaaaaaagtaacatttctgggatcttattttatcacctaacagtataacatggatatttccttgagtcattatttagcaatgtggtttttaataactacataagatttcgttgtatggctagactatcatttatttaaacaattctccattgctggacatgtagaatatctctagtctactagtaaaggcactgccagactttttagatttaattcctttcccttcctcaaacctggtccttatgtgcccatcatttcctctgtcattggctgtaaaaatgctaatttccttttctttgggccaatcttacaaaattctttatttaggttttaaaaatgtaattttagctatccactaatataaaacttataattgcataaagtaggttaaaaatactgtgtagaatttttggtactctaatgaatatagtacttttttaatgattgtaggagtatatattctggggaaatatggacagaagaaaatcagagaaatacaggaaagggaggctgcagaatacattgcccaagcacgacgacaatatcattttgaaagtaaccagaggacttgcaatatgacaggtaagacagagaaatatttatacatgtgtaaagttgtttgacggttgtattaatttgcatatcaccgggatcaaatttagaggaaaaggcaaagaaaagatggtaaatctagcaagtgtttgaatgatttaactgaattacatcattttaatgtgaattttaaaaatcagttcattcattttatttattcatttagcaaatacttgtatccaggcctggggaagcaggaagtgaacaacaacaacaaaaagcccctgacctttggagtttatattctagggagaggaaaagatgataaacaacaaataagtaactttaggcagtgatggctgccatatggaacataaagccatgtgagggctggaacgttctttaagacaggggatcagtagagtcaggtttctttgaggtaacatttgagcagaaaccaaatgttacaatggagggagccatgtgaaatgcctgaggcgggaacaagcttggtactctcaggacacagcaaaaaggccatgtagctagagcagaatgaacaatggcagtgataggaaacaaggctgcagaagtaggcttgatcccatcgggcctgtgggccataggaaagagtcattaagtttattaaatttacagtaggcaactatagacctgtgagtcgtccacaatagtatacactcaggcaatgttaattaatggcaataatttaacctccagagctagaaacatagtcctgggagaatgccatcacaaaatcaacctgcccatatttgaagagaacagtgtgtcctaactggcataactgaagaattagttctcaaatccatgcaaagcctgtttttcttttctattgtttaaagcttactcatttctctaacattctttcaagaacaattaatttagaaacaatttataaaggtacattctccttatttaattttaaaattagaaattttttagagttaaaggcctttattattagtttacttacctcattttacttgaggctgagattaagaagggtaagaggcacatccaaaattacaattggagtatgatttttaatatttgaagtagtaatactcagaaaaataccttcattctgcaaagcgaatagtaatcataaatactatacataatgacaattctgagagtaaaatgaacattataaaagccacttcataaatgttttgtgaggccgtgatgagataatgcctatacagtgcttgatgtatgataaatacttggtaaatgataactttttaaatttacatttagcattcaatatattggcactgcctaggacattttaatgaatttttagggaatggtccatttctgcttattatttgaattttcaaaaaataataaaatgggccaggcatggtggctcacgcctgtaatcccagcactttgggaggccgaggctggtggatcacctgaggttaggaatttgagaccagcctgaccaacgtggagaaaccccatctccactaaaaatacaaaattagccgggcgtggtgttgcatgcctgtaatcccaactacttgggaggctgaggcaggagaatcacttgaacctgttaggtggaggttgcggtgagctgacatcacaccattgcactccagcctgggcaacaagagtgaaactctgtctcaaaaaaaaaaaaaaaaaaaagtaaaatgtagctgctggggtcttaaaatacatcgcagtttgacatggacccttgtgtcagtttgggtcccctgggaagcagatgctaggatgggattagatgtacaagagatctactagtagaaatgcctgtaaaggataaaggggaagggaggcagaagaaggcaagcgaagcatttaggccacagtgcaggtctgacatttgtgaagggaaaaagacaaggaaggaagaaagattaggcaagaagagtctcagactacagcacagttctaagaaagcattgggagaccatgaagagtctgcaagccaaagtttctggtagaggagacctgcagaaatgggcctgctttactgtgcccatacaagcagtgtcattggctgggagcagtgcaaacatggtgatggatccagagcagtggcagatggggttgtcaattatgtatgctcctccagcaaaagataggggtcacacgtttccatgatgcaaccctaagatgaacaaatagctgactataggcaattaaaagtaaaatatttaatctctaagagccaaaatataggttcagtgaaactttccaaattagctttctgcacattctgcattttttgtacaattcataacatgagcaatgataatggtgttacaaataatatcaaatttctattcctttggataagatgtaattgatatactagaaaaaaaaaaaagagtgctttggggtaaatataagtagttttcttacccaagaagttttcccttttagaatgtggtgttcatagccaggtgtggtggctcacacctgtaatcccagcactttgggaggcaaaggtgggaggattgctagagcccaggagttcaagacaagcttgagcaacatagtgagacctcatctgtacaaaaaatttaaaacattagctggtcatggaggcccacgcctctagtcctaactactcgggaatctgaggcaggaggatcgcttgagcccaggaggtcaaggctgcagtgagccgtgattgcaccactgcactccagcctgggtgacagtgtgagattctgtctcaaaaagaaaaggaatgtggtggtcttcatattttttcattttgttatcgttacttttttagggtttagagactcattttacatttttatatgtgtattcctccatttctttttttctctaatcccatgacagattcttattctccagcatttcttattccacatgtagagccataaataaactcctaaaaatcacatgaagtttttttcccatagattgctagtctcatttcatcttcacattattcctgggagtaagaaacaataacaaacaacagccactgacaaaactaaaactaaaactcagcaacttttagtttctaacccagtgcacttttatttatgttataataaatgtttattgctttgtagtattacaaacagtaaacatgtacaataaacagtaacaaataatacccactgacaaaactaaaactcagcaactcttagttcctaacccagtgcacttttgtctaggttataataaatgtttattactttgtagtatttaataaactttttaaaaattagaatgaaaaatgaaggaaaaagtatagctgaatataaaaatgcttttgatcattgtcattaaatcagaagtaaacacttttgtaaaaaatttggagagtatggaaaagaaaaaaaaggaattgttcataatccatagctcaaagaccaccactgttaaaatctgagaataattctttctattgtttcttctgtgtgtacttgtgttgctgtgatcataatgtttatataattttgttaaattacataagcagataaatgatttgttaggatataatcgttttataataataataataatttgaatcgtctagccctgactttcccttctgactcttgctagttgctagccctatcatatagcctaaaacaatgcgcatttcttagtgagggcagtcatatcacttgtgaccttttttattttttttgtttgtattacagtgctgtccatgcttccaacactgagagaggccttaatgcagcaactgaattccgagagcctcacagctctgctaaaaaacaggtaaatgcaagttacagcattttctgtttaagcactacacttaaagtttatagaatgaactgatagacttttcaaaaatctttgttatttttctatctaatgaaagtttatataggctcagtaagaaaaatactaactatatcatttaacctacatttaattttgtctatgctctacttttttgcataaagcattcaaggcaatgatatttgtatgtattgtttttcatataaatagaccttatagcactttgaaattgttcacaaatttaattatgcagtgcttgtgaaatgtgttcctgaaccagatgctgtgaagctaacaaagttacgttaaatattgtgcttctttctgaaagagcttacggtgtaatacagcatgtgaacatacgttttaaataaataagatatacaggacttatatcttaaattactaacaaaatgaaatacaaacataacatgagcatgcaatactaataatttacattgccatggcagtttgctgtttccaaaagcactttcacatatgtaaccttgtatattgcatgtagcatgtgttggggtattgtaatttggtatgatactgtattagtttgagaagacttccagcaggaaatggcttcttattttgatgacaatgatgggagggtgggcagggaaatggtttcactaaataaatgttaatcattgtggccttcctaaaataatcacttgcctttaatcacccttcaaatagccaggggaaaagtagttctatttctaaactgtctcactgtgctagccctggtgctaggtaccttccatatatgctcccacttaatttacacaatatccctgtgaggcggttactattattcattttgcagtaggaattgagtgctcagacaggctacataacaagtggggaatttttttaaaaacacttactatattcagagaatacttcccaaaataacagtggatttgtgtacttgagatttcttttatctgattaaaacagaatgctagtgatgggggttttccattttaaatttcttcattcttagaggtagacagaccttccttccttcttacagatataaggtttagcttataaattagttcatacagttttatgaagaagaaacatataagcagattgcttttgatcaaataaataattaccatttgtgtgtacataggtaggaattgaaaagaagtagattttaatttcctttttgtcatgatgagaaggcaagacaagttaaataagtgaatagcatttttatacaagcaacataatacagataaaataatcgtggtggcattcttccttcttggtgaatctgtttcctgcaaggccctatgttccatgtgctttaggggatttaatagttaagatcaagtctctttaagaccttttcatccaaaggaggaagtagactaaataaattatcgtaattccggacatatttagtgcaatgacaaaaagtaaaaggaaaatttaggagtatcaaaaaaaccaaaggattaattttgatagattatcctggacagctttaaagaaaagatgtgattctttttttcttaatcggtacacagggaggagaatttcttaaattctggagaatttaaggtgggccacagttctcctcattcagtttcctctttaaatatctcaatgttacttcttcttggctttcttttgatttgaaattactatttgtaatttggtggggggagaagggtaatatccatttgaaaaatatttgcataaataagggcttgatcccttacaaagtatcattaaataaggcctccaatcttatgactgcttttatattaattttatatgagactctggtctcatataagcctgttgagcaagtttttttttctttaaactatttgtgataataactaagataataactaatgagaaataagtagatgatttgatagtcttattttgccaacttcataacagcaaataaacagttatcactgtttttgatatttggcactcttcttgaagactgataatggcaatgaagtttcaatggcaaaaacaaaaaaatcttaaacatcctccatcataagagaagtagaacacttcgaaaagattcgtttaattctctttactttttatttctccatgaaggtattttagtgacattaaagagtctggttgtatttaacttgcagttgatttccatcaaacaaatcatttgaaaggaatatttgtgttgaaggtacttttctctgttctacatagatttggaatcttttatgtagattttggagttttttaaaaaaaaatagcatcagtatttaaaaatctacttttaaggtctaataatgttaagtgtaaacatgaagaaatgtcctgggtaactattactgtcttctcccaccaaaatcatcccaaataaaatacagttttttgttcgtttggttttggtttttttttagatagagtcttactctgtcgcccaagctggagtacagtggcacaatcatggctcactactaagcactttctatattgaaattttcggaaccactgttttcttatcttttttcttttagaatttttataagaagtacttagaaatttttctgagggagcattcaaaaagagatatgagtcacttaggatacattaaatacctcacctttgaattgtggttgattcccagtttaatccgaatacatatgacattctgccgtgagtcttgaacactagattagattaaggttgcagcagtgtcttgcatgagttactcaacacattttctgaacctgtgccatctaggaaagaggtaactgaaactatagagtctgctcattggcaaagaaagacaagaagctagtagtatctttaaaattgtaatagtaactcaatttcttgttggaatgcaaatttatgtctgaaagtaataataaagaatatggacttgtgttttctatatctgtggttttttttatttcatgttttctagtaatttatttttattgtatttaacaaaagtgctgctctgtgacagattggaaaggaaaaggaaaaaaaatggatccttccactagtggtttgaaaagcactaaactacctccacatagtacatccatacaatggtgtactacacgttggttagaagagaaaagtggctaccatctgtatacaatagtcccatccaccttatccatggtttcactttccaaggtttcagttagccatgacaaccatggtctaaaaatattaaatggaaaattccagaaataaacaattcctaagctttcagttgtgtgccattgtgaataacatgaagaaatctccctttgtccagcggatccatgctgtagatgctatctacctgttagtcacttagtagccatcttggccatcagattggatgttgaggtattgcagtgctttgtttttaaggaacctttattttacttaataatggccccaaagtgccagagtaatgatgctggcatattacggttgtgctattttattgtgagttattgttgttaattttttacactgcctagtttataaattaaactttaacataggtatatatgtataggataaaacatagtatatgtaggggttggtactatcttcagtttcaggcatctaccgagggtcttcaaacgtatcccccaaggataagaagggactactgtagtactatggaatgatttccacaagatatattgctatatttttaaaaaggtaaagaaaaatgtgtataatatttttcacttatctaagggggcagatataaatgtatatatacatattcacttatataaagcaaaacaatggaaagtttaagcattttttaagtcgtcatctatgaagaagggagaaaatgaagggggttaggaacagacttttttgaatatactgtattatataaatttgacttgggaaccatataaatatttaatattataaaactatagtgtttaaaaaataatgtccaaaaatatatagtaccataaatcaaattaacctaaatatgattcttgttggtagtgtaactacaaagacagaaactgtgctaaattactttgaaacagaaatttcatgtatatccttagtaggatatatactcttcacacacaaagaattggaaaaacagaaaccttaaactcttttacactgagactgttgtgtatagagtgagggatgaaacaaattagtaattatgttgctttcacctattttttatgtggacaaaaagaaacacagatgtaagatcaatgagattaagttaaaaaccttttgactaattttagactaattttctaaattttgactaatttagaaatatcagtatgaattcatgatgtatattacctttttgatcatatgcacatataaataaataaataaataaacatttattagcttagttcactgaaaaaatcttagaaataatgacctacccagtagcaatgaacattctgcatcgaaggttttggtctctaccatttcctgctatgagaaaacaggacccagtgaaattggtgatatcaagtctgcagcaagaattaaatgagatgaacccagaataagttttcatgtcagaaactgtagatactataaaagactaataaaagattatacaaatcaaaaggattcaggaggcaatgtgaatagtcttccagaagtgaaagatgggcagtttgaacatcgatagagataataactacagtggattgatacacatgaaatatatgtgtaaattcatgtgtttatgatcgtaaaacaaaaaaaacttcatatttacctttgaaggattataggacctacttcattatttctaaaacagcaagttagggaaaagaaagaaatatttcctctgcatttcctatatgattttgtaatctatctatacataacactcaaggagaaaaagattgtaagaatatataccagttaaagtggttgttattgattactggaattaaaatttttttttaccgtattttgtgggcttgcttttctgcagttatgctgtgttgcttttaattttttttaaaaagtaaaaatagatctataaaattcagagttttctattagattatctagattattattttcatatttttaaattttgttctttaggccttcaaacaagctagaaatatgggaggatctgaagataataagtaagcctgcatattctgtgtgacagcacatccttaaaatatttataaagggaaatgtttgcattctattaggatgactcttctttacctgccttttagaattgttgttagtattaaataatatagtacaggtaaagcaaatagatcaatgtctggtcatagaaagcattcagtaaatgttagtggtaatgctattgttattatgatgatgatggtaggtaaaattgtcctagactacatatgcctttattaggtactgatatctctaatgtgctttaaaggaagtttttattccaatccagatcatagatttactttgatattgtattgtaaatttttgttagtgataaaaaattgaaacaaaaagctaaactagggcctacgtatctgcttgtctcagaactgttatcctgttttcccatccattcagctaatccttgtcagcagaatgatgcttaagccttgcctatttgttttttgttgttgttgttgttgttgttttcatttttattatactttaagttctggggtacatgtgcacaacctgcaggtttgttacatatgtatacatgtgccatgttggtgtgctgcacccattaactcgtcatttacattaggtatatctcctaatgctatccccccccccccccccaccccacgacaggccccagtgtcgacaggccccagtgtgtgatgttccccaccctgtgttcaagtgttctcattgttcaattcccacctatgagtgagaacatgtggtgtttggttttctgtccttgcaatagtttgctcagaatgatggtttccagcttcatccatgtccctacaaaaggacatgaactcgtccttttttggggctgcatagtattccttggtgtatatgtgccacattttcttaatccagtctatcattgatggacatttgggttgaattccaagtctttgctattgtgaatagtgctgcaataaacatatgtgtgcatgtgtctttatagcagcatgatttataatcctttaggtatatacccagtaatgggatggctgggtcaaatggtatttctagttctagatccttgaggtatcaccacactgtcttccacaatggttgaactagtttacagtcccaccaacagtgtaaaagtgttcctatttctccacatcttttccagcacctgttgtttcctgactttttaatgatcgccattctaactggtgtgagatgatatctcattgtggttttgatttgcgtttctctgatgggcagtgatgatgagcattttttcatgtgtctgttggctgcataaatgtctgcttttgagaagtgtctgttcatatcctttgcccactttttgatggggttgtttgattttttcttgtaaatttgtttaagttctttgtagattctggatgatagccctttgtcagatgggtagattgtaaaaattttctcccattctgtaggttgcctgttcactctcatggtagtttcttttgctgtgcagaagctctttagtttaattagatgccatttgtccattttggcttttgttgccattgcttttggtgttttagtcatgaagtccttgcccatgccaatgtcctgaatggtattgcctaggttttcttctggggtttttatggttttaggtctaacatttaagtctttaatccatcttgaattaatttttgtataaggtgtgagaaagggatccaatttcagctaagccttgcctatttgaaaacaaacctttctagttccctgtagttcctttcagcttttatacttccttttctggggggtgaggggagatggagtcttgctctgttgccagggtagagtgcagtggtgcaatcttggctcactgcaacctccacctcctgggttcaagcgattctcttgccttagcctcccgagtagctggctctacaggtgcgtgctgccatgcccagctaatttttgtatttttggtagagacagggttttaccatgttggccaggatggtctcaatctcttgaccttgtgatccgcccgcctcggcctcccaaagtgctgggattacaggcataagccaccgtgcctagcctatgctttcttataatccttatgaccaagatttctacattccctttcttctcttcactccctcacgctttgatgtactacagccctgcagcctggcttccacacctgtgtcttcacctaagcaggtctctcaagcgtcagtaacaacttctgtgttaccagatctgctggacattttccttctgctaggactctcggcagcagtcaacaccttcactctctcctctgttttgaacaccctgtcctaagctactgggaggcctgtcttaccaggcttccccagtctttctgtactttcctgtagtccttaaacaggctcatcctcctcgggctgccattgaaggctagagttcttccacactcagccttcttctcttacttgaaaatagctccattgacaactaagagttctgaagctacaattctttgtgcttcccagacttttccttgttttcctttctaagctaatagtatatacctctttcacctaatatatttcattggttattgtttcaattaagggatcatacctaatttttattaaacaattgtgaggagagactgaaatattttgaattgatatatttttatactagaaacagttgtaaatatgtttttaaaagtcatcttacaaaaaaataaccttaggatggttcatgattttacacatttgtattaatcacagtaccaaatgcttttcttttctctgtgaaggtttcacaagaagtactgtggctgtatacagtacctgtatgctggttgttcttttgcgggtccagttaaacataattggtggatatatttacctggataatgcagcagttggcaaaaatggcactgtaagtttaatagacttaaatagacattgttctttccctcaggaggttcaaagtttaacttatttatcctgataacaatttctatgaaataaatatttttatatttcatgtgattgtgaacttttagtattatgaataatttttatatgttgaaactagaatttttggtgtgttaaaaattactatttttcccgtcatttcagatcttgaaaaatctcagccaaagttttattgaaaacatttcttatttaccagtttaaaacttggataattgaactgtatttctgttttatacagacaattcttgctcccccagatgtccaacagcagtatttatcaagtattcagcacctacttggagatggtaagattcttatttgtgacttttatactaattttaattcatttatttttattattgaggaatttttaaactaagcaaggcttttaggtttgttttttctttaataggcctgacagaattgatcactgtcattaaacaagctgtgcagaaggttttaggaaggtaaggcatttttctttgacttttctgacttcttgattctaatgagtgaaagaaaattagaattgttctagtgaaaccagtgacttgacaaacggtgatttgtgaaactctttgtaataaaatcagataccatcctaggatattgcattgtgggatccattttctttatctttttttttatacagaggggaaagttttaatgtttcattgttaattgattgatttcatacaaatcagaaatatttgggtcatgagataaaagacctactttaaaatctgcctctgaggcttttacctcccatttatactagtaatatctataattacagtaggaattctcttatggaatccagagaaatacttttcttggctctgtagtaatggcccttaactagtggctgatttcgtaatccattctattccagtcagcagttacaggtgtaagcagaagaaacaggattttagatagtagcctgttaagaaaagagtgtatataggatgtgttgtatagtttctatttatcccaattcccttttctctgtttctagtgtttctcttaaacattctttgtcccttttggacttggagcaaaaactaaaagaaatcagaaatctcgttgagcagcataagtcttcttcttggattaataaagatggatccaaacctttattatgccattatatgatgccagatgaagaaactccattagcagtgcaggtgcttaattcataaccatttaaccaaaccagttactctattcttttaaaattttactctcttgaaattttgatttctgagtctcttgaaaggtaagtgattgaaaagcatatatttcagtaattgaagtaaaacccattaatttagaaaaacagccattatgagtgatttctagtaagaagcacttaacaattttagatattcagtacatttttattatcaggtatgtgacagtagatactgtgatgtattctggagatgtaaaatgtgtaagacatgttcattacacctggggaactgaagatacaaattcaattggtgggctgcagcgtatttttgtatcagatcaagtagcagaacatagagctgaaggtcagggcaagattataaagagctttatatgccaagataacgagtctgaactccaatttgtagacaaagaaaggtagattttaaccagtccaataacacaatcacctttgctttttaaaaaagttaatgatgaaagtacaaaaatggactgaggaggttatagtcatccacttgagaaacaatgtctaatccaaaaattatcaactatagtgttgctaaacactggtgtgtcctgggtagttgttacgtaagttattcattgattaaaaataatagaaatgccagattgcaggttatggctcatttcctaaattagtaatttttcgtttgtctgctggtttgcactcattctttgtaattgggagaacagctcttacttgacaactggaaaagccttagaacagagaggccccctatgccatacctcagcagagaggccctgttagaacagaatgccttgttttcattgcctgcaggatttcccattgccagagacaaagatgaacctgtttgggtgctgagagatcctacattcatgagtaggccaaaaaaaaagttgcatcccatttaaggaaaccctgtaacttgaaagatagagactaaactgatcaaacagaacagatggaacagaattaatgaaacaggagacaacttacaaaatagaatctcaaggagacgcaataagagtattaagaaatctttttaggactctaaagtaatttacagttttcaaaattcaaaacaggaccaaaaagaaaacaaaagaacagatgaagagagaaatgatggaccagatcttactgaactgaattaaaacctgaaatttaagattgaaaggacacatagagtctcagactagattgatgaaaaaagacacacacatatcctgataaaatctcttactgataaaagaaaaaagcataggaggttgacggggaggatcacttgggtccaggagttcaggaccagcctgggcaacatagcgagatcctgtctctaaaaattaaaattaaaaaaatcagtcagatgggcatagtggtgcatggctatagtcccagctactcaggaggctgaggaggaaggattttttaagctcagcagttcgagtccgtggtgtgctatggttgcaccattgcactccagactgggcaacaccaatctgtctcttaaaaaaaaaatgctttgggaggccaaggcaagaggatggcttgaggccaggaatttgagaccagcctgggaagcataacaagaccctacccctacaaaaaaaaaaaaaatgaaaaattagtatggtggcccatgcctgtagtcctaactactacttaggaagctgaggcaggaggatcacttgagcccacgagttcgaggttgcctaagctatgatcatgccactgcactccagtctggatgacagagtgagaccctttctcaaaaaaataataatagtaaaattaaattaaaaaaaaaggccgggtgcggtggtgcacgcctgtaatcccagcactttgggaggccgaggcaggcggatcacgaggtcaggagttcgagaccagtctgaccaatatggtgaaaccctgtctctactaaaaatacaaataaaaatacaaacttagccggtcgtggtggcgcacgcttgtaatcccagctactcaggaggttgaggcaggagaatcacttgaacctcggaggcagaggtttcagggagccaagatcatgccattgcactccagcctgggcgacagagcgagactccgtctcaaaaaaaaaaaaaaaaacccagacctctgcaaactcaaaacctatttcttctttgtctgactatactagaaatctatccaagaagggccagataaacagagctcttactaagtataattttacttttactcatgtcttaaattctacttatttgcacacataaaccattacaggtttttattttggtgggggagggtctaactttttttattgttgatagaacatagacttagatttcctaaactctttatttatgaatgtgattagtttcatcataaccctgtgctaatgtttgaaaaccttaagtgtgacattttaattctataggcctgtggactttctcctcgagacattaccactattaaacttctcaatgaaactagagacatgttggaaaggtatgtatacttcatgtagcaggaaaaatatgtgtgtatgttgaatgtacttgagactattttttagtttttcttgaacaacatggtcggtataatattatattaaaattaaatttttgactctgttccccagcctttagataagatttcctactcaaactggagggaagcagggatttcttagggtaactcagctactaactctactatctgaattcatcgagttccagtcttttgtttttcctcagtaggattgtccacttttttgttattcagatttccacctcatcatttcatgaagctctggagaaggtcatcagtgatcttttgccatatccaatgaacctgtaatgttcatcttacttgacctttctctgatatttgacactgcctttcttgaaattctttgctcacatgactttcatgacagtataatctatatttttctcccacctctcaaatcatttcttagatttttctatctctgtctttcctttaaacatcagtgtttccaacctggtgcagcagctcatgcttgtaatcccagcactttgagtggccgaggcaggtagattgcttgagcctaggagttcaagaccagcctgggtaacatggcaaaaaccccatcttaaacaaaagaaaaaaaattagccaggcatggtggtgcacacctgtggtcccagttacttgggaggctgaggtggaaggatcacctgagccctggcaggttgaggctatggtgagccgtgattgcaccactgtactccagcctgggcaacagagtaagatcctgtctcaaacaaacaaaacaaaacaaaaaaggccatcagtgtttcccaggtatttgttctttcttcattggcaactgcctcccaggcaatgttttatactcccattactttactatgctagtagttaaagccaaatgtatagccctagtcctccaccctcaggagcttgtctggattgaaatttctacacttcatagatagaaataatttgttcattcacttaattcatttatctcattgaattattcatcaactatgtattggctgtctgtggtatattaggtactgttctaaatgctaggtcttcatccctactggaatgtgtatgttagtgggagagaaaaataatcaactaataaatttgatgtaatgtcaagtatgtataactttgttgatgaaacacaaagcagggtaaggggttagagagtgaccagggatgctgtttgtaataggttggtcagaaaaggcctctttgaggagatgtcatttgagcagagacctgaatatactgtggaagtgaaccttgtaacccagaagaatacagttcaaggcagaagaacagttgcagtgatcctaatgcttggcctgttcaaggaatagcaaggaggccattgttggctggagcacagtgaatgagaaaagtaatagggaagtgagattggagagatagatggaaactccagagtatgttgaaccttgtagtccatgataggaaatttgttttttattcttaatgtatgggaagccattggagaattttaagcagggcagtgacatcatctgtgtttataaaagatctcattgctctatggtaagctgactataaagagataagaatagaaggagggaaccaatttcaagagttgaagtagtctaatcaagagacagttgcagtttgaactgggtggtagcagtggtggcaataacaagtggctaaataatagatttatttttaaggttgaaccagtagtacttgtggaattatttagtgtgggttatgaaagaggaggcaaggatgactcctaggtattggggctgagcatttgaggaaataggaactgccatttacattttggcagtgttaagcatatccaagtggatatgcctattggcaattgaatatgcaagtctggaattcaagttagtttacaaatataatgttgggagtcatcactttgtatatggtatttaaagacatgggaataggaacagatagagactagaagacaactaagtcatagagcagtccaacatttagagtttgggatcgggggaagagccagcaaaggagactgagtaggagctgccagcgaaagaaaagaaacaccaaaagaatgaggtattttggaagacaattgaagaaatgtttcaaggagactgtgattgattgggtctaatgctcctgaaaggccaaaggagataaagacagagaaataacattagatggagttgttgattgatcttgttgagaagtttcagaggagcagtggagataagctaattcaaaagaattagagtttagcagagaccaagcacagacaactgttgcaacattttgctttgagagattctgagaaatagacagtatttaaggggaatgtgggagccaggagattttgactttaacacttttttatatacacctttctactaaactccatgagacgagtaatttttgtctgtttagctcaccaatgtatcttcagctcttagaacagtgccttgcatgtagtagatgctcaataagtatttactgaattgatagagggaaaaattgatgtagaaaagctcattaattttaagaacaaagtactttgaataggagaaaggaatgagattcaatacacagtaaaatagtttaggagtcaggtagggatggctgaggataggtcagatgcatgtaagtgggtagatgggtgggacaagtatgtggaagttctctttgcttctatttttatgtgtgtgaaataggaagcaagctcacctatttctcatttctttcattggcctaaatgaattcaattcaataataagaataaaaactaacatttttgagtgcttatgcagcaagcactgttctatactgctttatctatcttaactcacttaaaccttacagtaaccctaggaggtaggtactatgatgatcttttcttcagtttccatttcttcaactttcatccccttaatcatttttcttcttggaaccttaccatattacctttaaaagaataaagttcagcccaaattaccgtgcaacccagcaattccactcctaggtatctaccaaaaagaatgaaaacatctctagacaaaaacttgttcagatttttcacaacagcattattcacaatagccaaaaagtggaaacagtccagatttctattaactaacaaaaggataaaatctgatgtattcatataatggagccctatgtagcaaaaaaggggagcaaaccactgatacatgctacagcatagaagaaccttcaaaacatgctaagtgaaagaagccagacacaaaagaccacatatgtatgactgtttctatgaaatgtccagaaaactatatagaccaaaagtagattaatggttacctggggctaagactgagatgagaattggctggaaatgggcctagtgggtgatgaaaatgttctaaaattggattgtagcgatagttgcacaactatgcaaatttactcaaaatcattgacttgtgcatttaaaatgggtgaattttatgccctctaagtcctacttcaataaagccgttaaaatgcttttaaaatagagatgactaaggagaaaaggtaggtagatagaaagatacacacatacacatgcacactgtagtcaagaaattggaacataactaggtattttctagctttcttggcatctttatatattattctttatattaaagagttttgtgaggaactaagagagtataattaagatcaaaaaaccccggtctcatgtttgagctccccaatttactaatcacaggcctttcgtcaagcttcttcatccctcaagtatcatttcctcatctgtacacaataatattttctgtctcactgaaatatcatgctagaggatgtaaagccaactaatctatgactataaggaaatttaagagtttcctcaaaattagtagtactagtactgatattttttaaaaaattcattgtacaaagtgctgactagtataaaaaatctgaagtggatgaatattctcattatgttgtgctaaataagctcatttttaaatactttttaaagattgatttcttgatatattttacagtattagattatgactagaaatgttggtggctttcaaaggtaaccacgttattactgaatttgttttctcttccattcagagtctaaaaagtaacttatacttcttactttatatagcccagattttagtacagttttgaatacctgtttaaaccgaggttttagtagacttctagacaatatggctgagttctttcgacctactgaacaggacctgcaacatggtaactctatgaataggtaagatgacatataaaaatgttatactaatgaatgctctaaaaaaatggtgctttgcttgtctttttgttccagataacaacaacaaacctattaaatttgagtgcctcattttttaacaaattaaactctgttaaaccaacaacttcttcactagcagaagctccttcttggtttcagtattaaaacttggagtcttccagaaactttgccactatattgaagtactttagttgtaattacctttctataagttgaattccaattattgtttttttttaactctttagaatacaaaactcacaatatgttttaattttaatgcattctctaatgttattccattactgcaggccattttggtctgcatatttcaatattttgttccttataatacccgggcattgttggtatagattctcatttgatgaattagctccttatagttctacaaatgcttaaatgtattcattccagtccttattacagaattaggaacatgtattagtgcaattgttagtgattttaatcataactattactaaatcatggacttatgtatgccataaggtatcttacggttttttatatctttgttatcccaacacaaatatctttggtctcatattagaatttatactctttaaggatttctattttgcagttttttatgtcaaactcggaaaataatgggtactaaattaatgttgactgactgtaaactcattcattaaaatttgagacacatcctttgaagtagctttaaaattttttttttaattggggacacagtaattgataggcaatatgtatgtgcaatatccaatttaattcttaaatacatagggccagaagttacttaccagattctctgagacccttctttattgtagagaaaagattaatttgacattgacattaagcatttggaatgcttacagccataaagtatattctctgaagtaatttaaatatcaacataaaatctttaaaaaaattttaagttatacaaaaataaatttcagctcaagaccaatcctatatactgtataaatcaaggtgctccaattagtaaaatttcaccataatctgtatatagcaagatattcgttattttgcaagtagtgatacataattgtaatggttattttaacataaatacttgattttgtacactgaagaattgtaaaaattatactacagccacaacagccatgatagtgtttcttttctgaactatagtaatcattatctgtactttcatgtacaacctacatgtgctaccttgaattggagttttattcctcagttacattttaagcctcctctcaaaagtcaaaaactatcttgtgccctttcatgtctctttactcatacaaggcactcagtagatattttctatataagtttttctgtttcatctcaataaccaacttcatgctccatgattgaaccctagaaacatttccatcaagcctattgtcatcattgtttaatgtgttgtgaaagtctagccatcatagtaagtcaagaaaaaacaaatggctaaggcctgtaatcccagcaccttgggaggctgaggtgggtggattgcacgagcccaggagttcaagaccagcctgggaaacatagggagagaccctatctctacaacaaatacaaaaattagctgggcatgcggcacatgcctgtagtcccagctaattggaaggctgaggtgagaaaatcacctgagcccgggaagtcaaggctgcaatgagctgtgattgtgctactgcacttcatcctgggcgagggagtgagacccccctgcccccccaaaaaaagaagtaaggtttttaactattggcaaagacacaaagtatattatttacgtgtattataattaataagccagacctctgaagagaatcaactgaaaaatgaggtaaactaataaaggctttaatttatatatatatatataaaatatatatgcaacatatatgtattaatgtattatatgtattacatatgcatgtaatataatgtataatggatatttaaaagtcaaaagtgcaaaatgaaatccagaagtatattacaataataatagcagctaatactttttccatgtgctagtttgatgataggtatttttcagaatgtctctcattgaattcttaaaataatcctaggaaatacgtactagtattcttcattttccaggtgaggagactaagacacagaaaaattaaataacttcaggtcaagtggtaaagccagttgttcaataatgtctatctgagatagaaatttttctccaaatttttaattattctccaacactatgattaattaaggtttaagaatgtaaggagggttaaaactagaaaagctattttggtaatccataacattaataagctaataagataaaaaacattatcttcagtgttgctgaaaagacattcaataaaacaacatttattatggataaaacctcttactagaaataaaaaatacatttttatataataaaataatatttgagtcaggtatgatagctcacttctgtaatcctgatgcttttggaggccaaggcaggaagattgcttgaggcaggaattcaagaccagcctggggaatatagcaagactcctgtctctacaaaaatttttaaaaccaccaagaggattgcttgagccccagagttcaaggccacagtgagctatgatcatgccactgtactccagtctgagtgacagaataagaccctgtctcttaaaaaaatatataaaaaaagagtatttgaaatcaaaagcaaatatacttaatagtaaaactggaatgatttccattaagttcaaaaacagtataaagatggtcactattgacagattattcagcatcattctattattctatctaatggagtaaggctaggagaagaccaattttgagattcaattaaggaaagctgttgatttttttctatacttatatcttgaaaataggtaacttttactgttggatagcgaaaaaagaaagaaaatagacaatttactgagtgttcttaccattttaataaactgttagttgaccgttggttttctaagttaaactcatgctatctttaaaaatgatatcaattttgaaaagggagaagaaaaagctattgttatatgaaggggacagactttatacttagaaacccaagagagtcaactaaaaagtgtaaaattagccttccaaaattaatctaaaatataatcaaaatattatcaaaattctattggagattggaggatggttgatttttttcatcttaaacctgacaaatgataataaaggtaatatggaggaataatggaatgagaatgtttaagcagttattggaaaagaagagcaatggatatgcttttcctatataatatataatataaggtataattattgttactcataaaataataggtaagtcagtgaaatagaatgtaaaatccagaagtagccctaaaaattgtaggatgttagtaatgattgtgggcaaaatatatgttggtaagacgaataacaattagtcattttacaatgactaataaaattcaggaggtttaagcatttaaatatactaagtaaaaacaaatatactgatcgaaaacaggtgactatgtgacctcaagatggagaaggtatttctaagaatgaaagtaaagaactttatataaaagaagtctaggtttgactgtataatttttaaaacttcaagatcaaacaagctttttataagcttttcatcaatattaaatgcaaataatatacaggaggaaatgtttgctctctttatgtatatatatcatccatgagtgtaatgacattatatacagaacttttgcacatcagttaaggaagcaaacacctaaggaaagaaaaattttctttcttagaaaatgtgcatcaaagacacagataattcacaaaagagcagatggaaatggccagtttgttaatctaagatttattgaacacgtgttatgaatcaggcactgtattaggtttctgttcccatagatcttacaatctaattggggaaatagtaaatataattgtataaactatgagaagtgttataaaggagaagaacactgaacgtataatagaaaaatttaaacaaaagtagacagtcaagcagttttcctgaggaaataatttgaactactaagattggaagctattaaatatgaccctagactacagtgggacagttgacattctgggcagaagctacagggcaaaggttttgaagccacctaagtacattttaagacttataaagaggctggcatggtagctgaatacatagaacaagagtggtgtcagacaaagctggagaatgcagcatatacagatatggctgtcatctgagaacactggaaggctgctggagagttttgagcaggagagtgatgtaatggaatttacattgtatgatttctttgactggtttgtggaaaaggaattgggtaaacagggactggggcaggacagacaaatggatgaatgaagacttattaatcaattcaacaagtatgtattggatgtccactgtacacaagaccttttactatgtgctgggacaatacagtgcataagatagacatggtgtgtaacctcatggagcttgcatgatagtgaggggagacagagcaatcaagtaatcaaaatcatgatagattttgaaaaatgccacaaaggtaccatgaaaaaaaaaatgcctgcttccctcaggaatacataaatcttcccacttcctttattcttttttaagcattgcctcaaatctcagcatagcacactggttgtacaccctagcttcagcacttgcatgatatttaaaaggaaatttttagtgtagccctaggttgaaatgtatgagatgtcatatttaatgtaataagactaaatctacaaccccaacgcaaaaatgagtcttgttgtttaagtcattgcatcacatacatacagtgatacatacatgtattcatttatgcatccaacaaatgtttattgtgctctaacaagttaaaaagttattgctgtagtccaggcaagagataatgctcagcttggaatctgttgggcaacggggagaattcttggcacttatttgaatataggcaagggaaagaagtgccaaggattttcaaaagattttaagattattaaaagatttcttttgagaaatctttagaatatctgattgggtataggcaagagaaagaagtgccagggataatgcccatatttgctgcttctagaacctgatagataatggtgtggttcactggagtaggggggaaatactcaacattgttagtaattaagagaaatgcagatttaacctgtaagatactattttcacctatcagatgtgaaagattaaagaaaaggataatgttggatgttgaaagaaggcataatggagcagatacattcataccctttgacccagtgatttcatgtttatacaaaatcttacttagattaagaaaatttaggcaaaaactgaaatgcccaactctagggaactcatgatataaattgtcacagctagaggacagattactgtatagtcattaaaaaacaatcagacaaacactttagaacttttaataagatggaaaatactcataacaataaaaatgcaaaaacagtgtgcttaggaggttagaggtttttggtagacacaaaaaaacaaagatatgtgtaaaaaaacgccaaaagaaattggtcatgatgtcaattagagttgttatttctaagcgatagaattgtggggttttttttcctttttaatagatttccaaaaatattctacaatggctatgtattacttttataattaagatgttaaagtcctgtggggtcatttcagaaaataatcattactgtaatgatttttcagtctttccagtgtcagcctgcctttagctaagataattccaatagtaaacggacagatccattcagtttgcagtgaaacacctagtcattttgttcaggtaagaagaaagcttgggagtgttattaaaagcaaattatatttgtggtggtggtcatgtttgtctaacataaagttacattctctgctgagaggttttttcaaaaaatcacagaacttggaactacatgtagagtatggtagagtgtcccatgagagtaataacggaccatagcaaatgtgtaagtttggagtacctttctccgtgttgtagtccaacactgtgggactacattttagtccaggtgtattatagtggtcagttgaatttatatagcatgaatgtttgcattaagctgtgctagtaagaagattgatccttggggcagatcaaggatcctgttctacacattttgaggaaaactaaaaaaatttgtggagaagtaaagcattttagtgattaataaaatgtaacagttaatagtgcatcaataatatgctcactaaaagccacataaacagtgggtcatttaaatgttttatcagactacctataactccatcttatttcttcatttccatttggaatgcatggagtaattcagtaattcattgagtaattcagtaattcattgagtaagacaaatattataaacaaaataactttgaatttctgagtcatgtgcaaacttggaaactgtgttataagttaaaaaattgtttgcaatgccagttgcaaactgcttcaataatgtacaatgagaagagaccctatggcctaagcataaagctgacatcttcttagtgtaacttgtctcagacaatttagtgtatcctctctgtagactttttactcttgggaacgtggagagcactgagactaagagttcgtttcctcctttcactgtggtgtcatcagcctgtccttcacatgcacattttcccacactggactcttcagtcttctgtcctctttctcacccctaagagcttggcactcatattgcagaagaaatagtgaataagactgatctcattttactgaatgttaagcttcacatctatatcaatgtgagaaaaaggtcataacttggggcatttaaaccttacctttacctttgtcctcttctgtagaagtccctggcttggccagtaggctgttcattttgacagatgagtggaaattacaaccaagcataaagcatcatcagccttaatgcttaaataattttatgcactacactttaattaaaatcgatataattgataataaaaacaaatgtttcaatatggtaaaaacgccattgatactaatgtttagtaaagttttttactgtaactggatgtatattaaatgtatatactagaccattgattgacaaggctattacaattatagtttaattttttaaactataatttctatgagttaaaataccaagtggtcttcttaataaattgtcatatgctttactatttccacttatctttttataaagcctttgccttgattagaatgctaatttacataaaattagtcctttcgaattactgctactacttcaactacaatggtgtgtaggagagcctatggtgggaatgctgtagaacaggggtttggcaaactgtacagggccagatagtacatactttaggcttaatgcaacatacattctctacagaaactattcaactctgctctggcagtgtgaaagcagtcagaaacgtacatgaacaaaagagtatggctgtttcaacaaaactttatatacaaaaacaggcggcagtggatttggcctgcaggccatactttgctgacccctttggtagaagatattaggatggtagttggtaaaggtaggaaatgggagaatcagaaaacaatcgagaaaggtggtttttcaaattattttcaaatagctttcaaataacataagcaggagataaattatttcagattgctttcagataacataaggaaagagcttttatagtgtgaaccaaccctatgatacataatttttatctcagactactgaaacatcctagaagctgcatcaggatacagtatttgaacagattaaagtctttattataaagctgatataagttagctatgacctatgagccaaatccagccaagcaccagcttttgtaagttttattgggtgacagcatgcccattggtttatgtgttgtttatggctgcttttgcactacaatggtagtatttctcagatttgtccatacacctcacatacatatgtacacacatataccacagtcctccagtgtttaaatcatttttagtgtataaattaaaaactcaataagatccttaagattagagctttttcgtaactcaaaaccaaagcacttttattgtcaagtagaatctaaattacaaaaaaagattgttctataatatggctgacgtctactattaataatttgttgtgccaaagtgaatgtggacctgtctgctactgttcatgctgttgagcattcagcctgcattttctgaagctgacttgctagtatttttttttttatctactgtaactattctgaaagcttcatttgtatcatgtgttttacatgatttggtcttcatttgaaagattttctgcctctgttcttctctcattagcacaagacagttaaagtaatgttacttaaagccaataagaacataaatataaacaaatgccctaaaatcaggaacaatagtaggttatatattttatcttctcaataatcaagagcgtgtttgagttttctttacattttcatagaaatcaaaacacaaaatttcccctcaaattcttgggcccctgaaagtatgtctgtaaattctggtttgagaaacattgatctaaacctatgtttcattgaacacctagactgaatacttgaaactaaataacatcaaattctctgatgagataatttaaccatgaattgattgagattaggacatgtctaaacctcacttggattttccgatacttaagaaacagagatcactagggacaggtttacttcccatttctttgacactctcagaggctgtcaaccttttctatcatggaccctttcacagactggtgaagcctatggaccccttctcagaacaatatttataagtgcatacaataaaatacataatattataaaggaaaccaatcatatatagttttcaaaatttcttttaaaattaagtgtatgatatagcggtattgcttctttattcatgcattaaataccaagatataatgagagttctgataacttccacaactgtcatatgacatgaaaatgcctatgatttctattgaagacaaagtcatacaacctgctaatattatcacagtttgttgcctacattcataattgaaagagataccagattttggttagaagttaaagaaaatgaaggtgtaatttttttcttatcttcacattcgcaaatcccttggggtgttaataacccttacactatagtgtatatgtgtggttcatgtatgtgtgtatatgtaaaatatgcacttactacacatattcataccgtatgttagatcttctagaaagtaatacacccttaaccgtgttatgtcagcttccagcaaaagtacctttactcctacaattatttattcaacagatacctatctagcacttgacatacaccaaaattcatttgaagactatttggggtttttgtccctcaaagtcacacttgaacgcttatgataccatcatccctcatataagaacctaaataataactatctcctagaatttattacaagaaaaactactcattttcttaaatggtttgcctcttggcctttaccacaaaacttagagctgaattcatcgcttgattgcagaaattaattcaaattagctatatgttttgcaaactataatgttatattatcatctttgctaggatctgttgacaatggagcaagtgaaagactttgctgctaatgtgtatgaagcttttagtacccctcagcaactggagaaatgatttttccttcaagaaaaactacagtgggattcatttactttttaaaatacactgggtaaatcacctatacttagagtaacagtttgttatcaaaatgcctgataaaatatattcttaataaaagtcttcatttcataatgaaatcaatttatttggcatcttaatatatttttttagattcatcaacagaccagtttttgtgggcatatatatatacacgtgcaaatatcagaattgttaataatttgttacacatggacatttgttccaaactgactaaaaatcaatatagatattttatatacatatatatatatataaatacaaaattcagtgtactttaccatattaatactgaggaaaaatctgttggagacataggtctaggatgtgtgaagtttggaaaaatatgctatttaattataatgttccctagactgctgtaaacagaagtgaatcagacttttctccagctacctttcaaaataataaattatttgtctcaaatataccttgatggaggacttttttattcttatggaaatagtgaattccaacaactatgatgaactatgttctttgctatttcttcactatattttttaaggttttattaaaaagccttagaaagttacatattggtttagaggctaaaattgtgttgatgctgtttactcacctaattacatagttttaatcatttgtacataattttaaaaacttactttgtattgattttgaatacagtgaaaatcttattgcaataaactattttagtaaaatattattttgttgagttaatatttttcagctattaatttacttatcccatagcatttttgttattatttcggaagagagagcatgctagtttaagtttcattttaattggtcgtgtacttggtgcttttttgttgttgttaacttgttcatttagtaaaaagcaaatagctttactttctgaaaaagaaataattcattatctctagtaatacatctgtaattcttcatttagaagggtaattagggcaaaagtaaataaatcattatatatcattagtatgttgacatatattttcagtaacattgttttatgttcctccagcgtaacatgtagctgaacagtagaaggtagaaaataaattatgacatctcttctaaggcctggctaggcctgaagctcactgccagggagtttgtgtctagaatgtttttaaaaataggtagtggagccatagccctcaccatagacacctctgagcccactggcattgtctctgagcagaagatggctgtgccactcacatatgctaatcttggcaaatctgccaagcatgtcttcaccaagggatatggatttggcttaataaaacctgatttgaaaacaaaatctgagaatggattggaatttacaagctcaggctcagccaacactgagaccaccaaagtgacaggcagtctggaaaccaagtacagatagaccgaatatggcctgacatttgcaaagaaatggaacactgacaacacactaggcaccgagattactatggaagaccagttagcatgtggactgaagctgaccctccattcatccttctcgcctaacactgggggaaaagtgctaaaatcaagacaggatacaagtgggagcacattaacctgggctgcgacgtggatttggacattgctgagccttcagtccgaggcactcttaagtgctgggttatgaggattggctggccagctaccaggtcaattttgagaccacaaagtcctgagtgacccagagcaactttgcggttggccacaagactgatgaattccagcttcacactaatgtgaatgacgggacagagtttggcagctccaattagcagaaggtgagcaagaagttggagactgctgtcagtctcgctgggacagcaagaaacaggaacactcgcttcagaatagcagccaagtatcagatcgatcctaaagcccacttctccactaaagtgaacaactccagcctgataggtttaggatacacttaaaccctaaagccaggtttcatactgacactgtcagctctcctgggtggcaagaacatctatgctagtggccacaagcttggtctaggactggaatttcaagcataaatgaatgctgtagaattgtttaaattattttgcagcatagataccttcacaatttagtgtatcttttaatgttgtatggctgggatgcaagtattgctaaatgtcatattggacctccaggttaaagatgattcagctttaaggtgttaccctttcaggggtacagaagaaacccagttccaaaaaggtcccttcagtggtagatttggggaacttggtggcccctgtagagatgccaggtttcttttttatctagaaatggctgcaagtggaagctgataatatataggcaccttgtaaattcatattgagtaaatgaatgaaattgtgatttcctgagaattgaaccttggtttcctaaccctaactgatgagaggcttgttgcttgatggtgtgtacaaatttacctgaaagggaccttttaaagacagatcttcatgacttgttcccatcccaggtcttcattacctcttttacacaaaaagatctacagggtgtggtcactgtttcttttgtgctgttttggggtggagagggtggatgtgatgaagccaataattcaggacttaattccttcctgagttgtggtttttttgtccttgcatcagtgtataaaatagcttccaggagctctag

SEQ ID NO: 12266 - DNA, 21210 bp, Human
aaacctgggagggtcaaatgagaggcgggatcttatgagacacatctgaccacacaactcccccgcccacacttgccttccaagctgagagctcctgtgtggccagatgtaacagtacacggggagacataagctcttctccagactcttcctagcacaccttcagcaggccttggcttcccttgcacccctcctacctctgcttccagcttcctgggtgaccttgagcaagccacttgctctttctagacctcagttacctaacctgtaatgttgagattataaatcctgaccagcccacctctcaaggtttgctgtgaagatggcaatatggaaaataatggatggggagaacctgtgttctccaaaggccataatacaaagtttgtattattattattatttattattattattattggagacagagtcttgctctgtcgcccaggctggagtgcagtggcacgatctcggctcactgcaacctccgcctccgggttcaagagattctcctgcctcagcctcccaagtagctgggactacaggcgcccaccagcacgcccagctaatttttgtatttttagtagagatggggtttcaccatgttggccaggatggtctcgaactcctgacctcaggtgatccgcccaccttggcctcccaaagtactgggattacaggcctgagctaccacgcccagcccaaagtttgtattattaataaatcctacagcttcagttccctttgcagcgccctctcctggaaggatgcccatatgcaggctttgcctcagacctgagccctggactccaacctccgtctggagtgggtttctgtttctcttctttcccttccatacccaccttccctgtacctccaataccagcacactgaaccactcatgccaagggggtctccagggttgggactcaggttttcagggcccaggtgggaccctggacctctaggttcaacccgcctttcccctcagccctagtccctgtcccacaaccccagcctcacaccaccagcccatttatctggaggacccctagtctgagacagcgccaagaatcctgaataagccataggatggcagaggcccattgccaggtggggaatcccattccttccctgtctcctccctctctgtaacccttctccccctccctgcccccactcccacctgctctgtggcctccgtccccatctctggctacacaggtttctgaggtatagccacagggggtagaagttaaactactagcgggacaggaaggaagaggcggggagaggggccgagagggaggtggggattagggtctacggggtcactttcccattccacctcctccaaaagacttcactctcttgtgcaggatctggattttacgaaaaaaaaaaaaaagaagaagaaaggaaggaaagaggaaagaaagaaataaagaaagaaaaaaaggaaggaaagaaagaaaaaagaatgaacgaaagaaagaaaaaataatttactgtctttgtcagtgaagaaagaacgggcttcggaatataatcatttgctgtgtgatattgactaagtttcttgacctctctgagcctgaggtttttcatctgcaaagtggagtagggcaaaaatgctaaattcacagtgcccagcaccactcctagagcataatttgccttccgaaaatgttaagattcttttacttacccttcattccatttccaggcacccctcccccaaaccacctcccttttcttgaaattttcaggatgcttctggccctaggttccctgtcctcactcctgtggccctagtcccgggcagcctcgggttacttggggttttcccggtggcgagaggctctctacccccgccctttcgcagcagggctgaggcacgcgcttgcgcggggtccgggaaaccggcgcgtgccaggagacagaggctggggaaggggggaggtgagaggaaagagggtggaaaggagaggatagagagagaagagcggaggaccaggaaccagagagagagagagagaaaagagagaggagagacagagcgcttgggggcgaaaggagagagggagggaagggtgggtaaggaggagagagcggtctgctgcaaaccccaggaggagagcttggagcccaagccagaactcgagccctagccggagccgttcacagggaggcggctgccgggaccgtcagccctgcatgatgcatctccggctcttctgcatcctgctcgccgcggtctcaggagccgagggctggggctactgtgagtgttgggcttggaggcaggtggggttgggcccaggagtccagagcctgcagggcggccccgaaccgcattgcggctgggtggtcgcgggtccttcccggccggcgcgcgcccgctggctctcatcttttcctgcctctcccccgcgctccgcattgcagctctgaggctgccgcgcgcgcccggggctggggctgggctctgggaagaggatgaagtcagcgggcagggatttggggttgggatccaagcaggagctggtgcctgggtttgaggctagggctgggggataagtgtatactggtgaccgatactaggattaaggttttgccagggcttaaggctggactttggagctggccaaggggtggggtttgtggctagggctggggtttgtggctggggctgggttttgtggcagggatccaagcaggagctggtgcccctgactgatgctaaggctggacatggagctggtgatggtgctagcactggctgaggttgggtgcaaggcctgtatttggggatggtgcaggttttgggggccgagttggattgaggctagggttggagctggattggtgtcttgggttgacttaggttgtggaagatgctgaggtttaggattgagtttgggaaagtactaaaccagggcaggtattgggctagctagggagggtctggccttgggcctataggtgtagcctaggggtttgcctagaaggagaaggcagcctcctctgagcatgcagctgttgctgcagccaggattgaatagatggctttaaggtagggctgggtgtgcctctgggggcgggggttgggggcacggaaggggaagcttcggtcgctaagtgggccggcctttggaagggtctgggaggggccagcgctgactaacatgtcggtttccctaccctagacggctgcgacgaggagctggtgggtcccctgtatgcacgctccctgggcgcctcctcctactacagtctccttactgcgccgcgattcgccaggctgcacggtgagctccgcggaacatcagctgccaactggcagcgcaccgcggaagggtgggggcctccggaggacttcggggagagggatagccggttaaagctcctgtcctttctataggcataagcgggtggtcaccacggattggggatccgaatccctggctccagatagacttaatgaagaagcaccggatccgggccgtggccacacagggctcctttaattcttgggactgggtcacacgttacatgctactctacggcgaccgagtggacagctggacaccgttctaccagcgagggcacaactcggtactctgggcgccaaggcggtaacacttggggagcttcctctgctccaggctctgggccgggcaccagcctctgggaaaatggagggggtggtggtgagggctcggacaaggagcagtgactccactccagggactctgtccagagggactgtcagcttaggacgtgcgcgaaacactcggttcacagggtttaacacactttagggtaaaacctgggagagcttcctaaggaggtgacatttgatttcaggtctgaggaaataataggattgtgggacagggcactttatggaaactgtgcgggcaaagccgccaagcagggaagaccaaggagtgtttactttccagaagtcgagattggctgggtgtgaaagttgtgggctgggaggctatggagaaagaagcagaggggggccgggcgcagtggctcacgcctgtaatcccagcactttgggaggccgaggcaggtggatcacgaggtcaggagttcatgaccagcctggccaacatggtgaaaccccgtctctatgaaaaatacaaaaaaatcagccgggcgtagtggcgggcgcctgtaatcccagctacttgggaggctgaggaagagaattgtttgaacccgggaggcagaggttgcggtgagccgagatcgtaccaccgcactccagcctgggcgacagagcgagactctgtctcaaaaaataaaataaaaaaaagaagcagagggcgggacgtggttactactctcctccacccccgcagaccttctttggtaacgtgaacgagtcggcggtggtgcgccatgacctgcacttccacttcactgcgcgctacatccgcatcgtgcccctggcctggaacccacgcggcaagatcggcctgaggctcggcctctatggctgcccatacagtaagtgtgcagagagcgcggagggggcctgggagacagcctccccagttcccggcccacctacggtcctttgcgcagaggccgacatactctatttcgacggcgacgatgccatctcctaccgcttcccgcgaggggtcagccgaagcctgtgggacgtgttcgccttcagcttcaagaccgaggagaaggacggtcttctgctgcacgccgagggcgcccagggcgactacgtgacgctcgagctggagggggcacacctgctgctgcacatgagcctgggtgagctcggcgaccatgtgcgatgcggagccaacccctgaagctctctcaccgccctcctcgtggcacctcctccgcgcatccgcgctcagcctggtcttccacttctctaaggcctggaccaaactgcccctttcttgtagcatttggtgctagcaaaacactggagttgagtgagaactggattccagtctcagctctaccactacacagagatgtgacctcggatggggcacttccgagcctcagttccctccttgtaaacacacacacacagacgcacacacattgtatctcattagcttttcataacacccgcacatgaaatagaagcagctcatgtgttcccagttttacagacaggaagccaggctaaatggcttaccctgtcacacactcgccaatggctgttgatctattcgcccactctccctgattgccctgggctttgttacacgctgctgctctgcctaggagcttggactccatggagttctcctggcttgaggtttcactctgtcctgccccaccctcaggcagcagccctatccagccaagaccaggtcacaccaccgtgagcgcaggcggagtcctcaatgaccagcactggcactatgtgcgggtggaccgatttggccgcgatgtaaatttcaccctggacggctatgtgcagcgctttattctcaatggagacttcgagaggctgaacctggacactgaggtgagagactagggaggtgctatttcgtggtagggtagatgctggatgagtgagtgcaggtcggtctctccctttctcttttcctctgtctctcagaggaaagacctggcattcaggctgtgggtggtggctcatgcctgtaatcccagcactttgggaggctgaggtgggaggattgcttgaggccaggtgttcaagactcacctgggcaacatagtgacatcctacctctatttaaaaaaaaattttttttcaaagacctcgcattccaattcctgaatatcctagcagcccttggcaaacttgccactcaccagaaaaaggcctgtttttttttttgtttttttttttttttttgtgggtgttgttgctgttagcatgcagactcccaggcactatttcagaactaatgagatggggtttggaaattcagattttggggactaggcaaggtaggaaaattgttcccttggatcctcccacaactttgtggagttgttaaagaccctgaccccatctgcagataagaatcccaggcaggctaattgacttgcccaagggcgtgcagccgatttgtgttggagtcagagcttgaactcaagccttgaaaggcctagcgagctttagtaccgacactggggaaatgtgtgttttaagtcttttacaaaaccccatctggcatttgggaaagcatacggcggggacgcgcgagaaaggcaggcgccctcctgtgcccaagaggcctcattccccacgcctcccgcagatgttcatcggaggtctggtgggcgccgcgcggaagaacctggcctatcggcataacttccgcggctgcatagaaaacgtaatcttcaaccgcgtcaacatcgcagacctggccgtgcggcgccattcccggatcaccttcgaggccagtgggcaggggggtctgggaggacaggatatcaaagcgtcgtggaaagcaaagaggtggagcgggaagagatattgaacatcagataaaagcggagaatccctctgtccccagccagatgctcaagttgggaggggagcgggtctcacctgaggtgcatgagccacgcaggcccctagttaagaagcagtggtcgggtccaatcaccttcttagttcatagatgaagaaagtaaggcgcagacacagggagtggcttgtccaggggtcgtgcagctgcacggtggctgagtagggacttgaaccgatggcttctctgatatgcccccctcaaccctctccgactctggagctctgttgggaagctggcaggagccaggtctgtggtccaaaattgcctctcgatactggaaggagagaagcggtcgaatcgcagacggtggagatcagcgagagcaagcgagcagagttccgagggccgactgggttggggccccctccacagatggacgagcttggaggggaagaggtcacgtcatggttggagatctcacccccgccaacaccgaaggagggcggtgaccagggtcttagaccggtgtgaaaactgaattcccagctgaggcagaggcggctcacgggtgttgatgcgtcttcacttttgcccctagggtaaggtggcttttcgttgcctggacccggtaccgcaccctatcaacttcggaggccctcacaacttcgttcaagtgcccggtttcccacgccgtggccgcctggcagtctcatttcgcttccgcacctgggacctcaccgggcttctccttttctcccgtctgggggacgggctgggccacgtggagctgacgctcagcgaagggcaggtcaacgtgtccatcgcgcagagcggccgaaagaagcttcagttcgctgctggtgagggcgtttcgggggaggcacaagaagagaagagaagtgtagaggatcccaggaaagttgtaggcctggactgaggcctttacattctggagaggggagaggagtgaagggggcagggcaggaggccccagggtactgggaaaaggtgggagtggctagaggcagtgaggaggcgaatctgagggactaagtattcttggagaagggggaagcctgggagtcctggtattctccagttccagaaggcccctggagatttggttactcgtttataactgtgcagactctgtggcagttgctgggtcatggataatgaagagacattcagagaggtctccactgggtgtgagaagtgtaatcacgggggcacacaggctgctactgggacacagtggggctgctgcttccccactcagaacattcttctaccctagttgctgcttccctccacccacaccatcatccattcttgtccagggtaccgactgaatgacggcttttggcacgaggtgaattttgtggcacaggaaaaccatgcagttatcagcattgatgatgtggaaggggcagaggtcagggtctcatacccgttgctgatccggacagggacctcatatttctttgggggtaagtgggggccaacctgaccagacctctgtttctgggtgggaaggctccatctaagtccacccagatggggccacatggagaattttggagggatcaagccctcttcccctctggggcctcagggagtggaaggtcattgccatctacactttggttgtagtcccctttcttcctttatgtctggctccccctcagcatgtccctgggggagggtctttggggtctcccctggggaggatctcacaggggtggttgctccaggttgtcccaagccagccagtcgatgggactgccactccaaccagacggcattccatggctgcatggagctgctcaaggtggatggtcaactggtcaacctgactctggtggagggccggcggcttggattctatgctgaggtcctctttgatacatgtggcatcactgataggtacccagaagcccctaacaagagatgacccctccaaagccctcttccctggtctcccagtaggaatggcctctttcaataatctcccttctccttgtctctgctccttagtcccctgcttggggatgattcttctttgatctcttacctcctatttcttcccttaaggtgatacatgctcaggatggaaatgacacatttgcttttggtcctagaggggttttttgtgctagggggatgataggggtagaataaggcatgttttgatgttttcaggaagggggaatagtagtacttgagccctgaggactgcctagtgcccctgcatctgtgcttatacccggctggctaggcggggtgtgtctcaccgggttctggggcttcaaggagctgggagtgaagcttgcagggatcagaccccactctccagctcccagtaaggctccttcccttggtcctgaccccttccctaggtgcagccctaacatgtgtgagcatgatggacgctgctaccagtcttgggatgacttcatttgctactgcgaactgacgggctacaagggagagacctgccacacacgtaagccagatgtggtatggggggagtcagggacaagggaggtcaatagaaggttgctggggatcatcaggctgctagagatggcgaggatggcccttccagccctctcgctttttgtttttggtttttttgagacagagtcttgctctgttgcccaggctagagtgcagtggtgccatctgggctcgctgcaacctctgcctcctgggttcaagcgattctcctgcctcagcctcctaagtagctgggactacaggtgcgcaccaccacgcctagctaatttttatatttttattagagatggggtttcaccatgttggccaggctggtctcgaactcctgacctcgggtgatgcaccaccccggcctcccaaagtgctgggattacaggcccgagccgccgcacctggccagccctctaactctctaactgcctttatctcaacctattatctgccagctttgtataaggaatcctgtgaggcttatcggctcagtgggaaaacttctggaaacttcaccattgatcctgatggcagtggccccctgaagccatttgtagtgtactgtgatatccgaggtaagtgtctctgttgggtggtgagggggtgaggggagaaccaggaaggatagagtggtgggtgggggccagttagactaaacaagtgagggtaaaggaggacagaggggaagggcatactgaggaatttgtaacctagccttaaaagtaaatcccaagccaggcgtggtggctcacacctgtaatcccagcactttgggaagctactcgggaggctgaggcaggagaatcacttgaacctgggaggtggaggttgcagtgagctgagatagcgccattggactccagcctgggcaacagagcgagacttcatctcaaaaaaaaaaaaaaaaaaaagtatatcccagcttccttacccattccagctatcttatttccagcctacaatgcagagtgcccagggcagaggtggaatggagctgctggccacgttcagtggctctgagttgcagcagcggtggtggaggtgggcagggagatgggtagagaatgcccaactccagccaaagctctgtcccctcttgtctgccagagaaccgagcgtggacagttgtgcggcatgacaggctgtggacaactcgagtgacaggttccagcatggagcggccattcctgggggctatccagtactggaatgcatcctgggaggaagtcagtgcccttgccaatgcttcccagcattgtgaacagtggatcgagttctcctgctacaattcccggctgctcaacactgcaggttagggctggggtcagggaggtggcggaactggaggagacaccaatgggggcctgggagaaggaagccagagagccagctggggccttgggttggaagattcaaggaggggtctgaactcgctggaagggcgagaggagcccagaggctaatggagggacagggcctggaagctgcctgcacctcttccccaggaggctacccctacagcttttggattggccgaaatgaggagcagcacttctactggggaggctcccagcctgggatccagcgctgtgcctgtggtctggaccggagctgtgtggaccctgccttgtactgcaactgtgacgctgaccagccccagtggtgagggggcaaagggacagggtttttaggactccgggagtgggaggagctgagtggctggggctgagccatgacatcctgcccccacaggagaactgacaagggactgctgacctttgtggaccatctgcctgtcactcaggtagtgataggggatacgaaccgctccacttctgaggcccagttcttcctgaggcctctgcgctgctatggcgatcgtgagtggcagtccccttttgtgtgccctcccagagctgactctccagtttccaaaatctaggccgcatgtcactggtggtctctagctggggtgcccgacccccagctcctgctgtgatgcgatctcattacccctctgcacctggctcctctttcattccactccttagtctcccctccgtcacctcaaaccctccccctttgcccaaccttccctgcccccaaccccaggttctcttcctcctccaccctccaatctccctgacaagaccttcctccatctgcttttctaggaaattcctggaacaccatttccttccacaccggggctgcactacgcttccccccaatccgtgccaaccacagcctggatgtctccttctacttcaggacctctgctccctcgggggtcttcctagagaatatggggggcccttactgccagtggcgccgaccttatgtgcgggtggaactcaacagtgagcaggcagactgtgggagggcctcggggtagatgaaagtgctgtctggggagacaggggtaggctggggttggagccaagggcagatgcccttttgacaggcagcatgggaagggttgagataccctatgttctagccctcactcggtcttgacggctggctgggtgaccctaggcattcacttggcctctcttggccttaagccccttccttgtgccataaggaagctggaccttcgagtccctctcaccgctgattagccatgcttctagcctgggaagtgaggctgggaagctggcttcagggatctgtgatgtggggagagacaaagggtatgaggtttttaagcagctggtaagtttcaatgcaagctacagacaaattggagggatattcaagaagctccaaagaggtgagggaaagaggttatattgggcaaggatctatgaagggtcttgtaggtctgagtccttttctcccctaccctgcatcacactgtccagcatcccgggatgtggtcttcgcctttgatgtggggaatggggatgagaacctcacagtacactcagacgactttgagttcaatgatgacgagtggcacctggtccgggctgaaatcaacgtgaagcaggcccggctccgagtggatcaccggccctgggttctgcggcctatgccactgcagacctacatctggatggagtatgaccagcccctctatgtgggtaagcagcaacccagaggcaagtctgaagcctcctttacctccccatcctccaaggccactcgccttgtttccaggagcctcctgtcttaggtgccagtcccctctgcttcagagcaagccagtgtctcacttgtccctccaggcctttgtatcctattctattcttccagccctcttggctccctttccaactacaatacttcatcctgtctctggctctgcctccatttcttttcttttttttttttttttgagacggagtctcgctctgtcacccaggctggagtgcagtggcacgatctcggcccactgcaagctccgcctcctgggttcaagcagttctcctgcctcagcctcccgagtagctgggactacaggcgcccgccaccgtgcccagctaattttttttgtattttttagtagagacggggtttcatcatgttagccaggatggtctcgatctcctgagctcgtgattcgcccgcctcggcctcccaaagtgctgggattacaggcgtgagccaccgcgcctggccctgcctccatttcttgacctgttgcctacccttcccaggatctgcagagcttaagagacgcccctttgtgggttgcttgagggccatgcgtctgaacggagtgactctgaacctggagggccgtgccaatgcctctgagggtacctcacccaactgcacaggccactgtgcccaccctcggctcccctgtttccatggaggccgctgcgtggagcgctatagctactacacgtgtgactgtgacctcacggcttttgatgggccatactgcaaccacggtaagtgctgctggttatggggcaacagggagccatagggtgtaatgggatgtagggagggcagggaaggaaatagcatgtaaagcccatatcatggaaaattagagttgtccctggattcctgagctctgagtttggggagttaggcagttgaagatcatgggtgactccaaaggcatggacaaggaagggatggtacagatagctggtgcaaaaatatctcaaaatcaccaagtatgctttgggagcccaaggtgggaggattgcttgaggctaggagttcgagaccagcctgggcaacatggcaagaccctgtctctacaaaaaaaattctttttttttttatgagatggaatctcgctctgtcacccaggctagagtacagtggcacgatctcggctcactgcaacctccgcctggttcaagcgattcttttgcctcagcctcccgagtagctaggactacagatgtgcaccaccatgcctggctaatttttgtatttttagtggagatggggtttcaccacattggccaggctggtctcgaactcttgaccttgtgatctgcctgcctcagcctcccaaagtgctgggattacaggcgtgagccaccgcgtctggccaaaataatttcttttttcttttttttttttgagactgagtttcactcttgttgcccaggctggagtgtaatgactcgatctcggctcactgcaacctccacctcccgggctgaagcgattctcctgcctcagccttccaagtagctgggattacaagtgtgtgccaccacacccggctaatttttgtatttttagtagagatggggtttcaccacgcttgccaggctggtcacgaacttctgaccgcaggtgatccacccaccttggcctcccaaagtgctgggattacagacgtgagccacagcgcctggcaaaattttttaattagctgggcatggtggtgcacacttaggcctagctactcgggaggctgaggtgggaggatcacttgcacctaggaggtcaaggctgcagtgagctatgatcgtgccactgcactccagcctggggggcacagcaaggactgtgtctacaaaaaaaaaaaaaagcaaatcgcttctccatcttcccaccatcaccatggtaacacaggcgaactcccttgtcaatgtatttgatgattgctgcattcctaaaacatgtcaatgacccagttcttggttaaggtgagccttgacattccccatagcaagatcctacacacatgccaagactgcatcctccctaaggctggcctatagggaggatatatgagcaggtgggttactggtgggaggagtgtgggggactagggagatataagacttagggaccaacagatttctggtggtggtttggaagtgtgagtagtggcacatatactacatggggtcaggatatccccatcacccaggctggagtgcagtggcatgatcttggctcactgcaacctctgccccctgggctcaagcaattctcctgccttggctttcctatagtagctgggattacaggcatgcactaccacacctagctaagttttgtatttttagtagagatggggttttgccatgttggccaggctgttctcgaactcctgacctcaagatgatctgcctgccttggcctcccaaagtgctgggattacaggtgtgagccactgtgcctggccttactgcgtgtctttaagcaagtcactactcatctctgagcctgtttccccatttgtaaaatgcaggggttggatcagatgatctccagtttcccatggctgtaagattctgttctgtgacagaggggctcaaggggacctaaaagtaaatggagggttgtgagggtggcagaaactgaagtaagtctcaggatgtgtgtatggatgacataaaacctctgaattggggagtgagcagtgtgggggccctaacctccctgcttctacctgcagatattggtggtttctttgagccgggcacctggatgcgctataacctacagtcagcgctgcgctctgcagccagggagttctcccacatgctgagccggccagtgccaggctatgagcctggctacatcccgggctatgatactccgggctatgtgcctggctaccatggccccgggtaccgcctgcccgactacccccggcctggtcggcctgtgcccggttaccgtgggcctgtctacaacgttacgggagaggaggtctccttcagcttcagcaccagctccgcccctgctgtcctgctctacgtcagttcctttgttcgtgactacatggctgtgctcatcaaggatgatggtaagctctcccgggctctctcaccccactccagcttcaccccggtgcccctaattctcctattgattcacaaatacaaggacccacgtgctgttagaagataggagtcatggggcctgagaccccaaatttcttctccccaccccacagggacccttcagctgcgatatcagctgggcaccagtccctacgtgtaccagctaaccactcgaccagtgaccgatggccagccccatagcatcaatatcacccgtgtttaccggaacctcttcatccaggtatgcatagagggaggtgagccagttcagatcataacctcatggtctccgttgtggcatccaggaaaacatcaaatacttaatatttgtagatcacatttgaatgtatagaggattttcacgtgtgtcacctcatgtaaccctcacaatagctccaaggggacaataggcatttttttttttttttgagatggaattttgctcttgttgcccaggctggagtgcaatggtgtgatctcagctcactgcaacctctgcctcccgggttcaagcaattcttctgcctcagcctcccgagcagctgagattacaggcatgcgccacaacgcccagctaattttgtatttttagtagagacaggagttctccatgttggtcaggctggtctcgaacacccgacctcagatgatccgcctacctcagcctcccaaagtgctgggattataagcgtgagccaccgcgcccagccagacaataggcattcttatttaagtgttttacaaatcagtaaagagcctcagaaagtaaagcggtttcagctactcaggagggtgaggcaggaaaattgcttgaacctgggaggtggaggttgcagtgagctgagatcgtgccactgcactccaggcctaggcgacagagtgagactccatctcaaaaaaataaagtggtttacccaaagtcaaaccgctggtaagctgcaaagatggggcttaaaaccagggttttaaaaaatatataggccaggtgcagcggctcacacctgtaatcccaacactttgggaggctgaagtgggaggactgcttgaggccaggagtttgagaccaacctgagcaacatagcaagacctcatcttcacaaagaaaaatatttaataaataaaataaaataataataataaaaatatatataccaaatcctacatctaggcccaggggttgcccacttcagattgagctaggactcacccagctggcaccgccagtttggacagaatgagagatctccagtatctgcccccaagtatattcccagggtccacacagttccagtccagcccacaggcatctgcttctggtccccgctccctcatcgccctccccctccccctccccacctcaggtggactacttcccactgacagagcagaagttctcgctgttggtggacagccagttggactcacccaaggccttgtatttagggcgtgtgatgggtaagctgcgggtgcggacgcgttttaggcaaggagctgtggcatatgttcctggatcctcaaggaaagtgaaggccctgggaatggctgagggcagtgggaaggatgagtgggaaacctgtggacagtgagagtggcagggcctttgggtccaagtccctctttctgggcctgcctctctctcagagacaggagtcattgacccggagatccagcgctacaacaccccaggtttctcaggctgcctgtctggtgttcgattcaacaacgtggctcccctcaagacccacttccgaacccctcgacccatgactgctgagctagctgaggcccttcgagttcagggagaactgtccgaatctaattgcggagctatgccacgtcttgtttcagaggtgccacctgagcttgatccctggtatctgcccccaggtacattcccaggacacagaggacggaagggagggatgacacggaagggaatgattcttaacatggaggaggcatctcctaactggtgctttctcctctccagacttcccctactaccatgatgaaggatgggttgccatacttttaggctgtgagtagcactgatcactaagctgacctcccaagactaccctctgactgtcagcatcctttccctgcccctgatccccaaggctgcaggatggcaaaggcactagatgcacaatggcacaaaggatgatgagacaggctatgctgaaggtgccatataactgggcagagatttttagatgtttgaggatgagacaggctatgctgaaggtgacatataactgggcagagatttttagatgtttgaggatgctacagatttttaaataaaatattaaaatgagactatagctaagggatgggaaaatggggatacagtaacacctagagagataagaaattggggtaactaccagggatgtggaaagagaatattagaaacagaaggtggcagggggtaagccaggaattcaaacctgccagacacttgagatgagtttagtgtggtcgaacagctaactgagggtcatacattatgcttttggccaaaagtaaatgtgtgtgtgtgtgtgtgtgtgtgtgtgtgtgtgtgcaggtgaaatcccaaagtgtgtgtatgtatacaggtgaaatctcaaagagtgcgtgtgtgtgtgtgtgtgtgtgtgtgtgtgtgtgtatacaggtgagatcccaaagaatctgaattgtcccttttcttcttttcagttttggtggcctttctgctgctggggctggtgggaatgttggtgctcttctatctgcaaaatcatcgctataagggctcctaccataccaatgagcccaaggctgcccacgagtaccatcctggcagcaaacctcccctacccacttcaggccctgcccaggtccccacccctacagcagctcccaaccaagctccagcctcagccccagccccagccccaactccagccccagcccctggcccccgggatcagaacctaccccagatcctggaggagtccaggtctgaatgagtcagaagggcttctgggaccaattccagctcctgacattcccccagtcctgcctctcccccatcctatcagggacatttggctcctcttagctggctctgctcatccagaggatattcccccatcccccccccatcaagtttggtgggcagagctacagatgggacccaagggagtggccgagcctcactgcctaaaccaatgcccttctcatccctgtttccccaggctcctggctgtttatctgccccaaaggagaagcctcatggggttgacataggtcctttctgccatctctgttccagctgctgtcagggattaacaacagagtgtaggggagattaactgcctcccttccaatagacactatcagcagggacagatgtgtgggagtgcagggctgcagagggtatggggggaggaggctgctaaaccctatcccccagcctcccccctgccctgaagatcttccatttgcttccactcagctggaggctcaagagggcttgatggctgtcccctgcccccctccttttgttttgtacacagagaccaagaggcctcagtttagcaccttagtacctccgctgcttcacttgctttagccaaagccataaaaaacctgcaacgtagagaaaataatgcagataccctgactagccagccctctactcctccaaccttttccaagatatgcaatggcctttgtgcctgcccaaaggcttcgccccctccagtgcatgaggaaccctctttcctccgctcagagatgctgcttcatttacccaggaggtcatattctttatatatattttttgttgcaaagtgtctctctagagaaactctatatattattcgaatttttaaattatttgtttatatataaaagaaaagctcaattggctgtgctgtcctgtgctgtgctgtgcccacagtctgtagtttgcctttcctgtgttggaagtgtcgtgagtcctgctggtcacccaccagcctggtccggcctccactctgaagcagggttgagcctgctgtgctctcagacgcggagccgttccaataaagcagagtggcagagccccagtctgtgtgtggtagctggcgtcgtggttaggggataagtgggatgattttaagggaactaatctgagggctcaggaatttctagaaggagctctcagaatccttgcatcaccttccagggacttgactgactggctcttgccagaacccccatctccccctttcccagatctcagtgggtaagtggggatcagaatgctgatgcttcggcccaacctgctcctggaccccatccctggatccttccagccccaaagcacacagtacacaacttgccaaaatggattctaacactttattaagaggtcacaagccacaggactttaaagtgcatgaaatttattggcaatgaagccgcatgtataccaggctcccctagtccccaccaccttgccccatccatcatgacgtggtggggaggggttgagacccatctttaaaagtgggggacagcagggacaaaggatgggaaactggaggaacaggagtattcatgaactgaagctgggacaggagactgaccacagtgattctgctcactgaaggaagggtggggtcagtctagtctctcaaaggctggtgaaaagttttttttcacctattcctcacagcgagcccctggcatttcaaatagacctaactcctcctcttcatctttctctggttttctcctctatgagtaatttggaacccacagtccagcttgagggtatccctgatatgcacaatgaatacaaaccacggcggatgcagatttcaggatcatgctggggcctggcccatttgggtgggaggagctttctgtcaggagttgctgggtgcggggtacatgtgtgccctccagtgtggtgagtgagagcatgtgagtgtgtgtgcatgtcccataccaaaccgtaagaggcagctgggtcaggaggaaccccacttcttccttcatgggacaacaagtggagtgggaagaagcggggctctgagtcccagaaagaagggagaagcctgctccctactgtaacactcccaggccaatctatacccgcccacaccctttctactcaacatactgctccttgttcccagccagcccggcacacccaccatggacacagggcagctcttgctggccccattcacatgaaattcttctgtgtgaaactcactcgtctgcctctcccaggagatgagacaggactggaggagaatctcccaccctctcttcttccccctccctcaggagtgggatttaggcagggaccctagagaccttaggccaaactctaccccaatctatagaccttttaaaagaaatggttaaagtgctttgctctgcatgaatgccagagagggtggcaccacagcctgggacaggtggtctacctgcttcttctcccacttcagataccctctgccagtgtgccctgcacacggggtgccagcctaaacgcgtgcaatttagcccctcaccaaccttggaacatattctaactcaccctttccaaacagcaggcactacagacaggaaagcagattacaccaatctttctcctctctagtccaagcctgtgcccacctaccctgaagcgataagcaacactggccattgggccttgcctctatggggaatggaaggcctgaaaacacccacaaatccagcgagccaggatgctcacacctgccaggcatacccctaatgcttcttcaatagcagcataatgcttgcctgcagctgctaagccagaactttggaggagctggagcactggtgtctgttcccaggaatctgaaaacacttctccatctatctccagagtacacagagaaggc

SEQ ID NO: 12267 - DNA, 17282 bp, Human
aaaatccccaaccaaccagctgagctatgtacatagtccatttctaggcaaggtcatctaggtgccgttttaggtagatttgactcacaaaggaagcagacagagtgggtctaggaggtgtctaaaaggtgcgttggtggctgccttgatgagctcccccacaccttgccacaggctacagaaacatgttttaaaaagacatatgtgcaatagttacacatttccgcctcccatcttttcagcacctatctctggagtctacagagtttccatctgtctggtctttgcttcagaacctgggtgctgcttgccagccctctcctaacctcgcagcccccctggctctccatacgtggttcttgacatgaattgatccgggctgtctctgtgaatcagcctcaagccgagactctgcattaaaaaatatatatattgaaaggttcgtggtgaggctgccgagttaatgctaacaaaggacttcagagggcactgtctttctttgtttgcaaggagcgaaatttctcggcgcaaataccaggaaggaacaaggataaaggaaaatgaaattagaatgaagaactgacagtcttggtttcagcagtctggactctggaagcgccatgtggggcctccttagccagtttaaatcgctcctgcgcctagtgttttaaagcaagctgggaggcgaagcgcgggcgcttggggacgcggggacccggggacggaataaactctgtcgtggggccctcactctcgagctgcagagctgggacattgttgctaagtgactacgagccaggcaattcacatctccctgggcctcggttccccacctgtaaaacaagggggctggaccggtcatctatcccgttcatttatagacttagctccaaataccgaataaaagacagatattttaactcccagtggaaagacaagcctctagttgcaaagataaatgggattcgtaaaagtgatcaccacgcgagattatttttcgaatcgccttcccttctcctgacacgcgggactattaaacgtgtgtgtgtgctgggccatttctttactgaactccaaactaacaccaccgagcgataaaaaacaggagaaggtgatggaggcttaatcgctaggagaggaggcggcgtggctgctgctttgaggagttcactttgaatcaagcggccgcggcgattggctgaaaagcacgtggtgcgcgccccgcaggactgcgccccggctgcccctgcagtcgcctggcttagggcagagtccagccgggggtgccgcacccactggggagtggggagggaggacacataggaaatgcctggggctggagtctctttggctctctgccagcaagaaacttaaacgtcctggcttgctcaacccgagtgtccctaaactgtccagacttttgcccgtccattgccactatctctccccactctgggtgtcctacccaaggcgctgtctatgcgtgcccagggcctgtcctgcggatacccagctcgccccttgcagccctttttagagcatctcgcgggctctggcatcaccaagcgcacagccccgggctgcgctcccctaaggtgggtccctcagatccggggctgtccattaaccaggctggcccaaagaggcgcagacactcgaacccgggaaaacttattttattctcggttcccggggttgcagctgccagcggctgagacagtgcgtccgctttgtctctctgcactccccgcagcccccctctcccgcttcctctcccgattaactcccccgacacgctcttctctagctcctctcctcctcccactccttctcctcctcttcctcctcctacaccacaggccgcgctaatgcgcttcctccctcccccggtgtcggtctctttgcatacgcgccccctcccctccccgccgcgccacttatagcggggcgcacggcggcggggcgcagactgctctggcagccggagaggaggcggtgcggcggtggcgctgcggagacccggtccagacgcctggcggccgccggcacacaaggcgctttctagctccctcccccgagcgcacagcccgcctccttccgcggcgcctgcagtggcaggcttgctctgccctaccgtgacgcgctccggagacgctctgcgggtcctggacaccgggtccgcggcgtggggacgacagacggaggcgaacgccatcggtagccggtccgcgagccatcgttcggggcgcagtcctctccccggctggccctcctttctccggggcattcgccaccgcttccctgggctgagacgaccggttcgtcgcctccttgcccgtgaccgtcgctagaactcagttgtgcgttgcggccagtcgccactgctgtaagtttcccccactgccccggacctgttgcaggcgctgcgggcttcaggggctgcttcggctgcaggggtgtgttcgcgaggggtgagcgtgctccgagcactcgggagcttcgactagagggcaaggggagctcttctcggtgcggagatcacggtgcccgccgctgccctcccacagcaggcagaagccgggcatcgccggagaggtcgaccggcctcccctccgcggtgcaatgtctggggcgagccgctggggaagcgaggagccgagctaaggatacagtcagcctctctcctctgcggaaagcagcgctttcctgggggtgaatgtcgcgctgcgtcgctccccgcagcctccagggccgagcgcgcgggatggttggcccacgttgcatcctccccggcttggaggaaagttggggccatgcacagacaccctgagtgcgggcatgttcactgcggcggaaatgtctatagagaatgaatgaaaactgctttctgaaaaactagtttcttgatctgtcgtgttaacattattagttacaaaggataggaattggtgggcctgggatgaaacactgaatttatccacatgcggtttggtgtcacacaggcatggccagcttgttaaatagcgttgcaagtgttaataaaaagactctggcaagaagctacttttgttaacaagatctttataatgttctattgttaccggtaatgtgaatgcccagaaaaaaatctgcttagtttctcttttgattggattgagatcatgttcaaaacctggagaagggtgcgggacgctaagcattggaggcagagagcctgagttaggagcatgaagtgaactgaagttactgtaactgaagcccttttgatgttcacagtaatagcagccctttctctgtcttctttgcagacgtaggttaagtacatgtgtgcattttcttggccacttacttggtatgcaaatgtgatttctctgggggcttaaaaatgctcgaaagatgattcattttatgttgaaggtgtgttcagtgacttgtatacatggtttctgctgatattttgaggtttgcacagttttaaaccagaaagcaagtatttcctcttgggtttccaagtttactttttattttaatcaaacattgttgcaagaatgttgattgtgattttgactgtgacgtgcttttccatctggatggtatccaagatgacaggctaggctcttccttctggcttgttgggccaacctggaacatacaggagcataaacacaggatgcggagagatgtagatcctatatcctaaggtcttctaagcaaattgttttcttaggtgtaagtctggttgtgaatgttgttttgcaccatcctgaatttaatgttcaaggaaatgtgttctgggcctagcatgattccagctcaatgtgtaagcattttggtgcctgtgcacctagtttcagggagcctcattcttccttcactcagggcagcatttgctctgagagaggcggcagattcacaagagtaagtagacagtctattgaggtttaggtttaaagtcttcctccagatactccagattgaatgtactaattaaaatagcaactacagtggtggagcattgagaatgctaatgaatgttttaaccctttggaaacctgatgcattcccataggttcatatggtcattctccaaaacactgggcattggttagaatggagtagacagtagatgcttagcttgaggtgggagtgaagctggctcctcaccattttttatatctcaagtcactgtggaaattactgggtgctttgtaaagtcttcctaacactggagctctaggactttgttgcttcctttcttccactaagccatgtttactcatcataaaaaattacattccaaaaaggaaagaaaactagttgcatcacctaatggtatgaggtatatgtgtcatgcccctgcctttgtggttttctgtgcagtcttacagtggggctcacatctggttggggaggtgcaggttagtattttagcccatgaatctgtggcaaatcattcatttgcatttattaataattcttagaatatgcatttaaaaatgtctgaatggttaaaggaaacagagtttcagctgcgctttcgggactggctgttatgtgtctggaacagatactgcaaccagccacacagtttaccctctggggataaacagcgggataaacagcttccttaggaatccttggacaggcaggttcttgaggacttcattcctttgaagtaacagagggatggtgtaaaagaaaaggatgaaggcatgtgattcagtttttgaagatgggtgacaagcatttcctatgtctctaccctactgttttcttactgaagaaaaccaaaagatagcattagattctactataatttcaatgtagataccaaggaaagcactgtagtcagcaaataaattctggggtggccctaaattaacaacaggtggcaaaatacacacacacacacacacacacacacacacacacacacgtgttttttgatttaaataaagcagtgtttgcattttgaactccttctatgcaggtgtcagcatttgcaggtatacaggaacagtcctagtgatgcactatttaatcaaaagacggatggatcttttgttcttgcagctggttttccaagaattgatataaagcgggaagaacagaaaacagcagtcataagtatgctactcaaaatattcttctttttatgtgccaaatcctcacattggaagctgtcccgagcaagacaggtagttggtgattatggccagaatttattctgtgctttgactaaaggcttgctgatcaatatatggttaatgttgaaattggggtgcttttaggactcttcagtggtagagctgtctggttagaaattaatctttaagttgggatgccgaggtgggaggatcaggtgaggccaggagtttgagacccggtctctacaaaaaatacaaaaaattatctgggtttggtggtgcacacctttagtgccagctactcggaaggccaaggcaggaggatcacttaagtccaggagttcgaggctgcagtgaactgtgattgcaccactgcactcaagccagggtgacagagcgagacttggtctcaaaagtatatataaaatgaaatacattatctgtaacatttaaataaaggtctgatcattgcagaagttggccttacatttcccatttactgtatgtgctgggagattggatcttaccaaaggaattcttaatggaattaattattaggtgtttgttttacgcatggctttatgttgcatggggcatgaaagccagtgcccatcctggcattataagagcaggagacctggcattttaagtggcccgcagtgaatgagctggactaggacagggagctgtgggaatgagactcactcctcttggcttttgctgacttatattctaaaagacttcgatggcctgaaagttggcaatcaggttttccaagatgaacctgctttttatgcagtgattttttttttttttttaaacagtgcagagttcaaatagctcaacagtattagcagtgaatatccttccttccgggtagttgtctctggctttgtcctggaatggccatacactattctagaatagtaggtggcatggtcaacaacaaagtgttctgttttttgtgcaaaaccattgttgctttcgttctgctgttctgaacatcaggagcatcattttcaatttattattattattatttttaggagtggaagcaaaatgtcagtcagtgtgcatgagaaccgcaagtccagggccagcagcggctccattaacatctatctgtttcacaagtcctcctacgctgacagcgtcctcactcacctgaatcttttacgccagcagcgtctcttcactgacgtccttctccatgccggaaataggaccttcccttgccaccgggcagtgctggctgcatgcagtcgctactttgaggccatgttcagtggtggcctgaaagagagccaggacagtgaggtcaactttgacaattccatccacccagaagtcttggagctgctgcttgactatgcgtactcctcccgggtcatcatcaatgaagaaaatgcagaatcgctcctggaagctggtgacatgctggagtttcaagacatccgggatgcatgtgcagagttcctggaaaagaacctgcatcccaccaactgcctgggcatgctgctgctgtctgatgcacaccagtgcaccaagctgtacgaactatcttggagaatgtgtctcagcaacttccaaaccatcaggaagaatgaagatttcctccagctgccccaggacatggtagtgcaactcttgtccagtgaagagctggagacagaggatgaaaggcttgtgtacgagtctgcaattaactggatcagctatgacctgaagaagcgctattgctacctcccagaactgttgcagacagtaaggctggcacttctgccagccatctatctcatggagaatgtggccatggaggaactcatcaccaagcagagaaagagtaaggaaattgtggaagaggccatcaggtgcaaactgaaaatcctgcagaatgacggtgtggtaaccagcctctgtgcccgacctcggaaaactggccatgccctcttccttctgggaggacagactttcatgtgtgacaagttgtatctggtagaccagaaggccaaagaaatcattcccaaggctgacattcccagcccaagaaaagagtttagtgcatgtgcgattggctgcaaagtgtacattactggggggcgggggtctgaaaatggggtctcgaaagatgtctgggtttatgataccctgcacgaggagtggtccaaggctgcccccatgctggtggccaggtttggccatggctctgctgaactgaagcactgcctgtatgtggttggggggcacacggccgcaactggctgcctcccggcctccccctcagtctctctaaagcaggtagaacattatgaccccacaatcaacaaatggaccatggtggccccactccgagaaggcgttagcaacgccgcagtagtgagtgccaaacttaagttatttgctttcggaggtaccagtgtcagtcatgacaagctccccaaagttcagtgttacgatcagtgtgaaaacaggtggactgtaccggccacctgtccccagccctggcgttacacagcagcagctgtgctggggaaccagatttttattatggggggtgatacagaattctctgcctgctctgcttataaattcaacagtgagacttaccagtggaccaaagtgggagatgtgacagcaaagcgcatgagctgccatgctgtggcctctggaaacaaactctacgtggttggaggatactttggcattcagcgatgcaagactttggactgctacgatccaacattagacgtgtggaacagcatcaccactgtcccgtactcgctgattcctactgcatttgtcagcacctggaaacatctgccttcttaaatgcagtacattctaaagagagtgagcatgaggtaagaagtttagctatagatgtaagtatgcatataattaggctattgtgtaagttcagtacatggagtgagatctgatccacagagactgtactgcagaagtactaccaaagctgtaaaaataagagagctggtgcccctagaacttatccacttgtgttgaccacagcctcagcccccaccatggcattagccagtggttctcagcttttactgagcctcagaatctcctgaagagctttttatttattttattattattattattatttgagacagagtctcgctctgtcacccaggctagagtgcagtggcatgatcttggctcactgcaagctccgcctcctgggttcacaccattctcctgcctcagcctcccgaatagctgggatacaggcgcccaccaccaggcctagctaattttttgtatttttagtagagacggggtttcaccatgttggccaggatggtcttgatctcctgacctcatgatccgcccgcctcggcctcacaaagtgctgggattacaggcataagccaccgcacccggccctgaagagcttttttaaaaactgcccatcccagagacttagtttcatttggtctggggtggggtccaagcatcagtatttttaaaaagtttccggatgattccaatgaacaaccaagttgagaacccctgacctctgttaagtatgccagctaatgtttattgagccctcactgtgtgcttgcagcggtgccacgtgtttcccacggatcatctcattctatcctcacaacaaccccgtggggaattattactagcttcattttatagatgaaaaaaccttcatgcattacggaggctaagctgcccgagttagcagagcttagtaagaggtggagctggttaggaagtcaatgcagggggtctggctctagggcatcagcactggagcatcgtgttgcactgccaccgaataaacttgagcttcacatccatgacaccaatgtcatcccaggtgatacttcatttatattcaaattttgcttcctcaaaccctttgtagaatgattagggtttaaaaatgtattgctcaaattcattcctagtttattctctccaaaattattagcttattttaaatgttttacttaaaaagtagccccctttaaggcgtttattacctttaaagataaatctatatctgtctttgtaaaaggttgcatgtacatagcagaaatttgtgcagataacacagagccacctaaacttcccaaactatggcctttcagagttaatcagtcaggccgaccctattgtcaaggctaacaaaagttgtgtttctgagtcatatatctgagtacataatagttgtctgtgtatttaagagtatagaatactcttggctcaaataattaataggcctacacagttcagagttcgcaaagctcacggctgctttgctgctaagcattcttaggattggccccaggaatcgcttaggcatgtgtaagtatagcccagcgcacacaggatgtgttgacttgttttggtgattcatgggcttattactaataataagagaagaaagtaactgctttggaggaactacaatgaaaacaaactcatttacttgggaacttttggctctgttttccctagtatgtttcacacctttgaaggggacttcaaagggagaaaaggagatctaggcctagtggcaagctaagcacagaggggtttcatctcattggtcttttctttccctgtcccttacagctcatttagaaacatcattaaacttggcctcactctcacatttcagcttgccattttattttctttttgagacagagtcttattctatttcccaggctggggtgcaatggtgctatctcagctcgctgcaacctccgcctcctgggttcaagggattctcctgcctcagccttccaagtagctgggattacagtgcccgccaccacgtcgggcttttttgtatttttagtagagatggggtttcaccatgttggtaaagctggtcttgaactcctgacctcaagtgatccacccatctcagcctcccaaagtgctgggattacaggcgtgagccaccgcacttggcctccagcttgctattttttttacttcttcagttatctcttccagccttcgtacagttatcagagttctgagttatgtcatgctttcctggaatgaaactccttcaaagcagcaggaacaatcagacacctcctctggggagcaactgggctaatagtgtctcacaccaaactggttttttgtagccttgctggcatctcagtaatcttgaataaacaaatgctctgaaagtggttatttcatttgagatatgaatgcatgactcacctctaaagcaggtttaaagaacctcctaggcgaaagcatcaattaacagcacacttagttgggtgttagtccagaactgactatatttgcacagaagagccataaaaattgctaccagggtggtggtacataaaaaatgacaatgggcaggctggctggaatccttggaacaaggtaaggaaattgaggcagaaagaggagagaagccacatgtgtattctggccctagttttaagttctagaccttcctgagttttaggttgcttctctgtcaaatgagtggtttgatctttaatctcctgtgatctgtcccaactcagacttgggtcaattgataggggagttaaaagaggcgaaaatacctagcccagtgcttgacgtgtagtaacttactgtgagataatggcagtggaattagctttctgtgtggtaggaaaatgaggtttctttgactattatctgcttgttatctttagacttcacttttggttcctcctttttcagcccagagtgaacatgttggcaaacacttgacttcaccctaccctgggtgtttgaactgaatcatacccttccggtcgctgggaaacagagcaagtaaagtgttaagttatatgtgaaataacatcctcttcacccttggcgctaccagtgagagagtcaagcacatgaaaactaaatttgacagggccaagtttgctgcttttaaagggcagcgtaagcgcctgatcaaagccactctttgaatttccgacagggagaatgttggttaaaatttctaaagtttactacacaagatagtgctaaaacatttaagagggggttggagtgccttaaagtgctgggtaggtgggtctcagtcccaaactgcaaattcctctgccctccaaatgtaggtgctaacggaattaatagagtgtttaacagaaagtttccctaggtcttaaagctcatccacctaggaggttttatctgcctcctgctgctctgccagtgggtgggaagggcagaaaggaaattactttgattatcctctgttttcatggtgccgtgtggcctcaacctaacttaggctttgatttgctttgtttcttctctagattttgttgttgttgttgttgttgtgtgtcctttttttttttattatcgttcctgtttgaatatgcaattttttggggggagggtgtgtgtattccttttttcctgtttgaatatgcattgtcttgaaattttatattattataagatacattcttttggcctaatgttgacatataggttacaaggaggtggaggtggggcaatgacaccgtagtctaaggcatgccttgaaagcttgaatcactgttaggaaacagccaaaagaaacaactcatgaaatgaatcaggcttctgaacacacaaaagcaaagaattcagtgcaaggtcatgagtggctcctccagaattccctttgtctgtacttagacttacagcaatagggatacaaaagccctctgcacaatttccccagatgaaatgagaaataaataaatgggaagagtaagcagtgtgaggaaatgcaagctctatgaaatgtgcaggctttgtggttacggcactttgaattgatattcacacttgatgtacgtagattctgtagcactggcatgccgtagctgctggcacctacgtgtggactgacgaactttgagaataaactccaaacttgggctgttgaggcctgatacattgtcatgtgaaaggaagcgagactgatttctgccataatggataacagagatgcatttaaataagaggattagtatgtctgcctcctagatggtaaagttaatttggaatctttcatggtacatgggccaaggagggtttgcacaggaatctcccttcttttcaccccttagtgatcactttacagtcgctctgtttaaccacagaaagaaattttatgaatgttggaagcagaagatggcaactcctaatagcatctagacatataggtttggatttgaaagtgtgtatgcttaggaaagaagtgaaggtccttctttagacaccactgtttttgtcaggccagccatctgcatggatgtgtacgtgcacacgtgtgtgcatttaaggcaagtactttaaatatctttgcacagttcctactgaacatgtaagacctttggaagcaatattgtccagctccataccaagtttaatttaaaaaaaaattttgtggctaataagaaaaatttaaaaactatggcatcacacaaatccttcatgcttttttgttttgttttttttccttttccttctatttcagctcactccatcactcgatgagataatatgagatttctacttcggagaggccaagtctaatgaagagaaaaaaaggaaaagaagttgcaagactcgaataaaatctgctgcaccttgtaaatgctctaactggacatgaaggaaaggggcgagggaggggggtgggatttttggtgcaagtagcacatggtttaaatatgaatgaacaaacctgtgatctagtccttgtcttgtaattgtggattaatgtcaatgttaatcagcccctcaaagggagagaaaagctggaccttttcccttgctgtaccatattcagcatttgatttccatgggccccaccatttatgtgtagaatttgaaatggttgtcacctctctctgaggacagagcttgaagcctccacaccagctgctgctggagattcaaagcccaactgtgggtccgagagggaagctggctgggctggctgaagaatgaagaccactggactctccgttaatctctaaggggtctgctccccaggaacgtttctgaacaatggggactttgttggtagccatttggtagatgttcttttctatttataagtgactttaaactttcccttggctgttaagaagtttgttatagatttagctatttattgttcgatgcctgcatgctgaaacaatgcctacagctgtcttcacatgtatggacgtgtgtgaatggttgtacgttttgcacattttgtggctgttgagatgtgctttgctgcacaaacatgaaaatttttgagttacaatttggagcataactggagggtgggttggggaggggtggatttttaaaatgtcaagacagggaaggatgacaaaatggaaatttaaatgacatcctagaggtagagaaaccgtggagatcgcttttctcagactcaccaacttttaatgggatttcatggggtttggttgtgctgatagggtaaggggaggctgctttctgcccttctccccactcccatctgatttacttaattcagtctcagctgctgaaatttggaaaggaccaaattgctttacagtttttttctttgtgtagtatcttgaaatcctggaaaattctatggaatagttctgtatatagggcacaagtaaaggcattgtccaaagtttatttatttatttattaccctaagaatgctttgccataaccacatttaatgggaaaaacggcagtatcacagatgtaaattaactcaccagatttactgggcctgaactcattctcttcttgctatatgatttagcaagttctagaaggtctccaagacaataattacattggcacaatgtatacttcagtgctcacccgtaggcaaatctctttttaaaaaactctttggtgcacaagtaacacatttggccacaaaacaccaaagaattgtaggcagtggcccctattgagaagttttccggtagagttggaaatcagttgtgaatacattctttgctagttggagtgcttgtttactaagcatgtgccgtcgtaggtattagtgctagtctcaaataggtgcttcccctgaggtgcaggggaagaccaaagtttgcaactcgaactgctttcgtccatgtttctcacattgctgtattttagaaaataggggttaagactgataacaaccttttacattgtgactgtgtttgcattgtctaatgacagataaatccttaacatttctctccaccttagtactttagactaattgtgtttgtccgtccatgccatgaatgagtgggctgtagttgggcctaaataaatgagctgttggaagaaaagaatcacagtactttccagcagtcagtccctggttcctagatgtgttctaagcaatgcaaatgtctaattgtcccccagtgggcatagtcagtgtcgtttatattgtagcagttacagctctgtagtttatgatgcaaatctgccaagagagatgtatgtgtcactgcatggcttctgaaagcaggatgaattttctgcagctgtttcaaagttggggtctgttcttgaatcctctattaattactgtgtgtgagccagagggagctgtggtaagggttgggcccccagcctgtagggaactttctggactcccactctttgaatcgatataggcatttggtctcactacttgaccattctcaccctgtgaaacgtcccacactttgaagcaaatacaattcacagcacagtacacacaaaaaccttggcataagacagagaaggttcttcttattttgtgggctggttgctgtagaaacacataacaaagggcagccctccacttctggtataattgtgtagccccttttctttgggcttgacacctgtcttgaataagagtgattagagctgcataatgtccctctcttggctattgaccatgtggttcacgtacaaaactctgtataagttgaaggaaaatgttcatgttcatatgtacttgtttgctatgactacattttgaggttttgtaaaactgttatttttttttttttcacaatgtgaaactgaaggtcaataaattattagagattttctcttcattatgtgtgtgggtcttcatttgaataagacacaatttgaggcattgtaaacgtgtgccttttctcgtttatccaaagaaggatcatttcagatattccgaacgtgttttatttcaccatttagtgatatttacaaaggtaattttgcatattaaataaaacttcctgaccattagagtatctctttaagcaagacaaaattcctcatttatgggttattcatagctgggaatataacaagtcacacaccatgcgatattaagacagcatactttatattggaatgaatttagttttttgaaatcctcacgtgggttatattttgacagaaagctgttagagaaggagctggagttcaatcctcttttcatctgctgacatctgctttagaaatcatttaaagtggaaatatatgcatattatttctgtactgccacagaaaagcacaagtttaacccctcagggatacttagtttgttccaagctgatggctgtcctagctggctctgcataaggccagttgaagcctcctgcccctacctcatgatggcttcatgtcacactgagatgctcctttatcacttgggttggaacccttattgtttcagtgtgcagagcaaggttgggcataaccttttctgggtagaaaataaatattacctaattgggaactctaggagagctcacaagtaggcataatgcaattacagcctttggactttgaccaagatgccagagcagatgccttgggtttgacaggaggatcattcggttctgtgctgtgtgaggctggtctagagccaagcctttggggaccagtgtcagccttcagattccaagtgcatgatgttgaagacccgtggaaaccctgttgatgacaccatatggatgacaccaaatgacagggaagaacggcgggttagttaggagttgacggatgggatttagactcaggaaaaagtcttgatgttaatccctagaggggttgagaatggttcctgtagacatgattgtgaacagatctttcattctctggagttgtttctctttatcatctcagtcggaacatgtagacagattaaaaagatacttcaaattcttaattttcattcatttggaaatttcatttcatttagatagatcacaccaaacagtagctatggtaataaaaatctggccacagtaggcaaacgggttggaggtcggcagtccagggccgggacagcacccccatgaggccatcaggcctcatgcttgcaggatggcagctgcatctcatggcatctcatctgctttccaggcagcaaaagtggggcagacaaaggggaaagggctcaggccagaggacattctcccttttactttgaatagtaatagtttacccaaaaggctcaccgggagacttacacttacctctcagtagccagaactgggacatgtgaacttcccaagatataagagagcttggggagggcagaacttttatctggcacactgccaccccacagcaatgtgatttaattagtaaggaacaaagggagagcagacgttggagggggaaatacacagattattctctgcagttggtaggcttatctactacagcaatggttcccagcctttttggcaccaggaactggtgttgtggaagacagcttttccatggatggggactgggcctggaggcggcagggatgtttttgggataaaactgtttcacctcagatcatcaggcatcagatcaatcttgtccaacctgtggcccaggatgactttgaatgcagcccaacacaaattcataaccttaaattatttgtgattttttttagctcattagctattattagtgtcttttatgtgtggcccaagacaattcttcttctaatgtggcccagggaaaccaaaagattggacattcctacactagattttcataaggagtacaaaatctagatccctcacatctgctgttcacaatagggttccagctcctatgaga

SEQ ID NO: 12268 - DNA, 30536 bp, Human
taattttttgaattttcatagatcctcctgccttggcctcccaaagtgctgggattacaggcatgagccaccacacgtggtcctaatcttaaaattattattatttttttatagagactgggtcttgctctgttgcccaggctggagcgcagtggtgcaatcatggcctggcctccactccccccatgccaagcataacaggaggcaaccactagtcagtgggtggacattcttttggggagctgtccctgcccctttggaagtggataaagcccctgccccctgtggggtctgcaggctctccacccctgccaatgtctgtgatctgggggattgtgggctgagaagggattagtttagagggcgggcaaaagagctgggcagggcagaaagaggccccaggattttcaggcagagaagtcaaagggggatgaaaaggggaaaggagatggtggagataaagtgtctgcagctgacagccttgcccctgtcttcacttgtaaggaagtttgtttctttgatggtgataaacctggcatgtgaatgcctttccccagagaatgcaccacagaggagcacgtaacgttgtatacaatttcagggggcttactgatgcaacccctttgcagaaattttaacagtgagaaaattatgacagtgaaagtgatctgacctaaccgactccattttgcttctaacccccaaactgtccatattcattcctgggcataggccaaacttacagtctttttgtttgttttttgagacggagtttcgctcttgttgcccaggctggagtgcagtggcgcgatctcggctcactgcaacctctgcctccagggttcaagagattctcctgcctcagcctcccgagtaactgggattacaggtgcccgccaccatgcctggctaatttttttgtatttttagtagagacggggtttcaccctgttggccaggctggtcttgaactcttgacctaaacttctgatccacctttgcctcccaaaatgctgggattacaggcatgagccaccatgcccggcagcaaatttatagttcaactttgaaacaaagataacagccctctcccaaaataaacccctttcttgcctggggaccagactgcttttgtaagactaacaaattagccacgagattagaaattacggtttaggagtcatgcaggtagtggccacagattctaaacctccccagttgctcctagggataacatcactactgtaaaacctaagattggtgctcaagatatttttccgatcctgcactcaatggatccgctggcgatacacagattaagaaaccggatcatccggttttgtggcccccacccagagatccactcagcacaagaggacggcttccactccctatgattgcatctccgacctgaccaatcagcactctccactctctggcccctacccaccaaattatccttaataaaacccagtctccgaattttcagggagactgatttgagtaataataaaactccggtctcccattcagccggctctgcatgaattaaactcttattgcaattcctctgtcttgataaatccgctgtctgggaaacgggcaaaatgaacccatggggtggttacactgaccctctgctgcacatcccggacagccttgttaagaacccttggtaggctgggcatggtggctcacgcctgtaatcccagcactttgggagcacgaggcaggcagatcacgaggtcaggagatcgagaccatcctggctaacacggtgaaaccccgtttctactaaaaatacaaaaaattagctgggcgtggtggcagacgcctgtagttccagctactcgggaggctgaggcaggagaatggcgtgaacccaggaggcggagcttgcagtgggccgagatcgcgccactgcgctccagcctgggcgacagagcgagactccgtctcaaaaaaaaaaaaaaaaaaaaaaagaacccttggtattattgttccacgctcccattttaccgaggtggatcctgaggcccagagtgggcaaagggcttgccaaggtcgcagagcgcgcagaggattagaaccctgacttccgtccagcacctgcggagttggagacgcccacaggaaacgcccacctgaccgggtgagtgagggggcgggcgagccggaggggtggagtttattcgcgccccgcctccgccaccagggcttgggggcggggccttcctgcaacctttgcggctccaacatggctccgcggctgtgcagcatctctgtgacggcgcggcggctgctggggggcccggggcctcgcgctggggacgttgcgtctgcagctgcggcgcggtgagagcccggccaggcagggatagacgcgcgcggggtggggtgcaggcgcgggggccagggactgggtcgtgggggaggggctgagactcctcgcttggaatctgggggttagaggcggggcaggatcaaggcctagggaggggtctgggcaaagaatgggggaggtgagaaagggatgggtagggtctttgtcctggttgggaccgggctgtgatggggacctgatgaaagatggtgagaagggcaggtactgggccctggagagtgggagagggcagaagacaggaggagtggcccattcccaggcgtagcttgtgatttaacacccactgggggcttctggtagtcagctcctccgtcgggaagttctgtgggaaagagatgatggcaggggagcagtgggggatccccaggggccatggctgcacagaccctttgttcctccacctcgaactgtacaggtggggaaacggacctgagagggaatgggagttgtccaaggtcaccctccctgctgtgccgtggcagcaccaggtctgggacccaggcctgccaatgcgccatgcactttgcacccaactggtggcctcctgggagtgggagtctggctgggccatgtgctctcagcctgggcttttgtttgggccctgctctgggctgagctagggcttggcctccctgactggccctgggcagcccctcactccttggtccccacagccctgtacttcccccatctctgcatatatgaccctgcacagttatgacttggtgcttgtctgtctctctcactagaccatgatctcatttttctctgtttccccagcctcccaccctcagagggctcaggactgtgtatggtcaaggaatatttaccaaagaagtgaggccacctgttccccctcccccaacctgtgaaaaggaagcaaccatccctcctgccctgcagcccaggaatgaagctgcaaagttctgatagtgcctgccatgagatgttacagcacagagcagtggggcttttggacagctgggaaagaggagtggcataagcgccccacctagactgcccaataattagggataaagctgacaccgtgggaaaagcctagagtttgcctggcactaacagatctaactcagactttgtaggtggggtgacctcaggactctttaagcctcgggttcctcatctgtaaaatgggagtaatcaggatgtatctcatagggttgttgaggattaaagatgctgtggttggtcgggtatggtggctcatgcctgtaatcccagcactttgggaggccgaggcaggcagatcacttgaggtcagcagttcaagaccagcttggcaacacggcgagatcctgtctctataaaaagtacaaaaatggccgggcgcggtggctcacgcctgtaatcccagcactttgggaggccgaggcggtggatcacgaggtcaggagatcgagaccatcctggctaacacggtgaaaccccatctctactaaaaatacaaaaaattagccgggcgcggtggcaggcgcctgtagtcccagctactcaggaggctgaggcaggagaatggcgtgaacccaggaggcggagcttgcagtgagccgagatcctgccactgcactccagcctgggcgacaagagtgagactctgtctcaaaaaaaaaaaaaaaaaaaaaaagtacaaaaatttcaccatgttggtgaaaacgtgtctctactaaaaatacaattagctgggtgtgatggctcacccctgtaatcccagctactaggaagctgaggcaggagaatcaattgaacccgggagacagaggttgcagtgagccgagatcacgctactgcactccaacctgggtgacagagcgagactccgtctacaaaaaaaaaagattccgtggttgtgaagtgtctagcacttgacgaacatgcagtaagtgttgctccttaacccctagcctatgtttcaagcaatttctgcatgtgacccacataatgttgaggctcaaagggctctgggaagatcatcttttatgagccctttgttttccagataaaaatatcaagattggggaagggatagaatggattggtggtaaaaccatttgtgtggcaaacacccagaggccgtaaaaggagcatgggtctcagagtcagcctgctgcccctcactcagtgaccctggatgagttgctgaacctccgtcagcctcagtttccttttctgtaaagtggggatgttggtgttttcggcaggattgctatgaagccacttgaattaatgtttatcaagtccctcaaggactgtcttgcagttacttataccttaattccacattggatacctgagaacactctgtcctgctgcccctcaggctgccccatatctctccagagtcactagtagggccagcagcagcccttctggcctgtgaggtttgggggcaatgaggctgctggggtggggatggagtgtgggctttgaaatcagatggacctgggccaggcaccattgctcacgcctgtaatcccaacacttcggtaggccaaggtgggaggattgcttgaacccaggagtttgagaccagcctgggcaacatggcgagatcctgtctctataaaaaatacaaaaatttggccaggcacagtgggtcatgcctgtaatcccagcactttaggaggctgaggcgggtggatcacctgaggccaggagttcaagaccagcttggccaacatggtgaaaccccatctctactaaaaacacaaaaattagccaggccaggcctggtgactcccacctgtaatcctagcactttgggaggcccaggcaggcggatcatgaggtcaggtattcaagaccagcctggccaacatggtgaaaccccgtctttattaaaaatacaaaaattagctgggcatggtgtgtgcgcctgtaatcccagctactctggaggctgaggcaggagaatcgcttaaaccagggaggtggaggttgcagtgagctgagatcgcaccagtgcactccagcctgggtgatagagcaagactctgtctcaaaaaaaaaaaaaaaaaaaaattaggcatggtggtgtgttcctgtattcccagctattctggaggctgaggcaggagaatcgcttgaactggggagctggaggttgcagtgagccaagatcgcgccactgcactccagcctgggcaacagagggagactccgtatcaaaaaaacaaaacaaaacaaaacaaaacaaaaaaacatgccgggtgcgttggctcacacctgtaatcccagcactttgggaggccgaggcgggcagatcacctgaggtcaggagttcgacctggccaacgtggtgaaaccctgtctctactaaaaatacaaaaattagttgggcgtggtggcagatgcctgtaatcccagctacttgggagactgagacaggagaatcacttgaacccggggggcggaggttgcagtgagctgagatcgtaccattgcactccagcctggggaacaagagcgagacttcgtctcaagaaaaaaaaaaaaaattagccaggcatggtgacacatgtctatagtcccaactactccggaggctgaggcaggagaatcccttgaacctgggaggtggaagttgcagtgagccgagatcgtgccattgcactccagcctgggcaacagagtaagactccatctcaaacaacaacaaaaattagccagacgtggtggtgctcacctgtggtctcagctacttgggaggctgaagtgggaggatcatttgagtctgggagatagaggatgcagtgagccatgattgtgtcactgcactccagcctgggtgacagagtgagaccctgtctcgaaaaaagaaaaaaaaaatagaagaaaaaagaaagatgaagctgagctaggatcaaaacctggatttgtccagagcttgtgctcataagcactagttctgctgttggtgttaaggatggaaaggacccctgatccctgagtgaagtcactctgggtcaaggtctacctttttttttttttttgagacggagtctcattctgtcagccaggctggagtgcagtggcgcgatttcggctcactgcaacctctgccctctgagttcaagcgattctcctgcctcagcctcccaagtagctgggattacaggcgcctgccaccgcacccagctaattttttgtatttttagtacagacggggtttcaccatcttggccaggctggtcttgaactcctgaccttgtgatccacccgcctcggcttcccaaagtgctgggattacaggcgtgagccaccacgcccagcctaaggtctaccatttcttttgtttcatacttttcagctttcatcattttcatgcaagaatgtcttagctcctctttcattcatttctcaaacttggactgcattctcaccatgtgcccagcactgctccaagcataggggatacagcagggatacaacagaacagacaaggattctgccccgctagggctgcctccagtttagagactgacaataaacaaagcacataataagccaaaaagtatagtgtttttttttgtttttaatttttagtagagatgaggtcttgctatgtttcccaggctggtctcaaactcctgggttcggccgggcatggtggatcatgcctgtaatcccatcactttgggaggccaagtcaggcagatcacttgaggtcaggagttcgagaccagcctgaccaacatggtgaaaccccgtctctactaaaacatacaaaaattagccgggtgtggtagcacgcacctgtagtcccagctactcaggaggctgaggcaagagaatcgcttgaacccaggaggtggaggttgcagtgagctgagattacgccactgcactccagcctgggcaacagagtgaaactccatctcaaaaaaatacaaaaaaaaaaaaaggccaagtgtggtagctcatgtctgtaatcccagcactttgggaggctgaggcaggaggatcacctgaggtcaagagttcgagaccagcctggctaacatggtgaaaacccatctctactaaaaataaaaaattagctggatgtggtggcacatgcctgtagtcccagctacttgagaggctgaggctggagaattgcttgaacctgggaggcggaggttgcagtgagcccagatcacgccactgcactacagcctggacgacagactgagactccatctcaaacaaaacaaaaaaaaaaaaacaactcctgggttcaagcaatccttccctcttgcgtcagcctcccaaagtgctgggattataggcatgagccactgggctaatcctagtatagcgttttagaacgtgctctggaacaagatagagagcaggaagagagggcttggggaggtcaagggtaggagaacattgtaatttcactgagaaagtgacatttgtactcttgcagatgtacccttggggatgctggcttggagttcaaaccctcctctgagatctttgacaagctccttcttggattttacctgtagaaaacagctttagggatgggctccaccaccctgctcatttgacagatggggaaactgaggcccacaggcaggaaggattagagtagtgggaagagacgggagcccatcagagctcctgaagtttccagtgttccagcccctaatctctttcttcagggctggctatttgactgatatttatcttggtcagtgctgatgttaataaattactctgtctagtcctttctagagcaaaggtcttggttgataaatagtaggagctgctctcctcactgcccatctccctccaggggaagcagcccctctacattaaaaccaaaggtcaggtccctcagtgcccaacctgaggtggggattggctttcaaggaaagagcgctgggttcttaactctgccctctgattttctgtgcggccttgggcaagtcccttaaactctctgggcttctttccattttatcctcgcgagaatgggaatactaatagtaccaatactataagatcattgcatagaatcagtgagatcctgcaactgaaaagtacatcacagatccctggcttagagcctcccttattctggtccaaaaacttcacagaccgcactacccatctaatgataattgtctttttttttttttttttttgagacagagtttcgctcttgtagcccagtctggagtgcaatggcacgatctcagctcactgcaacctccgcctcccgggttcaagtgattctcctgcctcagcctcccgagtagctgggattacaggattgcaccaccatgcccagctaatttttgtatttttagtagagactgagtttcaccatgttggccaggctagcctcaaactcctgacctcaggcaatccgcccgcctcggcctcccaaagtgctgggattacaggcatgagccaccgcaccaggctgataattgtctttttgctaatgaagcagatgcatgtacaatgatcgagagagttcatgaattcagaaatgcttaacacactttaaaatctttataaaaaattacaatgaataaagaaaaatttagccatctcctattcctctttcccaggtaagcagtattaacagtttgggacaagtaatttattttcttttctttttctttctttctttttctttcttttttttttttttttttttttttttgtgaagatggagtctcactctgtcatccaggctggcgtgcagtggcgtgatcttggctcactgcagcctccgcctcctggattcaagcagttctgcctcagtctctcgagtagctgggactacaggcacacatcaccactcctggctaatattttgtatctttttttaagtggaaatggggttttgccatgttgcccaggctagtcgtgaactcctgagctccagcaatctgcccgcctcagcctcccaaaatgctaggattacaggcatgagccaccatgcccagcctctttttttgttttgttttgttttgttttgttttttgagacagggtctgctctgttgcccaggctggagtgcagtggcccgatctcagcttgctgcaacctccgcctcctgggttcaagcgatcttcccacctcagcctcctgagtagctgggactacaggcgcacttgacactcgaccacacctggctaattttttttttttttgagacagagtttcactcttgttgcccaggctggagtgcaatggcctgatctcggcttactacaacctccacctcctgggttcaagcaattctcctgccccagcctcctgagtagctgggattacaggcatgcaccaccacgcctggctaattttgtatttttagtagagatggggtttctccatgttggtcaggctggtctcaaactcccgacctcaggtaatccacccgccttggcctcctaaagtgttgggattacaggcgtgagccaccgtacccagcaatttttttatttattgcagagacagggcttcagactcctgagctcaagtgatccgcctgcctcggcctcccagagtgctggaattataggcgtgagccaccatgcccggcccatttctcatttttatgcttatacaaacatatcaccactttggcccagcgcagtggctcatgcttgtaatcctagcactttgagaggccgaggcaggtggatcatgaggtcgagagatcgagaccatcctggccaacatagtaaaaccccgtctctactaaaaatacaaaaattagctgggcgtggtggcacacgtctgtagtcccagctacttgggaggctgaggcaggagaatcacttgaacccgggaggtggaggttgcagtgagtggagatcataccactttactccagcctggcgacagagcaagactccatctcaaatacaaacaaatgaacaaaacaaaacaaacatatcaccactttaagattatttttaaaaagaaattttttttttttttgagacatggtctctgtcacccaggctggagtgcagtggcctgatcatagttcattgtagccttgatttcctgggcttcatgcgatcctcctaagtctctcaagtggctgagactacaggcatgtgtcaccacacccggctaattattgtattttattttattttattttatttttttgagatagagtctcactctgttgcccaagctggagtacagtggcaagatcttggctcactgcagcctcaacctcccaggctcaagtgatcctaccacctcagcctcccaagtagtgggactacaggcacataccgtcatgcccagctaattttattttttgtagagacacggtctcacaagtttccccaggcttgtctcatggcctcaagcaatcctcctgcctcagcctcccaaagtgctgggattacaggcataagccagtcatatttattattttttttgtagagatggagtctcattttgttgcccaggctgatcttgaactcctgggctcaagtgatcctctgacctcagcctcccaaagtactgggattacaggcatttagccatcgtgcccagctgattttatccgtcccaatggctgctccatattttggaaaaaattgattgattttttatttgcaagacatttgtccttttttttttttttttttttgagatggattctcgctctgttgcccaggcgggagtgtgatggtgcgatcttggctcactgcaacctctgcctctcaggttcaagcaattctcctgcctcatgctcctgagtagctgggattacaggtgcacaccaccacgcctggctgatttttgtatttttagtagagacagggtttcgccatgctgggcaggctggtctcgaactcctgacctcaggtgatctgcctgccttggcctcccaaagtgctgggattgcaggcgtgagccatcacacccagcctaagacatttgtctaaccacataaaagtcttaaaaagggatagggcagccgagtatttgtattgtaaaaatacgaaaattacctggatgtggtggtacgcgcctgtaatctcagctactcaggaggctgaggcaggaaaattgcttgaacccgggaggccgaggttgcagtgagccgagatcgcaccactgcactccagcctgagcaacaagagcaagactctgtctcaaaaaaaaagaaaagaaaaaaagaaaagaaaggatagggcttcctgtgacctcacttggaaaaaacaaaagagaaaaaagaaaaaagggataaggcttgctgccactcagggatccctcttgccaggctccctggctaggaattgtctccattgggagacttccttttcaggcctggctgcaagctgcaccaaggctgtggagcgggaagattggtagtctcaaaataagcacccctgcctcctgctgggaccttgggtatgtgtttaggatgggagtgcagttctggtccagtaggagctggcagcagaccctccactgcccttaaccacagtgctcatgggcaaagcacataatcatattcattgatcattcattcattcattctcagtatcctatggagatgggcagagcaggtgttggctggatgagtgaatgcatcttgctttgcagtgccttttactccctctatctgccaaaccagtcctggggactgaccagctcatctcctcctctgtagagagtctgcccaggttgccagaagcagagttaaggctagttcacctgggctcttccagagacccctcctataattgtgtcccaaggcccatttctcctagtggactatgagctcctcaaggacaaagcttatttgtatttggctttccatgtgtggggtcagggtggggacatgggccaagtgcactgtgagagtgctggggaggacggtgagagcagtcttctcgttagaggggacagaacttgtacagaaagcacagagtagcagatcctggtgtgttcagggaagagcacacctggagagtgaggtgtacaggtgagggggcaggaggggaggctgacaagttaggttgggttgtcaagggctttgggcatgatgcaaggtggatttggggttgatcctcttggcgagaggctggagttatatgacccaagtagaggacctcttggaagggggatgaagtggaggcagggaggctagagagagaagtgggaggtggggctgcctctcctggcgtcctgaggctctgcaaagcttcaagaagccaactgggcagctggaatatctgtagaaaggagctggctccaatagcatttcacagtctggagctgccacaggactccgtggccctgttcccagaaatgtgggtcactggtctaggggagcaggacatccaagtggatggaattgctggggctcccccaacctccgcgcgtccccctcaactcctctgtcctgcagtttctattccaaggacaatgaaggcagctggttccgctccctctttgttcacaaagtggatccccggaaggatgcccactccaccctgctgtccaagaaggaaaccagcaacctctataagatccagtgtgagtggctgctgagctgaccaatttctgccctttcaggggctctgggggcctgtgaggctccaggaaggagatgggagggtctggaatgtcctcagctgtcctgggacccctggccttgatgggctcccctcaccccaagttcttccctgtgtacacaccctacctcacttcttgttctctgtcctctgttgcagttcacaatgtaaagcctgaatacctggatgcctacaacagcctcacgtgagcaccctgcatccatacatcccatcccctgcttgggtggggaacacactttcagcaaatttgcggaacatcctccaccctgttcttttctgtagaaatccaggagatgtagatttcttttatttctgcctttttctttctttctttctttctctctttctttttttttgagatggagttttgctctcgttgcccaggctggagtgcaatggcgcgatctcggctcactgcaacctctgcctcccaggtacaagcgattctcctgttccagcctcccaagtagctcggattacaggcatgcgccgctaagcatggctaatttttttgtatttagtagagacagggtttcaccatgttagtccggctggtcgcaaactcctgacctcaggtgatccacctgcctcggcctccgagtgctgggattacaggcatgtgccactgcgtttggccccattttctttctttctttttttttttttaagagatggtctccaggaggcggaggttccagtgagccgagattgcgccattgcactccagcctgggcaacaagagcaaaactctgtctcacacacaaaaaagagagatgggatctcactttgcttcccaggctggtctcaaactactgggctcaagcaatcctcctgcctcagcctcccagtgttgggattacaggtgtgagccactgtgcccagccaggatgtaaatttcagtgtcggaagtcctgagggcctcttgcctagcttctgcattttagagatggagagtctgaggcccagccccagggtctgtttgaactgagtttgaacccttatctcagaggccctggtggctatgtgaaccctgcccctctctgcacctcccccacagggaggctgtgctgcccaagcttcacctggatgaggactacccatgctcactcgtgggcaactggaacacgtggtatggggagcaggaccaggcaggtaaggcgctcacctccctagtgccattgccactgcccagccctggcctccagcacctttcacacctggctgttctccactccctctccacaacagcacctggtggggctcttactaaaacctcatcacctcactcccctgctcaaatacctgtcctggctcccctgtgccctcaaggtgacccgtgaagcctgtgactccttcccggccctgcccccagcctcatggcaccaaatcctccatgcctcgctgtgctgtcccacccaggactcagttcctcagattgacagtttcactctttagttccagactactgctcattctctttcttctgccttaagcattatttcttgtttgcctgctttacctggatcactgtcttttattctttttttttccgagactgagtttcactcttgttgccccaggctggagtgcagtagtgcaatctcggctcactgcaacctccgcctccccagtttaagcaattctcttgtctcagcctcctgagtagctgggattacaggcatgtgccaccacgcccagctaattttgtatttttagtagagacgggatttcaccatgttggtcaggctggtcttgaactcctgatctcaggtgatccacctgcctcagcctcccaaagtgctgggattacaggtgtgagccaccgcacccggccttttttttttttttcttttttcttttttgagacagggtctcgctctgtcacccaggctggcagatagtggcacagtcttggctgactgcaacctccacctcctgagttgaagatattctcctgcctcagcttcccgagtagctgggattactggcctgtgccaccaggcctggctaattttgtatctttagtagagatggggtttcacatgttggtcaggctggtctcgaacttctgacctcaggtgatccacctgcctcggcctcccaaagtgctgggattacaggagtgagccaccactcccggcctttttttttttttttttttttttgagacagggtcttgctctgtcacacaggctggagtgcagtggcataatcttggctcactcgagcctcaatttcccaggctcaagcagtactcccacctcagcttcctgagtagctgggactataggtgcgctccaccatgctcggctaatttttgtgttttttggtagagacggggtttctccatgttgcccaggctggtcttgaattcctgaactcaaatgatcctacctcctcggcctcccaaagtgctaggattgtagacatgagccaccgtgcctggcctttcagttttattcatttttaaattttcatttatttatttatttttgaaaccaggtcttgttacccagtggggagtgcagtggtgtgatcacagctcacacagccttaacctcctgagcttaagcaatcctcctacctcagcctcctgagtagctgggaccacaggtgcatgccacaatgcccaactaatttattttaaattttttgtagagacgggatctccctatgttacccagggtggtctcaaactcccgggctcaagcgatccttccactttggcctcccaaagtgctgggagtacaggcatgagccacagtgcctggactattcacttttctattttggcatagatgtcacctcctcctggaaggctgccgagatttcctccacgcgggctgggtcaggcaccttccttagctctccaggcctcagtaattacctcctcacgccctgatcatgtacccctatagctgcctgtttagttgtctgtctccatatatgggtgaatccccaatatgcagcacatatttgtggaataaataggagttcttcttgtctgagctggtgtcttacagtcccaggggcacccctagcatgccccatcccagcctaatagacacatcaaagttggcaccagctataagaacccacacatgaatttggctgactcacagcatctcagccactcaaagggacctcaaattcagacccacactgtccaaaatgatagccactaaccacatgtagttatttatttatttatttttttgagatggagcctcgctctgtactgtcacccaggctggggtacagtggtgcaatcttggctcactgcaacctctgcctcctgggttcaagtgattctcctgcctcagcctcctgagtagctgaggttacaggcgtgtgccaccacacttggctaatttttgtatttttagtagaaacagggtttcaccatgttggtcaggctggtcttgaactcctgacctcatgatcctcccgcctgagcctcccaaagtgttgggattacaggcatcagccactgcgcctggcctatttatttatttttttgagacagcgtctcactctggtttcccaggctggactgcagtggtgcaatcacagctcactgcacccttgacctcccgggctcagatgattctctcacctcagcctcccaagtagctggaactacaggtgtgcaccaccacagccagctaattttttatatttttagtagagacagggtttcgctatgttgcccaggctggtcttgaactcctggactcaagcaatccgtcagccttggcctcctggactactgagattacaggtgtgagccactgcgccctggcctcacatgtagctattgaaatttatattagttaaaattacataaaatttaaagttcaagctgtgtgccaaggtgctcacctgtagttctagctacttgggaggctgagttgggaggactgcttgagcccaggagttcgaggccgtgattgaataccatcacacctatgaatagccactgcactccagcctgggcaacacagtgaggaccctgtctctaaaaaagaaaaaattcaggactgaatatggtggcttatgcttataatcccagcagattaggaggctgaggtgggaggaacacttgaggccaggagtttgaaaccagcctgggcaacatagtgagactttgcttctataaagaaaatacatattaaaaaaaaaaagaagaaaagattttaaaaaagaaaaaattcagtttcttagtcatactagctacatttcaaatgctcactcatacacacacaggctcatgcagaaagtacttttggacagtactggtttagagtgtctgcatagcacagccataacagatggtcctctaaacttcccttgaacactcctagccatgaagagttcacttgtaagccaatctatttcatcctttgacagccctgataatcgtgtctttgaaaataatctgtgacctgcagatagataggtgtatctccttaatcaattatttggtttccgtaacagacattaacatattatttatgttttatttttattatttccatttagaaacagggtctcactatattgcccaggctggagttgaatttctgggctcgggcaatcctcctgagtagctgggactacaggcgtgtgccatcatacctggctagacactgatatgtggctaagggaataagagaaaagcaaattgccttcagtttcagccactacagctttcccattttaagcttgacttgatcagctccagcagtattccttgaattctcttaagcatttgctagttgtgaaatgaactctgagggatgggatcctgactttttcttttttttctttttcgagaccgagtctcactctgttgcccaggctggagtgcagtggcgtgatctcagctcactgcaacctctgcctcccggattcaagcaagttctcttgcctcaggctcccgagtagctgggactacaagtatgaaccaccatgcctggctaatttttgtatttttagtagagatggagtttcaccatcttggccaggctggtctcgaactcctgaccacagttgatccacctgcctcggcctcccaaagtgctgggattaaaggcgtgagccactgcccctggcctttttcttctttttatttttctgtttgggacagggtctcgctctgtcacccagtttggagtgcagtggcatgatcatagttcactgtaaccttgaactcctaggctcaggcgatcctctcacctcaacttctcgagtagctgggaccacagacatgcaccaccatgcctgggctagttgttttgttttgtttgtttgtttgttttgtagagatgaggtcttgctatgttgcccaggctgatctcagactcctgagctcaagtgctcctctcctgcctcagcctcccagagtgttgggattacaggcctgagccactgcgcctggctgatcctgactttttaaagcataccctacattttttgtaccttgaagttcagtccctcacatagtcagctgaatcatgttgagctgtacgctgggagtagggttcaagaatctacattttaataaacttgtaagaaccattgatccatctcctatggagagcaccacagttgttagacaattccttcttcttggctgggcgcggtggctcatgcctgtatcccagcactttgggaggctgaggcaggtgcatcacctgaggtcaggagttcaagaccagcctggctaacaaggtgaaaccctgtctctactaaaaatacaaaaattagctgggcgtggtggcatgcgcctgtaatcccagctacttgggaggcataggcaggacagtctcttaaatccaggaggtggatgttgcagtgagctgagatcacgccaccgcactccagcctgggtgacagaaaaataaagaaaattccttcctcttgccaatgatgctgtccttgtaacttttctccgttaatccgttttccacaggtcattcctggttttggtagatttccatccatacagtacttttgccatttcctttgggaaaaagacctttaaaccatagggtcaggccattttgcagatgggaaaatcaaggcacagatggagtcaaaaaacaggtgaaggtcaggctggggatggggatgggaagttacagagtctgagtttctagactgctggcagccagctgcccttagctctagcttgcctgtgtgatcccctggggaccttcctccgctgatgggcccagccatgctcccaggatggcaaaactgttcctttcttctcctccacaattaattaggtttctttgttactaggaattagattagtttcctggggtggccagcataccgcaaactgggtggcttaaaataacagaggtttatcctgtcacagttctggaggctggaagtcacaaatcaaggtgttgacagggctgtccttcctcctaaggccttaggggagaacccttccttgcctcttccagtttctggggattgctggaaactcttagtgttccttggcttgtagacttgtcattctaatctctgcctccctcgtcacatgctgttctctctgtgtgtctctgtcttcacatagtgttctcctgtgtccagatctcccacttctgataaggacactagtcactggactcagggctcacctagtataatctcatcttaggtcgattatacccacagagacctatttccaaataaggtcacattctgaggttctgggtgggcataaattttgaggggacattgttcaactcagtgcagataatatgatttttatttatttttatttttatttatttattttttgagacggagtcttgctcttttgcccaggctggagtgcagtggtgcgatctcagctcaccacaacctttgcatcccaggttgaagcgattctcttgcctcagcctcctgagtagctaggattacagatgtgcatcaccacgcccagctaatttttgttttagtagagatggggtttcgccatgttggtgaggctggtctcaaatttccgacttcaggtgatccacctgcctcagcctcccaaagttgattatttatttacttgagacggagtctcaccctgccacccaggctggagtacactggcacaatcttgactcactgcaacctctacctcctgggttcaagcgattctcctgcctcagcctcccgagtaactgggattataggcatgtgccaccacacccaactaattttttttttttttttttaagatggagtctcgctctgttgtccaggctggagtgcagtggcatgatctcggctcactgcaagctctgcctcctgggttcatgccattctcctgcttcagcctcccgagtagctgggactataggtgcccgccaccacgcctggctaattttttgtatttttagtagagacggggtttcactgtgttagccaggatggtctcgatctcctgacctcgtgatccaccttcctcagcctcccaaagtgctgggattacaggcgtgagccaccgtgcccggcccaggatttttataaattctaacagtacaaagagttttccatgcaaagtaagcttccctcctgcccgaggccccacaggcctccattctgtgtcccaggggcatctactgtcaatctctttttttttgagacggagtttcgctcttgttgcccaggttggagtgcgatggcacaatcttggctcaccgccacctctgcctcccaggttcaagtgattctcctgcctcagcctcccaagtagctgggattacaggcatgcgccaccacacctggctaattttgtatttttagtagagatggggtttttccatgttggtcaggctggtctccacccacctcagccccgcaaaatgctgggattacaggtgtgagccactgcgcctggtctactgtcaatctcttaagtcgccattaagaggtgatgcataaattagcatctctggatgtccttgccacctcaacacatgaggtagcataccacacatcctcttctgttccttggttccttttttcaattcactgtcttggaatgttccatatcagcccatcagttctcccctgttcttttgttcagctgcccctctaaggcctggtggtcttccttatgcatgccactgcttccagggtacaggacacatctgatcttcttgttgctatttaaggaaggtggggtgggaacattattcccattttcaagatgagaacattgaggcctagagcagtccaaggctgctgggcagagctggagctcaaatccaggtctcctagacttgtgtctagggtcatcccctccccagcatggtcttccaccaaggcagagggaactcagggagtcttgctgctacagggaaccaggccaccccgcctcccccgtccccaccacttagccaaccttggggaggtcatctgctgggggtcccagcagctcactgacctatacctctcacccccaacagtgcacctgtggcgattctcaggtggctacccagccctcatggactgcatgaacaagctcaaaaacaataaggtatgttagtgtccactcagcacacctctctggatgtgggatgcagcccagccctgttctggggactactctgctaccccatgaggcacactgtcaggatggagcgcacttcctggtagccatgcctttaccaccatgcccacaggagtacctggagttccgaagggagcggagccagatgctgctgtccaggagaaaccagctgctcctcgagttcagcttctggaatgagccacagcccagaatgggtcccaacatctatgagctgaggacatacaagctcaaggtgcctccctccgacagaccccctcctgccccccaatttccctgctgcaatgctgctttgcagctgccccaacacctagactggggcttctggcttctccctccctatgggctcagagcagagttgtatacacatgtgtgcaaacatgcacaccaggtgtgtgtcagggcctgtgaatgaggccaaatggccgctgcagcttgggaggtggggagacagggcagtttcccttccttgccaagctgtgatgctatgaatctgaggtgggggctcattcccatcatccctttggttctctttcagccaggaaccatgatcgagtgggggaacaactggtaagtggcagcaccaagactggggttgggggaggcgtaccctgctcacctgccccaccaaggcccctggtgggccaccttttccagggccatatcacagggaactctttaccttctgcccctcatggatctgggagaaggatccaaccaggaggtgaggatctcctagaaggttgtgacccctccgttggtagaacaccccgccatcagtcctttctctcagcatcccggaggaccgtgggttccacctaggcccctcctgtgaagtgtggccaaggaatcagcctcagtaccctctgcaccagccctggcttctgccccatattattgtgccttctccagggctcgggccatcaagtaccggcaggagaaccaggaggcagtgggcggcttcttctcacagataggagagctctacgtggtgcaccatctctggggtaggttgaggaccttccaggagccttttgttagttctctttctctgtcatcactctctgtagccaatggggttgtattagtgtcctcatagaacttaatgttctagcaggagacactatcttagatgtaaagtcacaaaaagatcaatttcagattacaaataatatttatagaaaataggcaaggagtctgggagcggtggctcaagtgtataatcacgacactttgggaggccgaggtgggcaaatcacaaggtcaagagatcgagaccatcctggccaatatggtgaaaccccatctctactaaaaatacaaaaattagctgggcgtggtggcgcatgcctgtagtcccagatactcgggaggatgaggcaggagaatcagttgaacccgggaggtggaggttgcagtgagctgagatcacgccattgcactccagcctggcaacagagcgagactccgtctcaaaaaaaaagaagaaaaaaaaaaaaggcagggagagatgatggtgaaaaacataggggatctacattggtctaggtagacaaataatgcctctctgagggagtaaaatgtaagctgagagctaaaggatgagaaggagccagctgtgaattgctaggcaaaagcattccaagtagacagagcagcacatgcaaaggccctgtggtggggaaaggccttcggggttttgaggtgtggcaaggaggccagtgtggagtgagtagggaagaatgtggggagatggaacaggagagggggaatgagttgggatttattgtaaatgcaatgagagactatttgtttcaaatagcagtgacacgacctgatttttgttctagtatgatttctctggctgctgtctgctttgttaagagtgcttggtaggcgagcaagagagaaagcagggcttcaggaagccattactctagttcaggcaggaggggatggggcagtgggatgctgagaagtccacagaagatttgttagtctagaggtggaaccaacaggacttgtggatgaattgtctgtgtggggcaagagaaggagaagggcattccagaagagctcccaggctcgtgcttgagctgctgtgtgtcatctcctgagtctgggaggtctagggaaggagcaagtcagtggggtcaggagcgtaattttggcccttggaattgttactttttttttttttctttgagacacagtcttgctctgtcacctaggctggagtgcagtagtgtgatctcagctcactgcaacctccgcttcccgagttcaagtgattctcgtgcctcacgctcctgagtagctgggattacaggcatgcagtaccatgcccaactaatttttctatttttagtacagagtttcgctatgttggccagactggcctcgaactcctggcctcaagcagtccaccagcctcggcctcccaaagtgctgggattataggcatgagccaccgcacccagccggaagtgttacactaaaaatgctgacacaccaaagtagagatgtcaagtaggcagtagatggatataggagtctggagcccttgggagtgtttgcgactagaaatataaatgtaggcaatattaacatatgtactgattggatggatgattaaagcagacagtgtttgctaatagtctgagggaggcatctagggaggaggagacagcagtgcagggtttaggggacagtgggaagagggccctgtgctgggtaagggatccagtcctctgtgcctgaggaatgagcctgtgcctttctcacagcctataaagacctgcagtctcgggaggagactcgaaacgctgcctggaggaagagaggctgggatgaaaatgtctactatacaggtgagtgaagcctttggaggtcttctgctgagaaccctgtctgaggatggaatcctctctgcaaggagatctagtctttcttgattacctccagtgatggggaactcacttttaagacaatgagttaatgggtttctatccaagtggcacactccataggataccagcaggcctaggtgagtactctaggggatgataacatagccagggccacgcctctgcctaggagatgtggattagcaaacgcccattgtgaccttgggcatggttctttacctcgctgaggctgttccctcgtctgtaagatagtgatggtgatagtgcttctgtcagagggctataacggaagattctacaaactattttattattttatattttattttattttatttatttttgagacacagtctcactctgtcacccagggtggagtgcagtggcatgatcttggctcactgtagcctccgcctcccaggttcaagccattctcctgcctcagcctcccgagtagctgggattacaggcgtgtgtcaccatgtccagctaattttgtatttttagtagagacggggttttatcatgttggccaagctggtctcgaactcctgacctcaggtgatccgcctgcctcggcctcccaaagtgctgtgattacaggcatgagccaccacatctggcccacaaactcatttatgaaaagtgctttctccagtgtctgtcacaaaggaagcatgcaggaaatgtttttgaataaggtttttgtttttgtagagatgcagtcttactatgtcacccaggcaggtctcaaactcctgggctcaagcagtcctcccacctcagccttccaaagtgctgggatcataggcatgagctactgtgcccagccttgaacaagttttttgctcaaggtgtttgccactttgctaggaacctgaaaccacctagagtcagtgggtgttaattaagccctcactgtgtgccgggaactgtggtaggtaggtggttgaggggcacataaatgaacaagagcctgtccttgccattgagaagtttacagtgatcacttaccaggtggtatgagggagaatgtgtctgctgaaggagttagcaggagccttgctattcagtgtggtcccagctgggtatggtggctcacaactgaaatcctagtactttgggaggccaaggcaagaggatcacttgaggtcagtagtttaagaccagcctgggcaacatagggagaccccatctctacaaaacattttttaaaaattagcaggacgtggtgtttcccatctgtagtcccagctacttggaaggctgaggtgggaggatcacttgatcccaggagtttgaggctgcagggagccatgattgtgccattgcactccagcctgggcaacagtgagaccctatctcaaaaataaaaaataaaaataataaaaaacaagacaagcacagtggcttacacctgtaatcccagcactatgaagttgaggtatgtggatcaattgaggccaggagttggagaccagtctcggcaacatggtgaaacctcgtctctactaaaaataaaaaaaattagccaggcatggtaactcaagcctgtaatcccagctactcgggaggctgaggcacaagaatcacttgaacccaggaggcggaggttgcattgagccgagaacctgccactgcactccagcctggaagacagagtgagaccctgtctcaaaaaaaacaaaaaacaaaaaaaatcaagtgtggtcccaactgacagtattggcatcccctgggagcttgttaagaatgacaaatctcggctgggcgcagtggctcacgcctgtcatcccagcactttgggaggctgaggtgggcagatcacctgaggtcaggagttcaagaccagcctgaccaacatggagaaaccctgtctctactaaaaatacaaaattagccaggcatagtggcacatgcctgtaatcccagctactcgggaggctgaggcaggagaatcgcttgaaaccggaaggcagaggttgcagtgagccgagatagtgccattgcactccagcctgggcaacaagagtgaaattccatctcaaacaaagaaacaaacaagaataacaaatcgcaggcttcctgcaacctaccaaatcagaatctgcacattaacaagaactgccaagtgatttgtatgcacattaaagtttgaaaagctctgagctggaggaaagagtctaacctcctggatgacctggagctgaccttctctaggctgcaccctctctatctgtaaaacgaggcagttggtctaaatcagtgtttttcttttctttttttttgagacggagttttgctcttgttgcccaggctggagtgcaatggcctgatctcggctcacagcaacctctgactcccaggttcaagcgattctcctgcctcagcctcccgagtagctaggattacaagcatgtgccactacgcccggctaattttgtatttttagtagagagagggtttctccatgttggtcaggctagtctcgaactcctgacctcaggtgatccgcctgtcttggcctctctaagtgctgggattataggcacaagccaccatgcctggccaacaggtaactattaaaatttaagaaaatgttattctcatcaccaccaaactcctgtcttatcccataatttgagggatctggtgctcttcatgggcccttccacgagggcaatgggacattcctgtcgcagcatctggggcctcctcctgcccactcaaaggccagcatgtgtgggtggggccaggggaggttgttggcttgcttgagccccctgtgtgacctctgccttctctctccgcagtccccctggtgcgacacatggagtctaggatcatgatccccttgaagatctcgcctctgcagtgatgctgcctacacctccacctccttccccttctccctcaggcaaccccgacagacagtggcactcctggtcctgctgtcttggttttgtcttggctctgggaggactctgaggggcagtgctcagttcagacaagggggaactgaaggctgacaagttctgaggattacagctctgcccaggccctttctactttccctgcctgcctccctccccctgctagaagtagtttctgatttccctgaatgaaagatagtgatcttttaggccttcatatatcttctaaaattcctcatctcaaggccaccagtccccagttatcacccttggaaatcctctgtttagcttagttgcacaaaaggtagtatgtccagtggctagaggtggggtgggaagagaggaggccaggccaggccctcaggaattccctggtttccactgggccacccacttgctggacagtctgagccaagtccctcctgctggagaaaagcctggaactgccaaaacaaaaaaacaaatacaaacaaacctcgtcaccacggtcaggaggaggttcagacattctgcccagaggggctggggaaagggatgggagccaggaaagatttaggggcaggagacagacacgtaacaggaactcggaaggtagaacttagaattcagaacttgggtttcaattgtagaatttggaatctggaatacagaattgggaagaagaacagagatgacaaaagaccacttgaagagaggttcctaatactagacagatggagagtggcttggctgtttccccctgcatattggggttgaaaacttaaatgtgtagttccagtccttctatgcagagtctctcctgccctccctccttcctgcaggcaaatatacaagctagaccctgttccctcaccctgtatcctgtctcccctaattgacattctatcagcccaaccctcattctgcagggccacctggtgtgtggaggtggcgggaggggtcagtgactctgggggtctcctcagtgacccccatacctcatcatgaacccttgggtagcttgattctgcctaccatccaggaaaacttgtgctggaattgctgatggaaacaattaaatatttactataaatcagtgtcttttcttcatctgcaaggaactttagcaggtgcctgaggcagggcacagtagagctggtgggcttagtcccacatggcagatctaccctcctggagggtactgtgttcttgagctattctcaacagtcagtactggttgggtgcagtggctcacgcctgtaatcccagcattttggaagtccgaggtgggcagatcacttgagtgaggtcaggagttcaagaccagcctgggcaacatggtgaaaccctgtctctactaaaaatacaaaaattagctgggcatggtggtgcatgcctgtaatcccagctacttaggaggctgaggcaggagaatcctttaaaccctggagtcggagtttgcagtgagcggggattgcgccactgcacttcagcctgggtgagagagcaaaactctgtctcaaataaaaataaaaataaaaaagagccagtattttcctccttgctcctgggaaggagaaggaactggccccgtacaaccagggattcaggacacgtgttactagctccagatgaggatttacacgaaaaaatcctgggccttgtttgtacagttcatgccaggggtaggaaatacctgaagctttcaaatactgcgttagagttgtgactctgtcctgggcaagtcaggcctaaaatggagaaactggtgatgcactcctcaaaaagccaagtgtaaaatgaggttaatgccctccctgacttgttgccttcactggcgtggcatattatggtaaaaataataattaagaagtaaggttatgcaggcaaatcctctagcgccgaaatcttccccgccgcgctaccaggttctttcgtgttatcttggacataacacaacattaattcaactactcggtggagcgcccactagctgctggacactctcttaggccctgggcacagtgaacgagaagcatgtgtctttgtttttacagtctcaccacgccaccacctccctcgggggcctccgcgctgagcttccggcctctacgcctcgcttccggtcggccgccccttccttacttccggttctctatggtgcgcgggcaagctttgctccgcctccggcagtggcttactcccggtgccaggttcttggagctgtgaggtgaggaggggacaagggcagtggggctgggagatggggcggggctgggcgctccgggactgaggtgctgatcgcccaaagggcgcccctgggctggggtctgacccggcttctcctccctcactacccgcggtccccggcctctcggcgctgcgctgttacctcatccgaaaagtgttcgctgcagcatcctcaggcttcacgttggagcctcttgattgtggtaatgtagcctgatgggggtgggggtggtggtgatggtaacagctcacatatatcgtgctcttcggtgtgccaggcactctactgtgttgccaaagtcaggatttcccacacttaagcctttcaggtccggtctttgtaggctttgccagatcaacttaccacctctactaccgtttattaaaaatttgtttgtttgtttgttttagtatttattgataattcttgggtgtttctcgcagaggggatttggcagggtcataggacaatagtggagggaaggtcagcagataaacaagtgaacaaaggtctctggttttcctaggcagaggaccctgcagccttccgcagtgtttgtgtccctgggtacttgagattagggagtggtgatgactcttaaggagcatgctgccttcaagcttctgtttaacaaagcacatcttgccccgcccttaatccatttaaccctgagtggacacagcacatgtttcagagagcacggggttgggggtaaggctatagaccaacagcatcccaaggcagaagaatttctctcagtacagaacaaaatggagtctcccttgtccacctctctccacacagacacagcaacaatccgatttctctatcttttcccc

SEQ ID NO: 12269 - DNA, 10467 bp, Human
  misc_feature (1)...(10467): n = A,T,C or G
cacaatctcagctcactgcaatttccgcctcccacgttcaagtgattctcctgcctcagcctcctgagtagctgggactacaggcgcccaccaccatgcccatctaatttttgtatttttagtagagacggggcttcaccatgttggccaggctggtctcgaactcctgacctcaagtgatcacccgcttcggcctttcacagtgctggaattacaggcgtgaggcaccacgcctgtcctgaactgtttttaaatcatctctgtcaattctgaaggacctcagctctgccttatcacccctgagatgtgtgtttgggggtgggtggtagagagggattgccagccttacaaggaggctgagtggggatagtgacaataaagcttacagaagcagtcgatttaagaaaaagaacagactcaggaggctgaggccggaggattgtctgtctgaccccaggagttcaagaccagcctgggcaacgtaacaagacccccatctctaaaaaaaattaaaaattagtagggtgtggtggtgcaaagctgtagtcccagctacatgggaggctgaggtgggaggatcacttgagcccaggagtttgaagctgcagtaggctatgatcacactagcacactgtatcctgggtgacagagcaagactccatctaaaaataataaaagagatccccaaaattagacctccttaaaactgttttctgatcacactgtcctttttccttctgtcattggttggatgtgacttaagctcctgttgctctctgtcatccagtccttactcaagttgttctgtttgtgtaactggactcaatacctcatgtctctccagactagctcagggactcttctgagctgtttaggaatagggttgtagaactacttaggctaagttaggaaggagaagtagagtggactcagctgtatggcttttctcagcacccagtgtgtggcctgctcaggggttacatttttatctcctgactggcaaagttgaggtgaaggtcaggggcaggtaatgtttcacaagcaacgggtaagggagtccctaatttctgggtttggaaactggtagaatgattacctatcatgaggattgctctttccttttgaactcccccaccatagtgtccacctgactgcaagttcgttaaagctgttggctgtgatattgggtttgattgatgagaagattaacagactcatgagttccttatctgatattttgttggagcatgggacttctgaagacttccggggctttccgtcccttcctcacagaaagatcagagctgttgctggctgccagctgctcagtcatgggctaggaactcctttcagagcaggcctgtttttagccttctaggatatttagcctcttgttgatgggagatttgttcctatcatttgcatatactgctccatctctgagctttgcttagagaggagaatttggacattcatttgggtattctaagaaagggaaagggaacaagctgtgaagctaaggtataggactcagcttgtagattctcctagaggaaacttttttttttttttttttgagaacagattatccagtaagcaggaggtaagagagatgggatggggaggagaatggattaatgacaatttcagagggaggagtaacccactgatttctctgtcttacaggtagaggggaagagattgaactttgctgacctttgatgtgaggcgctcagccagggccaaggggagagcctggcaagatttgcagcctgaagccatgggccagggggccatggtgacctgagacaagtggactctgtatagttgccccctgcttccccttctacctcccctaccctatgctaaggggactcgtctccacctcgtaaaggaaactccccaagggaatccctgtcccctattttcctatccttctacccttccaagacagtcctagcctatagaactcctacctcccatcccctgaggtggtccccattcctccctcccttcctccccccgccatgctccagttgtggaaggtggtacgcccagctcggcagctggaactgcaccgcctcatactgctgctgatcgctttcagcctgggctccatgggcttcctggcttattatgtgtccaccagccctaaggccaaggaacccttgcccctgcccttgggagactgcagcagcggtggggcagctggtcctggccctgcacggcctccagttccacctcggccccccaggcctccagagacagctcgaactgaacccgtggtccttgtgtttgtggagagtgcatactcacagctggggcaggaaattgtggccatcctggagtctagtcgttttcgttatagcactgagttggcacctggccgaggggacatgcccacattgactgataatacccatggccgctatgtcttggtcatttatgagaacctgctcaagtatgtcaacctggatgcctggagtcgggaactgctagaccggtactgcgtggagtatggtgtgggcatcattggctttttccgagcccacgagcacagcctactgagcgcccagctcaagggctttcccctttttttacactcaaacttggggctccgggactaccaagtgaatccttctgccccgctactgcatctcacacgccccagccgcctagaaccagggccactgcctggtgatgactggaccatcttccaatccaatcatagtacatatgaaccagtgcttcttgccagccttcggccagctgagcccgcagtgccaggaccagttcttcgtcgggcccggcttcccactgtggtacaggacctggggcttcatgatggcatccagcgggtgctctttggacatggcctttccttctggctccacaaacttatcttcgttgatgctgttgcatacctcactggcaagcgcctctgcctggaccttgaccgctacatcttggtagacatcgatgacatctttgtgggcaaggaagggacccgcatgaaggtggctgatgttgaggtcagtcttgttacttaaatttttttcttagaagctattcacactctggcctgtcagactcccttccttgattctgagcttgtcataggtacactccctgcctttccaggcaggaagaatgctacttctcatgtatttcctgttcagtctgctctcctgatttctcttgtccctgctactcttcccaggctctgttgaccacccagaacaaactcaggaccttagttcccaacttcaccttcaacttgggcttctcgggcaagttctatcatactggtgagcttatacccctactcctttggcatatcatagtttgacctgtcccttcactgtccacctccctgggcagacaagttgaagaaaagggtcaaggtttggggtcagactgctgtgaggagctagtggtgggcatgaatttaggttcgcatgggtggctggatggcaagttggcagtggggcaaatagaaagtcttaggcaaggatcagggatggaaggtggtcagtgttgttacaaaataaaggagggaacaggggctgactggctgtggtcagtggtcagcgtgtggtcatagggacagaggaggaggatgcaggggacgacatgctgctgaagcaccgcaaagagttctggtggttcccccacatgtggagccacatgcagccacacctgttccacaatcgctccgtgctggctgaccagatgaggctcaacaaacagtttgctctggtgagacccttggatctcttccccataatttctcccagccatgcttccttttctaccttcccctaatgggctacccttttcctatcctttgcgtttttctttatttggaggcttccccaccctctttaccctctactccccaaacctcaccaggtcctggtgagagtctatgccattcccaggagcatgggattcccacggacctggggtatgctgtggccccccaccactcgggtgtgtaccccatccacacgcagctctatgaggcctggaaatccgtgtggggcatccaggtgaccagcactgaggagtatccccatctccgccctgcccgctaccgccgtggcttcattcacaatggcattatggtgagggactcccaatacaggcttgaatcaaactctaacatttagacagctttcaacatgcattgacctatgttctctatcaactgccagtccaagtatgggggtacataattgggggtagaaaggtgaaaaaattttaacaccctcagtaagagctttattgctataacttcagactcagtcctctataaatcccagtgtcctccatctacttctcattctatctttcaaatctcatctgttttttcttttccctccaggtgctgccccggcagacatgtggcctcttcactcacacaatcttctataatgagtatcctggaggctctcgtgaactagaccggagcatccgaggtggagagctctttctgacagtgctgcttaatccggtaaggtgctgagaggaacggctagaagattggagagccaaggtgtttgcaggctgggacctttattcaccaaggctaattcagaggtggggtaggctctccaaatctgacatgcaggtaccccttacagatcagcatctttatgacccatctgtccaattatggaaatgaccggctgggcctatacacctttgagagcttggtgcgcttcctccagtgttggacacggctgcgcctacagacccttcctcctgtcccacttgcacagaagtactttgaacttttccctcaggagcgaagccccctttggcaggtaaaggtggagctcagtctgatgagagacatgataggggtggggtgttttttgttgttgttgttgttgttttgagacagaatctcgctctgtcacccaggctagagtacaatggcacaatctctgctcattgcaacctccacctcccaggttcaagcgattctcctgcctcagcctccctagtagctgggattacacgcacccgccaccacgcccggctaattttttgtatttttagtagagacggggtttcaccatgttggtcaggctggtctcgaactcctgactgcaggtgatccgcccgcctcagcctcccaaagtgctgggattacatatgtaagccactgcgcccagccggggtgggggtttaagagaagactaggccaggccgggcacggtggctcatgcctgtaatcccagcatttgggaggccgaggcaggcagatnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnttgcagtgagccgagatcatgcattgcactccagcctgggcaacaagaacgaaactccgtctcaaaaaaaaaaaaaaaataggccttatctgattattggccctggcttcagaatccctgtgatgacaagaggcacaaagatatctggtccaaggagaaaacctgtgatcgtctcccgaagttcctcattgtgggaccccagaaaacaggtgaagtatccttagctaacttctcttgccctgccttaaacccaaaggatccttttgtcaaggaactctcttctctctccaggtaatcacaggagtgaaaaaagtatttttaattttaataatttttttttttttgagataagagtctcacttctttgcccaggctggagcgcagtggcacgatctcagctcactacaacctccacctcccaggttcaggcaattctgctcagcttccctagtagctgggattacaggcaggtgccaccacacctggctaatttttgtatttttagtagagacggggtttcaccatgttggccaggctggtctcgaactcttgacctcaagtgatccgcctgccttggcctcccaaagtgctgggattacaggcatgagccaccgcacccggccttaatttgaatttttaagagagaaaaaaaggaactccttttatacccacccctcattgatccagtctcttgaggcagtgattcctaaccctggttgtatatcagaatcatctgtggtgtttttacaagatcacaagtcattctggtgcacagttaaagcagagaaccactgttttagcccttccctgggcctctctcagacttgcctcctatcattgtagtttggccataggggattttcctacccagagtggttattttttcacttccttcaagcttatgctgttgagctggcttccctcccacaatggctgcctgaagctggtctttctctcccatttagggactacagctattcacttcttcctgagcctgcacccagctgtaactagcagcttccctagccccagcacatttgaggagattcagttcttcaacagccctaattaccacaagggtattgactggtgagactgggccccatttgaatgtttctcagaggaacactcccttcccccaaaataccccattccagcttccctcagcacagacttctggccacttcactctgcatatttttctgcttctctctcttctgtgctacttcctaggtacatggatttcttccctgttccttccaatgccagcactgatttcctatttgaaaaaagtgccacctactttgactctgaagttgtaccacggcggggggctgccctcctgccacgagccaagatcatcacagtgctcaccaaccctgctgacagggcctactcctggtaccaggtctgcctgaagctagggacacacaggctaaaggttggggggaggggggaggggacagtgactgctagagagggagaaaggagtgaggtttgagaaacttaactagtgccttggggacgggtacccgtgctgtgctgtctgtctccagaccaagcgtaagggcagaatactgtcaaatcaccagtccttcaccttccttctctttgtccttcagcatcagcgagcccatggagacccagttgctctgaactataccttctatcaggtgatttcagcctcctcccagacccctctggcactacgctccctgcagaaccgctgtcttgtccctggctactattctacccatctacaacgctggctgacttactacccctctggacaggtataatccccacaagagccctcagtggggttccccttcccctcttcttcccttcagcccagaggcttcttaggaatatagagggaaccacatccctgtccttttagttgctgattgtggatgggcaagagctgcgtaccaacccagcagcctcaatggagagcatccagaagttcctgggtatcacaccctttctgaactacacacggaccctcaggtgggagagcatgacccaggggaggagtactgtatgggaaatggggaagcaggttgaccatgtctgttagagacatagatttactctgtctcacaaggagagacatgtccctgtgggcagggaagggcattgtgcatttatggaacttgagtttctcttttccctgccacctcatggcctcttcctgttgagcaggtttgatgatgataagggattttggtgccagggacttgaaggtggtaagactcgctgtctaggccggagcaaaggccggaggtatccagatatggacactgaggtaagtaaagccaggggcaggggaatccctctccacttccaggatctgattctgtgtcccacttcttaccatttctgccttcattttctcctgtcagtcccgtcttttccttacggattttttccggaaccataatttggagttgtcgaagctgctgagccggcttggacagccagtgccctcgtggcttcgggaagaactgcagcattccagtctgggctgatgtcccagcctcccataccagcaaaatgccccctgcttccctaaggggcaggtccagagcagggcccacaagggggattagagtggcctggcccctccccctctacctcagtagcccccaggcctgagatggctgagaagggaagggtatccttttcccacagttctgggacaaataaaggggcttcctttggtaccccacataatagtgctaggtacctttgacccatcatcttgggaggtggggaggaatgagagggtccaggcagggtgtaggggaatgtattagtccaatgagatttccctcttcatccgcagcagtgtatctattctatacctggctatgggagagaccccttgcatgggagggaccccttgctatggcccctttagccaggcagtgggatctacctgtggcccggcctccctaatgtcattcacattgaatggggatgaggtcggacagtggctcatagagccgagtatgagccctagctgtgggctagaaatgtccttaataaacatccttatttttctgttttgtctgcctccctggagtgggaaaaacctagactaaagcaagtgtcagaagtttcctccccagttgaaggttcatctgcacatggaatttggaaagaagggaaaggcccaggtcgactagagtaaaaaaggagtttatatatttataaatgccaaataaataccagaggccacccaacgccccctcccagacagggctgtctcccccagccctaggcttctagggtgtgagacatcttggccccaagctatagcccaagagcagctgtcagtctgtgctaccagggaactgagtgaggatgatctgtccagccaagtttcactccccctgtgtgaggggcccccatagccacaggcctgggtccctgtataggaccctaagggtgaaagactcagggggagaaggtggccatctcgagtgagacccgctgccacagctccttggtctgtttgctgcgcttgaggttctgtaggatgtcgttgaactgcatcatgcccatgggcgtcaggcagaaggcgctgcgggcactccggatcgcattcacaaagtcgtcgtagtccgcaggagtcaggtgaatcaagcggtggtggatgtactggaggaggatgtgtgcaggatgagccttagtacaaagcacagaaacaggccctgcctccctctggtccaagaccacccaggaagtgctccaccctgctccataattctaggttgtcacctgcatgtatgcctgctggcagcgctgcaccagttggtggaaggccggggcacgcaggtggttgtgggcatgagcgggactcagccgctgcagcgtctccatgacgatctcctgcagcacaaacgggctcagcacccccttggctgcccccacacagaactggtgcacgtagttcactcctggggggcagggggaggggcatgagacgggggtggccacctctgccctagggacccaacttacagatctcagctctggcctggcagagagcctccctccaccccaggagctgaggtaaccctccgccccccgcgcacgcacacatacccgaccaaggcctcaactctgagcaagagctaggaaggaggtctgggataaggaaggtggggagagcaggtggggggggggcaatggtcctagggaggggaggtgttacccagctttgctgccagccccagcaaccatttgacatcatcagtgtaggggggggagcgggagaagttgttggggtgatcgttgtgtgcccggcgacccagcatctccagtgccagcattcctgggagatagataagggtgggcacatggtacggtgtatcctcttcaccctttaccccaacctgtcacctgaccccacagtaaacaaatgaagagctagaggaagggtcctctgaagagccactggcacaactgcaggtaggagcacagaaagggatgtcctctcaccgacacggtaggcagcatgcaggtggtgcaggctgtggggattgactggctgactgtgtgtctcctcctcgggcggtggaaaacctccgctcaccagagggctgggctgtgtggtcagggcaggcagtgaggcaccttggatggctggaaacgtggatgctggatggacactgctcactaagtggggtgagagccatgtgaggaactcagagcccaaagagagacaaagaacattccctccccacctcccctgcccagtgtgcctcccctccattcacctgttccctggccccacaactcacaggccacactggtgggcagtggaagccctggctctgtgtggtagggatgtactgtgatgggtgccatggaaggaacggggaaagacacagcagtggcagcaagtgagggaggagtcactgaataagggtactgagcccctaggaatgcaggatgcacaccctaggggcagggagaagaaaggggaagatgccaaacttgattaggatgttgctgtcgtgcttcacccccacaagctgctatcctgacatgttttt

SEQ ID NO: 12270 - DNA, 63930 bp, Human
aaactcctgtgctcaagcaatcctcctgcctcggcctcccgaagtgctggtattccaggctggtcccattttaccagcaggtctacacatgtgctcacatcgctcactcagaggagacctccgttattagggggacctagacctgtgctgccttgaccccagggacagaggttgtttgggaatcccctcccttactttgatttcttccgaggaagccggcttcctggtgacgggaggtcactgttctggggaaaaagagtgggaaaaacaaagccaatcagccacttggctaagtgtcaggtttcccaacaacttcatgggttgctgtggatgggcggggctgttttgagcccagaccatccctttgcctgtgggtgtgggaccacgtgattttggatcaggggtcatttgtccttccagaagccaagccctgttccaggcatgggggtgcagcagtgagtgagacccacagaaccactgccctcctggaacacaccccccccagagagggaactggggcaccacagacccgtgtgcaggcagcaagggcgtggtgtcggccggggagcagcagggacccctgagccccacagtcggggctcatggcgctgagaagcactgcagcaagggcgcagccagtaggagaggagccgcaagcgcaagcatccgcagacagtgtgagctcagcgtgctgggaaggcgggggcctgggtcaagggccaggcggcagagcataggggcctgggggggcagtgcctaggagtgggaggaaagagcatgggaccagattcactttggaaatagaagcccccaaccagcagccagccaggtggaggaaggcgtgcagagctgagagggttcaggaggcggtggggggagccactgggaggggacccaggggttcaggtgaaagacagcagtggctcagcccaagggtggcagccagagatgtgggtggacggctggatattggcagccatactcattatcaatgctgctgtaacagctcatcacaaaccctgcagcttccaactgcccagagtgagatctcctggttcttgtgggtcaggcattggggcagagcagggctgggtctgctgttttgggacccctgagctgcagtcgaggttcttgccgggactgggctcaccttggaaacctctggtaggaaaggatccacttccaggctccctcgttcgtttgaaggactcctttctttgggctgttgggctgagggctcagcttctcgccagctgtcggcccgaggctgccctcagttcctgccccaagggcctctccaacaccacagcttgcttcatcagagccaggagggacagtctctagcaagacagaagtgacagtcttgccattacctttgccgtgttctgctggttagaagcgacttgctaggtgcagcccacactccaggacaggggctgcccaagggcaggaatcccaggagctgcggacatcagtggcatctgagaagctgcctgacttaggagctcaatggcagcaccaggaagctgcactgggctggagtcagggcaagggacagtgtcagcgatgaccctgggggacagcagtgcagtcaggagctcagaaagtacacagatgccccctgggcggtctcttctgcaccatgtgggcagcagaaactacacctacggtttcagaacaacagttggggtggtgtggaaggacctccacgacatatagggtgggagtgtggagtgatggagtgtggaaacccttctcacagttgtcacctgctctccagcccctcctgagcccgtggacctgcctgcctgccgtgtgtctgtctgtcgtctgtctgtctgtctctctgctgaggggctccccgatgccctgaacccagacagcctcctcagcctttgtgatcccagagtctcccggccaaacctggttgatcttttttaaccaccaccctcttcccctcccttattttgcttttcttccagaattttcccactgtaaaaaaccgagcaagtctggataagtgaggctggctccatgtatccagaatcaacgacgggctccccggctcggctctcgctgcggcagacgggctcccccgggatgatctacaggtgaccccctgccccctcacccaggccccctcccagggtcagtcctgcttcgaggacgggttcccaaggccactgtcctcccctctggaggtggaagggcccaagcagggcccacaggcttctgccttccacggggttttgaggtgcacgctggtgagcgttttctccaagaaaggagcaggggctttaaaaacccaagtgggaaagaaaaaccaaaacttttccagggcgtttgagccagagtagactcctttcttgtccctgacccttccgaaatatctcgtttgaggttaacagagcggccggacagtgagtgcacggccaaccccggcatcctgttcctcccactttatacatcgcagcccctgtggccctgccagtttctcctgagcgaggatgacgaccttgcaggcctttggggaaccacgtctgccggtttcccaacactggagggagtgggggcggccaaatgctcctggggcatcctgaccccctccttgtggaactcacttccgcttgcagccctgggtgtttctgtctgcaccataaacagcgctgaacatcagcgacagctgcggagggcgttcagtgagagctgagcctctggggacagagcatagaacccacgaaagacgcaggcacaggcagtaccccagcagcccatcagtcttgggaagccagacctttccggataatcactggggcctgagccagagcccgtgtctgtgacagccacagggaaaggcagtgtctgtcctaagaagagccaggcgggcaggtgcgggtttgccagcacgcgggtgctctgcacgtctgggttggagggttttcagccattgcccacaagcatattgcaaagcaagtcctgaagcacattcaatccaaaccaaccctcactcggaggttcaccacggaaaacagggcctggcatggaaggagcccttggtgtccaggaaactggctccgggtctctgccccgtggccaccgggtggcgctgctgcagagcacttggcaccggctgcgcttcctcagagactgccctgagcaggcgactggtgggggcctgggggcatgggacattggtggttctttctgacctgcacctgctggggttgatgccaactgtggactctctctcttctctccctttctcctttttctcttttctccattgctgtccgaagtactcggtatgggagtcccaaaagacagctccagttttacaggtaatgagtcttcattctccctaaaacccagcgagccgaaggccagggagcgggtgggaggactgcacccttgccgagcagggtgtgctggtgtattctctgaagccaaagcccccgagacccccaggctctgctcatcaccctctgtgcctacccacaggatgctgtgcaatgtcctgatggaaaatgtgaagtcaggttaattgtatgtgttggtctgccagaagtttgctttgatttgagcaaatgggcttttgatgactgccaagctctcagccaaatctaccgttaaagcttcactcatcaggcagtgagggagatgtcttcctgtggtcaccagcttgccctgcttccattatcagagtacaggacgtggcgagcccatccgttccccctttgcctgtgggtttgacctgatctggaactcacagagctcctcaggctcattgaaggttaatgcctgcttgggggtgtgcagtactgatacgacgtggatcagtgacatctttctgatatgtttttctgttggtgaattaacaaaccgggcacctggcgagagactgtgccccagcaggatgtgacatcaagatgccaggcttagggccctgcagggtgctcttggggagacccgttcctctctctgggctgcctctccctcacctgtaaggcaggggatgcatgttcttggtgcagcctccaaccctaggaagtaaaatgtcagggctgcctggagcccatgggcagcagcctccccatgccttgggactgtttggggaattggcacggcttctggcagcaggtccctggtatgcattgctgcatcttggcggtcaggccgggaggtctctctattcggacccggacatctggtaacagtgctttggggatcgttgccaatgtgccaggcagtggtcatggaggtggcaatgtatttccatgtagcttttctctccccgcgcccccactccccacccccccccccgtttgccagccatagcacctctgatggggaccgtggacctagatgctcagagtgatctgtgccacgccttcagtgcctcctcggaggtcctgctccttacagggagctctgaagacatggccaactcttagatcctactgaaattttggtagataagattttgcttaagatagttaaatctgaactccggcttgcaaatgctttccctggatgaaatgtttgtattgtgatgtatgtacacatggtataacagatcctaacaaacatatgccgctcatcccaggggatttcatcagtgaaacaaaacatgtacctgaactgcatcctcagagagccgggagcagcctcagtcctcagaagggaaggggtgaggtctgatgagcaggcaggaaaatcccaggtgcagacctgccagctcaaaagggctgcccacaggtacagaccatccagctccaagggcctgcccctaggaggggccaagtaaattatccagtgaccaagtgagagccttccagcccactcaaggccctcaaaaccccacaggctcaacatgttgtcccccccgccgggatccctgtgcttaagaaccttcatttccaggtggccttcctggccccaagggaagctctgaagcttaccctctaggctctcagccccaattctggtgcccacaggctctggccatcctacccgttggatctccagggggtcacttgggtgtctcttgtgggggctctggagatgacctctaagggctagggtctttgtttgttaacaggctgggggccactcctagtagggcaccctcatcacaccaagcataccactaaacatggctattggatggttctttcagttacttaggcctggccctctcacagggcagaggcgttcaaggcatgtgccctgcccccatgcagctcccaggcaaggaattggcataggacactgtgccaatcagctgtccaccaagtgctgcataacaaacaactccaaaactcagtgccacgcagcaatcagcatctcttccttgctcccgtgtctgcgggttgaccaggcagctcgtctaagctggcttggctgggtttgtctccaagctgcaagttggatccccatgtcctccatcttcccatgcttaactggggcctaccccaggcatgtccttcccatggcaaaagtaccagaggaaaagcagaaacatgcagggtctcttacggcctatggttggggtcagagcgctgtcacctctgctcacgtgcttttggccaaagtaagtctcaggaaccagcccacagtcaaggggctggaaatatattgcccccaccagtgggaggagctataaagtcacatggcaaagggcatgggtacagagaggggtgaaggattgggagcaatacttccatgtaccccaggtctcaaatagccctgatgatctccagaaggcagagcacgtcacaggagaagcccaaagagcatttggggtccaaggaaggaggggccacagccagctgagagccaagaagacttcacggagaaggcagcaggggcttggatctggtccttgaaggctgggcaggattcaacgcagaggctgggaagcatattccagtagatacaacagcctgagccacagctcagaggtgtgcacagagaacaggaagtgacagttacccagcctgggccatcagggacatgatggagaataaagagaggctggctgtagaggtggatgttggtggggggcctcgaatgcctagcgatggggcacagatgcactcagagggcactggggagccatctatggtgtttgagcagggcaggggtcagagatctgctctaggaaggaagcctggtagcagggagtaagacagggaagagagaggctaatgcaaggagaccagacagtgcccaggaaaggtgcaggacggctgagctccaggaactgcacagagagagaatgaaggggtgcagggcctgaaaaaaggacgtcagaagccacgtccacagggcttggccactgatgggcaggtgctgagacagaaagggacagagaggagcagtggacccagggaaggagagggcctcattcggagcatgttaggctgcagctaccacccagtagtgaggcgcaggccccccgaccagggcgacatgtggggatctgacagagtgggcttgggcctttggggacaaaccatttcaattgccaaggccttcgcagctagtcacccgcagccaggcacctccagactctacgtgctctcccagcctcccacttcatttaccttccacactgcgactggggcactgatttcctgtcccccaccttcccccatggcagctaccactgtttgctcattcatcatggggggacggttctgcctccattcaaaatcccacattcactggcgcgctttctcagccggaagatgatgtcacgctgggactttgctggcatcctgtgacacgcagtgaccctgggggtcatgaccctggggttggggctcagcacttagcctcatcccagagctcagccttgtttggcctagtctcaaagcatttcccaaaccccaggtcaggacatgtgccgtggagaagggctcctgtgtccctgcctggagtgagtggcagtgtggagtccaaatagcaggttctggggccttcctgccatttatagctaccggtagtatcagatatacccatctcgggtgtatccccagaggacaggaggagcatgcgcgtgtgctgagcagaggcctctccagacccccttggctgtgggtggtggccccatacgacggggcccccagctcccctgctgcagacacagttcagagttgagtggtatgcggaagccacaggctctgtgtcccgcactcagataccaaagagcaaggcctgcccctttcgacctgtgggtccaaaggtttgtgtttctggcacgcggggatggtggaggcagcaagggtaggcctgagggacgggcaggacctccccctcaccttgggctgcaccccaaccccacgcaccgggagtcagccttgccaggttgcagcacggaactgcacttcccgagcttttaggggaagaggcactcgtgaataattcagcctctttcactgagatgaaaacgccctaatagaactaatggactcgctgcctcaaaactcgactctggtgggactcatctcattcaccaattgcttctgacgtcctgcagtgacactccctaatgaaaaagccgctgtgccagatccttagagtgtctggtgatccctaataaaccagactgtggcctttttaacgagcagacgcccccacgaaggcaggtgagtcctcccttcagccgctaccttcctagtggagatgccgcttgggggcacgcatccgcgggaatgaaaaataacagaggagaccatattttggggtggttttgtctgatccggaattagaccctccgtgtttttgcaaagcagaagaccttaaaaaagagccagcctgaggtaaacttggaatgaccgtgatggatggggtggtgggcggcaggtttcagccgggcagcacctctcgcttgagtctgctcacagcccagacctgcccaaggctgactgttttcccatctgccggagacacgggcgtctagctcgtacctcgctgtgttcaccattgattaagattcagcattttccagttttgcccagagcgctgtcagggaggtttggtcttgtctgaaatgtctgtgcaggaagcacgtgctgagggagccaggggctgcttgtttgggcctcagtttgctgattgtccttgagcgaaaatcattctgtgtttgcactgaagcaatgccgtgtcttgtagagccgcaccccggaatggtagcagctccccttccatttccgctttggagaactctggctgggctctctgctctctggacaggtgtcaccattcagaagagatgctcagggttccttctcaatctcaggttgtatgctttgttggctttcagtaaacagaacaattcagaaattccaggtagaggagtctggggtgaggtagtgattcctactgacttaatgaggttaacatcttccttgcatttttccatgtcacggtgttaattcacgtgaattcccctgggcccctgatctacaggaatagatttgcaccaggcaggcccagcccaggaaagaacttgtgggttccacgtaattagcaatggctattgaggaggggctcgtttttcttggtaccagggtggtgagggagtgtcagggctcagagaccctcactctggaaagcggccgggatttgggatattttgaattggaagtcaggggtcactgtgctcttgagcacaggagaagtggggaccctgaggcaggagcccggcagtggggccactctctcctccctgcagtgtcttaccggggggcccttcgtccaaggacctgacgctgctagagtctcggcaaaagcccagaatagagccccagtgtgagggagtccagaggtgtcctctgtccccaggcaccgctggtaacgggcagagcctctttgccttctgcctgtacctatccttcttcccctggggcagccctcccagagtcatgagccttcaggaccacagggagcccccgctgtacagagtcctggcatgggagtcccccccacacaagagagggtgacctgcaaagagctgctgggtctgaggtaggaagccagccccgcccccaccaacagctgcctggcactgccaggaaatgcccaggtatagccctggttggccttttggagcctgggccttggttactgttctacaaatatctgagcccctcctctgtgcacgggacactcccgtgggcactggtcagggggcagtggcagcaggcagaagagtccttgccctcctggacccaaccttcaggggagtccagcggccatgggctcctcatggcaccagccctgctcctcaccccaccaccccatgccaaaggctgccatttctgtgcccgcaagttccctggcccaagccctgccctggcaccatggggacaagctcgtagcaagaggctctgggctccctccgtgccgcagggctcccacctgcaggtctgctcccagggctgcaacatgagctctaaggaaagattgcaagcgggcccccacagggagggacgccctctaaatcctggccacaaaacccattctgtcctgccctctctcccctctcccactcacatccccaaactcggccttccaccatcttgttgtgaagggggcgattattcacatctgtgttctcttcccttaagcattttctagggagatttggtgtctgtgtggctcactcctctcactcaaacctgtggtcacaagttccttcccgccctgcctgctggcccctggtggtggatttttctttccacagcatttatcataattggtgtcttatcccacgccccccaacagactgtcttctggctgcgtcaccaactcccacccagttgtccaaagcctcatctcatgcagcccacagcagcctggtacaacaggcctctgcccagcctacctcacagatgtggaggctgaggccgggagcggtcaaggtgcctgcctgggccacaccatgagcaggtgacaagcagagctgcccctgtccagaagctgggcactcagccaccccgtcctccagccccggggccttggctatatttctagagccaaaccagacccggattgctttttgtgagtaatgtcttgaaagctaatggctattgatctcagcctggtcgggccaggcagggaacttgcgtgtctgaggctggtcctgcctttcagaaagagccctggggctacagcctgcccagctggccttctttctaaacacagacctcagggaagtgagggttggcccccatttgccccacaccggactggcagctagccacatggccacctcagaagcagctgcctgccacgcgcatggagggaagggagtggccggccagtaggcagggaagggaagctggtgctgctgtctgtgggtgccaagggcctcatttcctaaggtgaacctctcctggagtccgggcctctctgccctccagagcgattctcctggaaggcagacggctttccatgccagggtacccgcctgctttagcgtccagaggtccagcagccaccacccctcccagcatagaaatgagcagtggtgaatgcaactcctggcatgggaaccccccagcaagagaggacgacctgcaaagagccactgggcctgaggcaggaagccagccccgcccccaccaacagctgcctggcactgccaggaaatgcccaggtatagccctggttggccttttggagcctgggccttggttgctgttctacaagtatctgagtccctcctctgtacacgaggggcactcccatgggcactgagcagggggcagtggcagtggcaggaggcagaagggtccctgccctcctggactcaaccttcaggggagtgaattcagcacacaggacagctagaaaggaatcagcaaggtggatgatggcgagcgccatggagacagatcacagcaggaaagaggcacatggtgtggtttgtgtgggacagagggtaggatgggaaacgcagcccccccacccccgggagccatgcccatcagacagaggtgcagaggtgcagacagcacagcaggctccccaaggacgactggttgctcgcctttagggagggggccatccagccctgaccagggtggtggggccaaggcctgtgtggacactgctacccagctccctgtaggggctcctcgggggctccttgcctgctggtctctctttagctcttctctgagcccaccttccctacctcaattgcatgttcatgcaacaggcatttgtaggctctgctctgagctaggcctcatgctgggcacaacagggcagacatgaatgaaggtccctgcaaataagatacagacgaatacttgcagggaaacccccatgaaagaggcagctgtggggctcctggaggtggcccccctctctgggtgcacatataggcagagcagtgaaaggtcagcaggctggtcacccattctggaaggaccccagcacatggggctcatcacaaactcctgccccttgtgggtctttcctttggcccctggagctcaccccaggaaaggcccagcctggggcaactccaggacatctcaacccccttcaaggaccgtgctaaagcctctgtagctgcctcagctcccaggatagccctcccagctccttcccagggataatcgaacttttcctctcttggggcagaaggtggggacagtgctggttcctttccagctcccaggccaggttccaggatcccactgtgcagctgacccagctgaaatggtgacttcccctctgcaccttctctctctggtgatgatgcagagctgcagtgcaggccacctgggccatggccgaggctgcagtcaggtggggtgagggtcactggactggggacctcctttgtgttgagcctgcctccatgtcctcattgcgctgtcacagactctgcagggtgaggactcagccccgaggctgccctcactggtccactcactgttgtgcacatgaattaacaccagtggttgcgttctggacacacgctttctcccttggccttttaattgtccactatctctcagggctcactcactcactatgttgagatgcctcattcttgacagcagcacaaattcccactatgtggatggactgtcacttaggtaaccagtttccctactgatggacatttacattgcttttagtttccaagaatgtgcattcatcatttcagctatatttcagtggttcttcacatagaaactttgaaactcccctgtcccaactaagcctatttccccaggccactctcctccgcaacctgcttaaatgcattctgctcagtttttcttttgcaaaaagcatgaagcccaaagatctctgcggtgcaatgatgcgttcaacaagcagggaatgtgttgtatagatagcatttccctttacaaggctaagagcaaataggaccttcccatgttggggccacctggcatgcgggggtgaggtgcctccctggcataattacaggagagtttacttcagcaacaggtgtgccctgcgctgctttcccagggacagcttttgacccagttttaccctgggaaccacctcaagagaccaccatgacatggtaccgcagtcaccacggaacagcaaccctggtcttcagcatttggggggctcaggctctgcatgctctctgtgctcccgttttcatttggacacttggggtgcagctgtcctgcctggaatgcagctttgcctgtgcttgtctcacagatgcaggggacagaaaagggcagcttagccagagttcctggcaagcactgctttgcggactgagaatctcatgccaagaggtgtttacatccaggggccgggtcccactcctagacaccaagacctggtggtggcactagttaaaggatgtttcgctgcagctgccccctgccccagggccagccatccagcctggggcacgtggggcattggcacactgtctaactcatcaccgtctggacagtggcagctcccaagccaggcggcaccatgctgtccatgacgtacagcgagagtctgcggagcgtgagcagcaggtgccactctgaatgggccctgcaccccgtccgccagacggacacgctggaactgcagcggctgcgggaggtgcgggcggctgcccaggccaggaacatggagagcttcctccgcatgcacggcctttccctggacggctgcaccgcccagcgcacaggcatgaagtatcggtaagggccgggcaggggggcggtggggtgggaagtctgatttcagccatataaatatgtataaaagggctgggcacggtggttcacacctgtaatcccagcacttggggaggcagaggcgggtggatcacctgagatcaggagctcgagaccagcctggccaacctggtgaaacaccacctactaaaaatacaaaaaatagccaggcatagtggggcgcacctgtagtcccaactactcaggaggctgaggcagaagaattgcttgaactcaggaggcagagattgcagtgatccaagatcataccactgcactccagcctgggcgacaagagtgagacactgtctcaacaacaacaacaaaaatgtataaaggaagaaaatgaggccaggcacggtggctcatgcctgtaataccagcactttgggaggccgaggtgggtggattgcttgagcccagaagtctgagaccagcctaggcaacatggcaaaaccccatctctaccccaaaatacaaagaaattaggtaggcatggtgccatgcacctgtagtcccagctacttgggaggctgaggtgggaggattacctgagcccaaagaatctgatgctgcagtgagccgtgatcgcaccactgcactccaggctgggtgacagagcgagactccattgcgcaaaaaaaaaaaaaaagtttagtaaattctccatggggtaaaaatgtgtgggtgtgtttctccatggggaaaaatgtgtttctgggtgttggagacccctgctcttaatgataggcacgtaggtctgaattttcttggaacctccaaaggacattctttttagtgcgcttgtctttgaattcagcacctcggacagcgctctgctagccaccgttctctggctggtgtaaatccctctcaattgcaaattgacagctttatcttctgtgcctctcaggaacatgcccttgtgagagccattcagccaaagaggaccctccccacccagtccttgtagagttgccagttaaatttgaagttcagataaacgcgtaactttttagcataaatacgttccatgcaatatttgggtcatacttatactaaaaagttcctcattgtttatctgaacttcaaatttaactgggcgtcctgtgttttatctggcaacactaaatatctggcttccgtctgagacagaccctagggatcatctgcgtgctctgtgcagagtggagtgcaggccaggaccgctcctttaacgttttctcctgtggacggcgtgtttggtccttcagcccattgtttgaatatgtggttgtaatttagaaacaaaacacttctcctgtgagtccattagatggcagtgtttttcaggctttgtatcctaaatccagctgtaaaggaaggacaaagggtccgctagtttggccacagctgacctccttgttctgctggaaatttctcaagaaggagacgctgggcattcatgaggggctggtcattgattccttttgtttattcagtaaatgtttattgagagtctgcttggcaccaggcgctgagccagatcctggagctgctgcatgaacaagagcaaccaggtccccaacctcacggcagccatggcctgggggtgtggggggcagagaagcagcgagcttgcacggagacaagttccaacagcgaccactggccgaggcagcaaagcaggacaatgcaatgaagaaagaccagggaggccgagggggaaccctctgagagagggatcatctgaagatgtggagaacattccagcccaagaggagaggggtctggaatggatgcctctctcagctggaggagcgaagagaaggcccaggcggctaggctggagggaggaaggtggaggacacaaggcgatgatgcaggaggggccagaccccatcctccaaactcagggaaacctcagctctctcctatgtggacaggatttgtgatggaggatagtttagtgggttaaatcaagaccccccaaaattcacattcatcctaaacctcagaatatgacgttaggctgggtgtggtggctcacgcccgtagtctcagcactttaggaggcagcctgggtaacatggcgaaaccccatctctaaatacaatcaaaaaattagccaggcatggtgacacatgcctgtggtcccagctacacaggcggctgatgcaggaggatcacttgaacccaggatttcaacgctgcagtgagccctatttgtgccactgcactccagcctgggcggcagagtgagaccctgtcttaaaaaaaaaaaaaaaagaagaagaagaagaatgtgacattatttggaaatagggtcattgcagatatcattaagatggggcaatggggccatacaagactagaatggaccctaattcctacgactggtgtccttataagaaggccatgtggtgatagagagtggagtgacgggtccacaacccaagggactctgaggagtctcggtgttaccggtggagggtgtgcagccaggttcctggcatcttgaacaaagaattggacaaaacgcacatacaaagcaaggaaagaatgaagcaacaaaagcagccgggtgaggtggctcacgcctgtaatcccaacagtttgggaggccaagacgggtgggttacatgaggccaggagttcgagagcagcctgggcaacatggcaaaagcctgtctctactaaaaatacaaaaattaaccagtcgtggtggcgggcacctgtagtcccagctattcgggaggctgaggcaggagaatcacttgaacctgggaggcggaggttgcagtgagccaagatggaacaaaagtacactccacaggatgggagtgggcaagcggctcaagaacctggatacagaattttctggggtttaaataccttctagaggtttcccattggttacctggtgtacatcttatgtaaatgaagtagtggcctgtgatcattctgattggttgcagaaagtgaccaattagaggctgaaatgaagttacaaagttacacttctatgcaaatgaagacttggcccacagccagcctgattggttgcgggaggggacaaatcagaggtattttccatttttcgtctgccacacagaaaagggggcgccatgcaaagagagtagcctctggttcttttgttacttgggcgtggaaagttggggttttccttttgacttagttataggaaatcagcgggaattggccttcagttccctgcctccagaccctggtctcctgccccaacaggagccacgagatgctggaagggacaggaaaggacacctcatgagggtgtttggagggaacactgcccacacctggacttcagactccagaagtgggagagaagacattcctgttgttgtaagtcctctaatttggggatctttgtaatggcagccgcagggaactaacacaggtggagagaacatatcttttatttgcctgaagccccgaggaaaatgcctgagcagcctcggagacactgcaggtcccactgtggggctgaaacgcccttggggatctcgcttctcagggagtggaggagaccagaagacaaacgcttttttttttttttttttttgagttggagtttcgctgtatcgcccaggctacagtgcagtggcacagtctcggctcactacaacctctgcctcccaggttcaagcgattctcctgcctcagcctcccaagtagctgggactgcagggatgcaccaccatgcctgactaatttttgtatttttggtagagacagagttttgtcatgttgaccacgctggtctcaaactcctgacctcaggtgatctgcccaccttggcatcccaaagtgctgggattacaggcatgagccatctcaccccaccaacaaagtccctttagcagttgatgggccagaggttgttgttacacccaggtcagggtgaaggtggggcggggagggtggtggcctcactctatctggtgaatttcattttgctgcaccagggttgacggggtgggtgggatgctccgtgactcagaccaccagttattaaagatcccagataaatttattctgtgcttacctcttctccgtcagcgactgggctgggtcaccattaaacttggtcttaaatatgaatatagaaaagatgatacctggggataggcactgcccggtgccgcaagaaaccagctgtgcccctggcctgggcatttcatcagctgaactgagctgtagctgatggaggtggacggcagcatgcctgttacacttccccagtttttttttgagacagagtctcactctgtcacccaggctggagtgcagtggtgcaatctcagctcactgcaacctctgcctcctgggttcaagcgattctcctgcctcagcctcccgagtagctgggactacaggcgcgagccaccatgcccggctattttttgtatttttagtagaaacggggtttcaccacgttggccaggctgatctcaaactcctgacctcaagtgacccactcgcctcggcctcccaaagtgctgggattacaggcgtgagccaccgcgcccggcctacacttccccattgtttaaactgtcctcaattattgctgttaaaaagaattttaagatgaatttttaaatccacacagcccctgtgtaagcatgagggagcagggtgagggcagctggcctagcacacacttcccctcccctgtggacgttagggttcagagatgtggcctcagaatggcaggccagaagctgtggccgggcccacactgtgctgactggacaccagccctcagttcagctgtgttttcctctgctccccatggtgctgggagtgaacccaaactccccgcaaggctctacgtggccctagcctgcctccttggtttcaactcggacccctctccctcccgctcaggaggctctggacgccgccccttccttctgtatccccaaaggggaactcattccatccacagggtcatcgcactttctgttccctcttcctggaggctgcctccccagacgtggcctggttccttcccattgtcacatctaagcttggtccccaaagagactgtcccaagcacccactctaaacaagcacctatgaagtcatcagaagcccctctcctgagtgagtgtcttcctcacccctcctccatctcggttgccttgctctttgcccatctgcactgctttgagatcagagctttgtctgtccctggcacccggaacacccccagcctctgtgagtttaggtcggaaggcgctgcgtggtcttggtcttaatctactttccaaagcacatgtctcgttcgggctgcatcctagatggtgggaagacaggactgactggaagctggtctgaggctctctctgcagtccagatgtggatggcagggagcctctgcggtccttgggcactgacccttggtcatgaactcctggcagggcaggagtcctgatttcctgtgctttctgactctagatcccaggctcttaccacaagctcaggttcaccaggaagtacttggttggttgccaggttcattgagcagactgtagttgctcagttaaccataggccatcacttccagctgggaagagctgggaatccaggtgtgtcttaaaggacaggcgggaaggagggcactgagggcaggaggaggggaaggagaaaaacagcagagaccaggggggatggcaagttaacctgtctacaaggccaagtgcatcctgggaaagaggggtccccaaggaacggggtccatcttgggaaagatcctgttttactttcctgaggctgctgtaacaagctgggtggtttacaacagaagctttttctttcccagttctgggaggtgaaagtccaacggccaggtgcagccgggccatacttcctccgaaggccccagggagggtcctttttgcctcccccagtttctggtggtgccggcaggcctgggcattcctcagcttgtggccacatcgctccaacctctgcctctgccgtcccatggccattttctctctgtgggcctctgtctccaaatctctctctccttataagaacaccagtcatggccaggcacagtggctcatgcttataatcccagcatcttgggaggctgaggcaagtggatcacttgagtccaggggttcaagaccagcctgagcaatgtggcaaaactctgtctctacaaaaaatgcaaaaaatggccaggcatggtggcaagtgcctatgatcccagctattcctgaggctgaagtgaggatcactgagcccaggaggcagagtctgcagtgagccgagatcgaaccactggcactccagcctgggtgacagaacaagaccctgcctcaaaaacaaaaagcaaaaaacaaaaacccagtcattggattgaaggctgaccctaatccaggaccatcgcatcttaacttgattacatttgcaaagaccttgtttccaaataaagtcacactcacaggtatcaggaattaggatctcaactgtcttttggggacacatttcgacctgccacaggccccaaggattgactcaacaccttgagcctgcggggacatccctgagtgtcctgggaggaacccgggctcccaccggctacctgtgtgacctcagacaagtcccctggcctctccatgactcgatttccttacccggaaagtggagaccggggtcactacagcagaattgtcctgaggactaaataagctccaggtgacataactcaaagctccaggcttggctcattgtgggagagaaatgcaggcccttcccgtccctggaaaagggaccttcccacacagcagtcgctgtccaggcacctggactgtcccctgtctatccatcttggggtctcactcgtgcacctagtctcacttagagatgtagttcagtgccgcgcagacaaggggcggaggcatcaggaaggaacaggaggagggagggaggcgagcagccagtcattccggaagagctgccgggccagacgcaggggctgggagaaagccagctggcaggcccagtgctctccttgagggcctgcccaggaccacggctggcagctgtgtggggcttgggtcggggctgggagggcttctgctggcagcgggcaccacattggagcctcggtggtcatggtcatcccaggcctggaaacagcatccgtctgcagccccagcctctccagccccagcttccctaaagggacagaacagcccttccctcccccacagggctgctgcaggagaggtgggaggaaaggcagagagacccagactcctgcactgggtggttgccttgtaaccgactgatgatgtgctaggtgtttctggagctgacctggccacaggaatcacgggccatacctgtttttcctgttttttgttgttttttgtgttgagacagcgccttgctctgtcgcccaggctggagtgcagtggtgcaatcatagctcactgcagcctcagcctcctgggctcaagtaatcctccagcctcagcctccctagtagctgggaccacaggtgcgcaccaccacacctggctaatttttgtgctttttgtagagatgagtctcactaggttccccaggctagctgggaacccctgggctcaagcgatccacccaccttggcctcccaaagtgctgagattataggcatgagccactgtgcccagccacacctgttacactaccgatccccaggccccttcctggaggtttggggcatcttcccctggaggctcttcggacaagcaaggagagggagcaccacccatgtgctggcgccgtggtcattgttgttggtcttgttacgtctcaaagggtgcttctgaggacagaaggaggaagagaaagagaggtgctcgcttggggctggagagttgcatgggaaacagcagcaactcagagcagagccggccatctcacagccgcgggcctctctcccctttctgggctcctagagttggaagtgagtggggccatgaggtcctggtgagcaagaggaaggaggaggaactggctttgcagaccgtgcaaagccggttcccgggaagcacacacatggcctgcaggaggccttgtcctagcatcacctgcagcttcaagcacagtccactcagcccaaccacagaatgggccccgccagtgggatgtgcgctctgggcaaggctcacatgtcctgtcatcggtcctgtggcctcctccttccctcggcctcccactgtccctccgtgtcaagtctcccaccatctgatgcgccctctggcaaggccagtgagtcaccctactccagacacagaacctgctgctgcctcacaggctcccgccatctgccctcctgcctctgctctcaggagaaggacactcctggaattccacatggatcccaccttctccctggagccctgccatactcctgggcaccgctgatgcgctctcctgctggctgacttggccttgaacacgggtggctcaggcctttcccagggacccttgcttcatgccccagctggaggaagccacactcacagcacttagcccctatggggtcttcagctcttactctcctggtggactcctcctccaggaaggccaccggccctgcctccctttgttcttagaaactgctcctttggggcagcccctcaactgttcaacatcctctgcccttccttgggcaagaagccacctttgggtgtaaaccacactccgttcagcacggacaaggcggtctctgcaggatgcagaccctcagtctcactctcggaggagctgctggaggctgtgcttttaaaagccatgtcaggccaagcgtggtggctcacgcctgcaatcccattactttgggaggcccaggcaggtggcggatcacaaggtcaagagatcgagaccatcctagccaacatgctgaaaccccgtctctactaaaaatacaaaaattagctgggcatggtggcacgtgcctgtagtctcagctactcaggtggctgaggcaggagaattgcttgaacccaggaggtggaggttgcagtgagccaaggtcgcaccactgcactccagcctggcaacagagcaagactccgtctcaaaaaaaaaaaaaaaaaaaaagccatatctaaaaccttctccagaccttgagccctccacaggcctcgttctgtgcatgagagggcatccgcccccttccactgcgagcctgttgccattgtaggggaggagctggccggccccagctttccagcctctccaggcccaagggggaggagtggaccccaggcactgagccggaagcctccgctacagcagggatgctgtctgtggtgcactccagggacacagagcagagcttttaatgggggtggctgctctccagtgaatcacagcaagagctagctgcttcatcttatcaacagcaggtaccggagagacagaaaaagaaccagaaatgggttgtaggttgaagtcaaccagccacgctccatgcctctgaccaaagcctaccagcactgggccgggcggtggctcacgcctgtaaccccagcaccgggccgggcgggggctcacgcctgtcatcccagcaccgggccgggcgtgtccccacacatgaatgttccaggcttcccttgtctggacgatgtgatcagggagacaccatcccagattctggctggtaacagagcaggcctcctcaaccctggcaccattgacacttgggctggacaattctctgtcatggggcagcatccgtggcctctgcctactgccagtagcacctcctgcccagttgggacaaccaaaaatgcctccctatgctgcccagtgttccctggggaacaaaacccctcccaggtaacatgcactgatacagagtaatcatctctgccaccaattttcacagattataacggaatataatgtgcataatgcaaaaattatattgaattctttttaaaattaccctccaccccaccttattccaaaaaggattgtaggtgacgttgttaaattaatctgctaccatgaaatttttaaaataaataatagcaaatatggggaaaatggaaaataagggtaggtcagtaaaataagtcggtggtaaaaataaaataccaaattcacccactagatgaccaggcagtgactggtgagggctgtgtgttttatacagactttccggcaaagaataaacccactgattgcttagaagtccagtgtcagccaagcgcggtggctcacgcctgtaatcccagcattttagaagcccaaggcaggcggatcgcctgaggtcgggagttcaagaccagcctgaccaacatggagaaactctgtctctactaaaaatacaaaaaattagccgagcgcggtggcacatgcctgtaatcccagctactcgggaggctgaggtaggagaatcacttgaacccgggaggtggaggttgcagtgagccaagattgcaccattgctctccagcctgggcaacaagaaaaaaaaaaagaagtccaaaaaaaaaaagtccagtgtctctaaaatttctaccttgggttctcaaaaaagaacacaatgtgagctaggaaacgccattcccccagtaagtgggcatttgtctagcagctgtttgtgtcccttagtatcatatcataaggaacataaattagtctttcctgggtccattgatccaatatttattgaaggcttttgggcacgtgacatggtgctggacggtggagacaccaagatgaccacatgcaaactgctccccaccccctggtgtccctgggaagaacatggtcagtggcgctcggagaagggaggggttacttgtgctgggggcctagcttcatagcgcacacacactgtctgagctgatgtcacaagtgactccgagttcaaaggcagagaaacaggaaaggcacttccacagggaacagcaggaatagaagcccagagggttttcaggcaggtgacttttttgggggagatgggaacagctttattgaaatataattcacgtgccatacaattcatttaatgcaattatatggaattaagtgcaattcagcagttttcatgtattcagagctgtgcaaacattgccacaattttaggatatgttcatcaaccccagaaagaagccccatacccttcaactctcactccccattcccaccccctgcaaccaccaagctttctgtctctacggattcgcctatttggattttttttttttttttgagacggaatctcactgtcgcccaggctagagtgcagtagcgcaacctcggcttactgcagcctccaggtgcaagcgattctcctgcctcagcctcccgagtagctgggattacaggcgcccaccaccacacctggctaattttttatttttatttttaatagagacggggtttcgccatgttggccaggctggtctcaaactcctgacctcacgatccacctgcctcagcctcccaaagttctgggattacaagtgtgagccaccgtggatatttcatatgaatggaatcatacgtgttctttcatgaccgtctttaacttagcatcatgttttcaaggttcatctgtgcctgtgccagtaattttttttttttttttttgagacagagtcttgccctgtcacccaggctggagtgcagtggcatgatctcagctcactgcaacctccacctcccgagttcaagcaattctcctgcctcagcctcccgagtagctggcattacaggtgtgtgccaccacagccagctaattttttgtatttttagtagaaatggggtttcaccatgttagccaggctggtctcaaattcctgacctcaggtgatccacccacctcagcctcccacagtgctgggattacaggcatgagccaccacactggacacttccttctttttatggctgaataacacttcattttctggagagggctacatcctgtttctccatttgtcggttgatgggtgtttgggttgtttccagtttggggctattgtgaataaggctgctgtggacatttgtgttgaagtttttgtgtgggcgtatgttttcagttatttgaggacatagctagcggggggattgcctggtcatgtggtgaggccgatgacattttacacttggtgactgaaagtctcgtgagtctccctgaactctgtgctgcttaacgtgcaccactggggtaagaacacccctggggaagagtaagatgccagccattgtgggatccgatgttgccagcctttgtgggatccgacggtttaccagagtgcagagaatgcgtaaggaagaggtagaggatttctgcgtctcactaggccagcatgcgtagcaccacttgaagctcttggtagaaacgccgccttccgggctgaacaccgccttctgggctgggcctcagagccactgattccgtaggtcagggggatgcccaggaccctgcctttgtaataagttcccctgacatgatcagatgttgaacagccctgtcctagacggtgagcgccatgagagcaggtgccttgtgatacacagtaggcacccagaggctctttgaacaaatcaatgtgatcctttttataaatagggaagggggctgttgaaaaattctgttagatagtctgagcaaattccatcttggccctggctttgcacatttaggggaagtagggatgctaagatttgctgctggtcacaccctataaagagcctccaagtagggagaagggtagggggcaaaagacttaacctgagccctaggtaggggccaaaggtggaatggttgccatctgtgcctcttcagcagcccatgagctcccgggaggccagggctgtggcctttgaatcctggggtccagcctcaaggaggggtgggctgtgcatagggttgcctatcccccgtcaccccaccaccttccagtgcccttagtacctcctggcaggacaagagggggcccagaaggcagctctgaccagggtccacctgcagggtgtgagggggacacttgggatcagagggcagagccagcccctccggatgctgaagaggatgaagtaaagtagggcaggggcttcattcagccattcactcactgattgcagagtatgtattgagcgtctgctgtaacctaagttttactgggagtgttggaatctctctgtccctttgacccccgcgtttccttccttgggccatctgtgtcataaccatcaagacgcagtggcttcttcacatttctggtgatgttgcttctccatgtgccaatcccccagcggataccccactctccggagggagaaccccaagcaggtgccgctgggcatgcgccagggaggctgtgaccggagcaagcactgccttgcttggagctggctgcctacaagctcagacatccagcccgcagagtccaccctggctgcagcgcctgcccaggcctcaggccagtcctggctcagcagctgtcagcccggagcagccagcgatggcctcaggggaccagccaaggcaggcggcttgtgcatcctgcttcattaataatgaatggccagacgctgcccgcgcctctccctggtcgcctcattgacatggtgggagcctcagccgcccacagcgcgcagagccaggagctggatcccaggccccctcagaaagactcaagaagccccgagaagcagctgctccccaagaccccctgagctgctgccccagaagagcagtcacagcggccctgcgcagccccccaggccatcacctccggctccacaagtgacaccagagagagccctcccttctccagtccaaggaaggcgggtgtgctcatcacccgtcactcatcatcaggagtaactcacagcccagccctgcccaacacttttggagactgttgggctgaggacttgggcagccagggctggttgagggtggggacagaggaaggacctgcagagacgagagatgtgaggggaggagaaaatgcgcaccccccaacctccagccgcgcttccagcaggtcttctgtacctcgggcctggaaatgtgactccctccctcagagctgtgcagccttcttccccaccgttgccttcggaaatcctcactcctcaaggaatgcctgcagcttccttggcttctggataaagtctcgtcctggtcgggggagaagagtttcttggggacagatggctcctgagcccaaggggacaggggacgcagccaggatctgagcacccggcctcagcatgcaggtgtccttcgtttgctcggagcacagcctcaagggccggggccctgaggatcggctgggccgaccggcggccagcagtcccagcctgggctcccgaggccgcttccgcgccgtggccatggtggcccggagcctgggacagctgtcggtgcagagcctcccgtgtgccggtgacaccagcgtgaagcagcaaaggatgaaatataggtacgggggcacacagctttgcagggtgggggctgacctcccggcctccccaactccccacctcctcactttcgagagcgcataaaatctgcaaatccccatttgtcagacttgggcagtttgtgctgagggccgggaggggctgtgcttagtgcttggtagatgatgagaaacagcgtggagaatccggtcagtgctaagtttctttcttcccagtttcagggggagatggtgagggcgccgtcttccttccttctgcctctgttttctttctgagggtcgtttacaatagccaagccaccaatgctcccttttcctggggaaccctgaggcatgggccacagggcccccccaacatcctcctgccctcccctgggcacacaggctccacaagatgccctgggggtggtctgatatctttccagccaggccaccatgacaaacatccgtttgatagtgagggactgtggggtgaaccctgtgatggaatgaatcttccctcctccacctgagccaggcccagggcccaattcctctagcaggcgggactcttgctccagcaggcacaggcagccaggccgcatctggagtttcccgatggtcagcccaggcaccttgcttccctccacccgggctcagcccccatctggctcccggtgctgtgacttgtatgtggggaggatgccgaccactcatgtcaggagcagggcctccctcctcttccctgccggggcctttctccaaggctgggtgaatgtgcccaggatggaaaagggagggtcccagctttgtacaaagggtcccgggagcagggttctggggcacccttctgggggccggccttcctcactccccatgtaagtctctgagtccagagccttgattgcgtccagaaccatcctccaggcataaaggaagtctccacaacacgtggtctacagaagctggaaaagctaaattaggtctctggttcccaggtttcctgggaaagttttcccaaaacaggaaccgaactggggacaactctgcttttcagtgacctgaaactggagtgcaggccaccagcctcagaaacagccacaaactgttctcattgcatttgggaatcttctgggtttatagctggtatgggtgccaacctgaaaagcattgtgagtccatcctgatgcctgagctgtgtggcttaaacctctacaaaaccaatgcctgagagttgggcctcgtgtgaaaaccgtgtcatctaagccaacccttgctggaggtgaattctgggatgactctgggggtcctgcatccacattcgtgtctcttccttccctgcgtcctgggagggtgagacatgctttaatgaacctctgggctgaaagtgtccaatcctctaagcttaatgacagtccagaatggaattctctgttctagaagctctggggtttacatcttttgttaagtagggatcaaaagctaaaattagagccaggagaggtggctcatgcctgtgatcccagcactttgggagactgaggagggtggatcacttgagctcaggagatcaagaccagcctggccaacataatgaaaccctgtctctaccaaaaaatacaaaaattagctgggcatggtggtgtgcacctgtagtcccaactacttgggaggctgaggtgggagaattacttgaactcaggaggcagaggttgcagtgaaccaagatcacgccacagcactccagcctgggtgacagaatgagagcctgtctcaaaaaaaataaagctaggagtaaaccgaacatgtatatgtatattttttggttcagatacctattgccttctgcaacttttatgtcagtcctaggatctcaaaggagttaaaagcgggactatttctaaacataaggcactatgtaattggaaagtgtggctgttaacactgtttccctcctaaaactcattgaggagtggctctcagagggtgaatgctcaccacgcccatgtgtgtgcttatgtgtgcatgcacacacgtgcgtgctggaggcagggagggcaagacagggcagtgaaggggggtgttcatcaggctggcaggtttgcagtctgtggaccagagttcaaatcccagccctggcactctctgactgagggcgggtttgcagtctgcagaccagagttcaaatcccagccctagcactctctgactgagggacccccatctctccagtggagttgcaaacaccgccttatacctggccaggcctgggagctttccttgctgctgtcacggcgggagggtaggttcatagccctgtaggatgaggtgcagtttcacaggggctgagatgggccttagaatccaaagcctgtgccatcgggcacccccgccccgggcctctcccatcccactcatgcggtacctgcgtcatgagttgctgcacagggactgtcccagggccacagccagggtgcaagaggggggcagcagggactgagggggagcctgatcccagcctccctgtgactctggcctcctccctgggaagctggcccttcccagtggtgtgctccaggcacagctgtccagtgacacgcacagtccacaggtactaggaaactaaaggtgcatggccagtaccaggcgccacattcttgcccaagggcctaaggcgtgctcagtgtaggatggcgggaggccaagcctgataagtaagggaggggccagcacttggtcccgagagtctgaccccagggcctgggcttctcacccctgaattactacccaacatcgtcccaaacaagcactccctgggaccctgccactgccagctccaattagaagacaaagactggaagcccagcctgtccttagggagcctggaatctcggagcagggcaggcgtgcaaacatcatcactgcacggagcagacaggcgagcagggcactaacaggagccaccccatgtgccttcctccgcaaccagctagccaaggccacggtgcttgcccttcacctgatcacagttttgtcctctgcccaggtggctccaatgaaaggccccaaactcctctttgtaaaatgacctgtcatttcccggagccttccagctccggcccttcccaagtctgaagtgcagtttttaggggtgtgcagcagccgggggctccacgatgggcatcagtgctcccctccggcagaggttatgtctgtgagtcctcactccaggagtccagaccccaggagagacatgaggcaaattaatgaagaccgacagtatttgggtttcgagatgttgaccacctgcttcattaggatgtcaggtttcaacgatggggaagaaatcggtagaaaatgatctctgtgtctgggaagtttcaagtacagcagggagcagccccatccagacccggctgagacgtgtgctccccaccccacacgcagcagccatgcttacaaagcgttcagcctggaggcgccctgtcccttcgcatcccttctcccgaggcctggcagcggatggcagaaccaataccatcattttcacagggaaacaagttgagcagggtaattgcggcatcacgtggtgccctagttttgttaaattagtcctgtgggtggtgggtggaagagcggctgaacccagagcccactcggggaagtgggcccatttcccaacactcagaccaggaacagatatggaatcaggggcaggggcaccttttgccagccctccccaaactggtgaccaaggggtgcctcttctcttcagccctgacctggccttcagcagagccttttcaagcaactgttccccacagtcactcgtggaggtggttttgcagaggtgggggccaggcctcccttctcgatgcccagacatatctagaccagtggggtccagggctctgtgaacacccagacattgcaagcaaggttcgttctgagggcattcgtatctaggcatatttccaggctttatctgtttttgcaaaggggttatgaccccaaagcagctgagaggcactgatcagaacctccagccctttgcttcattattggactcctactaagcatttataatttcttaccacagttactttctagccagcatgggggaaattacctaaacttctaaactgaccaggcttatgtggaatgtattagtggtacagttgggctgttctccccagcagccacagacacgagttattctgggttggaacatgccagcaattcagagggtactatcaagagtatttcactgatgtataaggaggaaaaaggaaacttcagttcctttttaacatggtaatagttaaagcttatttgatttgtccattgtttttgaataaagaaaaggttaccctcctgctctctttgggaaatgagacacatgtgagtcagtgtcctgtggccttctatcctcatggatcttcttctgtcctcgtggcagccaccgtgagaaaggcagcctcgtgagcccattctgcagatgagaacactgaggcatcgggccactccataaaatgcccggtgtcctccagccaggaaagttgtaccaggatttgggctctggcttcagagcctcagcccatagccgccacccggtgcgcccctttcctgaaagaaaactcagcttttcttatgttctcctttagggaaaatcccagctctgcctacaggagcaatattgctggcagctggagtggttttaataggaaattgaaaaataaacctaggcaattttaaagtaccttcagtttggtgacacgttcaactgttttcaagctgcttacaaatattatatccactcatgagttaggagtccaggagccttataaccagggaaaccgaggctgagagggacagagtgggctcgtgtcagaagtcgggggttcagaatgaggcttgagccccatgccgccttcccaggggccaggcttggacaggaaagaggataaactgaggacatcgcatcctccgaagttggaagtgtcatggccccagggaaatgcagggcccttgggccaggaggctgggcctcacccgctggtaactcatggctctcactccccaccgcctagaaccagctgccccttgaccagatgctggcagctggattccacaagggaagtggaatctgaccccagatgggtcaaggcctggctgcagctgtgagatccacccggccacttgtcaacctcaccatctgggcagatcacgccctgcttaacaggctggggtgtgggatgcatgccaccatggtggggaacgtgagctggcagccaactgcctgggtgggatccagctcctccgcgtgctgggcaggtatcgtaacgtgggaatcgatgtcacgacaagcaaggcgcctgctgcgtagggcacctgccgcttaggactcctgccaccgcgtagggctctgctgcgtaggactcctgccgccgcatagggctctgctgcgtaggactcctgcggcgagggctccctcctgccgcgtgggctcctcctgccgcgtgggctcctcctgccacatagggcacctcctgccgcgagggcacctcctgccgcatagggcacctcctgccgcgagggcacctcctgccgcgtgggctcctcctgccgcgtagggctcctcctgccgcgtagggctcccgggaggatccggggacaggatgcctggggactgcctggcctgctgcaaccctgcaggctcctaggcaacctgtgccaggacatacgggcatgccggtcctcagcagagggctgccaccctccttcacctcctaaggacagtcatgatggcccaaggcctgttcctgtggaccctgggatgcaccacagtgggcaggtgcctcagtggccccgggaaggagcccgggcagctgtgcttggttaggaggcctacgctgccaggctctgccgctgctgttgggcctggctgtggctgtaacaaaggaagggctggccttgcttgagaactggcagccctaccatggagctccccgcaccccgagggacagatgcacaggccatgtggtccagtgaagtgggacgatctcctgccccagtcgctggagacaggaagaagagacacaaaatcacaaatgcagccttagagaggaaggaagaaggggcttctctgcaaggggcgccgcatggatggtgccatgggggtgagaccagtccagtttcgccataaaacagacagcgtccctgtgcatttccatctgtccttgagaccactctgcagacccccactgggcaccagcagggcccgtgccagcagcatggtgtgggccgggggcagttggcactttacccccggggtgggtgagcagaggcacctctctgaaggtccccggtgcctttcggagcctccaaacacacattgactgttgggggagtgggtggggggctggccctggcgggaactgagcctggctggcagggtcctgcctgggtgctgagaactcacgtggcgtttgtttttcaggaacctgggcaagtctggcctgcgggtctcctgcctgggacttggtgagtgtgggggtcccctccgtcccaccagggaaacaggctgtggggaggccgggcatggactgaactggacaccccttgggaggcagggtggcccaaaccttggcactccccagggagtagctgcacccagagcccaggattcaggggggctcggttgccatggcaacaaagaggcaggtgggaggggggctgggatagagggagagagacacagtctcagcagaggaggtgaggcggatactaggggcccctccacacatggtccccaccccacaccacaaaatcagaggcccttagggccccgggagtgcaacgaagacaccttaccttccaaggcaggctcagctcgtgagtccctcctggagcgccattggatttggccctttttcctctcctgtcagatacaaggcctgtttccagaatgtgcagtccccacctcccctctgcatgcagtacacacacccccacacacacaccgcccactgcagtacacacaccccgccccccaccagcacccactgccctgacaccgccctccccgctctgtcccagcaggagcacgcagacgcggctgtcagacctggtgtgttttcagagaggcatcccttgtgccatttcttgcggcatgtccttggaactagagctgcctcagtacagctctgaccagcatttcaaaagccccagacctcctggacccatagccagcagcccgctctagagacttttgtcccctcagtttattgaccccaggagagcaggactttctctgaaggccagctgtccacacacactaaggacaccctggccacagagcagcacagagggacacctgtggctgccccctgtgccctacagcctgaggtctgagcaccgacgggataatctggcttcctgccaggttcctaacttgagcccctgtgtctccttccaggaacatgggtgaccttcggaggccagatcaccgatgaggtaagatggggctctcccagcaccccagaacccagcacgggctcgccagagcacatggttaagtctgccgcgtggaccagtgagcacgtgctcccgggagccagcgcagcagcctccctccctctttctgttttgtgagggcgccctgccccaggggagagtagaaaggtgagccaggtggccatggccagaggggatgccgagtctggtgccatcacccagcagtggatgcctcgggcctcagcatgtcccttaagctccccaggactcagatttcccacacgcgtgacccccattccacagttaacgaggagaattcagggtgcacacgcttcccaaattctgaagccggatgcaggtcctagctgcccccatggaggctccagtaactgtctgtcttggtcattgggaatgcagcccctgcagtgtcacaagctgaagaacctgagatctgcatttcacccaacatccactgtccatttcccagctgccgcgaaccgtgcggatcgcagtcagatgtatttgctggggctcatgtccccacaattggaacaagaaagtgaacactaacaaaaagccagcttgtatgccgccagcgcctctgggtctctcggaaggacagggacggcacacgcccagacatgtgtgcttctggacagtgaggcagcatctcagaaatgagagcagtggcatttgctcagacagctctgggcatctgcacaagaagcagttttcacatttatcctacttagcactagaaaggttgcgtttaaaaattgatcagcgaattgatgtgagaccttgttagctgcgattgctcagtttccaagggaaagctttgcttctatcaaaatttaaatgcgtacagtttgtgtttgaggtcacttttatctttaagacactagctggccgggcgcggtgactcacacctgtaaccccagcactttggaaggctggggcgggcggatcacctgaggtcaggagttccagcctggccaacatggtgaaaccccatgtctactaaaaatacaaaaattagctgggcgtggtaggggcgcctgtaatcccagctactcaggaggctgaggcaggagaattgcttgaacccagaagggggaggttgcagtgagccgagatcatatcactgcactccagcctaggccgtagagtaagactctgtctcgaaaaaaaaaaaaaaagacaatagctggttatagaatgatttgccccttgctttgaagttgctggataggcgctatctcagggtgaagtctggagttattaaggcaaaaggaattgccttacctcagcccaccagattggttcagttggagccctggggcccatatggttcaatctgaatcagccttgcctgacttggcctcgtttccctttcgatgtggtttctaaaccaggatgggagaattctgtagaacggcataacttcatttccaaacaatattagctgggtggcctgtatgtccttgtgggaaagataaaaacaagcagacagactagacccatccaatgagatgacgttttcaccagcaaaccaggcatacccttagagcattaatgaatggcccagtggcagccccgctggcccaggcctctgcagtgtctccatcaggaacacagtgatggacatgtgtgaagatattggaggtcatttctagatgacaccaagctggaaggacagagaataaaatagatggcagtgtcagggttctgaatggttgtggcaggtgaaaatggcttagcaaaggagcaagacaaatttttgtattaatcctatagttagtgtcaaaaaagaaatcaatacatctagaagggggggcccgcctggctgcggttcagatgaaaagggtttgtgcacttcaggtgctgcggctcagtccgagccagcagggaagcaaggaccgtcctggactgctttttttgtttttcagttttttattacatatatgaaacataaaatttgccattttaaccatttttaagtctacagttcagtggcattaagtacattcacatactgtgccacccttaccaatatctgtttccaaaatatttcatcaccccaaacaggagctctgcacccttaaacaacaactccccatcccctggtcacctctagtctacttcctgtctctatgaactctgcacactgtttgtataaataaagttttattaggacatagccacgcccatcatttacacatagtggctgctttcactccacaagggcagagctgagtaattgcaacagagactctctggcccacagtgcctgaagcatttactatgtggccctttacagaaaagacttgacgtctcctgttctttgggccgcagcagctgtaccctgcactatctgcagggctgctgtgtgaactgctcagcccagttctatgccatgccagggacaaaatgaaagcttgcccaggggtggaacaaaccacctggtgaggcaggaatgacagccaccctcacatggcacagggcagagtccacagtttgtaggacaccatcacactctcagccagtgctcacaggagcccatgaagggatcaaactatgctaggaaccctaaaatgacgtaatgcctgtcggagccaccacggtggtttcaggtctccagccctcccattgttaggtgccctttctgtggcctcacactccccattagaagcatgtgttcaagacaagctggacaataaaaatttaatagatgtaatggttgagaacctaacacttattatctcacctaatcctctatcaacccagggaggcaggtgctattcccagttcagggaagctgagcctctggctataaacaggtgcaggggcctcacctggcctctggccacagggggttccacctggtgctctttgcctcaacgcttgcggccagtgctcagctgtggggtaaccgtactggggtagggacagattccttgtccccccagatgagggtgacagggaggtggcctgtatgtctcctgagcttccttctgacttcagtgtctgggacccagatactggaaggaaccaaaaagtcacaacataaaggctgcgtaaactgaaccaggatgcagccacagagcggagggctttagaagtcatgttttaggtctaggggcggtggctcatgcccgtaatcccagcactttgggagattgaggcgggtggatcacaaggataggagttcgagaccagcctggccaatatggtgaaaccccatctctactaaaaatacaaaaaaattagcggggcgtggtggcaggcacctgtaatcccagctactcaggaggctgaggcaggagaattgcttgaatctgggaggcggaggttgcagtgagccatgatcgcaccactgcactccagcctggatgacagagcgacactccatctcaaaaaaaaaagaaaagcatgttttgaagaacagcatgggaaaggcccgtgacagccaatggaaaatgcagccagcatagacagcagtctgtggagtagagctgcagttttctagggaaagggcagaaaaacctggaagagaaagtacagcaaaatcagagccgtcaaaacataaataaataaaatagtgagaaagcagagccccacagtgccgtgagtcgctccctctctttcctgcctctggtcctgccaatcccaggcgccaccctggatgtagctggaattgtatggtggcttcgtttttgctgagggacaggtgaggttagggttggtgtctgcagtgccggaccctgctgatccggctgtctgcacgccttcgggggtctgtgatgaccacaggtttctgtgattggccgggctttcctcccaggagggagccaggtgtgttcagggccaccgtgctccggagcggagagcgccgagccctttgttcttagtctatgagcaggagtgggaggcctcccggtgggcagagcagagccaggagcatccggggccccgcctcaggcttgcggagcccctgcctagcgccagctccctgcctgcttccagcctcttcccagtcactgtctttctagagagggcgacagggtaaagaggcaggcaagacaccgtctccagtggtcgaacagcatgctgtggagagggtgcgagctgcctgtggctgctgtaacaaatagccaccaatgcgcggctgaaaacagcagcaacgtattctctcacagctctggggtccagagatccaaactcggtacccctgagcctaagtccaggagtcagccgggccgggcttccttctcccggccaggacctttcccggcctaagtccaggagtcagccgggccgggctcccttctccaggccaggacccttcccagcctcttcagcgtctggcgctgctggccttccttggcctgtgcccgcatcccccagtctctgcccctgtggatactctccgtcctcctcttctgtcagtcaagtctccgtctgtctcgtcctcataaggtcacctgtgatggcactgagggcccacttagctaagccaggacattctccccactgcagagtactcacgttaatcccatctgcaaagtccctctttctacctaaggtcacattcccaggttccagggacgtgatacctttggagaaccattatttagttgactgcagagaagaaagtagaaaaaggagggcaggggggcgggggtcctgacgacagggtggtcaggaagcagaagcgagcaaggacgccacgtggtggtccagagaaagagccttcgggggccaaggggacaaccaaggcacagccctaaggccgagtgttggggagaaggggatgcaggggatagagctgggggtcagggtgcagatctggtggagactttggctttgaccctctgcgagatggaagcccctggagggcttttgcatggaggaaatttgacctgatttaaaaggtctgccaaggctcgccctggctgctgcactgggaatggcgagtcatgaggatgtcccagagttcagcgtgtgcacgatcccatgtactcggaaggcacatcctgatgtggcagggctgtcgtggagcctgggaggccgcatttctgatctcatgctgatgctggcccatggaccacgctttgcctggggaaggtgcagggagagaggatggaagcagagagctaggaggctattgtgagaaaccacccaagagccgctggaggctcagagcagggtgggcaccgtggaggtggggagacgggtcagattctggactaatttgcaggggaagccgcggcaggggctgaacttcaggctccagtgatgggaggattagtcaaggagggctccccagggtttgacctgagcacaggtgagcgagacctcccgggagctgatgctgccgcaggctgccctccctggcccacaccagccccagggcctagagtgcccctcccccacccaccctctccttgcctgcctgacaaactcctaaacacccttcaaaacccagtctttgtcggccgcactttgggaggctgaggcgggcagatcacttgaggtcaggagttcgagaccagcctggccaacatggtgaaacctcatctctactaaaaatagaaaaatcagctgggcttggtggcatgcacctgtagtccagctactcaggagactgaagcaggagaatctcctgaagccaggaggcaaaggttgcagcgagccaagattgtgccactgcactcccgcctgggcaacagaatgagactccatctcccaaaaaaaaaaaataaccccagtcttggatattctggacatgtgataccccttggatgaaccttgaaccttgaggacattacactcactgaaacaagccacaaaaaggacacacggtgtgactgcatttgtctaaggtgcctagagtagttaaattcataaataccagagaatgatgggtgctggggctggaggcagggagcggggaaggggagttactgttcaatgggtacagtttcagtttaggaatatgacagggagatggatggtggtgatggttacacaactatgcgaatgtacttactgccattgaactatgcttgaaaaaggttaaaatagtaaatttcatcatatatattttaccacaacttaaagtctctttgataaatgcagtaatgttttaattaaacaaaaagaatgaaagggatcttcatgagcaggtgtggattggtttttaggatgtattgtgagtgaaaaaatcaaagtgcagaaacatatgggtagtgtgccacccctcctggaagaaagatgggggataagaaaatacatgtgtctgaaatataaaaacagaaaacggagccctgggtcccctcctctgagaagccctgccaggagcgtgagtgccctaaccacagacttagccccttcggggcccagcgcaccgtgccctcctgggctctctcctcctgggcctggatgtgggaggcatctgggaaaagtcaggaggaagacgaggaggaagcagtgagcaggtgaacaagccacccgtctgtccgtgctggagccctggtgctgggaaggaaagtgctagaggtggggagagattcctgggctctccctgggtgggcacatccgggaggaggaggctgggggggcagcagcaggtccctcgggcggcggatgcatttgatgcatggatgcatttgatacctcagggcagttgagctgcagcaggaagacaacaacagagccccggcaggtggatcctgaaaaccgacggcctccacccccgggcttcctgactcaaatcacagccgctcactaaccggggctcagcttcagctgtgctgtatttcagtgtctgagatgtttggggatgagtgccagtgtcgccaggctgccggccagatttccatacaccccccacccacaaacatgctgcctttctggcttctcttgagaggttggcagatctctagcaccaggtccgccttcccacgtgcagcatttgggcatgggccttctcccatgggtgccccccagtggtggctactccgtcctcactctccatacctcctggccacaagggcttctgagttcagaaaggagagacgcagccctgtgaagccacccctggctggttttctgtcctatggtttttgagggttattaagaattattcaccccacgctgggcttgttgctggtgaggcccagtgctctgagccgcacctggggaagcgtgacactcagagggaagcagccctgtccgagagccagaagctcaggggcacctttctctccggcctcttggagggagctgtcacttgcagaggggctcccctcgctccatgagtcccaccccacgaccagttctttgctcatggagcacaatcgcgtcctgacagcagccatggagcaaagtctgatgcacagcgcatttagctcgggcagtcattcatccatcttgcccatgaggcagccaccaccacagcagtgccgctcagggccgggagtatgtgccgttggagaaacactggacaagaggccagaatggatgtcacccaccatgcaccagctgtgggatgtcagttgctccatctacaaaaataacaattcagtcctcatgtgcaggtgctgggaaagattcaatgagatacaactgaatacaccgccctggctttaaggacatagactcatcccagcaacatccacagagcccctgctggggactgccttggtttcctaggactgctgtaacaaagtaacataacctgggggcctgaaacaacagacaccgttctgtcaccttctggaggccagaggtctgataccaaggtgttggcagggccaggttccctgtaaaggctcgggggagggtccgccccatgcctctttcagctcctgggggttgccaacagtccttggcttgtagacgtgtcactctggtctctgccttcgtagtctcatggacttctgtgtctgcattttctctccttgtaaatcaccagtcacatagggtgtaggacccaccctaacacagtacgacctcatcttcgctaattacattgaagaaggccctattcccaaatgaggtcacctctaagcttctaagtagacatgaattctgtggggatactgttcgacccagtacaggtgctaagccctgtgatgaccccaactgatggggtccctgctctcaagaaattcacagtccttggcagtttcttcattccttttgccttctttattcttctcaatgggtttgttactgagagctgcctccatccctgtcctgtggcaggagagggcaaggagacagcccacaggggagcctgtcgggcccgggagggcagggcctggacacggggaggcctcccaggccgagagggtggtgctccagagcctctgggccccacccccggctggcaggacagtgtcggttttctcgtttcagatggcagagcagctcatgaccttggcctatgataatggcatcaacctcttcgatacagcagaagtctacgcagccggcaagtacgtgtcttttcacacgggaaaaagtggttcagaatgcctgggcagagccggagctacagggattcctgccgctcgcgttcccaagagtgctcacaaatgcaccttgcaccctgctttcatttttaaactctgaatggctttaggaggtgctattttcatggggctggaattgcagaacacttggacactgatcacttgctgaactccccgtggagccaccagggggaccacagtccctctggtgccaaagatgctgtgctgggtgagaggcgcgatggagctgctgtcctgggctctcctgatgtgcctgacattttgacatttcatgtctcacttgtgcaactagggctgcagggcctcagagctggggagggcaggctccggccaagtgctgtggggagcacttcccatcttggcggtgaactttcctgctcaattatgtaaaagctcagccttcttcagccaggctgttggcttcaattttaaagactggctgtaatcaaatcatccactctcctgcatcgggtttccagaagtcagcttttgtttgtgaaatcatttgttggccctctcttcatcctccttctgcccccctcctgcctggggccagccaagttcccgtcagccgggcaggctgcaggcctgggctgctgtgcaccatagctgcttggcccgcagctgcttcgtgggccctgggtggttacctgcaactgcagcggggcccagagcacccggcggcagggaacccaactgggccctgctcaagttcccacccagagcctggggagcgcacagccctgggggctgccgctgggaccctcaaaccgcctccagcccccatctgcagcccttttggccctccggatggcacagccccctcccactccctccatactggcagcagcttcccatcaaagtgaactgctttccagacagatgagcccagcggaggggtctgaggtcaaaaagcccagtgcagatgccaagccgagaggcacctcccgtcccgagccccccacctcttcgctgcctgctttggcctgggttatgctgccctgaagaatgtgtgggaggcagctccgtgcagcctccgtggatgaggccgggcacaccccatgtcacagcagccacactccgtcctctgtcactcgcagtttccatgttcccctgtttaactggacacccagagctggtgagctgggcaagttccctgggtctccggcagcctcgggcctctcggaagccgcttgccagaagaccggggagtcagggagcagcttcccctcaggtcgccgtttctgtggaatcccctgccctctgctcctgggccggccactgcggtccctctgtccagctcagagctgagcccccggtggacgcccatcagtgccctcacaggggagctgggcgctgcgtgccggggataggcagggagaaactgctttggggagtttgggggaggctgagaggcagcttgcagggggccaaacccgtatcttcccgaggccccttgcttctcctgctgacactaatttgcacgcttctcagagagctgcaggatttctgtgtcccgcgaacagatgtgagtcctaccaaatcacagccagagccacaagccacaggcttagataactcactgtctgctgctcctctgccccagagatcgctgctagcttttctctcttcctcctcctttcctgatccccaaatcagggaccaaggaataaaaggaagaggcctagggctgagtgaattttctgtgtgtcttgaccataaatgaggagcattcagagcgcatgctaaacagcttgcaaatcagagcccattatttctgagtggatgactcaggcgcttttataattggaatgtagcacagagtatggatcattctccgtctgttgttttgctcagaaacattttgctacaagcagaaagttcttcaaagttaatccagtgctgcagtgccaggcaaggctgggacggccgcccatgcccccagctggcctgggtttggtgcaggacccagtgatgccaaacaggacagacagtggtccgcctagcatctgactctgccgttcagtgcaggaaatgagagggacacgtgcacccacacacatgcacacatgtatacacacacatatacacaagcatgcacagatctgctggaaatccagcccttgaccctgagtacatgttgattgtctctcaaaacagagcgtgacttgatgaataatttacctttgaaaaaagatacttgtcccggcgcggtggctcacgcctggaatcccagcactttgggaggccacagtgggcggatcactcgagatgaggagttcgagaccagcctggccaacatagtgaaaccccgtctctactaaaaatacaaaaattagccgggcgtggtggcaggtgcctgtagtcccagctacttgggaggctgaggcaggagaactgcttgaacccaggaggcagaggttgcagagagccgagatctcgccactacattccagcttgggtgatagagcgagactccatttcaaaaaaaaaaaaacaagatacttctctggaaattttgcccacctaatgttgccaggcattttccctggtgaattttcagctgactaggaaatgggatgctcgacagcagctccttccttctgtgtgagagctggggccgccactgcttagacacgtgtctgcaggggaacatgccacagccatcctagtggggggcaataacacagctgctcccactccctcgggccaaccctgtctgtggaatgagctactgagccaaggcgggtgttaacagcctggctctctggccccagtgacattttcacagagggaaccaagtggccagtggccacagtgggtctgggtttgatttttctgtttggctgtgatgagagctcggtgtcttgttttgcagggctgaagtggtactgggaaacatcattaagaagaaaggatggaggtaacggccctgctctctgcggcctgtccctggggtgggtgcgggcgaactatcccggggtcagcctcgtcggcctgtcgtgcagtgtcgtaaggcccgcaagtccccacatctttcttgctgggaagtggagaggaaaattcagttctccaagaggaggaggtgactctgcttgagaaagaagttgaagggaggccgaatacactgtccacccccaccctagcctgcccactccgcctctgtcccaactcatccacagagacccagagcaccagggtccctgcttgcaaagtgtcaggccaaaaagagcttggcgtgagaacgggcctgggtacagcaaaggcgtgctgctacagaagatgtgggtgcaaagcacttccacttctttggctggagcacttagggtcaggggagccagggggccagagaagggagtggctcagagagcttgggggcctggggttggatcccaccctgcaccttgtccacaggatcttcgcggcgtctcagcctctccggagctcactgttcccatctgtaagagggtgtgtgtgggaccgttccggcagggctatcctgagggtcagtggccccaagtctgtaaatcacccacccagctcagggcgggacgtgtcacactcctctgggaagtggtcccctccagcacagaccggggagcggtccccgggtgtgatggagcccaaaggtcgcagatcgggggccatccacccttctctcccaggagcctatgggcccttcccaggccaaggtcctcacccaccttgggaccaactgggctgagcacttgcctacattttgaggctccccagacccctggacacagctttatctgaaggtgctgacaagccccggggccctgttccttaataaatgcgtctttattttcagaaacatcagaagcagttataaagttgggcctccctcctccctcccctcgaaatgccactcagaatcccagtgccaaggggagcccccgccccctcccccatggattcctgacaccccttcctcttgtcccatcaaatttgttttttggcaactctgatcccaaaacaaattcctcctcaccctgtaattaaacgaaattgcacgtattagcaaatcccctgatcacgtctttggcgaatgtgcatggaggtggtgtggggtgatcccccttcctggaggtgacgctgcctctgccagagctctgtggccgatgcttcggggcagaggaggcctcctactccagcctcgtgagctgcttccctgagcagcccgggacccgggtgggaaagaagctcagccatggggcaccaggaggtcattgtcaccccctgggtgggaagtactccctcctctgggaggggtcaaggtcaaacgtggctgggaggggccatcattatcccccatcccaccaggacaaagccactggtatgggcatttgtctcgtgtggacttagagcagaagaacgaattacttccctttgcgctgctcaagcccaaatcctcagaattctctgcctcagctactcaaacccagaaccccactggcctggccacacttgggctccctatgcctcccctccctcctttggtgccccccaagttaccccgaccaggccgtccttatgcctcccctccctcccttggtgcccctcaagttaccccgaccaggccgtcccacacagattttctgcaacacgtgtcacattctgtagggaacgttgcagagagcttccctgcctgcctcccacctacatctttccatcctcaactcctgccagatccccccagagcccgcccctgccccctggcccacacccggcctcctccagccttggctcttgccacttcctctacctggatcaaatccatgcacccctcatagtccctgagccaggcccccctcccacatcctgggcggaaggcatctcctccggactccggtcacactaggccccccactgtccaactcccactgcctgactcacagttactgcctcggtggctgcctcctggctccatgaggagcccacgcaccccggctgggcacgtggtacacatcatatgatggagaagtgcccatttcatgccccaggctcctgggtgggagggctttcaggacctctgtgtgagagatgaggacgtcggggatgaaggaggaccccccaggggccgggcttatcacaccccttctttctcttctgttccacaggcggtccagcctcgtcatcaccaccaagatcttctggggcggaaagtaggtgcaacagctggcgatgcttccagccccggcccagcagccacggccccgtgctccccagagacccctgacctagaaggctcctggggtggcgggaggacagtcctccttgagaagggagagtggtcggggtctgtcctggacaggccccggcccagtgccatttcctgtccccagcaggggcagagctggtgtttctgcagccatcagctatgcctggtgcctgtccctgttaagggacgtcaaatccagaaaagaagctgtggccgagtttgccttttacaaaaacctcgcttaactttcctttttactcacatggattattttttcctggtcactatggtaacatcataaaaattatagagaaaacagaaaatttgtgaactgcccaaacccccaaagcactccaaattccctgggccgcctgtcacccctgcaggtctccaagtgtctagctccatagtttctgggctggacacacttgggctcataggaattataactacgattcattcattcattcttttttttatttttattttgtttttattttttatttttttgagacagggtctcgctttgtaatccaggttggagcgcagtgccacaatcacagctcactgtagcttcaaactcctgggctcgagcgagcctcccacctcagcctacagggatgagccaccatgcctgactaatttgtcctttttctctctctctcttttttttttttttttgagacagggtctcactttgtcacccaggctggagtacagtggcgtagtcccagctcactgcagcctcaacctcctgggttcaagtgaccttcctgcctcaagtagctggttctacaggcacatgccaccatgcccagctaatttttttatttttatttatatttttatttttgtattttgtagagatggggtttcatcatgttgtccagcctggtctcaaactcctgagttcaagtaatctgcccacctcagcttcccaaagcactaggattgcaggcgtgagccaccacgcctggcattaatttgtccttttttaagatatggggtctcactatgttgcccaggctggtcttgaactcctgggctcaagtgatcctcctgccttagcctcccaaagtgctgggattacaggcgtgagccactgtgcccagcctgatgtgttcttaatttaaaaaaaataataataataataataataagtccaaatcaaacagacgggttaggttgaaaatcaaagccccccaccccctgctgctgcccccctcccctctgagccctgtgaccaggcctctccctgggcctctgggagttcagccctgtagcctcgggtccctacccccaaagtggaatccgactccacacggcatttgctgaccctgtttttgcgtctaacattgcatcgtaaacgttttttgggaggggccagggtgccaaaaccgctggtgacatcacacgcggtcggcctgttttccagggcggagacggagcggggcctgtccaggaagcacataatcgaaggtgaggacgcgctcgggcacctcagggcccccatacctgtgggatcatcctcggaggccaaagtgatggcagcacagggcccgacccccccagttaacccactgagggcccaatcccggggcacccggtgctctggcctgaccttctccttccacccaggtagcacagcgggaccctgcagagaacgagggcagcccggtggctgagcacagaccacagaccagcctgggtttcaatccaggtttggccccacactggctgagtgggtcttcagcaggggcaccctgccccatgcctctgccacagtatctgtgcaatagggacagtaagagcgcacccggcgagggtggctgggatgcccgcagcgcccaggagaaggtgccacacagcccggggctcagcactcgcaggcaccggagcaaggcaccggggtgtctggctcttgctgtatctttattgtcttcatgcctttcctgtccgtgttcattttcttcgaggtaatagatcattccattgaaaatcacctggcggggcaagccacccactcccatcctccccaccccaacccagcgtttcactctgccggctgtgtgtcctgagctgctctaagcaccagcgggtggcttgggcgttttagacactattgccattgtttttgtttttgagatggagttttgctcttgttgcccaggctggagtgcagcggcacgatcttggctcactgcaacccccacctcctgggttcaagcaattctcctgcctcagcctcctgagtagctgggattacaggtgcccaccaccacatctggttaattttttttgtatttttagtagacacagggtttcactatgttggccaggctggtctcaaactcctggccctcaagtgatgcgcccgccttggccccccagagtgctgggattacaggcatgggccaccacgcccgaccatagacactattgcctttgatgggacgggcagcaggtgtagccctccctccacatgtgatagataaagtcatctccctgttgtaatacacagtggcctcagaggagggtatattgtctgagggaggaggggcttccccttcatttagtcaaggacacgtggcctgtggtcccccgatgtcctcctgaagggaagatccccccactccctgtgggatgtgcccccacctctgccgtggcatttcacgacctccatcagcttctggaagcttccagatgccagaggcctcttctccatctcttgttccctgagccgggcatggatgggcccaggtgcctgtggagatggagccacagcagtgacgcccccccacctggtcctcccccaggtctgaaagcttccctggagcgactgcagctggagtacgtggatgtggtgtttgccaaccgcccggaccccaacaccccgatggaaggtaggtggtctgcggcggcgccaccggttaggcctgggcggggtctgaagggtctgaacctggggttgtagaggccgccagcatgggccctgctgggcacctgggtgagccgtgagaggaggccgggtccagggtggggggcgagggggcaggcctcccctcagtagggggtgaactcagcctctggctgcagacccctcgccaggtgcacctggcacctccaggctgagtccctgtcctggctttggacccaggccgatccgccctccgagtcagagccgcagtggaactgtcccctcccctctgcggctgctattttgcagctaagtgaagtcgcagtgtggggactccaactgcagtgttctctccaatcaccatccattgggaagcttggggggacttttttgctctgggggataaattactacatagaggagaagaagcgttcagcgctttgaaaatcggttttggttactttggcgttttttattctttctactcctgcgatctcagccccctccgctcccccatcctcctgctacaggcgtctttccatgtgtgctttgctgctgcagggacttgaaagttaaattgtgttccagttattgttttttatttgttcatatacagcacgcacgtgcgtgtgttgatatatttttttcctttttaactaaacgcgtgttctgcacggtgatttgtgcctccccgctgtgccttcgtcgtgccacgcctctcagtgctcccagctatcaactctggtctctttaaatctttcttctatcaccaggggacccatttagttcctccaagtcaaggacattcatcatagaaggtacacagtgcccccagcctgactattgacttctgtgtccaagctgcattttatgagacagtatttttatttacatgattcttttaccccatgagaaacttctccataaaatgcataaagaggggaaagagcaccctatgagaacaccttgcaagtgaaggaaaagcaaagtggtgttggagcccctcgcccccagccccccatcccctcgttcctccttcctcccgtgcatggcccccacccctgggcttgcactgctgagctccgcggcggccgggggtcctcttgatctgaggatgctgtgatccccacctggagccttgaccctggatggtgccatgggaagggttggggaagaccaggtttccacaaggagcaaagccatcagggaccccaaaacacgcggccccccaccgagtcttagctcctccatggtttatgtttgctaagctcctgtctctcctggaggcagagatcacctggcttgtcacgctgccccgtccacagcacgctgctcctcggacggcatgctggctgcgtgtcccctctcaccaggttgccaaagcgctccatcaacgtggaatcattttcctcctgaaagaataaccacaggagccggcagccttctgaaaccagggggtggcctctggccacgcacagtctctctgccctccccacagctaacggccccaggaccccaccccaagggcaggtgtcgatctccctgggcctgggcccctgtctgccaactggtgctgccacctgaacccccatgtattatttgtgatgcggcaggagatgctgtgagttttggcagcagctagaaggattcagtcttcctacttccgttcaaccccattaaatattgaggtgaaggacagttgtccctaattgtccctgggtctggggccactgatatcacacttgggcacaagtgcagggtgctccctcatgtgggctccctgtccagcctgcttctgcccagatcctccagggagcccaggggcctttgcctaggactccccacctcaggacagccagaggctcctgccccgtcagccccgtctctccatcactgcatggaaggggcgccgcagggcagcatgcggtttcactggctgggaccttggagacctgagacagctgccggggagggagagtgagggaacggggctggccttgggggccttggcttccctctgtctggcatgtggacctaagccttggctgagaagaatcgggaactgatgctgcatgctcacaggtgccccgagagtgtttctaaaaaaccacaaggccgggcaggccaggagcccggacctgggcaggatgtagtcagagattctcctgggaccctctaggttctcctcaaactttcccaaccaggcacttcctgagggtctatcggagttggcagttaaagcaggtggcccagggaggtggcccagagagttcagactccctcccagatctccacccccaggaggggacagagaggattcccaggagctacaacctctgaccttggaagtaagcagagagcagggctgggcctgcaagcgtggaagccaagggtggtttgccaggggtcctgggtgagtctgccgagaccaccactccagaaaccccagtggcctcagctctagcctttaggaggccccaggttctgctcagggtggacctcagtaaaggggcactcagggagcgacccccaaaacagaagtggacgggaagccagcactgccactttgtggcctcgttgccattccaggggggagcctgcagaacaaacccagcatcttccatccttccttccttcccatcagccccactcccagcattttcaggacctcagcttccacgcagcatgggcaaaggacaagcaggcactgagggagagccagggcttttccagggtcaacgttgttgctgtctttagaaacacttgcactcccactcactcccacactgcctttggcggtcgaacttgcaagcactgtatccgacccgtgagaagcctagcgccatagtccctcgccctgcaaagctcagaggcttctgaaatttgaaatttcgacgccaagttctgtttttaaaatcacaatatccccatgaggctgagagggagctataaccagcagattgctgtgtctcaaagccatgtttgaatattgggaagaatccactgtgtcgctggggcgagggtccctcctctcttctttaaaaggccagcgtgaagtctccgcgatttcatcctcagggccttaggagtctccgccgtccacgattcaggttgttcccagggctcatggagcctcaaaactgtcctactccaggccctggcccctcacaggaggagcacccagacccctgtggccctgggaccaccccttgccaggggacaggcgggttgggactctggcctggtgctgggctggtttgagaacctgggccatggtcttacaaggctttccacgcccacttctcagtctcctggacatgacaggaaacatgagctcagccccgaagccctattctccgggaccatatggcgccccaggtcctgccacatctccttatccagcccactctctgttccaattagactttggaatagcccgaagtaggagaccagaaacgcaaaaacacatgtccctcctgccgccaatctgactgtaacgttcatgcattcacctggtccttcctgagtgatcggggccctcgaatcttccccagaccagagaacctccagttctagagtccagagccacattctttgattgtcccctctaatctaccatagaaacatcacggtccatccataacccatttttcaacatttccataggcctgtaaccagtcggggaaattgttttcacgaccaacttctaggattgtggttcacttttctctttcatcccaaaaaacccctcccacacccaacttcagagccaggaagtacactgcttgcaagacatcttcgcagcccctgtccctcctcccagcgtcctgcctgtatttgcagaatgtcccgaggctggccctgagccctggctgccccccacctgcggtttccctttctctcacgacagagaccgtccgcgccatgacccacgtcatcaaccaggggatggccatgtactggggcacgtcacgctggagctccatggagatcatggtacggtggccgcgcagcatgtgtgtgtccaggcacagactcccggcaccggctgcgtatggagaccccaaagctctggcggggtctgtgcctttggtcccaactgcaccgatgcctgggtgctaagggagggacaggatggtggagtgtggtggttatgtctgtaggccttgcagacggggattctgcatggatcccagcgctgtgtggccctggacaaatggcttaacgtctctgagcttgtttccccacctgtagaacacatctgctaggtgagcccccatggggccattctaaggagtccctgagagagccagtgtgaagctcttagcagatgccctggagctcagcaagcactctggggtgacaacaccgtcagctgtttccactgggctcctgagacgtgcccggtgctgttagggtcaagggttccacagggaccctctcacatgcaatcctcaccggtgcctttaccaggtgagtgccgcaggcagcccatttttcagatgtggacactgtggcacagagaggttcagtaacatgccaaggtcacacagcttgggccaagattaacatccaggctgtgtggttcagagcctgggctgctcataactggaccctccggcctgggggtcccaccacccacctccttttcccagctcaccagggcctgcctggctcccagggaagctatgagtgtgagcagtggggagcccgggctgcagctgctgggccagcctgctccggggacaccttggtgccctctccatggctgccccggcagccccccgcctgctcacaggcaagggccctcggggtccctttctgccttcacaggaggcctactccgtggcccggcagttcaacctgaccccgcccatctgcgagcaggctgagtaccacatgttccagcgtgagaaagtggaggtgcagctgccggagctgttccacaagataggtgggcaccctcgggcccctcgccccgccccaccccacccctgctctcgggcccagggcttgactccacctgcttttcctcttcaggagtgggcgccatgacctggtcccctctggcctgtggcattgtttctggcaagtacgacagtggcatcccaccctactcaagagcctccttgaaggtgaaggaacagcctggtggggagggacgggcaggggataggcattttggacgggtgggacctttgggccgactgctttggtgctgggcaggggttccgggagctgcagctgttcccacctcggtctgctgggggcgggctccttggcgtgagaacatggagcccctcctggcctgatcccatgtgtagaggggctgcccagcctgtggcacaggcccaagtggagaggccctttcacatccccccccctgcccccaccacatccccccatctctaccccctaccacatcccccacctctgccccccaccacagcccagcattcagaactctgagacccctgggcctgggctccgagatgggggctgcaaagccacatggaggtgaccctgggagaggcgcccctccccaccacacaacctctgagtggggactcaggagggtccccagactgcaggatctggagaacaaggagcaggccaagaaagtctgcccagccagcagtctcagcactggggcccacagccctgggttccagggcaacgtggcctggcccccgactcctcccatcccatggcaaggtcagggcccccctccaggaggccctgcaatcctctgggggggatggccaggggagagagcactcccctagggccaggaggttcttctgggccacgggtggcagccgagaccccaggctgccaagtttcctaagagaaggaaggccagcacctcgcctccttgtcctgacttggggttgggccagcaccacagtctttgcacttcagagcctggacaggccccgctcatccaccagcccgtgcccggcccactgcccactctcccctacttgagaggcctggggcaggggcactgccctggcttcaagatgagaagagcccctatgagggagaagggtccagaaggaatgagcccatcggccccctgcacgtgggggtccaggtgacctgctctcatctgtagctgtgctgctcccctcccccgcaaccagggctaccagtggctgaaggacaagatcctcagtgaggagggccggcgccagcaagccaagctgaaggagctgcaggccatcgccgagcgcctgggctgcaccctgccccagctggccataggtaacggtggggtcgccatggggccagtgcccctggggagaacctgccccagctggccgtaggtaacagggtggggttgccatggggccagtgtctccggggagagagggaagggatccctggacatcatcccccagccagcctcgggtaatcgggctctaaggggcatggttgggaccccatgcctctagggggatgtcaggagtccctgaggacctgggccaccccctccatctgccagccataggtaatggggctcccgctttcatgggaagaggatggggagcgctaagcacttgggccacctctccatcagggagcagcgggctcccccatgcctcctccagccacctcttagacaaagcccgtgcccagcactgcagggcttcctagaccccctcagacccccagaccaagatgctgggtctctcggcccagtcagaggcaaggcagacccatcaggggtccctgtggtgggtgtttctccctcaccttgggtctcgccgccacagcctggtgcctgaggaatgagggagtcagctccgtgctcctgggggcctccaatgcggaccagctcatggagaacattggggcaatacaggtaagagtgagaggccctgctgggcagagggcccatcccagcccgagccccgtccagtgcatcctcccaggctcgtcctgcgtgccaggctctgttctaggcactcaggatgcgcccgtgaaccatcagagttgtgctcctggagagcttgctttccagcaggaacagacatgaacactaactgcacgaaacaaggaggttagaatgtgtgtcagggtggacgagcgctgtaggagagaagccagagataaagggagggagctggggccagggacggtggcgctgcagactcaggttcaagggggcctgtcaggtgggcttgttgagaaggtggtgcttgagcagtcttgagagatgcggagtaagtcacgcaaatgcctgcgggaagaaccttccaccagcaggaagagttgatgcaaaggcccaaaaaggcctggagcagaggggcagatcctgagaggcacgaaacacctccagggacttctgagtgagacgggagccgtggcaaaattgtgggcagaggagggcgagctgcagctcagcctggaaagggaggctgctctccggctgctccatcggggaggctttgggaagcaaaagtcgaagcagagagccctggtgggaagtggcagctgcgggtccgagacgggagtggtggttggatcctggatgtttgggaaggtggggcccccgggactggctgacaaactggatgtgggggtgagaaggcgaggtggaagtcggtccccgggtgtgtcacccggaagggtggcggtgctgtatgctgaggcaggcgcagctggaaaaagcagtcacggacatggaagtccagcatttggcctggagtttccattttatgtcactgctgccaccacccttcaggaaggttctagggcaccttgacatttgagagggagtgcacagacccaggcatgcttcctctctgccccaaaccttctgaaacacaaaagcagcgtggcctccatctgcctcagatggagcccagatgtgatggggcaacccgggcctggccagccgaccatctggaagagcctggccccacctcctccccaggccaggcccgtcttgttggtgggattctgatttgttgttgttcttgcacgcaggtccttccgaaactgtcgtcttccattatccacgagattgatagtattttgggcaataaaccctacagcaaaaaggactacagatcctaagccgcccccgcccgcctgctcggacagtttccgttccctcctagtctctgttcgctcgcttaagctgttttgaagccaagtgaagagtgtggtttgcatccaagagaaaacaccacactgtgatgtcatcgggaaatgatctcccaagtcgctgccagacaccacccactgcttcgccggacaatgtcgaagtccagtctgtgccggggaaggcactggttaggaaggatgttcaaacggtcccacccaagcctgtcacctctgctcatcctccaagaccacccagctttctcccagccacagccaagattcccaaagtcaaggcccaaagatttccaaggttcccaaagtcaaggccaggccaaggcctggttgggtccttggggcgggcagggccggcctctcctctgctgagaatccccacttggtgtagggggagaggggaaaggggtctggcccatcgaggggccccttctgccagggccttggttgctggggcagggcctccccactgggggtcttcctccacctcccactttccaagggctccaggaatctggggcctgaccacagattcctctcccatccttttctgctccaacctgccccactgggtcccggcaggggccatgcctaccaagctcgagctggcccttgacccccacccacccccacccttgctggcaggggcagggaccccagggggattgactctgcagtttgggagccacaaaaagcgtagcggtgtgatttctagctcagcctcccaccgtcttcctcctacacaccaatgatgagcctcatgccagtgaggcccggagcgcttgggaggggtcccagtggggcaggcccctctgtctggccacccctctgtcctggccccggaaggccctgtggtcatgtgctcctagctgcacggtggctgctggccacaccacggcaagtggcagcaggggccggccctgtgcacaaggatgcactcctctcggcccctgtagactttctctaaagccgcccgccagcccaggccgctgctctgcaccgagctggtgggcttgggttttgtggagcgcatgcttggaccctttcagtaaggaagggtctttggggttttctgtgcccatgacttgggggctgcacccccacagcacccccacaatgtaggaaaagacctcagggaacctctccctggaaagacgggcagggctggttagcccctcccactgcctgacacctgggacaggctgggcagaggggagagagggcaggacaggccagagtgacgcccccgtgcagcttgggccggagggcaagggatgccagtaagtctgcaggtgcggggtgccacctacaggcccaggcctgtgtcccaagcagtacccaggctttgcagaccacgcggggcagggctccactgaagccacccccacccctcgccagctagctccatagggaagcctgtgtctcctgcccccagggcgcaccctcagtgcaggcacctctgttcccgctttgcccctggaggagccactattccagaaggctccaccctgccgtcctgcgggagcctgctgtccagtcctggccgggccaaggcctgggaaactgtgaaagtcagaaaggccagcggggagaggctggggcgaggggaggagggggatcagcttctgctattaccgaccccccttcatgctgcccctggcgcctagaacccttgcccctcctcatagaccaagtcccgggggtctccactcagtcctgctgcctgcttcaccagaagcagccctgtgagtgtggggtggggaagtcccttcccaacggaggtcccagcctatggccctgggcccaggtgggggtcgcctgcttccttcccggacagggtcctgcagtggccaatggtgccagagggcaggtggcccaccctcgccatcagggagggtggctggccccatccccactgccacccagccccacccactgttggaagagggaccagcgcgaggtggtgcccagggtgggcactgctgcttaatgcgaggcacacctggggcagctgagccccccgaaggctgcgggtttgccaaacacagagaggccaggccccagtgtcaggatgcagtcagcctctggcgcagctctttccacgacctggttcctggatgtcctgcttgctccacacccatctacagggaggatgtgagggggctctgcctcctagggccaggtcccccctctcgggagggggtattgggtaggaccatccaagaaagggcagaagaccaagggcagtcggggtctagaaaggagggcgctggccctgctgggcgcttcggagcccccactgtttcccactcagctttgtgctcagatcccaggtcccaaggagtgacaggggcttcctcccaccttctgtccttgtccagtcatgtaaataatgtgctatttctctccccgagtctttttttttaaaacctaccgtggttcctcagctaactgcattccctacccaggcagagactgtcctatgcctcgagcttccaaacgagactcagaccgcgacacagccaccgtatttatggaatgacaaaataaataaagcccaaacccatcggtctctgtgactttttgctcctctcatttcctcagggtcagggctgggccagggtgacacgggaggggaggaaaaggctgccagcagcagggcctggggcatcccccaaaccggagcctgcagccaagggcaggtgggttggaaagggcccgtggagagagagcggggacagagaatggggacagggtggtcagaagacctgtcccccatctctcccaagcgattcagccaagggagggtgcgtgcctcccctgccgcccccaacacacacattctctttcaccaactctgagggcccaaagctgcttgctgggaggctgctgtccctctggggacctggctggctgctgttctcataaggacagaggtccaggcctggggaagctctcatggtatgtgtttggggtacaggtgagaggggcctcaccccagcacacccctgtttcgggctcccctccttcccagtgagcccctgcacccgtgaaatgaccatcccaggcaagagaaggcttccggacacgcccccaccccccaccactcctccctggccccagcccccacccccattctaaatcttgaatcttaaaaagaaaaagcctctgattaaatcctttcccaaaggatttattaaaacacagaaaaccaaaacatacacacagagtacaaagtaaaggtgattgtgttggctacagcctctgtccagcctcccgtgggcaaagaccagacaagccacggctcacaggggagcctggcttccaaagctggacccgcccccgccggggccaccctggctgggactcctggcgcgccctgcacccagcccagggccctccctttgccagcctggggctgtgcctggggaaaggggtcggccccctcttagctgggcctgggccggtggagtctgctccctccacacccctgaactcagaccccacgggccagtggggaccctcccttcctctccaggggtgcttgggctccaatcgctgcttgaggagttcaggacacacacacacacccaacgggccctttctgggttatcgcacctaaaaaaatactttgtttaaaaaaaaaatctgaaaattaaagaaaaaaaaaacacaacgccagtgagtttgggctgatgcaccacaacctgtaaactttcagacacagaaaacaggacaggaaccagctgccgaggccgaggcgggccttgcacagaagagacttgggggaggggccgaggccaggtcaccaagacggtgagggcagaggggcgtgccagcctcggcc

SEQ ID NO: 12271 - DNA, 47471 bp, Human
gcagaatccatcccataggctactctttccccttcctgccatgtatttgcttggctagagtctgtacgtgaatgaacctatggagagagagacttctatccctgtctcttctccttggtgactggtacctcctgccatgtagcctccgtctgcctttctccctgtgcagttttgtcaagtgggaaggtatagggtgggccagctggatgagatgatgcactaaaaatgtctatggaagctgtagttggccataaagttgacgttggccaggagcccgttggggtcactagaggagttgccataagtagaggtacctcagtgaaaccacagtgtagatcagatccatgtatctctgagtgaggtccacagattctgcaaatcagaggtgctggcaccacctgggacctgctggatcaggcccagcagctgagagtgcagctgggactctattttggacactttttcctcagttgattctgatgcacctcaaagcttgaggaccagtgataaccatccatttgacagatggagaaattgaggctcaaagaagtcagattctctggccagggtctcaaggctagtaatcattttcttgtctgtgaaattaatgctctgtaaggttcatttttgctagacaccttaaggatatcagttttcctgagttgactttaattagcaacccaagtaagactgtatgggagtaagggtatgcgaccttagcaggggcatagtcaagctccctggtttgcctaatttgctgacgggtttctgaggcaaaggctcgccctcacctgcagatggtcatttggccaggtgtccagggtcgtgctggcctgaggggcggggtgccccccactccaagccggtggttccttcttgttgaagcccctccatcctttttctggcctttatctataaagtgacagccacttccttacattctaccaaggaagagtaaggccagactggccgcagtggctcatgcctataatcccagcactttgggaggccgagacaggtggatcgcctgaggtcaaaagttcgagaccagcctggccaacatggtgaaaccctgtctctactaaaaatacaaaaattagctgggcgtgctggcgggcacctgtaatcccagctactcaggaggctgaggcaggagaattgcttgaacctgggaggcagaggttgctgtgagccatgatcacgccactgcactccaacctgggtgacagaatgacactccatcttaaaaaaaaaaaaaaagaataaggtcatgcacaagtcctggggcacaagtgtgatggccacctgcggtgccttaggggtaagcctgcttcccaggttgctgtgtggctcaggataggagacatcccaggtcctgcttggggatctctggtattgagcccccaacataattgctaatagaacaacagagacccagaatcaaacattctttggagtcgtaggctcttaggacacgtgtagcattttgcactggcagtccttaattttctctgccagaacgatcccaggactttggcaaactgctgaggaccccaggctcagaggtacttgggactctggttttcttactggcggtggaagacatcaaaaggcaatataaagactgagtggaagctggaagtcggtttggctgagaaatccctcctggctcacggggttgggggagcggggagtcagggaggtgaccgagcagcgccccagtgcacattgtgtgtatttaggtttgacgttttggacccggggggtttcagaataaaatgtcgtgtgctgattcctcagtgccaggaggtggtggccttaactctcttctccccagtggattccgcggcttcaggcagcaagcggcacgcggaacgttcaccagcagagggcagcggaggggttaactccccaaatcacagactgagagaagaggaggggagacctggtttggagcagttctctcagagcctgtgcaggaggcttccttaattcgccttcagcccgagagctgggcgtgggaacagcgtggggtcagggagacccctgcttgccctggcccagaatatggtgacttaggattcagactgagcatccctgattccccagcgcctccaccctcagggaacctgaatggggggaaaaaatgtccaatatggagaacagctttgacgatgtttcttgcctctctccccagaacctgggatcctcatcgccaagcaaaaagcagagcaaggaaaacaccatcacagtaagtggctcccgaggggcgccctcagggtgggctgcgagctggggcatttggctgggctgttgccatggcgatgtggaccgccaagcagaagtgatgcccaacctggaaacggggaagttccaaagctcggatttcactcaagttccccatccacatgcccctcccacctccccttctcctgtcaatttcacatttcacttctctcctggtgaacaagtggaaggaggatggctgggatgatgcagaagccgttttttcagggcaggaggggaaggtatgcgtgcgggagtgggttgaagggggtggactgtgctcagcgcaagtgatgtgacgtgtaaattacagccacggcagggttgcttttgtgcggggtaacttctggaagatgtcaaagtaaaaagcaagagaaagcgtcctaagaatagagttcctaggagtccctgaggggagcaggcagcttctgcctagagtggccagcctgcctcccagggcgcttcgagatgcccaaccccatgtggagatgagggggagcccaccccacccacccccatgcagagatgaaggggagccccacactccacctctgctcctcagccctgtgtttggggcagctggggctggacatcattgccccctgaggggcacaggcctgagaagtgtggtcgcaggtttgctattttggcacaagggcaggagagcagggaacggggtattgctctcttaggctccaactcacacagctctgagccattccgaccacccctgtggagacaaaaccaagagtgggtgcatttccctgcttcgtccaggctgcacatcctgctttgggagaaaaagtgtaggtaaacaattaacaataacaattgctgcaacttttgtgtgcacttattatgcacatgtagtgatccaagtggctcatttaattgtccattagctatatgaagtgtcagtcgtggaatcaatatagtataacgatgatgaacgtggactctgaggccagagtgtcggttatattaatgacagtgcaacagcctggggcaagtttcttgacttcttcccgtctcagtcaataactgtcaagtggggaaatggggggtagtgggtggtctctgccttagggatggtgtagggactaaatgggtccatccatggaaagcacttagaacagagcctgcatatagtaagtgctctgtgcacactcatcaccctgtttacagatgaggaaactgaggcacagagccgcaccttgctcacggtcacccagctgggaagtatcaggatttgaaatctatgtccttaccacagtgccccttctggagctggcttgggttccttgtgtcatgagctcctttggagtgccctgtgctgatggacggtgtctccaagggctgggcagaacgactcagcctgcttggactgtggggtagcagcagcctccctgttaccggtggagttgatggagctggtgggtagggggtgtgggcaggctcaggtgcagagttccagagggtacagtccccatcttcaaattgtcacaaaatgccccagaatgctggggcacagcaggagctctccagagtcttctgaaatacataaaaaggagggggaggagaaagggggggaggtcggagtgggagacatatttgaattctagaagaaaaacaaaaatgcaaagtgaaaagcagagtgttatgtcgtggagggttgccttaaaggcgcttagtgatggtgcccaggccacagggtggggcacctgctggagtccatcttacagccagggcttcgggtgtggccggagggggctgatggcggcccttgttgggcccctgatgggcagcacacctcgcccatccctgccttccctgtcgcttcctgctgagccatatcattgcttctcatgagggagtctgcaaattgtattctcaagcctccaagaccttttttaaaatgcagattcctggatggcaccccagaccttcagttgttttctctggggccagactggaaaatctgcatttgagccagtgttccccagaggttttaagtaaacactcatgccttggagaatttttttgccagagaaactgagcaaaggagcgactggccagaggtcacaaaacaagtgaggagcagagcccaggacttgaacccaggtctcctggctgccggcccaggacacttcccggtgtaccacctggccttggcccacaggtctccaggccttggtgccttttcccttccacacaacaccgctctcccatgcccagcctcttcctctgggttctgatcctccagagttcatggtttcccaagaaggagatgctcagggggaaagggatggctcaggtctcaggaggctggggcgtgaacttccttttctgtggtgtgtagggatgaggtgagccgcttcccgtgccgtctgatcccgcagagcagaaatttccaggcctgggcagcaaagggtggtggatccagagaaagaatggagctggattctgacgctcctttttccccaggctatgggttttcaggggacagacacatgggccccctgacagcaacgggcaggggctggcagccttgctgggtcttgtttccgctgtccctggtgtggggctggcaggtggagtgtgctgtttgattgggagtgacgggtgctcatggcagctcacagcccttggcaggagcatgaacgcgtctgaatctagagggtttcagaaaagatgacagcaaagccacccggccacactctcacctggaaagaggaatttggggacacctgtggtcctcagcttcagggcttcccagcgtagccacagaacccggggtaggggctggaggtgaacccttggggtcctgtctactcttcttctctgttccacagagctccggggctggcttgttcctctcccataccctcccagatcagctttcctctgggagaaaattcagagcctgttggacttgaaccctcagttgtcaaaccattttcccttctctgctgcaggcaaggtggtcaaacaggccgtgcaagaagcctgtggcctctgttccccacaggctcctgctgggccaggacttaggggaggggcatgccttggggcctccgtatgtcagcccccttggtcacacgtgtgttcagtggctctcacacctcagccaggtggttttctggctgctgtgtcccactgcgtacccctcagagagcttctgggaggcagcccatgtgcttctggctgctcctgtgcggaaaagccctgcaggaaccccagctgcacagtggaccccagcagctggggagggatgggggtgtcactccatttacctgagggttggagaaaacagagttggtgcaagagcgaagacgcggctttgttgaggacactggtctcgggggaagtgagggtgggactgcctgctggaacttgccctgagcagtacacacggggaggcgtgcccctctctggctccctcttgagcacccttcctttttgagcccctgcctttggtggggacctggcacatttatacctcagtgtgttggaaaggtagtgtgacagaggctaagagcctagactgaagccggcttgcgtgggttcagagcctgggtccacctattccatgcacaaactgtgtgatcttgcataagtgacttagcctctctgtgcctcagtttccttatctgtaaaatggggataataatagcacctgccttgcagggctgttgtgaggattcaatgagctaatacgtgtaaaacgctgagaactgtggctggcacattatttgcttttgttgaacaaacagaaagtggatctttaggatggcagtgaagctcctgctatgcctgggaggccttgggaggaggatgaggtctttccagaggtgtagctggaccctggtattaaccatcaggaaaatgtaaccggggggaggacaggaatccacatgcggaaagtcctgtcccaccttctcttccctccttgggctttggagcaccgcagggtggagctgtgtggccctctcagcccttctgatccagggacctaggagccttgactttgaggtctggatgtcacagaaggacacagcaaggataaaagtggtggcccaggaattaggaagctggttctggaccctgctctgccacttatagtgaactagaattaaacattctgtgtctcagtttcctcatctgtgcatgaggttgcactagaccattgcaaataaacatcgaggctccagttgcttccaggacatctgcgcgcacacacctctcaccatgcccctctgctgccactgcctccctctctccgaagggactgttcttccatcttccatcccaatggatggaaacatgcttcctctccacccaggtcagtcaactcagggtttctcagcctcagcaccattgatcttttgggttggatagcactttgttgtggggagctgtcccgtgcattgtagatatgtatcaccttccctggcccctaccaaccagaggctaatagcatccaccctcgaccccacacagctgtgacaaccaaaaatgtctccacgttgctagatgtttctggggtgggggaaaaattgtccctggatgggcatcactgaattgacttcatggtgctgtcaagggctacctgtagagtatcccaggcttcttctaatcccctcttgactatgctgctcccagctgctatcatgaccccccaccccccatcccccatcactgcagactgccctgatggccacagtcacgttctccctccagtgcatcctctatgctgtagtgggggtgctcaccccagacaacagcctgattaattgttactctcctgcagggtgcttctgtggcccccgctgtcctgctgccttcaggacagaccttggcacccctgcaagaccccctctcagctcagtcttgtctactccctgactcaggagcagccagaagcacaagggctgcctcccagaagctctctgaggggtacgcagtgggacacagctcagccaaaccgagcaacgcggtccccacctgtagggcatatcctctcatcctgagtcctttcccttcctgcagtacccttctcaccttcccacccctctgtctgcctgggccctactattattacctaaatctaagattcctcccctggaccctcagtccttccagtaacctcagcacctcaggcttactccactggcaggtttatcccaaagaattacagtgacttatttacggaactgttgagagcagagatgatgccttacattcctagcctccggccactgcaccaagaaacatctcctgagcacccactatgtacccaacactgcaccagtcaggagggaaatggcagggaaaagatggtccccatccccttgtagaacaggctgtctggcaaggaggagaaacattaaataaaccatcacgagaaatatcattacaaatgtatgcatgcagcttgctgggaagagctagcgtagcacgtggcactgagcagcctttcaacagatgttcgaatggaaagtgaacgagcaaatagcccatcacatagcttcgtggtcgaggctggagctctgcagtcagctggatctggattcggatacctcgcttctgtgatcctcagtttcctcatatacgatgaggctgttcttcctcccctgtggagttgctgggaagatgaaatgagaatacatgcaaagccctaaagagggtgcctgagtcagggctcccctgcaggagtgaggatttggagaaatcccagtgggcttcctgggagggagaaatcccaaaatgagagaggacagagacagtggcaggcacctcggggctccatctgaggactggtatcctcaaggagtggcagaagcagcagggtgatgagtccttaatgagtcctcacattctactgcctttactcttctgccccaacctgttttctgttcctgcattcgtttgctaaggataatggcttccagctccatccatgtccctgcaaaggacatgatcttattctttgttacagctgcatagtatttcatgttgtatatgtaccacgtttcctttatctagtatatcgttgatgggcatttaagttgattccatgtttttgctattgtgaatagtgctgcaatgaacatatgcgtccatgtgtctttatgtggaaagatttatattcctttgggtatatacccagtaatgggattgctgggtcgaatgatagttctgtttttagttctttgaggaatcaccacattgctttccacatggttgaactaatttatgctccctccaactgtgtataagtgttcccttttctctgcaaccttgccagcacctgttattttttgacctttttaattatagccattctgattggcatgccatgatatctcattgtggttttgatttgcctttctttaatgattagcggtgatgagcatttttgcatatgcttgttggctgcacatatgtcttcttttgaaaagtgtctgggccgggcgcggtgactcacgcctgtaatcccaacactttgggaggccaaggtgggtggatcacctgaaggtcaggagttcgagaccagcctgaccaacatggtgaaaccctgtctctactaaaaatacaaaaattagccgggcatggtggcaggcacctgtaatcccagctactcgcgaggctgaagcaggagaatcgcttgaacccgggaggtggaggttgcagtgagctgagatcatgccattgcactccaaccttggtgacaagagcaaaactttatctcaaaaaaaaaaagaaaaagtgtctgttcatgtcctttgcccacttgccatgtaggatcttaagagcagggctctgtggcttgtttatctgtgtgtcttccattgtggtgggcacaaggtctcccccaggggctgtccctgtccctgctaaatggatcacgaatgctggttctcaaagtgtggtccctggaccttcagcatcacttgagagctcagaccccatccagagctcctgaatcagacagtggggggtgggacccagcaacccatgtcctctaggtgactctgaggcatgttcatcctcgactctgggacaagaaggggactgagtggtacttaggtgggtctcagtcctcctcaggacttccatggccttttaggtggttggcttggagccagccaggatgcatcattgaaggggctgtccttggtaccgtctcctcttccggctagcagtctgtctgcacaggcctgctggggtgcacggtggcatcctcactctgagggtaagtcaactcaggaagattctggggggaacaagactggccaagacccatttctcctcctgcctgccccacgttttggccaagcctcttcctgacatgggaaagtcctttcttcttgttttttttttttttttttttttttttgagacagagttttgctcttgttgcccaggctggaatgatgcaatggcgcaatcttggctcaccgcaaccgccacctcccaggttcaagcgattctcctgcctcagccttcccaagtagctgggattataggcatgcgccaccaagcctggctaattttgtatttttagtagagatggggtttctccatgtgggtcaggctggtctccaactcccgacctcaggtgatccacccatctcggcctcccaaagtgctgggattacaggcatgagccaccgcacctggccaggaaagtcctttctttgtagggaagtgtttccccgacaagagggcaaggccaagagcagtttgagtgaggaaagacgatggaaaggggagagatgcccgcagggcaggccactccagaagcattcagacccgcctctgagtacccacaactctactcgttccatcattcttaatgctcaatttactttaatgtcatagttaatttatcattaaatttgattgaaattttcatggactgcattattcagtaacataaagatggactgtgatgactgtgatttgttgaaataagaataattggaatacaaaataaggaatctgtgcacttttgaaacccgtcccttgttttcatgattgcctgcttggcagtgggttgtggaggcacaggaaggaaggagacttgtctctggacacaccttggggactcggcccgaaaccaaggcttggggctttctgctgctggcctcaagaactggccctcccttctctcactgaggctgctgaggcctgggagaaaactccccagcctcagctgatcttcatctagcctttgtttttttaatccatcacagtgctaattttttagagttcaggaagctgtgcaccttttttttttttgagacacagtctcgccctgtcacccaggctggagtgcaatggcgcgatctcggctcactgcaacctccacctcccgggttcaaacaattctcctgcctcagcctctcgagtagctgggattacaggcgcccaccaccatgcccggctaatttttgtattttcagtagagacagggtttcactatgttggccaggctggtctccaacttctgaccttgtgatccgcacacctgggcctcccagattgctaggattacaggcgtgagccaccacacgctgccacaaggtgccttttaaaaaactatcttgattttccccacttatcattagattcagattaaatatttttgacaggatttttttttaacttaggctaaagtgcagtgatataatcatagctcactgcagcctcaacctcccaggctcaagagatcctcctgcttcagcctcccaagtagctgggactacaagtgtgtgccaccatacctggctagttttgttttttattttttgtagagacaaggttgtgctatgttgcccaggctggtcttgaactcctgagctcaagtgatctgcccgccttggcttcccaaagtcttgggattacagatgtgagccaccatgccctggccaggaatcttacatagataatgttgtattcttagaagttacacattttgaaaaggagaaagaggcccagcacagtggctcatgcctgtaatcccagcactttgggaggccgaggagggtggatcacttggggtcaggagtttgagaccagcctggccaacgtggtgaaatcctgtctctgctaaaaatacaaaaactagccaggtgtggtgacatgcacctgtaatcccagctacccgggagaggctgaggcaggagaatcacttgagccagtgaagcagaggttgcagtgagccgagatcgtgccactgcactccagcctggtgacagagcaagattctgtctaaaaaagaaagggagggagggagggagggcaggagggaaggagggaggggaagagggaaagagggagggaaggagggaggggaggagaggaggagaggaagggaggaggggaggaagggaaggagaaagagaagaagggattatccttggcagaatttggtgcagccctgtcatctccagggtcgtccacgtcattcctgcctctgatccttctgctgagttgtgtttccctctagggtggtggggacctcagccctcaccttaaccacatgtaaggatctgggaggaggaggctccttcttttgttggggacttctccccagactgcgactgaggtctgtgccctggcagctggggagggggtgtgcgctagatttacttctagccacccaggagcttcctgaaccagaggtcacaacgggaggtccatgggcctgactttgctgacagaagagtttgttgggcctacatggtgttattgtgtttattattattgtttttaaccttgaattaattgccaacacttaaaaatggagacactttgcataaaagtccccattttcagcttccctcgagtcatcacataatccgtcagcactggactcctcagaagggcttgacgacacttggcaagagctgagcaggatctgccccttggacgcatctctgcagcctctggcccctgcccaaagagctgagcaggatctgccccttggacgcatctctgcagcctctgacccctgcccaaagcagatgctgtccgccctcctatcccagctgcagtttctgtgacgctgtccgccctcctgtcccagctgcagtttctgtgacgcctgggtacctcactggcttgcacaccccgcctagcattggagtttgtgtcctgggcccaaaacctcagggctgcatcattttttaatgtgtgacattttccacttcagcaggtgcttgggctgcaagaaggggttaaagacttataaggctcaggccttgctcccacagaggaagcaaattagcccgcgtcctaggagaggtgggaatctggggcctgaagccacctccacacaatggggaaaagccaggcagtattgcagatgtgctcgggcagaaaaggctgagatgacctgaaaatttctgtacttcacgctccttagctagggccagccttacacgtgcaacccagatttttttttttttttgagggggagtctcactctgtcacccaggctggagtgcaatggcacaatctcggctcactgcaacctctgcttcttgggttgaagcgattctcctgcctcagcctcctgagtagctgggattacaggcacatgccaccacgcctggctaatttttgtgtttttagtagagaaggggtttcaccatattggtcaggctggtctcgaactcctgacctcatgatccacctgcctcggcctcccaaagtgctgggattacaggcgtgaactgccgtgcccggccccccagattataattttaaggtgtatttgttcgtatgatacacatcgtgacataaaatttgcaaggtaatctctcacccctgaccctcacccacacagttcctttccttggaagcaaacaatgttatcagtttccaggaatattctatatgcaaataaccagatgtgtattatacaggtgacccttgaacaacatgggagctaggggtgccccctcctcacccatagtccaaaattgacatataactttgaactccccagaacttaactactaatagcctcttgttgagtagaagccttactgacatgaacacatattttgcatgtttatgtgtattatacactgtattcttacagtaaagtaagctagagaaaataaaatgttaagacaattataaacaagaaaaatataattactattctttaagtggaagtgggtcatcctcaaggtcttcatcctcaacatcttcacattgaatgggcgaagcaggaggaggaagaggaggggctggtcttgtcttcctttttgaaaaggaactataatactctgcttgctttttttttttttttgtttttaaccttcacctaaccatatatcctggcacattttccttgttaaattttcttttttttttttttgagacatagtttcgttcgtacaatggcatgatctcagctcactgcaaggctggagagcaatggtgccatctcggctcactgcaacctctgcctcccgggtccaagtggttctcctccctcagcctcccgactagctgggattacacgcatgcgccactacgcccagctaattttgtatttttagtagagacggggtttctccctgttggtcaggctggtctcgaactctcaacctcaggtggtccgcctgcctcggcctcccaaagtgctgggattacaggcgtgagccaccgcgcccggccgctttcctaattaaatttaagaacttcatcaccatgtcctttctgatttccatagatgtctatctcatactttgtttaaccattcccccactgatggacattggagttgttttccagcctttaacggccataaatagcgctgtcgtgaaaaagcgtgtgtggatgtcactgcccccatgcaactgtatctgtatgatagactcttgtgcaattgctgggtcaaaggcacctgaagtttgcaattttgatcctagtaaactgccatctagagaggtggtactggttcacagcccatttggggtgggggtgagcacctgttgccgctcatgtgaaatgctggcccctggagcacgggaagatccctgtgcgtgttctgtcaatagggaggctgctccagtgccgtgtcccccaggagccgaagccttcctcgctattccagtctccagcggggtcattctttcttgttctgtgccctacagataaactgtgtgacgttccctcacccagacacgatgccggaacagcagctgctgaaaccaaccgagtggagctactgcgactacttctgggtaagcagcgcctcagtttcccccacagcgtgaccccggtgaccgggagtggacacccaggatgggtaggagggacctggatctcaaagtggaggggcctttctcgttggagcgtgaagggctggtgttagagtttgcatctgtgacaggaacttaggaccctcttggggtccagctcattccatgaatctcaggggttcagcaggacttttgttcacattacagacacttcaaccagaatgtaggtaagcggggggccattttctccgatgctcagtgaaggcaggagactagaatctgcctcaataaatgaacgtgggctccatacctgcttgtcacttacgtgagtgacgttggacaagtgcttcacctccttgggcctcagtgttctcatcagaattgtgaggcagttgggcacaggatcttcagagagctccagcttgggtaatcctgtagttttaaaacgtttgcagatcacttagcgaacacagagttttagttttgcaagattaaagacaattttgcaggtggatggtggtgatggtcgcacaaccatgtgaatgtacttcatgccactgaactgcattcttaaaaatggctaaaatggtccgttgtgtgctagatgtatttttttcaccattcaaataaataaatttgtagaaatgcagagtcctgtacctcagaatatcctgggaatggtcctgggccatttgcatgttaaagtcatagtgactttcagaattagatcacccctttctggaatcagatagtggggatggtcacaaaccctgtgaatgtattgaaaaccactaaattgtacatttcaaaaaaacaagtgtccaaagactccaaggaacaataaataagtaaaaactttgttttcaccactttgcaagaatggattttttgagacagagtctcactctgtctcacccaggctggagtgcagtggtgtgatcttggctcactccagcctccacctcccaggttcaagcgactctcctgtctcagcctcctgagcagctgggactacagatgtgtgccaccacacccaactaattttttgtattttattttatttttttaatagagacaggatttcatcatgttggccaggctggtctcaatctcctgacctcaggtgatccacccaccttggcctcccaaagtgctgggattacaggcatgagccatcgtgcccagccggattatctacacttttttagatttgctaaccgaatactagataaaagtgcttttctctttctacaaaatcgcttgtaccttagaagatatacaaagatccctgttgcctacacctctcaccaaggcacaatttctgtagctccagctgtgctgtgtccagggtagagatctgtgcattggttgaggaaacagtataaaggggcttatctttggcatcagacagacctgggcaggtgagctcagagggcggggtaagcaagcatcggggtaagcaagcatcagagtgcgtaagactttctaggccccagtaagtgagttttattctgcttgtggaaggagggtgttagaaggtcttaagcagcaatatgatgtgatctgattcataggcattgtgcaggtgggggtgggaagttgacgggtgagtggaagagaccaggaaagatggtggtggcggcagagagggagagatgtacctgggtttggaaacatcatctctcaagaggggtgcagtaaatggagggttcaaggagagagtggtttgagccctggaaatgggtatcctagttgctggaggtcagcgtgtggggtctcaagccttggaaagctggtaggaatgtctgatgccgcctgcatccagcagcatccggagggcgacacttgtgagttcttatcttaattcgagctctctggggactctgatacttaatctgcaatccacttatccccctgaccatcaaggccttttccattaatagaaatttctctctcctgacacagtcattaaagcctgtttcttctggctggttttccccagagtgcatagctcagcatatccatcctagaagggaggcagatttgagctcagtatttggataattttccttctgctttttcatcaagatgtagcattcgtagagtgaagcacagagatcttcagtggacattgcttttaaactgcaagaacagcccgactgtgaccccgtaggatggtgatctccctgtcatcagggatgttagcagcgtggccggaggcctttgagttatggcacccgagggaggggtcccacaccgggggaactgggaaggtgtccataaaatccttcatctacttgatgatggtaaatggggttccctgcaggcatcagcaaccccttttctttcccctctcctaaaatgtctgatctggatgggatctgagagatgcaacccacccctatttcaagggggtggtccggggagatactacctaggattggacaccctgcagctgagcagagacaagaacctgggtcctaccagatgctgggacactgttctcaccaatgcacctctctctctgggatatcaaaaacctgttctgaacaccttccattaagtatcaaagtgtttgaccctgggttcctgatagggaaaagctgtaaggaggaggacacttttagacatgcctgggatggccctgggagctggtgctccagcagccacggccgtgcgggcagatgtgtgggtgaatctcaggcaggggaatggcagggaaggggcatttggtatgcttgaagaaatgcaggtaaaataaaataaatcatttaattttgaaattttaagaatatttgtttgcaaaattaattggctgctaagtacttatttcattgacttgcccatcctccccaagtttggacttttatttaaaagtaactaataacagatgccatttattgggtacatagtatgtgctcagcaatgtgctcagatatatacataggtcatttaccctgaaatgaccacatgaaggtggggctgttatttcgtcagttttgcagatgaaaaagcttaggcctggagtgagtgaagaacttggccaaggtcacccagctagtatttcagggcagcctgtcctgttctctcctccggcctcccttcaacccactttctctctatgatttacttttctctcctgtgatcttgtatgaatgtgtggttagagggtgtcactgccctaccagtgtaagaagttggtagaagacaggatggcttaaggctgggggtacctgctcctgagctcacacatagtccagcttggagtcaggatgccaagattcgccgagggccaagccagatctgcagccacctggttggaagtcgtaggccgttaggcatcacagccggtgctcttggacacttgcccttcttcctctcagttcccaggttgggagagttaaggggcttggatgtggggatgcagcaactgtaagagcctgagcatcagaaagcgctgttgggagtgggggcaccaggagagagatccgagttagggcagcagagacagctgctcccgcgtcttgtgctggactgggattgccaggcacatctaggagccgtcctccctctacgccattctccctggctccagactcagacgtgccctaaactcttgtgcttctgcttcctttgtaggctgataagaaggacccccaaggcaacggcaccgtggctgggtttgaactactgctccagaaacagctgaagggcaaacaaatgcagaaggaaatgtcagaattcatccgggaaaggtgaagcctgggcccctcccagccctggggcctggcaccagtgttccccggggccccgtggccggggcggggcgacagcacaggactcagtactgcacactcagcattgggctggttagcgccaggcggcaaactcatggcgcctgggatggatctggtcagcagttgtgtacctttggccgatatagtgtttttaaatattgaaagcaacacttaaaaaaatgggtagatttcatattaaaatctggatatttagcacaccttgaaagagcagaagcattggcaggattgcctccacatccctcacgcgacacttggctggagctgagtagcagctactcttgtagagggggtgtgtgttcccattttgccagtctccaccattccgtactgtcttcccccgcagactccttcactcctttacttatgtacctggccatcatttgaagcacagccctttaccgtaaccagtgggggggatgttacagttcaattcatcgttagccaaaacctgtgtcccagggcaggagatgttgaaccctcctcctaccccatccctgcctcaaggattataacagtgttttgtctaaagagcttgggaacacagatgaagaaacaataaattcagcccaatggaaatggagaaatcgacaaagagaaagagaagttccttctctatctccttcctcctctctctctgtctccaagttctgaggctctgttcagcacacactcacatacccacagctgcacatacccacctatcacccatgtgcacacacacacaaacacacaactttccacctggagttggaaatatagcaaattgcaatatctttttaaaatatttcttttttttttttcttttagacagagtctcgctctgtcatccaggctggagtgtagttgcgcagtcttggctcactgcaacctccatctccggggttcaagcgattctcctgtctcagcctctggagtagctgggattacaggcatgtaccaccacgcccagctaatgttttgtatttttagtagaggtggggtttcaccatgttggccaggctggtctcgaactcctgacctcaggtaatctgcccgcctcagcctctcagagtgctgggattagaggcatgagccactgtgccagaccaaaaatatttcctttttaattataacagcaataatcaagtaataatgcttcggcgttttgaagcacccctttcccttagagggcctattttcatatgagatcggatgtgttcagggtggtatgggcatagacagagggcctattttcaatttgtgtaatcaaatccttattttatgacccattaaactggtgggaaacggagaggttgcacagctcgggtttgagaaaacaatggtataaaataggcaaataggaaaattgctgtaaaagccaaagcttgaacacgcttatggtttatatttccatgacaacgtcttgttagcaaataattggaaactgccatttcaggacattccgggcttcctagagaaaacgcatacaccatccaccttgggatctcatagggaaggccctttagtgccaggagaggtgagagctgaggctcagaattgggagctcgcctggcttgaggacaggtgctggctggtttgctgggatcttggtttagagaagtggggcagaggtagaggtgacgcacgctgtcgtcctggaggtgagacacaggaggcagacagcgtatgcacctcgtgtgtctggtgcatgctgtcggcattgaggagccgggagcgtggcatggatagatctactttctagatatctctcttgaccacagtctggaggtgaaggtagggggatggagaggaagtgacagaggcagatcagttggaatgagactcaggaggacctagagaccagttgaaggtggaggtgaggggaaagcagtgcaagaaggaacgagattgtgagtctcctgatgccaagtcatgcaattattattactcggaatgctgccgccagactttgtcagccgccctctctccatcatcgcaccctttgggtgccagctgcttgagcagctgggaagcaaacgctgtggtcccagcatctctggagcttctctgttcaccgtgtggtggaccaggggctctccgaagcctgggctctggccagctctggttggcataagcatagctcttctgtctcccactgtggcccagaggaccacttaggtggtgaacaatacctctgacaacatgcttaacatggacgtgccagataatacaggacactccctggggagttgccttgcaaatgtgtcaaaggcctgcctgccggaagctacatccaaggcaactttcctctccagggaaatagaatctacctgcagccctgggcactgctaggtttccgtggaagtacttgtacccagcaggcttgacaatcagaggcattgggggtgtgagacagtagggagatgttctgttctgctgctgagggtccgaggccacctgggagttctggggctggaagggagaggggacagcactggggattgctggtagtccatcacgagttgcaaacgttcatttcttccttcattcatttattggttcaggggtcttatgtttcccgttctgtgctaggaactgtgtaaacgacagctctcgtcttcacagctctaggagaccggagaaaatgtcctactttgcagatgaggagatggaggtccagacagttttgttcattcatttatccaacaagtatttattaagcacctactgcatgtcaggtagacagacaagagccatgtggtctcagagcttatggtctagtgggttcctttccacggctgaggtgtgcagggcagcagggcagacccacgatctggcactggagagctgatgtgtgttgggttttctctctttgcaggataaagattgaagaagactatgcgaagaacttagctaagctctctcagaactccttggcttcacaggaggaagggtgagtgggtaggagagaggtgggagtggggaggatggggggtcactgaggaagggaaatcagccactatcactgatcactggcatggccccactttggatggggagctctccataggcctggctcaaggtgggcactcatggctcaggtaggtgctcatgacttgggtgggcacccatgactcaaggtgtgggcatccacactcaaaagggcacttccagccgggcgggtggctcacacccattatcccagcactttgggaggccgaggcgggtggatcacaaggtcaggagttcgagaccagcctggcccacatagtgaaaccccatctctactaaaaatacaagaattagccgggcatggtgatgagtgcctgtagtcccagctacttgggaggctgaggcaggagaatggcgtgaacccaggaggtggagcttgcagtgagctgcgatcgggccactgcactccagcctgggcgacagagcgagactccgtctcaaaaaaaaaaaaaggcacttccacattgtcttctctttagtgaccaagagccacgttccagatgttgaagtatgtcagaatcccctctggtctgacccctggtagctgggcagcagcctctagatgcccactccagcctccctttgtctaggggcaggctgggaggaagctgcgtatgagagggtattgtacctggccgctttgtctggagctctctcctgtgggcttgaggcataggctcccttcccgctaatgctgtgactgtccagacctccttgagtgggacctgggctgggagaagcttaacccaaccctcccagccacagaaggactcctagtgggtaaaaaagtctcagcccttatgcacccctgggggaaatggaatatggtacagccgctgtggaaaacaatctggttgttcctcaaaaagctaaacatagaattaccatgtgacccagcaattccattcctaggcttatacccaaaaaaactgagtacaggcactcaaactaatacatgtatacacatgtacacagcagcaatattcataatagccaaaaggtggaaacaacccacattccacccagggatgactggataaacaaatggtggtgtatgcacaatggatacccatggatagacaatggaatattactcagccatgaaaaggaatggaacactaatacatgctactgtgtggatgagcctcgaaaacattctgctaagttacagaagccaggcacaaaaggtctcatagtgtatgattccatttatgtaaaatgcccagaacaggcaaacccatggaaacagaaagtggattgtcatttgccaggggctgggggaggaggggaatgggttgtgactgcttaaaagttaccgggtttccttttggggtgtgtattcatctgcttgggctgccacaagatgtcccagactgggtggctgaaactacagacatttattttctcgtggctctggaggctgggaagtccaagatcaaggtgccagcagggttggtgcctggtaaggactctcccattgggttgcagatggccgccttctgattgtgtgttcatgcagcctttccttggtgtgtgctcagagagagagagagagggagctctgtgatgtctatttttttttttttttttttttttgagacagagtctcgctctgtcgcccagactggagtggcctgatctcagctcactgcaacctccacctcccaagtagctgggactacaggcatgtgccaccatacctggctaattttttgtatttttagtagagacggggtttcaccatgttggtcaggctggtctagaacccctgaactcaagcagtccaccctccttggcctcccaaagtgctggaattgtaggcgtgatccatcgcgcctggccaatgtctatttttataaggacactaatcctatcagatcagggctgcacccttatgacctcatttaaccttaattacttccttaaaggccccattgccaaatgcagccacattgtgggttagggttttaacctaagaattttggcaggacataaacctttagtccatactagcatgacgaaaatgttttggaactagatagaggtggtagttgcactcacaaaacaggcgtttgatttggtctcgtcctaaatgcgcctggatcgatcacttttcaacggttaattttatgttatatgaatttcacctctgtaaaaaaaaacagaaagactctcaggaggttagagttgaaaaggtccccagaggtcctctccgttctgacctccctctggtgctggtctgtttgaattccttctccaagggggagtgaacccccgaggaaggaagacgttctgttgtgggatggttgtggtcgtcagcgagccatgatgttaaaccagtccaaatctgccttcgtggcttgaaatccttcaggagactgagattttgccaacccaaatgtggctttgattaagccctccacatgggttggctgtgcagccaggcggcctcctttgaatggttctcaccctccctgccagccacagaccgcagggcggcccagcaagaccagcgtcccttccacagatgtaaatgaggttagttcattcctggcctccttctgctccatgcacggggcctgagataggggcaggaagggggcacatagaggagcagctcttgctgcctggcaaggggctttcctaagtatccccgtgccctgcaaccactgtgccactccggagtcttccggcttccatctctccagcctgggctgctgccaaggacactgtgtcctggccaacatgcacagcatatgctcctcacccgagcagtccagctccataagtcaggcccacactaccatactgtacacacatgcccggacaaacacagagacaaacacaacgcaagctcacatacatgcatcagggccactgcctcgtaggtgtacacattactctgtgtgtgcatgcacgcacagcagccccatgcacacactcctgcagcaggcactggaacatgaacacatgagccccctacgtacaacgtgcaaagacactgatttacatttacacacagctttggacatttaaccctatctccttgaagactttcaaagcaaagcaggagtctagaaatttggagcagttgaggaagatgctgctcagggaggctggagaggcttttgcaattcaacttctgtgtccaaattagatttcacaggacatgtgcacattggtaaataaacagaattcggttgtttattctgcctttagtttttctctcctatgtggaaaggaaatgcgattttggttttcctagttggcagtcatgaaaacaacatgcattttgatttggcgtacctgaaactgtatgttggaacagagatgcacctcaggttttgttttgtttttcattaaccgtttatcagatgaaaaatctcttttcaaatgagagaatttgtaagtagctttttaataaatggtgatgtgactccaaagagcctggaatattggagagcagggaggcattcaccaaggatgcactggctcagaggggcccctctgaatgtctggagacatgtcttcccacttagcagtgtctggcctggaggtagagctgaggacgttgtgttgggtgggggaaaaccatggttcttcctttcatcccagttgcccagagatgacattctcaggccaccacgactgtccctgggccatttacctgccatgtgctctgctgacagtagactgacagctctgtggaaagatgcatgtgctcatacaaagtctgggcaccgcctggggcctttttggctctgtgactcttgttcatacctcccacaggctgctgtgtgtggctcagctgcaggggcaaacccctctcacttccctttaatccagttcccattcctcccaggacaaccttggtatgcttcaaatagtgttggctttcaccctagagctaggaggcatcttgagataatttgtgtgtatggtgtgaggtagggccgagattccttttcctcctgtggatgtacggttgtctctgcaccatttgttaaaaagatcatctgtttcccccatggaaacaccctaacctctttgctgcagtcaatcggccctagctgggtgactttgtgttctgttccgctgatctgtgtaactgccaggactactcctgccacccctggacctcctacccacctgttgaatcaggtggggcacccaagccacccagagggggtggagtgccccagtacagcttcctggatctcaggcccttcaggcagagacaattgtcaacagcttggattgccccgtttcatactccagtgcttctctggtggcttcccctgccaggatcactgaggggacctttctttgctgctagactcctagataaaatcaggcagtcatttcccataaacacccacctcggcctgagcctgcgccaccaccacacagggctggccagccatcagagggatctgctgtgcactgttgggcaattcttcgctgctggctgctctgctccagacccagaagcctcaccacatgctgtcttttattcagcttttgccactcgactttaatgaattctctgggggaagtggcttttggatgatattaagtcaacagaacattcagcctggatttactggctgtgttgaagaggctgggagcaagaaagcgggggtatcacttggaagggtcatgcggttaaagagctccaaatcatagagaatgtagcctggggcctgcattggcaagtcttagggacttcaggagatttcttctacgtgaagcctctccttggagtggagaagtgatgctgctaagaggacttggcccttctctagtaagctgtgggcagcatcagggctcacagctagagaagcagtgctagaggagaccgtgcttcctaggatggccgtgggagccttctctgccctgtggctgcatctaggtcactagacccacacagtccatcttccccactcctggaagccaaggagctgggtttttcctataagcagcgctgtgtgatacctgctgtttgaaaagagcttctccggctgggcatggtggcttatgcctgtaatcccagtactttgggaggccgaggtaacccctccctgcagctgctctcagttggtcaggagttcgagaccggcctggccaacatggcaaaaccccgtctctactaaaaatataaaaattagccggatgtggtggcacacgcctgtaatcccagctactcgggaggctgagacaggagaatcgcttgaacccaggaggcagaggttgccatgagccaagatcgcgccattgtactccagcctaggcgacagagcaagactgtctcaaggaacaaactaataaacaaatgaaaagagcttctccctggaatagaacctgttttccttccttgatttattagcagatgcttgcacccctcatcagcaaaccagggaggggtgatgtgaaagctctggggacagtgacggcccaggggtcaaggccctcactgcagctgaggctttggaatgtccccacacctgcttccggcaccttcctgggtcctttcgagcctctggatttctaggaatccccaccccccccacctcttggctgtgcgccacagtctgtttccttagctccagaggtaaggtgagctcacttggaccttggtggctcatctgactctgtgagttgaaacgtgatgctcatgtctggtttctgcctgacttctgcctcatccgcgtccacattctcagctgtcatatacctccccgagacctggggtggagccccaccatcctgcctcaggaagggctttggcttgtgacctgagtctcatggtctttgtgttgcagctccttgggagaggcgtgggcccaggtgaagaagagcctggcggacgaagcagaagttcacctcaagttctctgccaaggtaacccctccctgcagccaccctcagttggtcttacacactggggtactaaaaaatagttaacaactgtctctccagtttgccgtttgccattttccctggtgtaaacttcaggctatcaacatgaagtcacggaatacggagttgggaagagatatctgcccagtggctcaccatgaggtggtgcatttttgtatagacacagtagcacaaataaccatcaatatccaccaagagcatggaaaatagtaaagtgtagttaggaggtggtaagtgctaggtatttattgcctttgttttttatgttttgttatttttaaaaagacaaggtctcactgtgttgcccaggctggagtgcagtgacatgatcatagctcactgcagcctcagcctcctgggctcaaacgattctcccacctcagcctcccaagtagctgggacaacaggtgtatgcaaccatgcctgggtaatttttttatttatttgtagagatggggtctcgctattttccccaggctggtcttgaacctcctggcttcaagcagtcttcctgcctctacctcccaaaatgctgggatcacagacatgagccactatacctggcctattaccttcgtttttaatataatttttattcaattataagttcatatcatttcctttttgataatggccgtgtttaacaaccagcaaacagaattcctgaaaatttaacattcagctcttgggagccactgggagcaggccttagcacacctgcccagtttctcagggcagcccctgagtgacgaagccctgctttctttttgcctggctttcaaagggatggagtaggatgtcctgtctcttcctagtgtcagggaacattaggttatgccaaagggagaattttttttaaatttgtggttgttgcaaaatttcagaacaagtaaagggtccttctttatttatttattcatttatttattgattgatttattgatttattgattttgagacagagtcttgctttgtcgcccaggctggagtgcagtggtgcgatctcagctcactgcaagctccgcctcccgggttcaagtgattctcctgcctcagcctcccgagtagctgggactacaggcgcctgccaccacacccagctaattttttgtatttttagtagagatggggtttcaccgtgttggccaggctggtgttgaactcctcacctcatgatccaccctcctccgcctcccaaagtgctaggattataggcgtgagccaccactcccgaccataaagcatccctctttcatttaattctgaagatactagtgccaggactcgagggcagggtgtttctgtcctattcccatcctcagggctcaggatggtgtcttgcatgtagtagatgcttaataaatattttcttattgagtcatgaatgaacagagccctctgactatctccaccccacccccagtcttttcaggtctgctttctctcaagatttctccatgtttccaagtgactctcccttccccactccctggcacatacctccaggttttctctccgactctcagctaatttttagatgaaaaataaactaaatctctcagtgaagtaatccactctaaagtgtacatgattggtggggctacccattaacaggcttgccttttaaagaaaggggccaggcgtggtggctcacgcctgtaatcccagcactttgagaggctgaggtgggtggatcatgagatcatgagatcgagaccatcctggccaacatggtgaaaccccatctctactaaaaatacaaaaattagctgggcttggtggcgcatgcctgtagtcccagctactcgggaggctgaagcaggagaatctcttgaaccctggaggcagaagttgcagtgagccgagttcacgccactgcactccagcctggcaacagagtgagactctgtctcaaaaaaaaaaaaaaaaaaagcgggggggacctttcagagtgcaccatcccagtgaccctggcctcctcgctcttccctctgtcctcccaccatcactagtcagacacagcagggtaaagtgcctaaacgctgagtctcccttctttaaacacgtgcttgatcatttgaaggtagcatccctcagagatggtcgctccttcctgggacttccacgttcagcactcactggtcctgtctctttcctagtgtcgttcctactgcaattgcaagtccctgctttgggatcccatacgatgtaccccgtggtggtactcggcacacagaaggcagaatgaatgactcagatgactgagacacgtgaaaggactttctaaagagctgggttggaagagggaacagagctgctacagctccccatggcttagtgtgccccaagattgagttgacacccagatgtgagtgagaattcccagccagtgaaggcatgctaactaacctcattacaccaagcgcttcagtagaaaattgctactcaagtcctggcagagaagggaactccgtgaatggatctttttcctgcattgcatccaaaacagcaagttatttttcagctgcagatcatgagtagctttcccctcaaggcctcccttcccctgtcggggcccccagcagctccattctctgctgtggtagaaacttccattgactgggaagatcctgggcgggctgccattgtgatggggtggggctgggagccagagttgcgagctttggaaaggtcacctgctgggtccccgggaatcttggtggcatttactccccatcagcaggacccctgattcttgattgtttagagtgctcaacaggtggcaaaactctctccgacgtggtagtggtgacataagtggtgtggatggctgtgtgcaggatataactcattgccgtcaaccaccacgcgagatagcatacacatttcacagtgagaagaggtggggtgagatcacagcccatggtcacacagccaggtgggttcagtcacagaggaagcaaaggaaaggactgagcgaatgggagacttggtccccagagcttttcttccagcagctcccctgctttggcagaccaatggcattgaaaacacagcctcttcttgagcctgtgcctttccaggggttgccaatgggctactgcagactggccctggacaaccacatgctcagaacattttaagttagtgttcaggacacagggtggacctcaccattcagttgacaggaagctcatgaagacccgtcatgcaaaacagactttgctacgagaggctctcggctgcttccagcctgtcggtcagtgttggtggcctcaagcggtcatcgcagcagcctagtggttttatggcgattccttgagaagaaagtggctccaaggatgtatttgactgccatgaataatatagctccatatgccaaaaaccgtttttaatgtctgctccaaaagacttattgaaattctgctctgaatgctctgtgtcaggggtaaaagctctttaagaaatgcaattttgttgcagcaatttttgtggtttttctggtccattagctcaagccattgctaatagcaacagattgctaaagaaatgagagagccgtatacaaagaaagttatacctggctcctgctgaagaagggagaagagcagaattccttctgctgatagaaaatctcatgcggtagaggctctgcgttccatcagaagatttaggggacaggagtgaggagacatgagttgtatctcagtattgtcactaacaagctctgtgaccttgagcaagtcacttagctcccctggggtttcatttcttcacatatgaaatgaagaattcagaccagatcagtctctttacacttatctgacagtgacttacaatgatgcattttatgtgagcattcagaacctgtctgtaggtatccactccgatatctgcacacagacattcacacacatctgtagctgaaacaaacgtttcataaaacagtatttatcctcctacttaaaatgtactctggtattttctgttcaagtctggtctgttctcaccaaaaagctggtcctggcccattaaatcgatttcacaactctcggccgcacaccgtctgaaaaatatcagactagacagtgtctgaaattcctaccaacttggaacttctcttattctcttctgatgtgtgagatgaaaaggaagcaaagagagcgagagttttggaaagaaaaactgatgggccatgacaggccggcctgagtctgtgaggacactttgaggaaggacttctgattcctggttcaacagagatgcttaaaagttaagaatgggtactaaagataccagcctaaccattttaaaggaaaaaaaaaactgtcttttaaaagtacttaatatcgccgggcacagtggctcacacctgtaatcccagcactttgggaggccgaggcgggcggatcatgaggtcaggagatcaagaccatcctggctaacatggtgaaaccccgtctctactaaaaatacaaaaaaaaattagccaggtttggtggcgggtgcctgtaatcccagctacttgggaggctgaggcaggagaacggcttgaacctgggaggtggagcttgcagtgagccaagattgcgccattgcactccagcctgggagacagagtgagactccgtctcaaaaaaataaataaataaataaaatacttgatgtctgtagcgagatggagatgccaggcatcctcatctgtggaatcaaatcacttgtgatagttagcagcgtcacgcttccagaatgtcatttgaatttggggaaagcttcctggcatattggcaggttcatgggcttttccccagaccacagaacctggggctggggtccaggaaaccttaatgttgaaaactcttcaggtcattcctgggcgtattaaagcctgaaagtcacttgctttccatgtccttagagaccccggagtttctgagtcagcaggctgagctaactctcccagattcccggagtcgtacagctgctcctactcagcaaatgccaaacctatatacgtgggaaaggggtttatttattctcgtaagctctcaagatttttgtagcatcctgcaaactgccgccaggtggggatgttttcctatacagggaaggttccaggggctcaaaaaaaatagtaggacatatttacaactaacacgaggaggagagaggggtgtttggatggccagttctctgttagtctgtgacggtcatccagcgacaaagctgtcttcttgtcacccaggggattgagctctgaagagtttgtcattctctctacaaacacagaaggggcacccacccagccccagcccaggtcagacactgggcacagcagtgctcaacccagatggggcccctgcccgcttggagctcccagccccgtgtaagtcagttgcttagaatagggacacctaagtcctggttgtatccagagaaaaagatattgtacagcaaaaacctgagggagaggagagaagtcacagaaccctcgttgggatatcatctgtccagggaagttgagctgtgctccctagagacacctctaagaccggtggaggcagatttgcggtggtggggtggtcataggttgaagagagttgcctgattccaggcagtggggtgggaggggtgcacagggctagggtgccacctggctttgaccacagcaggtcccgttgatctgttttcttataaatgttatgggctgggcacggtggctcacgcctgtaatcccagcactttgggaggccgaggcgggcggatcacgaggtcaggagatcgagaccatcctgactaacacggtgaaaccccatctctactaaaaatacaaaaaaaaaaaaaaaattagccgggcgtggtggcaggtgcctgtagtcccagctactcgggaggctgagacaggagaatggcgtgaacctggaaggcgaggcttgcagtgagccgagatcgcgtcgctgcactccagcctgggcgacagagcgagactctgtctcaaaaaaataaataaataaataaaaaataaataaatgttatgctcacaaacaaaaggaacaaattttaaggaaaagttcttttaaaggggggtgggatgggaaagagggaaggaataaaagagaagaaaaaagcttaaaaccctgatgccacccagctcttctgacagcataaacccttttctctggcccctgggatacagggcggttccctttgcctgtgctccaggcagcccagcaagctgagaatgtctttatgagcgcaatgcgggacagttgcccttgtgagtttccagcaggtctccaacagttcccaccatcagttcctcgaggtttggaccctgtctagctcacctttgtattctcagcacctgccatggagtagatgttcgataaataggactgacctgagaccttctaattgaatggcattcattcgactgttctttactgaagccgcgtaccccagtcactgtgctgagtgcttggagacacagacgctgatgtggtttctgtccccagaaagctctcagttcggaaaataagggagagagacataagaacaaagccgtgcaagaagctgtgggataaaataagtgtgtgaggtcattgattattattgttttttgtttgtttgttttgttttttttttttgagaccaagtctcactctgtcacccaggctgaagtgcagtggcacaatctcggctcactgcaacctcccaggttcaagtgatttcctgcctcagcctcctgagtagctgggattacaggcacctgccaccactcccagctaatttgtgtgtgtgtgtgtgtgtgtgtgtgtgtgtgtgtgtgtgtgtgtgtgtatgtagtagagatggggtttcaccatgttggccaggctggtctcgaactcctgacctcaggtgatcaacctgccttggcctcccaaagtgctgggattacaggcatgagccaccgtgcccagcccattgattattaacttgatttagccattccacaatatatacatatttcaaaacagcatattataaaccataaatagtaaaaaattctaaaaatttaaaagctgcagaagctcagaaaaaaagtagttaacagatggggaaatcagaaggctctagttgctaaccacttatcctgtagacgtgtgtgggggcctcctgagctaaggtgacctgcctaagctgagacctgataggcagccacgtgtcagggggtgtctctcaccttcctgccaggtcgctaccccagactcatcctcacttgcctggggaagtgggggtgcccctcccatccctcctccctgcactggcttacagctgatgccctgggtcctgagtgtgcgtctctactctcccaacagcttcacagcgaggtggagaagcccctgatgaacttccgtgagaacttcaagaaagacatgaagaagtgcgaccaccacattgccgaccttcgcaagcagctcgccagccgctatgcctcggtggagaaggtgagaggcccaggacgctgggccagggcaggtgcatgggggactgcctggaagaagggggactgggaagccagcagtggctccatacgccaaggctgagtctttgtccccaggtaggggaatagggggatgtccaagcctcgtgcctacgccagagcaccccacccatccaagggcagataggagctgcctccctgtggtgctggaatgaccacccagagggccaggggtgcgaggagaggctgcagctgcagtgggcagtcgagtggctgttggcgaccagttaaaccccgagcctagcagtgctgctgctggttcacgtggggccccgtgtttaagcctcacctggctgagtcgtcctgactcagtcaccgcctccctgctctccttcctgctcagggatgaggctgagtcctgggtggtctcacctccagggaactgatgttcagccttagagggaagagagtgtgccccagggactgattcccagtccccagtgccttagagaggagaagggggctcaaactgctgggacaccctgggcccagccaactgccgccacccaaggaccacagagatgccagtggtggcctggaggaaaggcagtacagtgaggggaacaagagggccgaggcttgtccagctccagaacgggagggctgttgctacatcctattaagtgctgcagggaggtgacacagatggcctttgtggtcccttccaagcagaggggctgtgactttaggactgcctaggtccccagtctttgtacaggctccatcgggaaaaaaacgtggtttgagagattgaggtaggctgagtccagatgtcactggaagaggcaaggacgaaaagagttgggttgtagcctctacctagctgggtggtgccactctggctgctgggcctctctggaccactgtggcatcatccacacaaacaaggggcgaaaggactccaaagggaagctgggctgcgtggcccaggaggcccactggctccgagctgtatgagcagcttctccgtgtccttggaccccaggcccggaaagccctcacagagcggcagagagacctggagatgaagacccagcagctggagatcaagctgagcaacaagacagaggaggacatcaagaaggcgcggagaaagtccacacaggctggtaagtgctgggcacccgcctggcctggtcagtgcacacagaaggagagggcacggggctaggagatgaggtgactggcgagggtgcatctctcctttgcaagactgcagcgaggaaattacttcccttgtttgccaggaggtaccccctcttcccttctctctgacccacacccagagatctcaaagaaagagactttgggggtcagaggaaggacacaggccgggctagttctggggcatggtagaggctggactccttactctctccctggtcgtggctttttttgttttccgcccaagccccagatctctgaccaggaggtggacaaactccttcatgcactgagagctcagggccctgtccctgttcagagcccacagaagcacacagctcacccaagctgcccacttccccaggaagcaatgctctctctgaaggttcacctatggggatgggctcctgccctgggaacagaggctgacactttgtttaaagaaataaccagatttcagtctcttgggaatagtctcccaatgagttggtttctgcttccacctagtggtcaaagttagctaatacacaaagaggaagagaaggcctggtagaaccagtgaaaacctcggtaactagatctaagggaagccacgtttcactgcacgagaggacacgcatgttgcctctggaattagaatgtgtgccgtagtattagagtttggtctgtaggtccctttcacctcaatttctggtgaacctgttacaattccttcattatagaagaaagcagccaccttacatttcaaaataaggtaagatagaaataagtcaataaaaaataatgtaatagaaggataacgtttattatacaaatcttataatgcacaataataaattacaggatcaagaagtagagggcacagtatatttattggtagagagaagggggggcacagaaggggaagagatctgtttaaattattaagttattaaaaaaataacttataggccaggtgcagtggctaacacctgtaatccggcagtctgagaggctgaggcaggaggatcagttgagcccaggagttcgagaccagcctgggcaacatagtacctcatctctacaaaaaaatttgaaaaaattagctaggcatggtggtgcatgcctgtagaatcagctactcaggaggctaaggtggaggatggcttgaacccaggaggttaaggctgcggtgaactatgatcacaccattgcattccagcctgggtgacagagagagactctacctcaaaaaacaattatattgcaaaaacagtattggtacatggcaaaatattttaatcagcagacaagaatataaaatgctattcacagaaataatcaccatctcttcctagtgttttgatttttaaatatttaaatttatatacatttgatcatacaatctatcttctgaacttatttaatatatcttggaaatacctctttttcatttctgtaaatctttttgcccatccattcatgcatatcaaactttttaatggctggccagtgtccagttgtatgattgtacccaaatttgtttcatcattcccttaactgaggtttaggactcttagattgtttcagagtgcttgccagccagtgaagctgtgttattgtacctgcatctttgtgtgtgcctaagaccagatctgcatatagagagaatatagttgctgagtcaaagggtattattcgtcttgatggatatttccaaattgctttccagagagagcacctatcaacagcatctatgaataatgcctgttctctaaatgcttatcaacattgtgtgttatcaagatttgaaattggtagtgagtggggaaaaatgatattttgtttttaatttgcttttctccataacccaggttgagtatgtaaaatatacatataaatcattgttgtactttctgtgaactgattaactcatatcctttccccactgaccatagattctttatctatcagggagatgaatcgtttttcattttaattgcagatatttttcctagattgtcatttgtcttttagttttgttctttgtaattttttttttttgcttgtttgtctattttttcttgctgtttttctgtacagtgatatttcccataagaagcctagatttcggagctgatttagatctttttttttaatcacctagagggttttttcttactttttttttttgtttcaggtgtttatttttgtttttgtttttaaaatagtgaaggccggccgtggtggctcacgcctgtaatcccagcactttgggaggcccaggcgggcagatcacgaggtcaggagttcaagaccagcctggccaacatagtgaaacctcgtctctactaaaaatacaaaacttagctgggtgtggtggtgtgtgcctgtaatccaagctacttgggaggccaaagcaggagaatcgcttgaacccagaaggcagaggttgcagtgagctgagatcgcagcactgcactccagcctgggcaagagagtgagactctgtctcaaaaaacaaaacaaacaaacaaacaaaaaaagacagtgaaatatgtaacccaccagacatttatttttccttacactggtggtctaaccatattccacaggttcttatttgtggtggttttatttctgctattttcattatgttttgctatttgggttttcatttgatcttcgaaccaagaattgtttcaaagaaaatctttatatgtttacaagcaagggctttgttgttgttttctaatcttgctatttttttttacatagttttattgcattgtcatcagataatacggtctctcattcctgtagtttggaattattttgtgacgaaagtgacagtccttagacctaactctgaaaaataccgcctcttctgagcactcgctgtggccagcctccatgctttagagcattgtctcttttgatcagcacagtccccctgcagggaggtatttttataccctttacaaatgagaagactgatggcagagaaaatgagaaccttccatgaggtccacagtggtggagcggcgaagccacaattcagtctcctctcattccagagactctgcttgtcgccattttgctggacagcctgttgctcaggaaatgccacctgttctttccttctgttcctttcctccctcttcctcatcttttccaaggctactagaaggaaagacatcagatcctcagggatcatcatcatcatcatcatcatcatcatcatcttcatcaccaccatagcccatattaatatttggctctctacgcccatctctattctaagtgctttacatattttgacatatttattcctcataacaacttggtaaaggtacaatcgttatctccattttacagatgaagacacggaggcaagcgcaggataaccgacttgtctacgattacatagctaataagtagttgagctgggatgacaacaaaggctttttttttttttttttgagatggagtcttgctctgtcgcccaggctggagtgcagtggtgcgatctctgctcactgcaagctccgcctccctggttcatgccattctcctgcctcagcctcccgagtagctgggactacaggcgcctgccaccacgcctggctaattttttatatttttagtagagacggggtttcaccgtgttagccaggatggtctcgatgtcctgacctcgtgatccacccgcctcggcctcccaaagtgctgggattacaggcgtgaggcaccgcgcctggccaacaaaggcattcttgtcccacaatccatggtcttaaccaatactgttctaaaaagttccaatttcaagctcttgggctgccatagagagaaggtacagcccccttcacctactctgtttcccaatgctgtggaagttcctgaagcaatttctcaaaatcagcattgacacacagggctcagggagtttcacagtgtacagagcagcacgccgccctcctcctcggccaggcaggagctcttgctagaaatgcatttgcatttcggaggctgaggcgggcggatcacaaggtcaggagttcgagactagcctggccgatatggtgaaaccccatctctactaaaaatacaaaaactagccaggggtggtggcgcatgcctgtggtaccagctactcgggaggctgaggcagaagaatcacttgaacccgggaggtggaggttgcagtgagccgagattgcgccactgcactccagcctgggtgacagagccagactccgtctcaaaaaaaaaaaaaaaaagaaaaaaatgcattttacggtgcagcatccactttcttctctccggttcagtgcctcttgggatcaagggtccagtcattggccttggaccaagaacaaaatgaataaatgccttggtgtgggctctgttattcaaggcacactcgcgtctggtgtgtggcatagctaggggtatggttcgcagctaggcctggggcctggagacataaccttccctgttctctttgactttcctatcagagtacctatgagccacaatgatgatactataggagtcactttgactctactcgaattactaaattctactctagcattctgcttctagaattactagagaaaattacttcactttggggttcactcatgagctttttccatcgtgagcaaacaccatgatgccttcctcttgctggagccctgtgaggatgaggaagctacgctgagacaaagccgtgcatgagagctgtgctgctctgcctgccacgtgcacacacattaccagagcgtctcataaacatgcagtctctgattcagtaggtctcggatctgtcctgggtttctgaatttctagccgaccccagggcatacaagtgccactggcccacagactgtgatttgtgtagcaaggttccaaggtgctggtacgcttagtaatgtttgcaattacttcgcagtgtgttttctttctaattacaaaatgttctaaacatacatatgataacaaagtaatagagtagtcctaaagattgaatagttatgtttgcctcggatctttctgtgatgacataaaatgcaatagaaggagctgattcctgcccactcaccctttctctgtttcccaaggtagccactctcctgaagctggggtgtgctcctccagtgcatgttttagactgtgactacagatgcgttcttttgtgtttcagaaggacatcttgcagtgtgttcatgcacacacacacacacacacacttacatgatctgcaaatttatcttccttaattattcttagcaccaaattgtgtgtgacatgttttaaccaatctggactccccagtgtaaaataaaactgccatctttagagagggaagcatttcttgggctcatgataggattgggggtcctaggaataccctagacacacacacacacacacacacacacacacacacacacacacacaaaatgagaaccaccatcctgaatccttggtatctggggtcaggcttcagggggacacctgagctgggttctcatggggctgggttgcccccttccttccctggctctgctttcttcttcttcctactgccatcccttttccagctttccagcggccaccatgaccccagggggaggagaaggcttggctgtggggctcagggtggggcacagagtcatggtgaggataggatgcttcatgatggtgactgtggtctttttccaggagacgacctcatgcgctgtgtggatctctacaaccaggcccagtccaaatggtttgaagagatggtgaccaccacattggtaagcgggcagggatgtgtggacatggcagtacagaggctgacacagagcagcccctggtggttgttggtgggcgcggggatgatggggtggagtgaccctggagatggtcatcaaatctacttcagtgttggggtcgaaacctcaatgtgagccagcttatgtggattcagatctctgctccagcgcttcctagctgtgtggatgtgggcagggttgggttggatatggctacatccttcttgggctgtcccctgagaggtcagggtcaactgaggactctcctcaactaagtggacaagggcctctttaggaaaaatagccaagctataggaagagaggaccgccccacacatgcacacacacgagttgcaggtccttggtaggagatccttgcaaagtggatggatgggtgaggatggagctaggcagtggggtggggggaggcctctcaccaagggtgaacaacaggcggcagggccgatgatgctcttgagtatttcttgtaaaggggcagcatctccttatcagtcagcacctgcctgagtggacagtgaagtgtggctggtacttgggccagatgggacaggaggcatcatgccaggtgctcatcggatcagcccactgcctaaagccacccctgtccatccagcacaggactaaccagctgccttccccaggtgtcagcccaccagagcagattagaggcctccaccagggacagtgacctagttttcctcctggttaatctcctaattaagccccctgctttacccccctttctgattaatcacctgggcagtgacctagttgtatgcagagtaacagccggatcccctagattccaaagacacaaaaccatctagaaaccagaggacaaaccctttccacgctcccctttgacaaaagctgtgccacgtgcagcccagtctgcctccctggcccggtctctattgcggccacagcactaggcataggcagaggaagggaggctgctcagcagaggcccagggacaaggtcccaggaatgtgtggcatggagctcccacatgtgcccccttgttataccccatcagggcaccagggccagggctgcatgggtgcattgccatgagtaacagcctgatggactctggtttaaatcctgttcctcccataattccgtgtcgctttgggtgagctgtgttgttgcctctctaggtgttagttccccagttcccttgcttggagaatggggataataacagaaacgatctcttaaaattgtaacgaggacagttaaggaacgcacgtaaagccctcagcactgtgcgtggcggagcaggcttttcaggaagtaaaacagccgctgctgctgtcatcagcttcaccttcaccttagatatggggcacgctcttcatcagaccccagagagtcagatgggacagaatgtccacagccagtgacttgcgttttgtggtcttggtggggggacccccaagtggaggggacgtgctcagagttctctggcctttgctttctcggcaggagctagagcggctggaggtggagagggtagagatgatccggcagcacctgtgccagtacacgcagctgcggcatgaaacagacatgttcaaccaaagcgtgagtttccagcccagcggggctcccgggcgacacggggcctggggagagccgcctggcgctaggccatggcaggttaagtggctgctgcaagtgaatctgccctaaaggcgggcagtgggcaggtgctctggcctgggggtggcctcgtggactgggcctctcaggattgtcctggacgtctgtgtgattcccaccctggcacatgaagtggacacacacgtgagctgttaccctgaggagaaagaagctcgtaacagttacagtagctgaagacattattaaatttcttaaaaaacaaaaccaaaaaaaacaacttctagaaatattcacaatacctaaagctcaagttttatttgtcctgttcactggtggtaaatgtggggtggaagggatagagacaggttttaaggccctcctggcctctcatccaggcctggggtctgcagggtgagaagcagggtcgggatgcatactgggttccccgttcacagccctcttcatgtgctgtccctcagatgggcctccccctggggccccggagccctctagagaggctgctctcagagacactaaggtgaggacagcatgtctcagaggagacctccctggcttggccgccgtctctaacagtgtcgcattttctctgtctcttgcagacagtcgagcccgtggatcagctgcttcgaaaagtggacccggccaaagacagggagctgtgggtcagagagcacaagacgggcaacatccgccctgtggacatggagatctagatgggcctgtgcagcttcggggggtcctgctggggaggggggctgggctcccaccatggggcccatgccgagtggatgccccccaccctctctcctgggccactgaggagaggggagagagctggtgattccagaagggtgacccggacagcctagctgggggctcccccatattcccaggcccagaagacagacccacagccctgcccttgtctctgaggctgaagaccccctgactcccatgctgtgcttgccgctctgaaacaaacagaggctggaactttgtggtccttgccgagttttgtaggggtcactgtcacatgcttgtgccctggaagccccaaggctcttcctccagctggctcccttgtctccagggctttggaggatcagggtagggagggctctgtctctaagccaggtgtcaggatcagaatcatgggtagaaggtgccattcagctcacagccgcacccagaatcctttgcagccctccttctttatttttttcccattgcattctgggagtccacatctggctttctcagccactgttcatcaccaggggttttaggaggaaggcttggctcctgtcttcccagacccaccatgcctggagaggtcaggatggaactacctcattcggcaaattagccccaaattgagcgctgaatcgtgtcccatgagatcaggcgccatctgtaaagtctcctctggaaatgccaatccatccttcccccagctgcttcctcggggaggcccctgcccccaccctgccagcccttcccagtctcattagaggaagctttccaaagttctcagttatcaagacctcatccagctcgtccaaaggcttcagggatggaaacaaaccagctcgtctcagaggccagcaagctggggcctgtccgccacggtgccctgtgcacctttgggctgccctggcccccactctcccgggccgcccaccacaggctcttaatggggccgggtcagtcctacatgtgagatgggttagggcaagtctttgccatcccccagatggctctgtcttcttgtgtatggcagggctgggactgctgtcccttgtacagttttctgtcactggtgggcactggacaggcatagcagactctcttgtggccacactaggttgtcgcctttcaggcagtgtcccgccacctttgcttcccgctccttctggacattccagagccctgcaccaaacccttacttggtgtctgcacctcctttccctctctccatcttccaatccctggaaaagtctggtctgagtgtgacttgggaagctttcagtgctgctgtttggcccagctcattactttctccctttctctaccacagcaaacacattctccaccatgtcagtctaaagagtctaaaggggccgggagaagcatgagcgaggggcagattctagtcgggagcccatgccctggaaatccatctttcttcatctttcccattgaccactttgggtttgacctgcacatctgcagtgagggcagaattcaacaagcacaactcactggtctttcagtcaacgtgctagaaaccgatgacttattaatctctaattttttggcgcctctttcattgaatgagaattgctttcgtatagttcacattagaaaaatgcctaatatactaaagtaaaccaaacgttgtcacttttctcttgttcttgaaacattgcaaccaaaaaggtcagcacaaaggccttcacctacgtgaagacctcctggtaggatctgtccatgggatggagaaccactctgtccagatctggggttgggtcatgacaccagctaccaattttagaatattatttcttggtttctttatgaaaaatgggtgctagtggtaattgctttgtggcttagtaaactactctgtggatgatttccaaacattcaaagccaatagccttgttattaacaagatattttgagtacaatatggctcattgacttttccattacatctgaggattccagagtcctctgttcatccctgggatagagtgagccctcttgcgtcttccagggtagctcaggttggcccagtttgggccagtccatttttggaggtcactctttcccccctcatcccctcacctccttctctttacccccttcacgtacttcctttctttcttccctctgttattcattcatcaagcaggttaaagccattgtgctaagatctaatctgaggacactataatggccctgtcgtcagggaagcccgtgatcgctcgttttcaggggtcttaccggtcagcaaccttggcattgatacataggcactctacagaatttaagttttcagaggtaagtctgttgttctgattaatctgcattcattcagcgaatgctcaagacaagccaggcatgctgagaagcggcgctctagttgtatgtaagatgggcattcctctgctctcctctattctccatgtcgactgagaagagtataataagaacattgtaccctctccacacttaaccctctgggattctttattataatataaaccaccgtcgtgaggcatttacctgttggatggaaggtagacagcaacaagattttaatcacctggtcaccagaccctcacggcccatatccaattcgaatttcagaaatttctctgtttgctttaaataactctttacaaataagggtcgggcacggtggctcacgcctgtaatcccagctctttgggaggccgaggtgggcagatcacgaggtcaggagatcgagaccatcctggctaacatggtgaaaccccgtctctgctaaaaatacaaaaaattagccagatgtggtggtgcacacctgtagtcccaactattcggcaggctgaggcagtagaatcgcttgaacctgggaggcggagattgcagtgaaccaagatcgggccactgcactccagcttgggtgacagagcaagactccatctcaaaaaaattataaataactctttgcaaataggaaagtgaagctcaagggtaaccagtgaggctatgaaattgccagtgaattaagaccagggctagagtcaacagtccagaacccctatccgtatgaacaggggcccgtttctggttgaaatcaaggttaggatgcaactgagaaaataaaagactgcactttggagaggcaagcacgctatccgggttgttgttttgttttatgtcttggtgcttaggtgaggacttagctgggtt

SEQ ID NO: 12272 - DNA, 31035 bp, Human
cctcactgctccccactcctatctacgtggcctcgggctaaagtactgggtgccctagtctactggcctctccccagggggcctggatcctttctgggccttctcttggtacttcctcctcctctgcttagccaagtccttccacctgactgaggcagacacaaccctccctcctcaggtgctcacagccccagcacccttctctcaagggtccagccatagggtgggtaggaacagggtcagacccacttttatccccagcacccgctctgcagcaagtgctggggatgccggcatgcacacaccatgtccagctggggagcaggcttccaacgactgacgggctcctccggctgccatgctgaccctaccccaacctcatgagccccaaggtgggccgctcttttgagcggtgagtctgtgctcttttgatgacacaaagtggcttctctcctagaaacttgtcctgcagggcaccccccatgggaccacacacccggccccaggggctgtgctcttgcagacttggctctggccacacctgctggttcactggccccaccttgactgcacaggtgtggctgggtcctctccccgtggcctattgcccgctgggctggctggacagtgtctggggatttggtgtgatggggacgacttggatgcctcttttacccctgggaacgattaaccctgtcttgtgatttgcccctgatgaaccatttggtgggttgggccctcgtgggtgagatgctgtggatttgaggctgtcccttccaacttaactgtggaagagagaagctggttccaggaaagatgaccaaattcttctccccgagtcttaaaaagtgacacaagctagcactcaatttcctcaaatctaaaatgccgttgattttaaactgtctgttttaggtaccactgggaaggaaaagcccagaatgagggctgtgctaggagacaccctcaacaggtgggccactcacggctgaacgctcagcgtccacgagaactaagcctgccacagcaggggacaacaaggaggcacggtgtccccaccccagctctcagggaggaggaggaaaaccctccctgggactgtgcactgccagctggggctcgggaaagcatggagtctgaattcgccctcagacctgggctggaaagctcagacagggaagtcaaagactgtggccccggaggctggccggggcagtcagaggtgcttctggaaggacccagctgagtccaggcagagagagggcaaggttgagcaccaggcgccccagatcccggggggtattgaaatgggcatctttgagcagatgacctgcaggaagcagcacctgctgggtgccagcaatgagttggggccacagtgagtactgtctccattaccccagcctctgggcgaaggggcttgtcctaagtctcagggctggctgagtggcagctggctctggggactgctactggtgcactggtatagctggcaaaggaacccatgaggcacatggctcctaaaggtccagccacccagcaaagccccctccccgcatccacacaggggacaagggtcaaaaggtggggacatgccttcactttcctcacctgacaggccctggtctgctggggtcagcgctgcagccagaacccgcattcacccgcgacgcagcctgtgcaggggaccaggggttttaggcaggatcagcagggaatctgcataccagctccacagtgcactcaggtggcagatggggaaactgaggcccaaggaggggcggggagccccttggacggggcggggcactccgcccggggcaggcaggggcctttatctgctgtcctgcccctcctcctcccccagcggcatcctctctctagcttctggcgctgcccactgtaacccgactccggcatttgcgtttggggcgccctccctgcgccgggggcgggagcccagcgagcgcagagccccggccccgcgcggcccgagtgccacatcactgcgctggccgtccaaggtccgccgccccaccatgccgcccccgccgccgctgctgctccttacagtcctggtcgtcgccgctgcccggccggggtgcgagtttgagcggaaccccgccggtaaggccgtcccctgcccccaccctccaccctctaccctgcaacctctggggagtgtgatccgtcgcttcccaggggcccgggagctttcttccagtaggtcacgcgcctatggtcctggcgagaacgtctccaaagtgggcagcatgtggcctgggactggtagggtgacctctcccctggacggggacaccagggaggctctctacggcatccaggccgggaccccaggcagcagagggtcaccacgcctgggccggggggtgagatctttttcctgtcggacacagcagcaggggcgccctgcaggtgggttcgagggagcaggtgccaggactttgcagggtgagaggccatctaaggtccccgggtctttccaggaacgggacagtctctctgggctgtggcaaactcttgacccctccctcccagctggggctgtgatgtggacagcaagtctccggaagtggccctaagggctgggagggggcgtgggccccctggagggatctggggcccggagagggaatggacgcagggatcctctgggaggtctgcccgcacgacctcacccaaggggtgtgcagcgggggtggggagcaggaaggtagaggctgggggctggatcctgggctcccgtctggcctcacggcctctccaggtgtgggggtgcatctagccaaccgtgctcaggactctcatcagaagcagacatctgggctcctgcgggagtggggccgtgtgtgggttcaagggtgcagggtgtcaggttctgaatcgcttgttctctggggtttgtggatacctgagaactgcctgagccctgcgagtggatgtgccaggaccacaataccccaccccagtgcgctgtgtcgacacttttcctttccgtcctgttgatgcctggattttcctcccacctctgctcctcgccttacctctgggctcttttctacccgctgcgtgtgtgctcatgcaggtgtgcaggtggggtgctgctggagcttgtgccgtgttgtgggtgggcctccccttggcccctgagagcccagacagtatctagaatcataggcttgttggagaccacagccccctcctccaggaagctctcctgacctgccctttcccaggaagaaatgcagcctcctcctctgcacgcaggcagcacagaccaccctgtcctcacccagcaggatgcatgggctggtctctgtccctggcaggtgctgagcacagccgtggcatcggcaagtgtttctgggagaaatcactcatcccccagtccagtctcccctcttatggacgagtgtagaagtcaaggacgtttccagcccacaggcagaagtgggcagagccggtcacctgcagtgcaggtcccccaccccgggctgccatgtccctgtctcgccatctgggtcttgctgagagcaagcctggtgctctctcctctctgcctcacccttccctggtggaagattccctgtcctcactggagcctggggacggaggtaattttcatgtcctagggtctgggattcagattctgactcctcaactctgctgtgtgacctgggcagatggcctgacctctctgacctcattcaggtctcatccctgacccaggcacagccactggtcagtttaggagggggaggactgacgggctgtcactcccctgttgaagaaatgctgccacctcgtggttaagaggcttagaactatttcaaaagccgctttcagaccagtgctgtccaacagaaacacaaagccatccacgcacagaattttatattttctagtagccacactaatgaggtaacagaaacaggcgaaactgattttaataacaaattcttttttttttttttgagatggagtctcactctgtcgcccaggctggagtgcagttgcgcaatctcagctcactgcgagctccacctcccgggttcacgccattctcctggctcagcctcccgagtagctgggactacaggcatctgccaccgcgcccaactaattttttgtagttttagtagagacagggtttcaccgtgttggccaggatggtctcgatctcctgacctcgtgatccacccgccttggcctcccaaagtgctgggattacaggcgtgagccaccacgcctggcctgtaacagattctatttaacccaatatgtccaaaatattccagcattttggcattcatataaaaattattaatgaaacacactgtttttagtactaagtctgaaatttggtatgcatttcacacatcgcacacattggtttgatcttgccacatgtgaagggctcagtggccacgtgtggctcgtggctgctgtactggagaccatggcttgagagccttctaggggcataggctttcaccccactgtgcgtttgcaagtctgcagggggatccggggatgtctgtgtcccacggtggttggggtggggaagcaatggtgaatagcctaaccagccacagttgtcctggctttgctctgtggctgccagggcaggtgcggcctgggagaggcagagggtgggctttgggtcagcaggcccacccccgtgtggtaaggggcaaaaccagaggcctacggaggccaaggcagctggcaaaggcccagccacatcatgggactagctgtgtggtcttggggcagttgcagcccccgagggctcctcccagaccatcctgactctcttgtggccacagcagcacccactggggcttgctgattgttgggggaagaattgtgttttccagaaaagacatactgatgatgtaatccctggcacctgtgaatgggagcgtacttggaaacaaggtctttgtggatgaaatctgattcagatgaggcctcacgggattagggcaggccctaagccaataactggtatccctagaagaagagggagatttgggcagagacagacacagggacaaagttcacacatgacaacagaggcagggactggagtgctctggccacgagccaaggagcacctggggccaccaggagccgggaggggcgggagagttcttcccttagagccttgacagggagtgcggccctgcagacctgcagacttccagccttccagcctccagggctctgaactgttgttgcttttttttttcaagatagagtctctctgtcacccaggctggagtgcagtggtgtgatcttggctcactgcaacctccacctcccaggttcaagtgattctcccacctcagcctcccgagtagctgggactacaggtgtgtgccaccatgcccggctaatttttgtatttttagtagagacggggtttcaccatgttggccaggctggtcttgaactcctgacctcgtgatccacccgcctaggcctcccaaagtgctgggattacaggtgtgggccactgcacccggctgttgttgatttaacctaagcatggtgggcgctttgctagggcagccctggcaaacaaacccacccctctctgtgccttgcacatggcggccagtggaagtgggggtgacccagccagcagacactcttcctgccccttgggaaaccccgatggggctgcatggcttattgtggggtcacaggggatagtcctgctcctgcccacgatatgccccaagactctgtgtgttgagcattcactgggcacctcaccctcctgttgtattaatcttgatggatcctccaacagccctatgaggtagacgtgatccttatcccaatctacacatgaggaaactgaggcacgggcagtggttcatcctggagtcttagtgccctcatctgtgaacaagggagactggaagccacaggaagccaggaaggatcgcctgtccagtccctgtgtgatggtccagtcacttgtgtgggcgcttggtggctttggaggagcaggtgcagggatggacacctcaccttgtagctccctgaggccagcagagttcccagggtcaagtcaaagttagttcttccagtcgctcatgtctgctgagtgaataaacaaagttccaggttcacccaagcttgccagctcagggccaggccacgctcagtgccagccgggcaccgtcagagccttgtgatgggtacccagggagtggagcaggggtgctgggctgagatcaccttgacccttgagctgactgtgctgtagcatctgcctcggtccaagctcagtgcaggatgagaccacgggtcagctgagtgcaaaccctgctgccagagtggccccactggtggccagctttgcacaccggtgctcgctcagggccctgcacaggatgggtgctcacacagggccctgtgtggatgccagccttttatctgctcttcccaacatcacccagttgtctttagccacactgacaggcgggtgagggcacagtatttcaagcagaatcccggaccagcttttttttcattccttttttcctaaagttcaagctgtcatgcctcctttatgctgcagattggtggagtctggggacgctctgtctggaccatgaaggcctgggagtcacgtgagagtgccagggagggtgtctggacagtctcacgcccacaggcccgtgacagtcatccagggggactcaagctcctctgtgctcatcccagcgcgcgttgtgggcgtccgcgggcatggacgggcaggtgggcacactgcagcacccctcttgggttagggccgccccactcccaggtgctttaggaaaacagtgcccttgcctgctgctctcccacactcagcacagcagggcttctgcagcttgtctccgggttgttctgaaaccatcccaggaatgatgcacactgtggctgatggagcctcttccccccggaagatcgtatgctgggctcggaccataggtcgtctcatctcacagtattcctacaaaatgattataatgaacccatgtgaaatgggggaaatggagacacaaaagagccacttgcccggggcccccggctgtgatgtggcggttggaacctgggcccggtggtctggggctgggcatcttccctgccctccacagcccttgtggttcatagtccatgttccctgccagcttggacagggagggagagtgagcccaagggcagccgtgtcttccccagggccgcccgcacacgcctgttccacgcccggagagcgctgtgtggacctcttttgtcatctgtgatgaggatggaaacgggagctctcctaggagtgcctggtggaggactagtgccctaaacgtccccatcccacaagagctctgtgagctgaatggtgtagggatccaggactgtggttgcccagtccccagtggggaaaccgagtcccaggaggttcccgagggtgggagctgcctggccacagagcagcccaggtctctctgacctttggagagttgccatatgctcagccaagttttcacagcccccagatcctagggtgagctccgaaaagcggcctgcactctcctggcctcaaggttctgtcccaggttttggctggaggtgaagtcacagccaggcaggcaggccttttcctctgctccagcctgcttgcccccttctccctggccccctgcacccactccacacgtcctgcctgtgggtcacgtccccttctccgggttcctgctgctcccactgcccagcctgccccctctctggccaggtgggctccggcatgggcccgtcccagcactagccgggttttaaatctgatgccgggttccccgccttggatgcgttctcgctgcctgatgcacacagagccttgggtcccacttcatacagggcccttagcagccagcattgcttagggttggctgtgtttggccttctcagaggccttactgttgggttcacatgtctgggttcagaaagggccctcgaaaccccacgattgtgaggatggttttgtgtgttgatcctttgttcttggaagagggcccctgattcaggaaatggggagaggccacaccctggtggtgtccttgggggcacggagcctgcgtggctgactctgggaggggcctgggtctgggtgcagcagtgcctgctggtgagggctccgggggctgacagttaaaacttttggaatcttctgaggactcagcggcttacggtgggaagcttgagattggccacagtagaggtacttgtgccccagcactcacagatgccacctcagggctcttctgtcctggacatcaggcttgtgggcaccatggcccagccccgggcttcgagccagatggatgccactgacgcctgctgccgcctgtctgtccttaggcaggtcatgtgacctctcagacgcagctttcatgcctgggaaatgggggtgactgtggtgtctgcctcaggggctgctgtgaagactccatgagatggagctggcggagggtggcctgggctggtccctacctgcactcagggccctggccgtgtgttgcccggtgagtgaaggatggcgaggcaggtccctaacagtgccatgtctctctttccaggtgaatgccacaggccaccagctgcagacagcggtacagtaccgggacctccctggcttctgttctgtaggagggctgcagcccccacactgtcagagcactttaggcagctgaatccgtgatttcagaagtgggtaatggataacacagcccattaatcaaactagaaccccctcgtaaacagccagagaaaaattagacataacaaaaaaagaccagctaggaaaaggtgcaccagcttcccaccgggctatgcccaccccagcccctgcagagatgtcctctccatccctctccagtccccactgcagtcacacgtcctgcatttgggccttgtccacatgcatttcatggtcactggctctgtgccgggcccctgctgagtctggggtttgggtgagtcacctccccctccaggccccgatttcctccttgtgacaggaggagtgctgaacgaatcttgtgagatggtttcaaaagtgacgtgggagccaaccaatgtgaagtgctcaggtcagggctgaggacagggctttttccctgaaaggggcaaacatttcattgtcgcctcctgacggatttgggcatctggtgtattctaagtggaggctttcaaaatatcagaaaaaaaattctgggtaccaagtcaatgacatatgtaaaatgcctattttattttattttttatttatttatttttatttttagagatggaggtcttgctgtgttacccaggctggtctcaaactcctggcctcaagtgatcctcgcatctcagcctcccaaaatgctggaattacaggcgttagccaccttgcctggctgtaaaatgtggtgagcagggcaatgtgaggcagaaagaatcctgtcctttctagactttgacatgagacgtggcaaaatgtcatgacttgtcctatgcgatgccacatcgggaaagtccagctgaggaaaagaggagaaggccatctgggggtgcgagcgtggagccagcggctgcggggacacagtcagctcccgacggggctggagggccctgctaggccgatgagggccttaaagatggggcttttggagctaaacaaacagctgtgatgaggaagcaggaaggtgcccagcaacaatgaggaccctaccctctgcctgggcttacggcatccctgcgagctgcagagcagagatgagccggctgagccgcatctgtcattatccacttctcatccaagtcctgagccccaactgacccattagggtccccaaagacactagacgcccaaagcaggatgtgtcttttgggacgtctttgtgctgcggctgtggctcctgggtggtctgtgcctgtccctgcctaatgcagcatcagctggctgccttcacgggcccttgtgtggcacagctgctttgcagatggagacgccgaggctcagggcagcctgctgcggctggcttgctggtgggtagttgaatctggttggtcttaggctcctcctctggtctctcacaggctctgattcctgcacagtagctgttgtcctggtcctcccctgccagaccgtgggtgcccctccctgcaggccctggccctgcgtggggtcccctacgtaaatgtctgacgcgtcacggtcagggccactgcgggagggactgacctgccgaccctgcctccccagccacctgcgtggacctgcagctcaggacctgcagcgatgccgcctacaaccacaccaccttccccaacctgcttcagcaccggtcgtgggaggtggtggaggccagctccgagtacatcctgctgagcgttctacaccagctcctggaaggccagtgcaacccggacctgcggctgctgggctgtgctgtgctggccccccggtgtgagggcggctgggtgcgcagaccctgccggcacatctgcgagggcctgcgggaggtctgccagcccgccttcgacgccattgacatggcctggccctacttccttgactgccaccgctacttcacgagagaggacgagggctgctatgacccgctggagaagcttcggggtaagggaaagtggcgggggcctgtgtggtcatggggtccaggtggtcaaggaggaccaagagccacactggaaggaacttgagggcttttccatcgacagtgacggtgcaggcattggtagagggcggggctgctccccgaggcagcatgttccccacaaaagggtgccaggcagggtcgggggctcagtgcagatggaggatcctctcgctgcccagggccccctagcagaagtctccagccccttagaggcaggctggggtggaagggtgctgagtccaagtgggggcagtgcccccgcccagggtgcagtgagcaggcctcgtgtgggggagcctgggctcagagtgcagggctggccctgggggtccagtcctcagccacagaccctccagaaccacagtgcttacccctggtcaaggggggggcgggacatttacatcccccgggaggtctggcgggcaaagcttcacgattgctcatcgctgggcctggaagatcacacagagggtttggcttggagtgactcctccaagcagggtctgcaccgccctgtgggctcaaggagggagaggagctgtggagaaatgctttgatgtctcttgcagatgaaacagtggagggggagtgggcaagactgggccaccatgggccacttgtctctgaggtgcgcaaagaggtgccagagggccacttggcagcggggctggttgggggccctgcatggagtcccctgtgtctgttgtctcacgagtcggtgtccaccagagaccctgcatgatccgcagcagccctggcccgttagacctttctgtgtaaaagaaatgttctattctgttctgtccaagacagttaccactggccgcatgtggcccccaaggcttgggatgtggctcttgccactgaggcctggatgtgggcgtttcattgcatttgaatgagtctgaacctgtctttgaagagcctagggccagtgtgtgccacattcaactgtgcagggcagtgtccgctcatggttgggttcagaggatctgactgcgggtgccacacatgtgctagctcacgcgagtctcacgacagccttgctccatggaagaggaagtggagcctcgggaagggtgacagcagtggggtctttagctggagtggcccaagcccattgcggatggagggatggatttggccatttgtcaaacagctaccgagcacccactgtacatgtggctttgtgctgggacattgaggagggcaggagaaggaaggcagacaaacacctgggccgggctccagcaagccctgggttccgggctatgtcaggtgctcagggctgaacctggcatgtcttgcagcctctggctcccaatctgagaagggtggaccctgggctcccatgcgatgcagcggtagggggggtgccctttgccagcaggtgggagccgtctgtctgcagagctcagtccctgtagaggtggtggagctgcctgtgggaggccagggaggcgaggaaggaagccaagcccacagccctgggaaagcccaaggagtcggttggagattattttgggcatctctaccaccaaattgccggcttcctctgctagtctttcccctggagaaccgttttgagcagaagcaaaaccacagggcaaggagaagcttagaggagcacattaactctctgtggacccaggaacagcctgcgggcacctgcgtcctgctcctgtgggcctgactgctgcaaagcccctggcggggtggagggagctgagcgtcaccggggtggccctcagggcacctctgttctagtggatgacaggatggtggggaagctggtgcgtatgtggtgtagagacgttcgtattctagttccagaacccctccctcttccccagcccccttttttcttcctcccccaagtccttcccagagcccccctttctgtttccttcctggacaggcactcactgttgtaccgatgaggttgtaacagaaacactgggaagcctcacagcagccggagggggcaccacaaggagccttcctgtttccaccattagccaagcaaatgaagcagaatactgaactgcctgagtgccactgtcatggaaaacacgcccaggaaaatcccctctgcacacccagcaggggtttgccttggggggtccaggaccccatatatctgtcttcctttctgttgtcctgctccgtattttaggagcttcccacagtggccccatagtatgtttactcacagtcacgttaggaaccatggcgctgtgctgtgtacatacctcaggtgccgtttggcttagatatcgttgtaggcactgcagagggaactctaattaaagatagagatgtccaagcatggctgtcgtgcagaggggactaagggtgctgtgtgtggtcagcgttcccaggcagtggtaggaagcctgggggcctgacactgactgagcccccccactgctcccccaggaggcctggaggctgacgaggcactgccctcagggctgccgcccaccttcatccgcttcagccaccactcctacgcccagatggtgcgtgtgctgaggcggacggcctcccgctgcgcccacgtggccaggacctacagcatcgggcgcagcttcgacggcagggagctgctggtcatcgagttctccagccgccccggccagcacgagctgagtgagtgcccttgggagagcctggcctggccccgtttcgggaaagggcttgggccgctccaccttcgggtgcacaagttggtggggtgtttggggtcctgggcagagctgggggcctcagggagctgcttggtgcaggccacgtcccgctgggcatgtgcaaccactatatgtataaagaagaatttctccagatatccatcttacttcaaaatgtagggtggcagactaggttatttcataataatggagacattgatctagtggctgaaaagatataaaacaaacaagaaattttattttatttttttgagacagagttttgctcttgttgcccaggctggagtgcagtggcacgatctcggctcactgcaacctctgcctcctgggttcaagcaattctcctgcctcagcctcccgagtagccgggactccaggcatgggccaccacaccaggccaatttttgtatttttagtagagacaggggtttcaccatgttggccaggctagtctcgaactcctgacctcaagtgatccgcccagctcggcctccccactcaaacagaatcggttattttagaagcagcctccatttgacccttggtcatcaccagttactgaaaaatgcacctgctctttgtttatggactcagggccttttcagtgctggcagcctcagccagtcttcatcctactggtctgggcagcatgaacaccatgagcccaaaggctctatctcttaccaggggccagaggccacctggccacaccctggcccccaaggctcactatgttccctctccaactgtaacatgctctgggcaggaggcagaggctctccctacagcactggaatttgagggcaagaggtgcccctgtgcagaaggccaagggaggtaaccagcgcagaaagctcccaggtcatttataccccgggatgtggcatctgaggaacacgggtgtttcctctcatccctggctgtccctgggccacacacagctggggagggagacatcattttccaggggagcaagtgcgaggcttagagaggaggagtgacttgcctgcagtcacacagccagtaaggccatggggcctggtccactcttcttcctatagtccattcatttattcatccatccatccatccatccatccatccatccatccatccatttattcattcagccattacacatccatccatcatccacccattcattcatacatccatgcatccatccactcatcatccatccatttatttacacacccatccatcatccgtccatccattcatgcatcaatttatccattatttcatccagccattattcactcatccatccatcattgatttatccatctatccattcatccatcattgatatatctatccatccagccatccagccagccattattcatccatccatccatccatccatccatcattgatatatccattcatccactcaagggccaaccaccttcccagctaagtaccaatgtgcactttgacttattacacaaacatgaagagagaccatcagttaaatttgcatgaatcaatgataacatatattattcatattcttgagttatgctaactaagaattctggctaggcataaaaaacgagcttaacaaaagtgatgaccttgatgagacctcattatatacagagattcttgagtcaaaacaagtatgaattggtcccagcccatctggtcattcttgctgagtgggggggcctcatgcctttggggacccccggctttgagatgatgccccaagtctctgtatttgcccccagtggagcccgaggtgaagctcatcggcaacattcatggcaacgaggtggcgggccgggagatgctcatctacctagcccagtacctgtgctctgagtacctgcttggtaacccccgcatccagcgcctgctcaacaccacccgcatccacctgctgccctccatgaaccctgacggctatgaggtggcagctgccgaggtgagcgcccagatgcctggatcctgtgggccaccgcccgaaccaccccctcattcatccatttatgagtagtttatcccagcagtgcttcgttcctgcctctctaggagaggagcattcagcaggtgtcgatactggcaaacccctgcttcaggggctggggagaaggaaggcactgagaattctaggtgaattaaaaaggtgatgcgtgtgatagaggaaaatgatggaaagggagtcgatggtgcccgtgtgtgtcagcggggggtcagggtagctctcggggaggtgggcaacgagcagagcaggtgactgtcgagggcgccccactcagggggagcagccagggaaggccccaaggctgtgacatcagcaaggagccccggggtggagaggaggccaagggtcaggcatgcccccgagctcatcacataaagccgggggaaaccgcagcccctggccttgaccctcagcccagcgtgagacccatctggaaggaggagggtggggtgtgctgaccccacccagtcgggggttggccatgttttcagggtgccggctacaacgggtggacgagcgggaggcagaacgcgcagaacctggatctgaaccgaaatttcccggacctgacgtccgagtactaccggctggcggagacccgcggcgcacgcagcgaccacatccccatcccccagcactactggtggggtaaggtaggagctgccgctgcccatgctggtctccaccaaggcatccaggggtccctagttattccaggctctctggagttgtccttccctggggacaggagagcctggtgctccctccctgcctcagttacctgtctgtgaaatgggaacacctccttgctggggtgttggtgagattcagagattcatgttggaaacgcctagatccccgcaggggcccagtgatgggggccgagtccagctggtgcgttgatgtagagaccgttaatagtctgcaccattggagcccagagggctgctgaagcccagggtatggctgcgggccagtgggaaagcccagccctgagggcggcctcatctgtcctgggcaggtggccccggagacaaaggcaatcatgaagtggatgcagaccataccctttgtgctctcagccagccttcatgggggcgacctggtggtgtcctaccccttcgacttctccaagcacccccaggaggagaagatgttttctcccacgcccgacgagaaggtgagagggctgtcgggtgtgtgcaggggagggagacagtgtgcgcggtccccttggagctggtgcccctccagtcctgagctcagtgaaggcaaagctcctaggaacctctactcagagcgggtcagcaccacctgctccaggcccagctctgcagggaagccccttcctcctggaagtctgtggcctcaggggccgtcgctcccctgatctccccgaggctggctgcactgtctttcacatgtccccgtctgggagctcctggggtggggaccctgcctcagcgctgctgttcctttgagctccgcccggcgcctggcggggtccccagtgcttcccaccgcagaggggtgcgtttccgggaggcgccggcagagggcagtgctgcagcgcgcatgctgcccgcccgtcctgcttcccgggggtcgtgcttgcttctcacgtgctgggctcctccggatggggaaggagttctggtcccaccgtccactgggccattaggtgaggccctcccttttccgggcctcagtttctcctactgttcgtagagcagcgggcgatgagacccgtgatgatgctgggaccctcccaacccaccctaaccttaggacgacctgctgggggagggcgcggagttggtccgttcccacactgtggataagaaagcggaggctgagggaggggttgtgatctgaggtgggccccagcctccagcccccagcccccagcccccagctgcggatcctggagcttagctgcctgaactgcccctagtggtccccactccaccggaggctgggcctgccctccacctggccccttgatggcccagagtcgctccccaggcttcgcgtggagagccaggcctgccctccacctccctccctgcactttcccttggtgtttgggggaaggagcagggagagagggactggccctgggtgggcaagtgccaggtgccgggcccctcatagcagcagtcacacatcgtttgttctcctttctgaggccacccggccgagcacatagctgggcccctggttggcactcaggtatcagccctgcctcacctgggcccctccctgtcctggggccatcattgggaatgcaaacgggactggtccctgcgctgggggtcctcagtctagggtgggaaatggagccagaaactggcaaggagaagactgccagggctgcaggagggctgtgagtgcacgtgtgtgtgtgtgtatgcctgtgtgtgcgtgtgcatgcatgtgcacacgtgcatatgttggggtggggaacccccagcctggtctgggacttcaggggggcttccctgaggtggtggtttcccaaaaggtctccacaggtgaggtagagatttccagctgcagggcagggaggggcactggaggcacaggccacctggtgcagagaccaaggggagccccagggagccgggtgcaggggcccatgccgagtgctgtggcccagcaggaatggggagagcaagctgagcactctgcagaccaggggcagtgacagcaacacctgggccaccggcgcatttgtcctgcatttgttcattcttccacccattcactctttcacttgttcatcattcattaactcactccttcactcacccattcactccctcactccctccctcactcactcaccactcatacattcacccattcactcactcactcccttcctcactccctcactcattcactcactcatttactcattcacccattcactcactcacttctcattaactcagccattcactcactccctcactcattcactcacccattcactcaggcattcactcactccctcactcacttactcattgacttactcactcattcattgtcactcattcactcatcactcactcattctcttattcattcacacactaattttctcattcagtcattcatccattcactcatgcacttattcactttttcactcactcattctctcattcattcactcacaaactcattcactcactcttattctttcactcattggtttattcccgcactccttccctcactcattcattcattgactcttgcaggtagtgcacaccaagggtgcgaggggtgaggtgtctggttctctgctcagacctctgcaagtgcccgcagaggtgactgggcggcctccacttctggcctggccttgcacccctgtgctcttgggggccatggctgggcagggcaggtgtccccctctgcacaggcccagtgtgtctcagcctcagagctggcagggcagggcaggcatcccctctgcactggcccagtgtctctcagcctcagaaccagatgtgagaagacgtccccaggggggatgttcaccccagtgagtcccatcagagccagagaaaataacactgtttccaagccatcaatcatcgggcagtgaccatgcagccctgtggccggcagtgatctctggaaaccagggtcccaggagaggcctgggtttggcaggggaacatgagaggggctggctggggtgtgccaaggtaccctttcaccaaacttccatggtgccctacggacgagagccagtgcctggggacagtgttcaaggccctgcaggctggccatggctgccttttgctgctccacacgtgcccctttgcccgaatcctgctcctgctgtgtcctgcctgccaacccctttctggctttgccaacgcttgctgtgggaatgagcatagccagtttcccaagggcttcctggggcaggagctgggtgggctgggtttcccacggtcctcagcctgtgtttctgggtccccattcagtcccagcttccctgctcccgcctggtttcatttatctgtgtctcttccttgcccatgtgcgcccagcctctggaccgacagctcctctgatgtccttgtcctgcacctgccctcccaggtcaggcctgtgttagccagatctgggcccctgcaccccagggttttggtgactggtggtcggcagccaccttccatgccttagccctagagactgaccagtgatgggagggaggccccagggcaagggcagggaggagggactgtagggcagggaggccttgtgggtagaaagggtgacacggtgggttgggtcaggagcagactttggagagagtcttgtcccaccctcctaccccccgaggctacaccctgtcaagctgacggataaaggcaggtcagaggtgggacacaggtagaatgtagcagatgtggcctgggcagatggaccgtttgttggatgtgattcattcttgatgggaaagtccgctgaggcttcctgctatgaggcagggcaggccactcctgagctgatgctgccccacccacaggtgcaggggctgctggcaggatagtggtccatggtctgccaccctggaaccacagggcctgagtggggttgtgtttgtgcccttggtttgtgtctgtgggactgagtccagatggcacagcctcacttctgagaagctggacccattcctcaccaaccccaaacctcacgtctgggagtccgagtctcatgacccccaccagggagagatcttcactctggcctggaacaatcactcattcactcagtcactcactctttcactcattcactcactcattcactcattccctcactctttcacttgctcacgcattcgctcactcactcattcactcattcattcgctcattcactcactcactcactcactcactgggccctgcctgtccaccctctagtgtcctccactcctcctttctgacagagggagccccctcctcagcacagacctgtcctgcttggtggggccctgatgagctcatgcagggtgagcccttcgcctgcctgacccaccaggagcctctgcccaaggtcagtctgggacttacagacggcccagagcccccacaaaggaggatctgtggactctgcctgggggatgggcacaatgcggggaagctctgggctgggaagggaagcctgtggggagggacccaggatcccagccacacatccaaacatgtcaagggtggcagatcctgtgagctgtgttctgtccctctgccaactgcagtggaagctggagggtggggtagtcagggaggggcttcctgcaggctgagtcccagcctctgatggtgctggtcagcctggaggtggagtggggtggggaatgaagcagtgattattcatagaagtagttggctttggagatgaagtcggggaaaatgcagcccacccttgccttcactgctccaacagcctgggctttataaactgtcaagccaacctgcacacaccctgtggacaccatgtctgtgtgtaacctcaggagagaaagcccacactacccggccaggtgtgcagagtctcggtgattaccccagttacccatgggacctggccccgaactccagcagtgccagaccgcctgtgacccacctctgggccttcacatacactgtgtcctctgcaggacaccgttcccctctcctacctgcagacaccattcccctctcctatctgcaatgcaggtgtttgcacgcgcagctcctcccctcattgaccccagctcacaggacgtcctgcaggggaccctttccttatctgagccaggtttcttttccagatgttcaagctgctgtccagagcctacgctgacgtccaccccatgatgatggacaggtcggagaataggtgtggaggcaatttcctgaagagggggagcatcatcaacggggcggactggtacagcttcacgggaggtgcggcttccgcagggcgggactggggtgggggtggggggtgcaggggctgggtggggcaggggcaaggcataactccacggtctgctgctgggatccagctggagagcccggaagacagggcgatgcctcacctggtggagaggaggctggcgtgagttttgtttctgtcttgatgaaaagctgtcgtgtgactgttgtggacccaggcccgtggctcctgtagtttatttcatgaacactcaaatgtcacggtttcacccatgaccaatacctttgtgacattagggaagtggagttgccagatgaaatgctggacttccagttaaattggaattccagagagaccgtgaggaattgtttttaggacaatgtaaggatgttccaatgcgtgggatatgcttacgagaacccgcatggggtggactgatactacaattgtatctgtggtttctctggagcccgacttgaagcgtgtacatctttatctgctaaatttgcccttggggaggctgcacaggagcaatataatgggcatatgccactgtgtgtcctgaggggtacccgccagaccaggcacacatgctctgggccctgcctgcacctctccatgccggcacatcacagatgagagcgctgggctcagctgagagaaggacttgctggaggcccagggccacaggtggcagagccaggacccacgtggcatccccttctgccccctcctcccatgcaggcgggcagagaaggtggcacttcttgcacactctgaagccatcttcgcagcctgctctgaaaacttttctctcctgctcaatggttggcacctgtgatctttccctggtgcggcgcagcctctctcccttccagaacccaggcagagggccctcagcccccgtcatagccctgtgactggggtctgcaacagacacccacgagcagagctgggagaggcccctctctgttcctttttttttttttttttgagacggagtctcgctctgtcaccaggctggagcacagtggtgcgatcgcagctcactgcaatctctgcctcccgggttcaagcgattctcctgcctcagcctcccgagtagctgggattacaggcgcccaccaccacacccagctaatttttgtatttttagtagagatggggtttcaccatgttggccaggatggtcttgatctcctgacctcgtgatccgcctgcctcggactcccagagtgctgggattataggcgtgagccactgcacctggcctctgtccctcttgcccctgatacggccctgggaaagcatgaagccggggaccagagctagctggaccagagagacggtgactgtggctacactggggtctgggcagggactgtcaacagcagctgcaggctctgcggctcaggagccttgaacttcagaagggcgtgggctccctgtggcccccgacacagccagccctgtgggtgctatcatcctaggcctgccttggagatggtcatggcttctgctgaacaagaagctccaagagcagatggcacagagggcagaagcgggtatggctggggtcgacccagcttgctctgaggccttctcggctggccaggtggctggttgtccaccctagcctgggcccgtggtctccctgggagatggagctaataggaccaccctcctagactctggtcaggacagcgtctgggtaaatggacattgtcaccatggggtctccaggccagcagctgggatgccaggggcctgtgcggctgccccgtgctgtgggcttttctgttagaaaccgattcatccctgacctcaccagagacagcatgggggtggggaagcctgtggactttgccgccaagcggcctgagctcaagatgcagctctgcctcttcccattgcgggacccttaaatgcctcatgccgccatctgcggatctgcaaagtggggatcatatggtccaccttgcagttgttcagcccctcagctgcaggaggggcgtctgtggcgagtacctgctgcactcacctgcctgctgggcacttggctgacaccccgacgtcccggctgtctctgcgcggctgacaccccggcgtcccggctgtctctgtgcggctgacacccctgacgtcccggctgtctctgtgcggctgacatccctgacgtccccgccgtctctgtgccacaggcatgtccgacttcaactacctgcacaccaactgctttgagatcacggtagagctgggctgtgtgaagttcccccccgaggaggccctgtacacactctggcagcacaacaaggagtcactcctgaatttcgtggagacggtgagttctgacggtctcagggctctggtccagctgtggcctgggtggggtgggtcacattcaggcccccagggcagcccccgtagcctcactgccccatacacacatgctccttttgccaccacttgttttggggttaactgtccaccatgcacaacttgagatacagtagccggctctcctttgcgtgctctgtgggtgctggggtggcggtgccatgtgttggagtccctgtgagcaaggatgttacagcctaaagcagcacaattaaacaagggagcatgggcctgggcagcccggcgaggtgtctgacccagcctcagaggctgggggggcttcctggaggaggcagccgcagggcttcatcttgaagaagggtaggagaaatcaaaccacaggacagggagagctcccagcagaggggagcatgctagaaccccaaggggacatcaaaaccctcgagagccgctggggctgtggtgaggactcgagccgtgggatggggcgggcactgtgctccaggaggcgcagaagtgagggctctgggcagtggggtagctgtgtggttcaggcagggttttggggcctcagagtgaagggtataggcaggaagtggctggcagaggctgggggcggggcagggcgtcctgactgaggggtgactactatcgtgaggctgaggtcacccagaagcaggcaggtgggaggtgagtggggatggctgagaatgtgtctaaaatgaccccctcgctgccccagagagccaaggtctccctagcactcagtgtcagagtggggactctgtgcccatgtctgctccccttccagcacagctcacaccgagggtgctggggaccccaagaagggtccaggatgtcacagggaaggcagcctgcgttcgaagaagcttctgctatttttttcccaagcgttttcaagaatcacataaattgcatatgagcacagatgcccagtgagaagcaggcctcagaaagagggttgagctgcagcagcaaggagaggtgagggcgcagcaccgtacagttggcgcccacccacacagggcagccggttctgacaccaggccgggcggcagacggggccgtcccattttatagatggagttgaggttctggcctggggtctctgggccacacacaggcttgtgctccaggctcccaatgtctgcgagccagccagaggaggagacagagggtcagagagtgacatggcctgtctggtgtcgcccagatctgcttcttcccaagccctctgtccatgagccccctcctttctagaaaaatcaggaaccttcctccaagtaagaatcgagccaactccctggggcagcagccgctgagataggaaagaaacaaagccccacacaaagtaaaatggaacattctgccatttgagtttctttctgatggctgtgccgcagccctgcaccacctgtggcgagtcccattcttctatgagctctcgcgccaggcctgtgcacattgcattttgcggctgtctgatgaacatgaggttgaaggagcctcggatgtggctggcattgctcctggatattacacatgaagtcttgggatatgaagatttacagcaagcgtggaccttggaaggctgggcagctcgctggctggctcttgagacggacgtcttacaggagacctgggcgcgggctcctgataaggatcaagcctgtcgtggccaattgaggcttttttcaaagtgatcctggccaggcctcgggtgggagtctacatcacctggggcgaggggaggggcggcgtggcagctctctttccccaccagagaaccgcatgtgccctgtgtttcatgaaggtgacccgtgggcccaagagcagggacagaaaaaaaatccgtccactgcaggctgatgctgagggcctcctgtaagagaccctcctgggagagcccctgctctcgggtggggctaggggaggcagaagtgagaccagggctggcagagaggaagactggggccgtggggccctggggtaggcccccagtgtggctggtcatcagggagggcttcctggaggaggaggagtgtgagctgtgttttgaagggagggaaggaatcggcccggtgaggggctggtgagggtattcttagcagagaaggctcagatgctgtctgggggtgaggaggagccacagggtggggtggctgaggggcatggtggcttctcgagctgtccagtttctcttcatcacctctcatgcaggaaaaccttactttttatgctctccctcccgctaaatgcgagtccatgagacattgtttcaggagtgcggttccattaagcagcgaagtgtggacaagagcatccagggtgggggtcacgagccccagagggcagggggcagtggctgtcagtccctctccatcgcgtcaggagggctgggaccccttgatgtgctcatcatggattccatgtgctctgggttcccgagatccctgtggcacagagataagtgctagcatgtgctttgtggagctagactgggtgcccactcccctctttcagccacctgcaccactgacagctgggcgtgagcctggaacagcagttaggtgccacagggtctgagctcacgggccgcgtgtgtcaggccagtcggtttctgcatcggtcacggcgggggtcagccgcggtgggattagagttcacatgcttgctgaaatcatcggtcctgcagaagccagagctgctttggcctcatgaacattttacagctgaggaaactgaggcacccagaagcaaaggtttgtctgaagtgaacagtccctacggcagagctgattttctggcccagagaaaaaccagcccctctcgggctaatgtcccggggccagggaaggaggatgctcctgttgccagggctgcttcctgaccctgtgggcccaggctctttgcttctgtggactcctccctccatataaagtatttaaaattatacaacagtcgacataaagatgaatatataggaaaacagtctctccaacctaaaatgttttgcttttatcctgattttaagaggagcaagatcattttcatagtttctggaagcacagcagggcctggctgggagccctttcccttgagaatctgttgctgctgagccccgtgcagggcccgggcagggggcagcctcgctggacggactcctctccccacaggcatcctggtcctgctcagcatgaccttcagcatccttggaccccacgttgttttctgctgactagagcaggggccgtgtgggtggtttgtcatcaactgttttacaagaaatgtggacaggatcaggcagctttgggagggctttccagggtgaaaacgttggagctgtgggcgtgcagggagcttgtgtgttcaggaccagttcgtgccaaggccaggcaagcagtaagaaggcagggcgtgttatacacgtgtacgatgaagaaaccgcgctgctcgagcgagggtccgagcactgtcctcgtcctctcccatgcccacgccaccttcaggagcctcagctcagagggacccagggagtcccgctggggctgggaaggcagggaaggaatgccgatcaggcagaagagtggcaggaaagggttctctgctcaatgcccatagagatggagtcagccaggcctcgggtgagatgcagggtcattcaaaagcccagaacgtgctcgggtcaattgccagggaggaaactgaggcccagagaggggagtgactgactcgttaaagatggcagagcgagggctggcagagtggggctctgtggggtggttccccctagataccaagctctgaggagcatgtggggaacgagctgacggcctccacgctcagcaggagagctcacgccatctccctggcctccccttggtctcttcaggtgcaccggggcatcaaaggtgtggtgacagataaattcggcaagccagtcaaaaacgcccggatctcagtcaaaggcattcgccacgacatcaccacaggtgagcacgtccctggctgtcccctggggaccacgtctgccaaggaaatgccacaccgtggcagccggcgccctcaggcactcacagtgtgcccagccctcagcaggatggctccattcctccccaggctggctgggtcggggagggtgggcaggaaccagggtctgcgtctccttacagcatttggtgagggaagagcttgcccagccgtagctactgaatgatggtggatgcatgctctgtattcctaggaaaatgccgcctcctccaacattgccggggagagccacctccacccctaagcctgtttgtttctatcccaaagttcataccctgttgatagctggggtgtccagccctgtgcgggctctggctgtccttacaggaatttcacagccgatgaaaaatgacggtatgctgtgatatgtgttacctggcagagatgtggtccagagaagagggggacttttgctaactgtggggtgggtatggggggtgggagtggtcatcgaaggtttcagagaagaggggtgcctaagcagggttttgaggtataaataagagtttgacagagaaaaggggtgggaaggacgttccaggcccacacagaggcaagtacacatttggcgcctgcctcccatgctaacctctccccactcatatccatcacccatcaccccgtggctgggtctgcagtcctcgtgagaatcatttttaatctatttgtccacagccccagatggtgactactggagactgctgcccccaggtatccacattgtcattgcccaagcccctggctacgccaaagtcatcaagaaagtcatcatccccgcccggatgaagagggctggccgtgtggacttcattctgcaacctctggggatgggacccaagaactttattcatgggctgcggaggactgggccccacgacccgctgggaggtgccagctctttgggggaggccacggagcccgacccgctccgggcgcgcaggcagccctcggccgacgggagtaagccctggtggtggtcctacttcacatcgctgagcacccacaggccacgctggctgctcaagtactagccccggccccagcacccgccaggatgtggagaccgaggcccgtctccgcatcccgggctcctggctcttgattttgtctgccacagacatcccacaaagccgctgccattttattaaagtgttttgatccactttccactggaatgagaggatctgtgtaaggcactttccagggaaggctggggactgacccttgttgcctgagggcagctgtggcctgggccccacagggcaatcccgggcagctatcctgctgcccacaggtccggattgcaggcccgagactccagcctatctgtactgggccaggtggactagctggcttttcccagaccaccaggccttgaactgacttcagatgggaaactgaggtgggccaagggtgtgagcatctgtaggagctgagctccggatcctgcagctgaagctcatgtgtcctggagtgtagagaaggaggggcactgaatgggaggatgggggtgggcaggaggtgaccccaaggtagggtcaagagctcaagggcgggagagctggccagagcctggggcctcatggcatgatcggggggaccacactcaggctcacaggcttccaggggggcctggctccatgggcgtggatattcctgggacctccctcatcctgatcatgctacttgggtccagggaccctctcctgtcccctctctcaccatcgagaaagtctgtcagccccgggatcttccaggaaggggtcccgtagcctgagcagagaatgcagcagagaaggcacctgagccggccagggctgtgtcaaaaagcagcagagacctggcgcttcaacagcagaagtgtgtcctcccacagtcctgggggctgacgtcagagccatgtccccagggcgggctccttctggcaccacgctccctggctctttggcggtcatctttcccccactcttcccatcatcatccctctatgtgtctctgtccacatttcctcttcttgtattgggctagggcctaatataagaccctagcgaccctcattttaatttagttacctttacaaagatgctacctccaaataagatcacactgaggacctggggctaggacttcagcagatgaattttgtgggagggacatggttcagcccctaggagagggcagcatctcccatacagtggctcctcacgtgctcctggctgtgccatcggcccccctggtttccagagctccaggcctgggcaggtccctccatggaactgggcatccactctgagcagtgccttgacctcaactgaatgacagcatggtccccaccagcaccctcagcctcgttccattgcctcctggcagctatgccctgaggcgaaggcctcggggttcccagctgaagcccagaggagcaggcacacccccggcgctgggtggcgtgctctcgggggaaggcatggggagggctcaggcagcctacagccctcaagtcttacactggcacaacagcgcttggtttgcggagcaagaatgatctggagtgtttggggaacatctcacagcctcctgagcccctgcatcctacattcacccatgcgcctagtgccttgaaggtttacatttatttggctccactgcatacagggcaccgtgcaggggtcctctgaaaccccgggaggcccgtggagcagacctctgcttcgtgctttgctgaagtgggtgtggaaacagcaggcgcaaggtgcccaggactcggggtgtgcaggtggccgctcagtctcagtccccccgtggggcacctgcacgaggccttccctgcacttcattctgtccccacccgttcacgctgtctagggaagagcctgctgcagtgggtgtgtggggtggaaggactcattccagagcccagttcgtgtcaggggccaagggccaggcccccggcatagaaactgggccgaggagtgggtcagggagccttggggaaggctgtgcaggggggccgtggcaagagtgggggccggggaggtggagacgaggagatagcattctcttcacacaccaccccggatccagccagcggggggcccttctgcacttccatgtccttttttgttggtttgttttgagaccgagtctcactctctcgcccaggctg

SEQ ID NO: 12273 - DNA, 130563 bp, Human
ccttatgtttttcttctgtaaaatgggagcaaaagatcttaatttcactgtggacataaatgaaatggacggataaacacaaaaggctttgcaaagactaatgccatccaaatggcagttactgccatgtataatttaaaagagagcaagacaatggggagtgttagctcacgcctataatcccagcactttgggagactgaggcgggtggatcacttgaggtcaggagttccagaccagcctggccaacatggagaaaccccacctctactaaaaatacaaaaattaggcaggcatggtggtgcacacctgtagtcccagctacttaggaggctgaggcaacagaattgcttgaacctgggaggcagaggttgcagtgagccgagataacaccactgcactccagtctggatgacaaagcaagactccgtcttaaaaaaaaaaaaaagaatgaacaagtccaatcagccaggagttgcagagtacctactctatcatagagggatccccatcctcgttttgcagggtgccaggagttggggatacaagaatagatgcaaaataaacacaaaggagcacacagctgagggggctgacagagacttagggaagtacagtagcttgctcataatcccacagccgatcagtaagaatcaagatccgagcccttgtctgtctcaacccagggccagagctcaagctcctgagcctccaggcttgggtcagcacagagcgtgtgcatggcagctgcttaataattgggtttactacattccaaattgacatgtacagtgctgagctggaatcgactttacaaccctaattacggtgtgcctggttgtgtattcagcatttatttaaatagtattttttttcttaaatgttgatttctgaaagaggccttccccagctctctctatttctctcccttagctgccttggcttttcttttataatgagaatcacaccctgtaattctatgtttatatttacaggattctatgtccaatgacactgagtgcaagaagggtagagacccagcatcttttactcacctctttaaactctggcttatatatatagcctggtgcttgacaagtattcatgataggggttaagctgagtatactgttgaataaaaccacaataattattggtcgcaattctcttgaatgtcttctccagagcactaagtagtgtaacttatcaagtttcctttcttgcattggctgttaggaagctcaaagccatatctgcaaacccttcatagcaagtctgtaaatcaacaagagcatttatttttgatcctgttctcatttgatgttccaaattttgttcttcaatcttcttttgttatatgttatttcatgctctcataatctattgtatatgtccttgtaagacactttaaacaacatccttgcttgaattaaataaattgcatagcctgtcgaatttctggcctgcaaagaaaaagaatgccctttccaacatcatggtatgtctccagagcaataaaccaccctcaggttacctgatttctggtgtccaaacccctttgggaataaggtttacatgactaggggtagttgagtggatgagaagctatttccttccaattaggtggttaggtggtggtggaggtggtgttctgaagtcagcagacagaactacaaaatctcacagaacgtgttttccctgctctgaccatgacctacggttactggggaaggaaactgcttccccaggtcaacccggcagcctcagtaggtgaggggcactgggtagaatacttggggtgccagggaggcattaatgcgagaggagtcaggtgctcagtttttattggagttgggagggcagccccacatcaggaagagaacctgtttctgcaggacggtccggggagaagggaggactccacccaggcttgtgtttgccctgctctgtgtattcagccagcaggctctgcacaaggaagcaaagtgcagggagccaggctccaccgacagccaggcactgggcagcacgcactggagacccaggaccctgtgcaggagcagctccgggtgacacgaggggactgaagatactcccacaggggctcagcaggtaactgctttcagatcctttaggcatggctggagggtttgctgtttgtggtagacggtgtcatatagaggccaggggtcagacagggtcaagtttgatcccagctctgccttctgttcactgtgtggccttggatatgtgtaagcctcagttccactatctgtgaaatggacccaaagatagcactcatctcaaagtttttagttttacaaggagcaaatgacaatgtggtcagtgttaggcgcatagccacataaataactcctatttggtggaactattgagggtcatttcaagcacaggacatggggagaagtcactggatggagggataggctgtgtgatttggggatccgtcagggcaagaatgccccatagccgagtggaatctgagccttcacctcaggcattgcctaaagaagtgggaggacaagaaaaaggacttgtggagtgccttttgtgaatcttatttaacgctcaagaccaccctatgaggcagctgctgattcaaatcctggcttcaggacccctgctgtttacatctccctctgaaccagtttcctgcctgaaagagtgattgcgattagaatgcgggtgcgctgcagccataccgccagatgccagccccagctccaccctgggctggctgggtgccctggagcaggttccctcagccctctgggcctcagtttcctcatctgtaaagtgaacctaataacagtactgagatcaaagggctgagaggactctactgcccgtaaatacctgtgcacttagtaactctaagctgtggttcttgttttcgctgttaccatcgtctccattttacaactaggaacatgaagctgggtgaagagggagctgcatctggttccaggtctcatggaaaggatgctgtggaactggagtccagtcgggcctgggatgagggtgcagccagtgagactctcaccttgggcacgaaatgtaagggatgccaaaaaactcagtcatggagataaacggtatgttaacacaacatttttaaaagtcagaattaatggcaagacacccgtgatgaacaaactatgaacatgttacagaaagataagatcaggaacagcggtaattttgattttcacaaatttcatgttaaaatactattcatctccatggctgagctttttggtgtcccttacattgttcccccggagtccagggcctgatccgcctcagcctcctggggatcctgagctgatcacagcagcttcaggccctgggtgtatatactcagggtatgtagagggtgcttcctcctaaataaagacaacagacggggcggggcatgctaaagtagtttctcatttaagtgagggtgggggaacaaaccaatgtcccaaatcacagaagattctttttttccaaagagttctggaacccagaagggttttgtttttaggaaaaaggcatgagctttgggaaaagcaatgggcccgttaaagcccatggattctgcctgctttaccatgacaagagatgtggagggagaggaattgaaaaaggctttgggttgggggcgggggtacctttgcaccatgcaggctcatctgtcctgctggagtattagatgtgacttgattgtctctgtgtctgcagcttctcttcaagccaagtgccctgccctgaagcagttcaggatttgagtgcctgagtcacgtggacccaggttcaaaccccaggtgtgcctccccatagctttctgactgctactcttgggcaagtagaactagtaaggtgcctaccctcatggaggtgacgttcgtgagatgaggggatggcattgctcagccttggtttctttatctgtgcaatcagggaataatgggactctgcaagggaaaaggagacgatgtgtgtgaagtgcctggcaccagggtcagggcaagggtgaagccagtgagcacctgggggataaaatgcagggaggcgctcactctctgctgccgattctgcaccagagatggttgccttcctatattttgtgtcctgctatgctcaccctggtgcttcctggcacatagtaagcctccaattaaaattacctgcgattatcatgcacttaacaatgtttggtgcaataataagactatgagagcgagctctaagatttttaggattaccatccgtttgtgcaaacataattaagtactccgaaagcaaaacatcaatcaccaagcagccctaaaacatccaaggtgattttgatcaaggcacccctgcccctggacccacaaagtcccataccaggaatcagggcttgggcagttcagtgaggactggatttcagtttcctgtgtccccttgtgcaggaggcaacctgtagcactgtacctggcactcctgataatagctgccgtgttcctagcactgtgcgggcacacacacggagctgcaggactgtggggcaggcaaagcggggttgttctttcctcctgcaaggtctttactgatgttgggggcagagggctggttctgctgggtgtgccagcctggccatgttggcgtcaccctcagctgagcagtgaggagggcccctgggttacctacattccattgcattgatcgaaggtgttgcttgtttacttggtgactaattctgtcaccattccacccttcaaaaccaccccccctcccattcaacagtcgtctagctgcctgctggtgatgaagtttcagaagtgctttctccaggccagcttgcatggggtttggcgtttggcctgtttccaggaggagggcctattattaatctgtaactacaaggaggcgacatggaccatcaatcactgtgtaaaagaggagggatttgagggcagcttccaggaggccaattcactcatggatcagaacacagaactaactcaattataacaataataagataaatgaataatattagcaataactaacgtttactcacctgagtactgccaagccctggcgctaaatccttacagtgattatcagtgacccttcaattgttcaatcctcactttatttgatttatttatttacttattgagacagagtctcattctgtcgctcaggctggagtgcagcagtgtgatctcggctcactgcaacctccgcttcctgggttcaagcgattctcctgcctcagcctcccaagtacctgggattacaggcattgtgcctccacatctggctaatttttgtatttttagtagagacagggttgcgccatgttggccaggatggtctcaaacacctgacctcaagtgatccacccacctcagcctcccaaactgctgggattacaggcatgagccacagcgcccggcctaatcctcactttagattgtaccatatatattccttgcctagttataattttctcattgcaagaatgaatatgcaggaaatattttctattccatgttctattatattacatataaatatttcataaaactataacatcacttatacagcagaagagacagtagaaagtatgaaaatagaaaagttaaaagtctaaactctggacttgagtttgcgagggttaagtcctcattctcccacttactagaagatgatctgtattagtcagcttgggctgtggtaaccaaaacaccacagactaggtggcttaaacaacagtcatttttgttttctcatagttctggaggctggaagtccaagatcaaggttctggccgatgcatttctggtgagaccactctttctggctagccaacagctgccttcttgctgtgtcctcacacggttgagagagagacagagagagctctttggtgtctctttttataatgacactaattctatcagatcaaggtccacccttctgatttcatttagccttgattccttagaggccacatttccaaatgcagtcatattgcacgttagggcttcaacacgaatccaacacgaattttggaaggacacatttcaatccatagcatgatcttaagtgaggagtttaagttccctgggctcaggttctgcatctgtaaaatggggacaataaaaatacctgcctcggccgggcccggtggctcacgcctgtaatcccagcactttgggaggccaaggcgggcggatcacgaggtcaggagatcgagaccatcctggctaacacggggaaaccccgtctctaccaaaaatacaaaaaattagccgggcgtggtggcaggcgcctgtagtcccagctactcgggagactgaggcaggagaatggtgtgaacccgggagacggagcttgcagtgagccgaaatggcgccactgcactccagcctgggcgacagagccagacttcgcctcaaaaaaaaaaaaagaaaaaaaatacctgcctcatcgggttctgataaggaagctgtgagttaacacagagaagcattcagagcaatggctggcataaggtaggcgctacaaaaatattaggtattactactgctaatgtatggtccattttatttactgcttatactaacagcttatctctattcctcagctgctgtgcaccagccacccagttatacaacacatgggccacacccttctaatcttcacaggagctccacgcaaggaatctattatggtccttccctccacccctcacttctcagacacggagccagggcttatgcatatggccagggtgagccagaggggagcccaggcagagggcttgcgctatttcaccaccacagacgaatttactcacgtgcttttcagaaatgcagatccctaggtgacacctggctacaaacacgaggagaacatccccaagtccaggcactagagcagggcccctcaatatcagcactagcgaccctcagcaaagcagacaattcttcgctgggggaagggggcggtccttggcattgcagggtatgtagcagcgtccccagcctctacccaccggataccagtgcacgccccccaaagctgaaccgtgactatcaaaactgcatgcaggcatttccaaatgccccttcggggccaaaatcgctcctgactccagaaacgctgtgctccacttattgtgagggagaaacaaagaacagcatatttccaaggagaaaacgtttagcaaagcaatgtaagtcatcgaggaataggacaagatatccaaaatatgaaatatagatatatagtcctggaaaattggtaccaaaataaaataccctaaacattgtaaatatgttatatatatagtgtgtgtgagatagatagataaagtagatgatagatagatagatagatagatagatagatagatagatagatagatagatgatagatagatactcatcataaagttgaaatattgtcagtcgaaccatcatgagttgagtttgggacatctatatcactaatagctactaggtgctcgccctgccaggcactttcccatcacatttaccccttcgcacggtaccacgatgtatcaggacatgccactcaacctctctgtgctccggcttctcataagacaactgggaaaataaaagtacctaactcagagagttgttgggaggaccaagagaggcaaatatatgcaaatcagaactgctcagcacagagaaaacactctaaatgtgtttattattgccaccattatgaatactgtcattttccacaagaaagatactttcagaagggtcaagtgctttgcccaaagcctcacgatcgtgggattttacggatgcctgtctcactccagatctcttgttctcaagaggagagaggggaaccccagagatgcaggagagcgagactgcggagggcagcctccacccacctccggtggggcatctgggcttgcttctgaataaccagctggaaagcctgccctgcccgccagttctgggggaagggaagctggaggcccaggacagttctcttgatttgcaagctcacgaaacagtgcgtcagcaaagcagtgcccctagaagggttgtgagtgtattcaggtgcctgggtgatggtggtctgtggactccgaagcctgagctattcctccgtctgagaatccgtgggtttggttgtctaggtcagggtaggcagcagccaggagagttctgaccccaggagacactcactcactcaccccagaaatatccaaaacaggggctctcagccatggaaatcacctagagatcttgaaagtaccccgatgcccagccccaccccagagaatctgctgtcatcagtttggcaggggcctgggcatggggatctcagaactctgtgggaggttctcacatgcagcccagtctgggcatgggcccccataacacaggcaggaggcggggaagtgaaggggctttctcatctgaacctccacaatcaacccccagtggcaaagtgccaaaccctcaaacacaagtctaatttcaaaaacaacacccctccacccaccatagcttcgtatgtttaatgtaaaataaggtcataaagacaaaacactcatataatcagttcatgaaagaaagggcattttaacaccccattcaaactttttctttttcaaaaatgaaagttagctctttcaattgtacgtttatcatgaaaaactctatctgatttatttttctcctttttgagaaatgggagaaaactattacagacaagaattactgtctgaactgccttgagcctcagttttcccatctattaaacggggatttaaaaaaaagtctccacccaagtcattctggtttgcccagggttttccaattttaacataagagtcctgtgtcctagagcatcctcactcctggaaaaagcttgaagatggtcaccatcacactattttctataggtgtctgatcatgagaatcactggggcatttgctaaaaatacaaattccagggccccaaattgacttttcggtgagaggatcacaggaatcagaaatgttgctggattcctcggtagagtctcactaccgggcacctgtgggagaaactggcttcaaagagcaaggatcatacccgtgagagtcctactcatgctaactcttgcgcagtcctctttatgtgccaggccctgttcagggcactttgcttatattcactggtttgactccataccagccccttgagatggaggctataattatccccatttttacagatgaggaaactgaggcccagcgaggctcagtgatgctcagggattccaaactccagagcccacattcctatcctatgtgctacactgatgtctacatagagcttcagcactgggctggcatacggcaagctctccatacaagtcatatatggttatcattattacgagttccaggacctttggggcactgaaggagttgccatcttcttgccaactgtgaacagaaggcttcattgcaaaacatcaaaatgcttctttcagccttcccagttgtttggacctagtcctgtaggctgaattcatttctgctaatattgacatcagccaatagatggcagtaaccttttgcttttgtcccacccagatgaatcctgttctttaaaaggttgatggacaggcaggagcaatttcacgacacatgcattatatctgctggtggagagtgacaatatctgaatccaggttatcactgaaaaagacacgccattagattttccttctttcagggcccttcaccttgaagtggccgagaggctacttagggtgtgcaatgatcagaataatgtaaccccaactctgtgggaagaaaaatcttctctcctacttctgtacaccatgcgtcttccagcaccaaggtttttcataacctcaagtgttgattcaaagtagctttgttaggattgaatttacattaaatagtaagagctttaaaataaagcttgtaatcctactgttaaaataattttaaaacttgttaaaagctgaatttagatagagatactttgtgtgtatatattcttgcatgtgtatatatgaacgtatgtgtttgcgcgtatccttgactgagacatttaacctgcgtgcctcagtttccacaccagcaaaattgaaataataatacctctgtcttgttgaattgctgcaaagagcaaattagttttactgcaaataaagctcctagaagtttctcaacagatggtaagcactcaccaaatgttgttattgttattactctatcatttctatgattttttagagttgttgtcattgtttttatacacagtaggctcaaatcctggtaaactttctgtaaagagccagatagtaaatatcttaggctttgcaggccataggtgtctgttgcaactactcagttctgccattatagcatgaaagccatcatagacaatatataaataaaagggcatgactatcttccagcaaaactttatttatggatgccaaaatttgactttcatataattttcatgtgtcacattctatgattcttctaatttttttccaaccatttataaatttaaaactcatttttagctcactggcctactaaaacaggcagtgagctgaatccagccaccgctgttctttgccaaccctagtcttgaggattcaatattatattattcataatgtcccattaacagacagaagcgatgatctgatgcaagtgtgtgagtcacggattttataaatagaaaatagcacaaaacaacaagtgtcctacatgttttaacagtgctcagctttattatgtggtatgatcagaagacatacaaaatccccagatttggttatgtattaaattcctgcaagagaacacatggtgagatccatgaccctttttttggcctcctcaatatctaattgctcaatgcgtctactaccagggaataaaaactcacaccaatggcgagagatccacaagaatccctggtgactcattgactcctttcagccagaaatcaaaagtcctaatttttattccgagagccactagagcagataagccagaagctaggtctttggagatgggctacattggaattacatgtgcaaaagaactttaggtggcaagacagcaggcctttggagtggctgcaagagtccttgtgtagggatcagatatactaggagtcaattcctcactggatgtttgcccttggtgggtcttggaggttccattcctcctttttaagggaagctagtaatatgcagaacattccggtggttaggagcacagccagactgtgtttgaatcttgctcattaactgggtgacctttggaaaatgatttaaccccctcgagtttcggctacctcatatgaagaatgaaatcatgatacctctatctcacaggagtgctataggactacatgagacaatacaggtgaagcactccaaaattagagcttggaattgagaacatgctaagtaatgatttgctattatcatcattattattatatatcatacattattataacgaagctcttcagaggtttggtgatgatgtggtcatgtacctaggtctgtgcctcatatgtgagagatgctatcaatcgttattccctccattgactaacaataattaagctcccagtaaatgcaaacacactgctaagattaggagatacaaaattgggtgaaggtagacactgcctttgacgtcagggtgcttacaatttcttgtggaagggagacataaattaaatattcaactttgcccttcacctatgggacaataaccacattaacagtcatttcagaaccatcctacccagcagtgccacaacctgccatctcccatatgatcccatctcacgtaatgttattaattacttttattcgaccaggcgcagtggctcatgcctgtaatcccaacactttgggaggccaaggcgggtggatcacatgaggccaggcactcgagaccagtctggccaacatggtgaaaacccatctctactaaaaatacaaaaaaaaaaaaaaatagtctggtgttgtgccacgcacctgttatcccagctactcaggaggctgaggcaggagaattgcttaaacccagaaggcggaggttgcagtgagccgagattgcaccactgcactccatcctgggcaacagagagagactccgtctcaaaaaaaaattacttttattcataacttagaaccctatgcatttttgtttaataagcagatatgttttgcttaacatgagctagacattgttctaaccacgtcacaagcattaactcattgggtccttatagcagtcttatgaggcacagagaggctaattaactctcccaaggacacacagctacaaggggcagagagaggattcatgcccaggcagtcttgctctagagtctgtggtcataaccactgtgccatgctgccttgaactatcagaaacaacctcgtttgtggatttattgttcctatgttaactctctccctgtgcaccatacttcagctccatgaagtcagagggccttgcctgtttaatttacagctgtaaccctagtgcccagcccagcaacaggtgcagagctgtgctccatagacacagtcatacactgcataatgataccttagtcaatgatggaccacatatacttagtggtcacatgacattataatactatgtatttactggactttttctgtttcgatatgtttaggtacacaaatacttcccagtgtgtcacaatttcccagagtgttcaatgtggttgcgtgctgtgcaagttagtggcctaggaacgataggttataccatacagcctaggagtgtagtaggctatactatctatgatgttcatacaaccatgaaatcatctaatgatgcatttctcagaacattttctcgcccttaagtgacacatgaccatatgtgctaaatcagtgaaagcatgaatatatacccaagtaagtatataattacaagccctgctaaatgctatgaaaaaaaaaaggccgtagtgtaaaaggttttaataggggaattaatttagtttgagaatcagaaaaaaatattattatttcaattaccctcattctaaaatcctaatagctgtgactttaactaaaagagaaaaaaatgctatctacactgaatacacttttcatgatgataaatattttcccctagcaatgaaatgcaactgaaaattatgactgcatttaactttaattctgttgaatacatgagtccaaaatctcctttctatttcccaaaataaatataagcaatgatatagtttggttgtgtctctacgtaaaatcttaccttgaattgtaatcctcataatccccacgtcaaggatgggaccaggtggaggtaattggatcatgggggcgggttcctccacgctgttctcgtgatactgagtgagtctcgcgagatctgatggttttataagcatctggcatttccccagctcgcactcattcttctggtgtcctgtggagaggtgtcttctgccacgattgtaagtttcctgcggtctccccagccatgcggaaccatgagtcaattcaacctcttttctttataaattacccagtctcgggtatttcttcatagcagtgtgagaacggactaatacaagcaatttgttctgatctcagctgatgataatacagccatgggcggcttgtcaggcctctgcaccttagtagcacatgtagcttcgtttggttttgatttctttctctcttcctctctttctctccattataggagcaatgggtaaccaaatgagtgttccccaaagagttgaagaccaagagaatgaaccagaagcagagacttaccaggtagtgtagtaaccattacaggggcatcagcagaaaaaaaaaaaaaaaaaaaagaacttcctgtatttgacaagtgtgttgactgaagtcctggctgctgattgattgtgtctgtgtgtgcaagacagtggagcgaggataacctaaaaggtgtcagaatcagcatattaaattcgtgctccagccctgacttgacaaatgcccatttgagcctggggtcccctccgtgcgacgggtcagagcttcctgtgagtgtggggtcccctgagctgaggcaccatggtgtgctctcataataactggagtccactcttggagtgagttattttggttctccaaggcatgatagaaaactggggagtttctagaaacacagcctttaagttaagtttaattttttgtgagacacccttgtatcttagaggttcttccttgagttcttctgattttcccccgaagatttgtctcacaatgccacgtgctctgtttcaggacaacgcgtctgctctgaacggggttccagtggtggtgtcgacccacacagttcagcacttagaggaaggtcagtgctactctgggaagggcatctaccctctcgtggggaaggggggtctgcagatgctgtttacggtgaaaaaaaaaaaaaaatgaaagggtcgaagccgcaggctcagtttgaaaatacttgcgtttgttccttgggctaccatgccctggtggcttaagcaacagaaatgtattgtctcacagtgctgaaggccaaaagttcaaaataaagttgtcagcagaattggttccttctgcgggtcatcagggagaacgtgttccacgcccctctcattggcttgtagatggccatctcctccctgcatcttcatgtcatcttccctctatgcatgtctaaatttccccttcatcatatggaagcagtcatgttggattagggcccaccctaataacctcatcttaacttgatcatctgcaaagatcctgtttccaaataaggtcacattcacagggggttaggacttcagcatctttgggggcaatatgattcagccataacaacagatctcttctgagtgtgtgtgacagctggaggagactgaggagttacagcagataagataaaagcaatagagtgaaaacatgaagcttggcagacctaggttgcaatctctgccctgcagattactggctgtgtgacctggaacaaggcatctgcttttctcagcctcagttttctcatctgtaaaatggggataaaagtacctacctcacagaattgctatcaggattaaaggaggttgtttattaaacatttaacatagtctccagcgatatttcatatattccttttccccaaatgtgcacagcctctgccattatcagcacttaggaattcctcagaagctgataaattataaaagacaacagaattgtgtccacatgagggcagtgttaaaactgaggcatatacttacctatttgactttatcctggagtataagactgtatattcaatgcttccagggtggtcaggctctactatgtgacggatacatataaattatgtaagaagaggtagtatagcccagtagttgagggtaagaattctgcaatcagattgctagctttgccacgtactagctgtgtgaccttgagcaagttacataacctctctgaacctctggctcctcatctgtacagtgggaataatgacagtacttatagcataagcatctgatataatgaaagcacatattacagtgcctgactgataataagtgctcctatcattatcatattatggttatggttgttttctttcacatgtaagattctgggcttcagtttcctttcctgagtaatgaaggaggtatattatagcattggttccaaagcttttagaatttcctagggaatgtattaaaaattccatgccctagtctcatcccgtagctgctattcagaataccctaaagttggggactgagaacctgaactattgggggctctgtagaaggttcttttaaaaaaaaatcatagctttagggtacaagtggtttttggttacatggatgtgattatatagtggcaaagtctgggcttttaatgtacctgtcacctgagtagtatacattgtacccaataagtaactttcaccctcattccactcccaccctcccttctttggagtctccaatatccattatgctaccctacgccccggtatacacatggcttagctcccactttcaagtgagaacatgcagtatttggtttctgtccttaagttgcttcacttaggataatggcctccagttccatccacgttgctgcaaaagacattattttgttatttttatggttgagtagtattccatggtgtgtgtgtgtgtgtgtatgtgtatatatatattcaacacatccaccaccatacatagctacttttttgtttttgttgtagggtgtggtgaggacccttacaatctactcttagcaaatttcaagtaagcaaaacagtattattaacttatatttaccatgcaacttattcatcttatgagtgaaagtatgtaccttttgaccaaaattttccctggaccttagcccctgataatcaccattttactctctgcttctatgaattcaacttttttagattccacataaaagtgagatcatatagtatttgtctttctgtgtctagcttatttcacttatcctaaagtcctccaggttcatccatgttgtttcaaatgccaatatttccttcttttgtatgattgaataactattctgttgtgtgtgtgtatttacacacatgtatatgtatatgtgtgtgtccatatatatatttcctttttccattcatccactgatggacacataggtcattcccatatcttggctattgtgaataatgctgcaatgaacctggggctacagctaccactttgagacccttctttcacttttttagatatacccagaagtggattgctgaatcatatggtagttgatatggttttgctctgtgtccccacccaaatctcatttttaattgtactcccataattcccatgtgttgtgggagggacccagtgggagataattttaatcatgggggcagtttcccccatactgttttcatggtagtgaataagtctcatgagatctgatggttttatcggaggtttccacttttgcatcatcctcattttctcttgccaccaccatgtaagaagtacctttcacctcccgccatgattctgaggcctccccagccatatggatctgtaagtccaattcaacctctttttcttcctagtctcagatatgtctttatcagcagtgtgaaaaacagactaatatagtagttttattttttaactttcttaggaacttccatactatttcccataatgactacgccagtttacattctcattttgtcccaatttttaatcgggttgtttgttttcaattatcttcttatgtttaatatggagtgcaagggcaaggaatgaatagggaaaaattgttgggattgagaaagcctcttctctatccttctctccatcctccatctcactttctcttttctttcctctctcacctgtaatatatttatgttttttatatattatgcatgtgtgttaacatatatgagatacacatatgcataggtatatctcatatatgtgtatgtctcacatacatgtatgcacatatttgagatatacatatatatatgcatatttcatatatatgtatgtatattacaaagatgttcccaaaaggagggaaataggtttctcttgaaacgtaggacaacagtctgagacagcagttgccgtgtgaacacctgcacatgacgagggaaaagaaacacacatttctgagtcatgggttatttgtacctcgccctcacacctggcagtcttgctgtcaacatcctcagctactgctggagagtttgtaaagagtcccagttaatcccgaggtagcaattttgcctgttattcattgacatcttcaacctgtgaaacttgctttagagtgattaccccttttaagcttattgttgtcctcatgcagttttcctaaggttattagctaagttataattttcagtgcagttttaaggggtataaaagtgaaattctgggtgaccctttcttgtccttcagagagaattatttgaccatgtcttttgatgcacatttctattgatctctattggtgtatacatatatgtatagaggtatagaaaagtcattggaaaaatatgtaaatagaaatctagttgactgtttggtttctttttatctatacttttcctacttacaaaaattacaattaaaacaattcattggtgatacggtttggctctgtccccacccaaatctcatcttgaactgtagctcccataatccccacgtgtcatgggagggacccagtaggaggtaattgaatcataggggcatgtttttcccatgctgttctcatgatagtgaataagtctcacgagatttgatggttttataaaagggagttccactgcatatgctctcttgcctgctgccatgtaagacatccctttgctcttccttcgtcatctgccatgattgtgaggtctccccagccatgtggagctgtaagtccattaaacctctttcctttataaattacccagtctcaggtatgtctttattagtagcctgagaacagactaataccattggcatccaataatatttcctatgaaggcttatttagaagcagcaatggtaccatggctaagcaaacagccaaagaggctggaatgctacattgaatcatggctccaatatgtgagcttgggcaggtttctgagcttctttgttctgtcatctgtaaaatgggaattataataatgataggaccaaagcttctaagttattgtacggtttaaataagttgatactcctaaaactctcagaacagtgtctggcatgtggtaaacacataaggaaagttattctgtcttggatttaatgtcaattgacataaagactgccattgctatttgaagttaactgtattatttctgcctaacatatcttttggaactttaagatcaaaagttaaaactagtctttcctacatcccttatgccttgtaagtcttttatttgtctttcgatacaatgtgagagatatcaatcagggaaaatacctcttttaaactaaaacatgaaattacattctgtatcctcctagaaagaaatgtatcgtgtagagtgctttttcttagtaagagcaaaccaccatgggaatttgatatcaaacaaacattaagtaatacaatccatgtggattggagatctttctcaaaagtttggtattattattcatcttaagtaacaatatattaaaaaatcaaaatgtctcagtttttgcttatgttatatttctagcttaactcaccaattttagatgttatttgagtgtcccgttttggagtaggttgctaatgatgttaaaacaacataccatgtgatttacctgcaatgccactaagacaaacacatttgcttgcaaactttgggtgagaggcttatgtgcttgttctgccaaaatgcaattgtttaaattagtatcctcaatttgtctccatccttttcaaatagttgttttatttgaacccaaaaatatcttgagaattattagagcaaaatatctatcattagaagaacggataatccaattagggtatatccgtacaatggtctcgtaatctgtttgtactgctataacaaaatgccatagatctggtaatttataaaaagtagaaatttttttctcttagttctagaggctgggaagtccaggatcaaagcaccagcaggttcagtgtctggtgagggccctgttctctacttccaagatggcgccttgctgtgcccaccagaggggaggaatgctgtgtcctcagatggcagacacgacagaagggcaggaaagggactaactagttccctcaagtccgtttataaagtctataattccatttatgtggtctttgccctctaaactcaatcacctccttaaggcctcacctcttaatatgatcacatggtaactaagtttcaacatatgaattttgggggacacattcaggctatagcagatggtatactccttagcaataaataagaaggaactactgatcaatgcaacagcatggatgaatctcaacattattatactaagaaaaagaagccagacacaaaaggcaacatactacatgattccacttatataaaattctagaaagggcacaaatgtagtgacagaaagtagatcagtggttgctaggggctggggctggttgagacactcactgcagaggggcatcgagaaactttgcaatgatggagaagctttataccttcatcatggtggaggctacatgactgcatattttgtcaaaatgcactgaattgtgctattaaagttggtggattttattgtatgtgaattatacttcaatcagataaatctgatttttgtaaatgctgttaaggtacaatgaagttttttaaaaatcagcatagttggctgggtgcagtggctcacgcgtgtaatcccagcacttttggaggccgagacaggtggatcacctgaggttgggagtttgagaccagcctggccaacgtggtgaaaccccgtctctactaaaaatacaaaaattagctgggcgtggtgacacacgtctgtaatcccagctactctggaggttgaggaaggagaatctcttgaacccagggaggcagaggttgcagtgagccaagatcgtgccacggcactccagcctaggagacagacagagacctcatctcaacaacaacaacaacaacaacaacaacaaacaaaaaaaaaaccagcatagtcaaaagcagctcacatcaactaaagaaaaaaaataaattcaataaagaatggggggaaagatcatttgctatgttagaagggtgtcttctgctcaaccagttcttttgcttcctctggattcatcactgggggcaggaggagtctgcacaaaagaaagtaatgtgatggggaggtgttttgtgaagagatgacatctcttagctattttgtcagcccattcctcccatatactgcccaagagagggagacctcaggagactgtcatctggtacctcttcacctccccccaatacatgtggtatgttaatttattgcatctcattgaatcagacaacttcaagtaggaccacacttcacagttgagcacatcaccctcctgttgcgtacagagatcccctgttttgttcacatgcaaactttggtggattgtgaaggagaaactcaatctcccatggctcagagatcaggcagttagaaaggacagaacatttagtcccacacaccactgtcaggccacacaaaattaatcatcctagaaagagaatatgctgttccatttagtgaaacattaccacggaggtgccacaacccctattaatatgcaacaatcactttcccaccaataagaaaggagaatgacggctgctccttacctttttcactcaaaagctaaaaagagaagagaaagcctaagcctagagattctgggaaggaaatacctaaaaaggctttttaccaccttgagaatatagttgttttctagtttgtttctttgcaaaagacccacctaaagagatagatggccagtattagcataaaaccaagctctgtgagagtgcagctaatgctgatgtgatttagttaacatttgttcttcaataacaaaaacatagttttaaaaggcacatatgttctcaagggggaccccagagtcatcttctcactcaagcagagctgaggtgttggggagggacgcaaggggaggcagagcgtggacggccagggcaaagaaggcaggtgggcaagtgagatgacacgttggcctcgcaggtgacatccaggactagacgaggtaatgcattaagagctaagcgcatcccattcatgaaattgtaatatcactgacgtgtatctgtgtatgtactgtatctgtgctctatacgtaaaaagaatgagttttgttcatcctctcccatagaaccattttcgccctcttgggattaataccatccccactgagagtgcatacactagggagtgcaacttacttatgcaatttcttcatgtatgagaccacagagtattatagctaagagtccagcacaaggcacggtgcccttcctcccatcaaatgctcacatctaatcttcagcacctatgagtatgtgaccttacatggcaaaaggacttggcagatgtgactaaggaatgtgagatgatgatattatcctggattatccaggtggacccagtgtgatcacaagggtcttcatgagagggaggcagaagggttggagtaggaaaaggtgtgattatgggagcagatgtcacaaagagagagaggcttaaagatgctacactgctggactggaagctggagaatggagccacaagccaaggaatgtaggtgacctctggataccagagaaaagaaggaaatagattctcccctacagcttctagaagctgacccatttttgacctacaggcttcagaactgtaatatatttgtgctggggcatttgggataattcattacagcaatcggaaatggaaccatatcctctcaagcattggactctaacagacccaagcataggttttggctctgccactcactagctgtacaaccttggcaaggaagtttattctgagtctcatctgtaaaactggaataatagtatgaactttgtaggggagctctaaaaacagcagctggcacaagataaaagtgctgaaataaaggagtccgggcaaaactaaaagtagaggctattgggatgggtgcagtggctcacgcctaaaatcccagcactctgggaggctgaggtgggaggattgcttgagtccaggagtttgagttcagcctgggcaacatagagaccccatctctatttaaaaaaaaaaaaaaagtagaggctattttcatacttattctttaccattggctttccctgacatatcacctgaccagattttcccacctgcatattatttatgcctaaaacttcatagatctttggagaaataaaaatgcctgatttttggccttctttgattcctttctagcaaatttatgacattagttctcaggcctcactgctaacgtatggcagagactaagacatgccttccctgccaggacacgtcattttccagaaacagaaggaatgtttgacctggataaaaggtttctaaaattagtattttccttttttgctcctagtcattgttcctaaaaagaatagactaattttgcttttcttaaaaaaaagatgtaagtggaatcattttattggattgaaaattctaacttgagaaaagtgctcctgccaataacataatgagtgagaagagaagcatttgccaatatcaatgcctagtcaaagtggaatgggagacctgatgccaaaaagcatagctccctgatgtagtaaaaaatataggcaacagcacttgtctggaagggagcaaatacatgtgttctcctagtgtccactatttccctccaattgatcttattttttatctgtttccaaactcaagtaaaagtccctgagagcaggacgcttgccatcctttcttgttatgagggtcccagagctcagcacaaggcctgagatacactaaagacttagaaatggttgatcaatgaacagtggcatattaagccagtggtagcagaggaataaaataataaggccgaagggcaagttcccagactctgctgcactcagcttcaaggaatgcaaccctggataagtaaatagcacttttaatttgagcaagaagtctggaggtggcagttctaaatttggtacagcagtctgacagcctcatcaaaacaccaagtacatgagccaattgtgtcactcctgctcacaagatggctgtcacagaaccaaacatcacatctctacatcatgggatccaaaagcaggagaggaaaggccaaactttgccaccatttttttttctccttgtattatgcgaggaaggaggatccttccctgaagcctctgccaccatgtaggcatcctcttattggccagagctacatcacatggcccataccagctgcatgggatactgggaatcaagcatctctttgagatgcaagtgaataataataatacatggttggggctggagacgattggctattgggcaggccacaaacagtgtctgccagaggtgattccaaagaattattagaattgagcaaaggaaagtagttcatatcctcactctggcctttcaaaagacattaaggagatctaactcacatcctaaacaccacttttctctctcctcacattgctatatgtctctcactcaagaggctccctatcctcaactctccaccttgaaactctgtgagacaccccatcctcatgaggtaggggaatagggtctggaggcggggaagctaaggacttcctagaactaaatcaagcagaaaacccacaactttctatgctcaactatggatgtaactgcacttcagctatggcaggaaatatcctcttcatttgcatagggtgtacaccaagtaaataactttgtaacttcccttcatcctcttcatttacatagggcatacaccaagtaaccaatgggaaaccactagagggtatttaaaccccagaaatttctgtaaccagcactcttgagccacttgctcaaacctgctcccactctgtggagtgtactttcatttctataaatctgtgctttcattgctttgtgcattttgtccaatttttttgttcaaaacaccaagaacctggacaactctccactggtaacactcacaggcactctcctttcttctttccctccattgcactgtatcaccactgagtctaaagtaataacagagagttctgaacactggctctcccagatggcccaacagctccttgtgcctctgtcttccttgggagtgagcaagagccctggggaaatctcatccttctcaaactcagtgctttttctcaccaaaaagtctagtggagaattcctgttagataaaattatcttccctattgcattattgtggttgatagtctccaaagatgcacacatacaacccaccacgcaataacccatgcttcctggtattcacacccctgtgtagtcccctctgggctggtcctatataaccaacagtatgtagtagaagggatgacacaggactttcaagaagccttttaagaagactcggagcttctgccttgtctcttgcaacactagctctgagaaaggctagacacaatatcagaagttctaccctgagattgccatgctgtgagagagcccaagctagtcacatgaagaagccatgaggcaagagagaggtacccagccagttcccaaatattccagccatcccagtccaggaaccagacctgtgattaaagaagacatcatgggcatttcagctaatagatgccgtatgaggaaggaccataggaaccagcccatagccagaactaaagctccagacatatgtccctgtgtgagccgtcccagccatcttcatcctttcaaggcaccccagctgtggctccagacatcatagagcagaaataagctgatcctatcctctctctgcctgaattctttttttttttttttgagacagagtctcactctgtcacccaggctggagtgcagtggcacgatcttggcttgctgcaacctccacgtcccagatcaagtgattctcctgcctcagcctcttgtatagctgggattacaggcacgtgccaccatgtctggctaatttttgtatttttagtacagactggttttcaccatgttggccaggctggtctggaactccttgacttcaggtgatctgcccatctcagcctcccaaagtgctagaattacaggtatgagccactgcacctggcatctgcctgaattcttttttttttttttttttttgagatggagtctcgcgctgtccaccaggctggagtgcagtggcatgatcttggctcactgcaacctctgccttccagcttcaagtgattctcctgcctcagcctcccaagtagctgggattacaggtgcccgccaccacacccagctaatcttctgtatttttagtacagacggggttccactatgttgggcaggctggtctcaaactcctgacctcgtgatccacccaccttggcctcccaaagtgctgggattacaggcatgagccaccgcacccggccctgaattcttaatgcatggaatcatgacctaataaaatggtggttaagtcaatcattttggggatgcttgttacacagccatagataactgaaataactattagtatgcattttaattctttgtattttatttttacatgcatatatacttacatacataccaattaacatatatgaataaatgcaatcatattttctgttattgttgttttggtgaaacctgtctttttctttttcttattggcttcttcctcatctcacatcttccctaccccctccaaggacacccaagctaacaacctaatatttcttctttcatatttttctctttgttctatactttgtaaaagacaaatctgagacacaataaaatttcaaagagtgtatctgaatagaggcaattcattaatttgagaaaagaaaaccaaaagggaattagtgttttgatgacaaagcattacatgccagaattaagggaaaatgcagaggcataatataaaatgtgtttgatgtgttacaattacacagttgccttatttgatcatctcattggaaggtacccagttatataattttaagtttgttgactgtttctgattggttgagctcaagttctgtttttctttagcataggcatttacaagaaacagttcgagttgttttgcttatgtctgcaaatcaagcaaggtttagctcatttatgtggtctaacaggctttgtccgctcagggattcttcaggtctggtctttattttaatttactttaactagccccatacagacatttcccagcacatccattaatagtgtttgtttttttttaattgtaataatcttccccatctcaactccaaattcaactggtataactttaattcattttttttaaagctacaatgtacttcaaggtatagacatactataattcattcagccattatgctaattttgggcattcagtttttttcttatttttctctgacaatttttacctgggcgtaagttttttgttttgttttgttttttttttttttttgagatgaggtcttgctctgtcacccagctggagtgcaatggcatgatcatcactcactgcagccttgacctccagggctcaaggaatcctcttgcctcagcctcctgtgtagctgggatcacaggcacacaccaccacacctggctaattttttagtttttttgtaaagatgaggtctccctttgttatccaggctggtctcaaactcctgggctcaagtgactgtccctccttggcctcccacattgctgggattagaggcacgagtcacagcactcctctggcataagtatttttaaactcgtaatgtttatccaatattaaaagttatttggaatacacttagaaaatttctttttttctttttttttttgagacagagtctccttccgctgcccaagctggagtgcagtggtatgatctcagctcactgcaacctccgcctcctgggttcaagcgattgtcatgcctcagcctccctagtagctgagattacaggcgcgtgccaccgcatctggctaatttttgtatttttagtagagatggggttgcactgtgttggccaggctggtctcaaactcctgacctcaggtgatctgcccaccttggcctcccaaagtgctgggattataggcatgagccaccgcgcccggccggaaaatttcttcttcacatttttcaaaaataaaacattggcatttctgttttaaatttttaaggacttttttgtacttaccatgacagatactctggacacaacttactgttccatgactcatacagtctgattttaactgtcatgcaactgctgttgagtaatatgcaactttctctttgcctctttggatggagaagaaaacaaggcagcacagttgggctccaaagataaaaacatgggcagggtttcaagatcactcatctctgtcttggaggatagaccaagagagataggacagaccaagagacaacatgaaaaaaacatgaaaagagaaacagcattgagaaataacaacagctgcactcaattcttttcctcaaggtgcattttaaccagatcttgaaatagaataaacacacctacaattctaatcctagagtggacatttttttaaaatcagcttttcatatccttttaccacaccaaaaagaacttaccaacaattttcatttaacaaaaataaaaataatcagcgagatcaaagaaatggtaaggtgcgcttcaagtttctggaagtttatcaataaaagcagcatactgtattagtgggtaggatccattatatgcaaagcataccccaaagagcaaatgtttctgggaacaagaactgaaaaatgtaagcagagcctgcctccttgtgtgggtgcaatagcagtgcccaatagcagtgactcgcagagttgtccctgggccagcagcatcacatcacctgggtaccggttagatgtgcagtttctgtagccggagcccagacctcctgagtcagaaacacccccttccctgggggtggggcccagctatctgttcccacaacccctcccgggtattcttgcactagctcaagtctgaggaccatgtaagaactggctcaaggctctgaatgaaatggagtttgcagggaactggaaagcgtccttgtttatagggctccacacagcttcaaggatggctgccctgggaaaccctgagccaataataagatatttcaataacagcctgattttaggacttttaaatgaaatttcccaattcaaaaaaatataaacactgtgttggccaaaccatcagcagacctcatagttggcaacctccgatagtgtgaggtttatttttttccctacctcaaatccctctaaaaagatggctataaaaaaaatcatcgtcatcatcatcatcatcatcatcatcatcaagttatcatagcttcaagcaatgaaacattgaaatcctgtaaccaatttcagctgtgcttgcagatttgtgggctctccaggcatcctgcccgtcacaatgtgcatcccatctgtgttttccacagagagggacagtggtgggatgttaccagtggctggccccctttgcagctttctgtcacgtagtcttaagccagtaagttggctatgtggttaattcatgagtcctcttaaaaatgccttctgagagttacatcagctccaggtgatataaaaagaaaagctggattttctgaatttgccaagcagaggctcagactctgcaacatggagatgtccctaaggccatgacactctcagcaagcagggcccacctggcctatcagcccctccattcaaagctgatgctcattggttagaacctgcctcgctgctgggccagccccaggcaaattgggaaataggtcaagtgttcagtccactttgaatcccacctctcatttctagttccctactttcattttttcttttcattatttcttcatttcttaatggatggggtaggtgcatacacatagcaaacattctgagcgatatacataataagataaggcagagaaaaaatccccaccctaactctgatggctccccaagccccatcccaaatttccttccttagaagtaaatactttacagtttcttatatccagaggtatcccaggcatgtctatttataagttgtctcctcaacctcccgacaccattttttaaaaacaaatggaaacatactgtacgtgctgttgggcacagctttttctttccttactaaaattccttggggaattttaatgcctgtggaatatttcattgtagggacatatgattatttatttttttaaacttttatctaggttcagattacatgtgcaggtttgttataaggtaaactcatgtcatgggggtttgttgtacagattattttttcacccgggtactaagcctagtacccactagttattttttctgatcgacttcctcctcccaccctcaagtaggctcagtgcctgtcattcccctctttgtgtccctgtgtcctcaaggacatatgataatttatttaaccaggtttctactaataagcgtttaggtcatttccagttttttgccacaactacagtagtccagcaaatagttccatacgtaagcctttgtacccctatgcaattttatttctaggataacattttagaagtggaagttagacttacagtgtttgtgaaattttaagtattaatagatattactgagctattttccaaagaagtggccaaattacactcccaccgacgatctatatggctgttcttttttttttttttttttttttgggggagacagagtctcactctgaactctgttgcccaggttagagtgcagtggcacaatctcggctcactgcaacctctgcctcccaggttcaaatgattctcctgccaccgcctcccaagtagctgagattacaggcgcccgccactacgcccagctattttttggtgttttgttttgttttgttttttagcagagacagtgtttcaccatgttggccaggctggtcttgaactccttacctcatgatttgcccacctcggcctcccaaagtgctaggattacaggcgttaagccaccgtacccagccacagctgctctttttttatacgctttccactggggtcatcaattgtctcctttttaaccaatttggcaagggaaagccaagtgtcataattttattgtgcttttattttactatttatgaggccaaacatcttttcttctgcttaaaagctggctgcatgtcttttcctgtgaactcttcactcctatttgttgtctgtttcctacccccaccccttggtgctgtgttgctgtttatttatctaattcttctttttacaaattgaggtacaattcacctaccataaaattcaccttttagagtgacaattccgtgattttaaggatatttgcaccatgtgtgcaatcgttccacgtctaattccagaacatcgtcattactccaaaacaaaactccctaccctttagcgctgagttttttccctattcccagccactggcaaccactaatctgttttctgcctctatggatttgcctattctagacactttatataaatggaatcatacaatattttgctttttgtgtctggcgtctttcacttagtaccatgcttccaagtataaagcatgatataacatggatcggtgctttgtttcttcttatggctgattaatactctattatatgcaaatgctagatttcctttttccaattgatggatatttgggttgtttccacttttcagctattatgaaaatgctgctatggacatttgtgtacaagtttttgtgtggccatatgttttcattttcttgcttacctaggaatggaattgctgggtcttagggtaactccatgtttaacttttccaggaactgttaaactgctttccaaagcagctgcaccatgtcacattcctaccagcaatgcatgagcattccgattttttcacatcttccctaccactggttattgtctctctgattatggccatcctcgtgggtgtgaagacgtatcatgctgtggctttgactgcacttccctaatgagatgacattaggcatctttttatgagttccttggccattagtatatctgctccaaagaaaacactatcatcctgatttggctgctttgctgcaccctgagcctcttgtctctgtttcctggctaatttttccagagtctcaaagtaataatagtcaccctttggcaatcttctatgtgtcctgaactcaacctgccccacaaccgtatctccacagctgacccgtggtgtcctaacaactgaagccactgatagaataataggccacctcccctggtaagctgcttaccacttaaaaggtgcttgagacactcattgctgctggaaatgtgaatctgtagagcctttttaagaaaataatatggcagtgtctgtttttcaaaactaaatgcatattgatttgagggtaacacttctacatctgtgcctctattctatagaaatatagcaccagtttaggatttttgaacacgaaagtttattccactatagtggaaatggaaaaaacaatgtggaaactaccaggatattcattgattaggcaatggtttaaatatcttttggtatatccatactgaggaatattatgcagctattttagaagataagatagctttggagctattgactgtgaagaccaactataatgtacaaaagtcatcagaaaatatgtctaatgtgatccaatttctataaaaacaacaaggacagatacagtccctgtatatgtgtatctgggatgcttatacgtgtttgtgtgagtataaacaaagttcaatatgccacatcaggttgcagatgttatttatctggcaatgagggtggaggatagagacaggaaaaacaaagggttcagagagattaattattttggttgtaaacacgggttaaatgtacattattatcagatttataaaaaaaatcaaatgaaacatctgatttgtctttaaatgaaaatatatgctcatgttggagcaaaggctggttttgcatttgaatgagctttgcatattccagagttttgtagcacatgaatgacaggaaatatatgattaaagagaagagtggaaatcttgagtgtcactgtcagtcttgccccacagtatctgatcatcactgttgcttttagaggatgttttctgaagagcatgggggtagtagtacctttgcctacattcctttggaatccagcatttccatcactaaatgtccagacatgttgtataaagctgatagtcaagaattctaccatgatgttccaaaatcccatccttttcttttatttatgctagaatttcttggcaaagacattctggctttttaatgtacagatgaaaagcatgaaatgcgatcattcagtgaaagtttcaaatctaatctaacgtcttcctccaagtcataagtatctgccacgtgtaccctgactttacgacctttaaaacaacaaatgcatttgcacaacatagaaagccgcagttgtttgaagtgtcatttgactcttgcagcatgaccattgaagggtcatttttgcataattttttgaggtcttcataaagttttgagttttcccaaaggcctaacataatcttttgatattctaatataactcttttgaagaacttactgtgttgtgttgtccacttttccttcttcggtgatctgtgttaactttgccagatccttgtccaaccacggtcatgtgtgtgatctgagcagctcaccaatgttacaagactctataaacccctgcatcttttgcaagatgtacaatttccctttgcaattagtgtgtatatgtccactttatcctgaatcctgacagatcaggatattgatgcataggacggtgttgcttgcataggaagagatgattcggcggtgaataatgttcatacatggacactttgtaaataaaattataatgatagttcctgctttcccctttaaactgaaagcttggaggatttggataatgtattgtcagaaaaagaaatttcatccagcacaacattagtctcttctcagagactcagtttcccaacctgttcattggtgtgccctactacagttacaatcatggtcctttgtggagtgtttgctaggctgtgccccaagctctgtgcttgctgcttcacccatgtttcctggcttaatcctagtgtctagcactatgggaactggaatccagctgtaagcagagcagaccaagtccgggtccacttggggcttacaggtcgtggagaggaaacaagtgaagaagaaattaatgggatcatttcagagagtgatgaatcctctgtggagtctagagaataaacaggagtaagcaggaggggttacttcagatggaggagtcagggaaggcctgacataacctaagtcttgaatgataagaaggtaaccataggaagatcttagcgaaaatatttccagattgaaagaataactagtggtgagggctgcaggtggaaacatgttggtatgttgagaggtgtgaggaaaaacatagtacgagctgaagttctggagggtgtggcccatagtagagagtttggattttgttttaattttgtgaggcccttctttggatggttttatgcaaatgaatgacataacctaatttttatttaaaaccaaaaatatatagatatcaatgtttcccagatgtgagaaaacagggtttttttccccctcttgtacatagttttttcttgggtatccactaattctattaactaaactttgtctactttgttcatcttccctcccttctatttcttctttctcttctgttcctgctttggttaccacatgttgttgggagtttgaactttggaatcaggcaaatgtgggttcaaatactaaatctaccagtcattagctggacaacattagaaaactgacttgacttttcagagcctcagtttcacgacctgtaaaatgggagtgatgatagtacctaacttgtagatttgctgttatacttaaataaaatgtttcttgttatagacatttatccaaataaataaataataaataaacaaatgtcatacataaataaaatgcctcttgttacacacatttatcctaatgctgggaaacagtcaatgaatgttagctattgtttttacagcttgatgtcgttaggctttttgtccccacccaaatctcatctggaatttaatccccataatccccacgtgtcaagggagagaccaggtggaggtgattggatcatggggacagtttcctccatgctgttctcataaaagtaagtgagttctcacaagacctgatggtttcataaggagctcttccctgttcatttggcacttctttctgctgccttgtgaagaaaggtccttgctccccctttgacttccaccatgattgtaagtttcctgaggccttccctgccatgctgaactgtgagtcaattaaacctctttcctttataaatcacccagtcttgggcagctctttatagcagtatggaaatagactaatacacagctgtagcaagtgaaagttttagctttggcacatgaaaaaaaaaagataattcttcctcagaagttttgaatattgtaatacaaacgtgtgtgtgtgcatgtatgtttaaatatataattagaactctgatgaagcagcttgttttgacgagaatatttggtactttgaaaatgataaacatttctgaaacttgcctggcccagatacttatgtttcttaagataaattgatttatatcactactgtttttaaaagtctttctagaaaactcaagtttgtaaattaaactattggaataattcctttccttatggcttacatttaaaaatacaaaatggtaattatattaataacatattagtataacaaaaataactactgtttaccgaataccaatcatctaccagcctgtggtaagcactgtatgggcaatatttcatttaatcctcagaattaccctctgaaggaggcactgttattttcatgccaatttgtaagaaaactgaggcacagagacaggaaataacttacccgggttatccatttaaagagtgagcagttaagagtcaaagccaggttcctgtgatccacaatccaagttcttaacaattacacgaagatggcactggaaataaggttttaatcacatatacagataaaatgactttctttaaaaaaacatgcagcacaaaatatttttctgcactaagaaaatcaaaattttcaactctaccttctaaatattttggagctgctactgtcattcttgatttctttttaattttccttaaattctttgacttttttaaaaatgaaaagtaacatctctttggtatgtcatctttttgcatttttttaacttttattttaagttcaggggtacacgggcaggtttgttatataggtaaatttgtgtcatgggggtttgttgtcacccaggtatcaagcctgggtgatgaaataggtattattaatacctgggtgatgaaataatatctattaattatttttcctgatcctctccctcctcccaccttccaccctccaataggccccagtgtgtgttgttccccctgtgtggccatgtgttctcatcatttagctcccatttataagtgagaacatgtagtatttgattttctttttcggcaatactttgctaaggataatggccttcagctccattcatgttcctgcaaaggacatgatctcgttctttttatggctgcatagtattccatggtgtatatgtaccacattttctttatccaggctatcattggtgggtatttaggttgattccatgtttttgctattgtgaatagtgctgcaatgaacatacacatgcatgtatctttataaaagaatgatttctatttttcgggtatgtacccagtaatggaattgctgggtggaatggtatttctatctttaggtctttgaggaattgccacactgtcttccacaatggttgaactaatttacactcccaccaacagtgtataagcattcctttctctccactacctcaccagcatcttattttttgactttttaataatatcattctgactggtattagatggtatctcattgtggtttttgatttgcatttctctgatgattagtaatattgagctttttttcatatgcttgttgactacctgtatgtcttcttttttttttttttttttttgagacggagtctcactctgtcgcccaggctggagtgcagtgatgtggtctcggctcagtgcaagctctgtctcccgggttcacaccattctcctgcctcagcctctccaagtagctgggactacaggcgcctgccaccacacccggctaattttttgtatttttagtagagacggggtttcaccgtgttctcgatctcctgacctcatgatccgccctcctcggccttccaaagtgctgggattacaagcgtgagccaccaagcccggccgatttttgtatatgttgtaaggaaggggtccagctttaatcttctgtgtacagctagccggttatcccagcactttttattgaataggaaatcttttccccattgcatgtttttgtcaggtttgtcaaagattagatagttgtaggtgtgtggtcttatttccgggttctctattctgttccattggtctatgtgtctgtttttgtaccagtagtatgctgttttggttactgtagccttgtagtatagtttgaagtcaggtagcatgatgccttcagctttatgctttttgcttaggattgccttagcaattcaggctcttttctgggttctatatgaattttaaaatagttttctctggttctgtgaagaatctcaacagtagtttaataggtatagcattgaatctataaattgctctgggcaatatggccattttaatgatattgattcttcctatcaatgaacatggaatgtttttccatttgtttgtgtcatctctaatttctttgagcactggttcattattctccttgtagagatctttcacctccctaattagctgttttcctaggtattttactctttttgtggcgattgtgagtgggagtgcattcctggtttggctcctggcttgactgttgttggtgcatggaaatgccagtaatttttgcacatttattttgtatcctgagactttgctgaagttgtttatcagcttaagaagctttggggctgagactatggggttttctagatataatgtcatgtaatctgcaaacaaggatagtttgacttcctctcttcctatttggatgcgctttatttatttctcttgcccgattgccctggccaagacttccaatactatgttgaataggagtggtgagagagatcatccttgtcttatgccagtcttcaaagaaaatgcttccagcttttgcccattcagtatgatcttagctgtgggtttgtcatacatggctcttattattttgaggtatgttccttcaatacctagtttattgagagtttttaacataaatggatgtctaattttattgaaagccttttctgcatctgttgagataatcatgtagtttttgtctttagttctgtttatgtgatgagtcacatttattgatttgtatatgttgaaccaacttgcattctacttgatcatggtggataagctttttggtgtgctgctggattcagtttgccagtattttattgaggatttttgcattgaagttcatcaaggatattggcctgaagcttttcttgttgtatatctgccaggttttgatatcaggatgatgctggcctcatcaaatgagttaggaaggactccctcctactcaactttttggaataatttcagtaggaactgtaccagctcttctttgtacaactggtagaacttacctgtgaatccatctagtactgggtttttttatggttggtagtctatgtattacttcctcaattttagggctcattattggtctgttcagggattcaatttcttcctggtacagtcttagaagggtgtatatgtccagaagtttatccacttcttctagattttctagtttatgtgcatagagatgttcataatattctctgatggttgtttgtacttctgtggggtcagtggtaatatcccccttgtcgtttctgattgtgtttatttgaatcttttctattttcttgtttattactctagctaatggtctattttattaatttgttcaaaaaaaaaacagctcctgaattcactgatcttttgaatggtttttcatgtctcaatctccttcagttcagctctaattttggttatttcttgtcttctgctagctttcaggtttttctgctctcagttctctagttcctgtagttgtgaggttagattgttaacgtgagctctttctaactttttgatgtgggatttagtgctataaatttccctcttaacactgccttagctgtgtcccaaagattctggtatgttgtatctttgttctcattagttcaaaaaacttcttgatttctgccttaattttattatttacccaaaagtcattcaggagcaggtcattcaattaccatgtaattgtatggtttcaagtaggacagtcctgtagatatctatcagggccatttgatttagtgctgagttagatcttgaatatctttgttaatttcctgtctcaatgatctgtctaatattgtcatggggtattaaagtctcccactactattgtgtgggagtctaagtctgtttgaaggtctccataaacttgctttatgaatctgggtgttcctgtgtttggtgcatatatacttaggatagttagatcttcttgtttaatttaacactttatccttatgcaatgcccatatttttttcttttaacctttgttggtttaaagtctgttttgacggcaactaggattgcaacccctgttttattctgttttctatttgcttggtagatttttccccatccctttatcttgaacctatgtgtgtcactgcataggagatgggtctcttgaagacagtataccaatggttcttggttctttatccagcctgccactttatgtcttttaatgggatcatttagtccatttacatttaaggttagtgttgctatgtgtcgatttgataccgtcatcatgatgttggctggttattttgcagacttgttatgtagttgctttacaatgtcactggtctgtgtacttcagtgtgttttgtagtgtctggtaatggtctttccatatttagtgcttcctttaggaactgttgcaaggaaggtctaatggtcacaaattcccttagcatttgcttgtctgaaaatgatcttatttctcttttgcttatgaagcttagtttagtcagatataaaattctgggttggaattctttttgtttaagaatgttgaatattggtcctcaatctcttctggcttgtagggttaccagtgagaggtccactgtaagtctgtgcttccctttttaggtgaccgggcctttcactctagttgcctttagcattttttcttacatttcaactttggagaatctgatgatgatgtcttggggaagatctttttgtggagtatcttactggggttctctgcatttcctgaatttgaatgttggcccctctagctaggttggggaagttttcagggatgaactcctgaaatatgtttttcaggttgattccattccctccatctctttcagacaccccaatcaatcatagatttggtaggcttgattgctatgtatttacaagtgaaacagggactgaccaattccctggaattctctcaaagtcactgagtatgtattcaatttcaactggcgtaagttggggaagagtgatttattggcttatgtaatgctaaagttcagcttcaggcacagctggatctaaatgtttaaatgacatgattgggtatctgcttcctggatttccaggttctactttcatttgtgctgattctcaagtgtacctcctattggtttgcaactcttttttaataggagtatcaaaagttacaggacttatttttattagtctatcttatgtcaggtgcccacctaggaggtgagcatctgagcaaaggaaatagaagccccaggtgatggacttgggtatgtacccacctaaatttggagagcagagcttcagttgcatggaacgtatcaccgaagaactctaagttcttagaaattgtcaaaaacactttacccattctctgatatcaaaagctactgtttggatttgctataatcactaaatgcactgaagtctagtccagatacctggatgtaaggaatttattctttttcaaagcaacatattggcactttaaaataaaaaaggttgtccatggaaagtactttgtgttttttgaagactttttctctggctataacactcttacttaccactagctcctttgctttccagccagtgggtaaggaagagaggaattaaactgaaagatataagttggtgctcttggcattttgaaaagcccttccctgttttgaatcttagcatttccctttttgtcaaccataccctcttctcctggcatggaccattcccacaattcatttatattcactctgacacttcaacagccttacttgctaactttacaccctgatgcatccatctatcacttacttattctccctctttttttcttctttagtataatattttctatcattatgaattcctgaatcacagaaaaaaaggttaagaagagctagaagatcaatatgctggcagggtgattttcttcaggttcaggtttatgagaaacccctaacattcatccctgggcttgccccagaccatttcttcactgtgcctcaatgcttaatccagctcactctccccccttttttgtttgttgtttagtctagacactgcgagacactagagttgggcaaaaacaattgctaatggatgcatgtgtgtgtatgtgtgtgtgtatgtatttctcactacatattaatgagcagtatgaatagatcaaagaaatctcaattcttccctttatttttctgtcttcctgcaaacagatattaagaagtgtctgactacagatagagcaagcaaaatgcaatgttgtcaaaggcatgagagaaacctgaaaagttatcacagtatctgtcaattactaagcacttattatggaaaaggcattgtgccagatcctttgcatgacttttcttctttaagcattacaacaaccctgcagtaggactaccaatattcccattttacaaatgaagagattcaaagatctttagtgatttactccatatcacacagcttatcagtagagaatcttgatctttaactgggatcccaacattcttggtgttctttttttcctgaatatttcactgatttatagtagggtcctagaaaagaaggaccttttatagttaatttaggtcaaggtagaggtcaaaggagaaagggtggatgttggaaacagtgcccttgcctggaggggttggagcctgtatccacacacacagtcttgaccagataaccctacacctttaattccacactggcctgaggtctaatttgccttcttgtgtggatatctgctcttccagcctttcaaagagaaattttctgagtactgtattttaaaaatcttcccatattcttaacagtctatgctaatacaagtccctggtaagacagagagcgcatgaacttagaagtcagatttctgcctgaagccagactctgctgcttactagcttactgggcagccaggggagggtgtactgacctctctgactgtcagttttctcactcatgaataatgataactaatgtttgtgatatttattaagcacttaatatattccaggtgctattgtacttgctttaaaactattaactcatgtaatcttcctaacaaaattacgagatttattatctgtctccttttaccagaaagttgaggcacagaaaattagataatctggattcaaaaagacatttcagctcagtgcctctcaaacgtaagagattttgtcctccaggggacatttagcaatgcctagagatatttttggttgccatgactgggaaatgtgaccggcgtctagtgggcagaggccaggatgctgctaatcagcctatgaggcacgggatgagcctccctaacaaagaataatctggcttcaaatgtgagtagtgctgaggttgagaaaccttgttctagctccagaacccaagctcctaactgctgtactgcctcccagttgacatcatgacaatatgctgctcacggagttcttacacagataaaagaagattaattaacattgaatatcactcattccacacctggcagctagtgactttccattaagtagctttccctcctcaccaaccttgccttctcctctcccaagaaaagcagggtccaaggagatgtagagagctaacttctgcctttcagaatgaccagagaacaacacagttccagtatgcagtatggcttttgtataaaaaatgtctggagtccattattagtgcctgaatttcccggcttggctgaataaccactgtttatgtttgtgtttacagtcgacttgggaataagtgtcaagacggataatgtggccacttcttcccccgagacaacggagataagtgctgttgcggatgccaacggaaagaatcttgggaaagaggccaaacccgaggcaccagctgctaaatctcgttttttcttgatgctctctcggcctgtaccaggacgtaccggagaccaagccgcagattcatcccttggatcagtgaagcttgatgtcagctccaataaagctccagcgaacaaagacccaagtgagagctggacacttccggtggcagctggaccggggcaggacacagataaaaccccagggcacgccccggcccaagacaaggtcctctctgccgccagggatcccacgcttctcccacctgagacagggggagcaggaggagaagctccctccaagcccaaggactccagcttttttgacaaattcttcaagctggacaagggacaggaaaaggtgccaggtgacagccaacaggaagccaagagggcagagcatcaagacaaggtggatgaggttcctggcttatcagggcagtccgatgatgtccctgcagggaaggtaagtgtgccaaggtgtatccacttggttctgaatgcatgctcgggggcgctaatgggataagaccactgcacatatgcagtcaccctgggcctaggcaaggtggcaagctgttgacccctctagaacaaatagcacattgcagcagagtgtcatcctgatgtttctctgggtagaaacttctgtgtgaagaacaataacagctgtggcatctgttttatgtaaaagaaaagaggaggtgagttacatgcagatgaatttgtccatccatttttcaaaggcggaagtagacaggttgcgtttacgatcagtggattctggaggaaaaggcattagtggaataaaaatgattcctaaaagatgttacctagtctctgtagtttgttgacatgcagagttttgttggaacacatttcgtcccttactgttaatagcctgaattgatatttaaccatcttttgctctaaggtgtgtgtttgaataaggagattttacagctctgggcagactcttttatgtagtaattcttttccaacaagtaggagtaataaacctttgtaaaaactaggggttttgggttttttttttgttttttggggggtttttttgtgttggttttcaaagaaggtatcctggaatcagttgctttttttcctgagcgaagaaaggcaagctctttttgacactaaaaagagcatttgcttttaaccttgagagagcctgtttgtattcaaggcaggaaaagaactccttaaaagaagaaggaagtaaaacttgatacattataggtttagggcatgcatttccttggttaacagactttttaaataacaatatttttcaaaacttgggaataaagttaagtgccactagcagacttcagagccaggaaaaaattggatgagctccaaatatatttgtcttaatacaatgcaactttgcacttccgaagtgctaataattacacttgctgtcatttattgaaaatgttcaatgtgccaggctctactctgagcactgtacgtaaattattttccttaatgaaaataagtatcacgttaatctatggttttaatgcatccagggtgctacgaagaattacattatgaaggctgggcaccgctgaacactctggagagttaaaattgggaaaagataatagtcatcatgtgttttaggctcttactgtcagcattcttgtgttttctatacattttgattcaaagagcttatttccaacatttctttcagagtttaaacattttcccttcaaacacccactttccaaaattcaccagttcaagaagccggttgaataactttccgtataatttaaaataagtctccaaatgcaccaggcatctgctctttactgagtgtgacactgtactaggaacaggtgaggcacagggaccacagtgaagggcgagacacagagtctcggccctggtggagtttgctgtccagtgagagaagtgaataaataaacctgcaattgcaatgcaagatgccaagtgctgtgctgggggagcagagtgtgggggagatgccagatgccaggagaactgggctccatggcccagggaacattccagcaaatgcatgaaccaggacctgaaagttacgtgcccagaggcggtaaactagtcgtcaatattcctgcatatgggagaaactgtttactacttgcgcctgagtggagaaaccattctcattattggtcataggcttctaaggccattttgaggttgtgattttttaacagtcatgtgtttcttttgcttgggcatccaaagcctatccattggctcagttaggagaagattgagttatttatgggaagacaatgaaggaatgtgttttactcatctttggacaggtgtccggtgactcatccaaatccccatcttaatcaagtaaaccagttcagcatagaatagccagccctccaatgtactcagccataaaacctcgacacactcaatctatttctagtctaagaaaagtgaggaaaagttttggagttgtgatttattaactcagctttctttattgaaaaagaactcttaggggtagaacctcaatttgagtggaatgtgttccaaaatgagatttgagtcagaaaatgggagcttgtgttaggaacatggcaggtatctaatatagcaaagcccttgtgtaatattttcaagttataatgatctctcagaagacccaagaattgtaactgtcttcctttctgaataagtgaattcactccctcagattcaccagtgaagtctgcatctgattttgttacatgacaaatttccatttttttcagtgatattgaaatttgaaatactgagtgcccactttgtactatgtacatgagaaacacagaaaagttatgaaatagccatttctccctcagcctgtgaacttatggatattcagatgcatatgcctgcaaaggtttttaacaacaacaacaaaacagccttctgattgtcaaggtttcttttctgactcccggctgcatagttctgtatttagggggaaaaaagcaattgttctataaatgtaatgggacaatccaaccctcagaaagtaacatgaataaaacttctcaatcagtggctttcttggtgggagtaccacattgtacatggctggatgtcagtgtattgattcagaattcttagggtgaattatgccttgggctcagccgcatctactgcctccctccagcagcccttccccccatttttatggcttgctccctgctggattggaattccagccacaagcccacagagctgtgaattgggagaaagatgccaccatttcatcctgggggaaacatacaaatcttctgtgttttcagaacgacaatcttatttttgtgccttataaaactacattcagggcaaagcataattaaaacaaggcaagaattcatgaacaaatgaagcgtttactacataggccaaagaaaagataaattatatgcctgaaaggtttcactgagctgtgattcatacaaaccaatgtgttggcagggatgaggtttttttcctctccccacaacaactgaaccagagctgtaagatatgcatttaaaagattcaacacacacacacacaaaatcacataatgcaaacttgacctttattggttaaaaataaaacccaccacatttctgttatcaacacagtacttccagagttgtgtttgtgttgagtgggggtgtggggcgcataaagtgttgccatgcagagtttcataagatgaagaatgtcttttttcttttaaaagtgtaattaaatcctgcaatcgttactttcgcactaaccttgtgcaaggcatttgaaaaataaatcatgtttctcgtctgtcaaggagtgtataatctagtaagagacatagtattttaagagacattgtgataagtgcatcggtcctcagattggctcaggctactaataataagaacaatattctgtgttttcacttctcttcttttctctcttgaacacactccattcaggctcttgtcacagccaccatgatgtttcaaattccctaccatcaccctggctgccaaatcctataggtctctatctttgtcctagtaggtctgacctgcaagttgaatccgacacagtgactgagtgggccacaccttgctgtttgaaacaacatccttccacctccctggtactcttccatcatctcctttgctggatctcaccctctaaatgttggacttccccagggttcacttcttggctatctctaactacgcttatttccttgaaggtttccctcagtcccaaaggtttaaatactgctatgggttgacaagttccaaatttacatctctagccgggatccatccctgaagtccagacgtgagtctcagctgcctcctcttccacatgtctacttgaatttctacatccccatttggctgctcactgagtatctcaaccctaatgtgtccagaatggaactcttcattcatcgcctaacaatgacaaaaacaaaatgcccaccagtttaattcacggggttttccatctcagtgaatgacaagttcatcctgtctctactgtttagtggtagaattggaattaaagaactaaggtctccagagtcctttcctacatggtatttagtagtgaattaaacataagcatcatagtcaagtagcctaggtttcctctctacctctgtcacctactggctgtgtgatcttgggcaagctacttcacctcctgagcctcagtttcctcatctgtaaaatggggataataatagtatctagcacattctcacattgttcacacttttagaagttaaatgagataggccatataaagtacttagcacaaattgcattttgaaagaagaaaaagagaaattagctattaccagtattatgggttttctccctgtcttctacttcacattttacttttattttttgcctttcccttccatagtcctcaacccaaactcacagagatagcacagttgactctaatttaagagttgtataaccaaaggcacaagtcctaacttgggtgagaaaggtataaaagttgtaaaattatttttgaaacaatagaaatgttagtgtccatgcccataagcctcagtttctttgtctgacatttaagggtttccacaatgtttcctctgcctattttccaactgcattttccacccttcccttaaatttctccagtcaatatggccaacacctgacctgtgcaaacgccatctgtctcctggtattttctctgcctatgtccctttctctctctgtttatcaaaaattgacttgatattcagtgccaggttctccatgaagctaaccagatatctccactcttggatgatttcggacagcatgaatccctctcgcattttaagtcaaattctgtgattaaatcattttgtagaaatcagctcattgagccatcaaatcttaccagggaattcctgtattttcaccattttacagatgaagaagtcaacagttcagagaaagcatatcactcctgacacacagctaaaaggtggcacagccaaaattgtccatctccaaagcccatagtcttaaatagtcaacgtttctatttttgccaattatttgaaacttgttcaatgaagttacaacttgaggcaatgaaattcaaagatgttagcatatgcaaagttgtaaatacccaaaatcccaagtgaaaaataaaaacaaataaaaagaattacccaatttcaacattagaaggccaagtgaattattaactgttttttattttgtgttgtttctgccttatgtccacaaggccatgccttttcaactggtaaagagaactagccacccaaaagactttgtcagtgcaaagggaaaatccatcttacattatgcaagttttggagtaaacaaggtcctcagctataccactgggattttgatgcatttagcagtaagaaacgcttaatatgagatgtttgcagtggcagaggtgatgtggaagtgttaggagcctgggtgacctaggtatgagtccagactctaccactaaatagctgtgtggttgagttaaatgacaataatagccccattttaaaataattcattatttctaggctgtgcagtaagcattttgcatacattatctgtttttattgttaaaaaaacccaacaaggtaggtatttctattgccattgaacagaggagagaacttggggagaacttaagttacctgcgttaaggtcgcaaagctaattagtggcagaagtggaatcgagatccatctgtcacctaagcctgttatactcaatcatttaaaaacctgtgttttcatccacaaaaggaagctactacctgccctaggggtttttgtaaagttagaagataatataggccatcagtagtagtcatgctaaataaaactgtatattttctaaattgttagaaacttagaaatgagtaattatgaaatagatcaaatggcttttcagagtgatggagtttgaatagtgtatcatttaggggttggtaatatatcatttttactttggctgcaggaaacacacacacacacacacacaacaatcaattaatagtggttcacttaacaaggaggatgtactatttcttgcatgtaaaaagaaccctagaggtaggggagttcaggttggttcaacatcttcacagcccccacaagcccgcctcagtctttctctactggtgtcctccattgttgcttagtccctaggcttagtcccttgtggttttaacatgattccaagtatgcaggagtacctctctttattgtgcttcacagatgctgcatttttacacattaaaggtttgtgacaatcctgcatcaagcaagtctgtcagcaccatttttccaatggcctgtgttcactttgtgtctttgtgtcagcattttttagagataaagtttttgttgtaatttttattttaagttctggggtacaaatgcaggatgtgcaggagcccgggtgacgtgcacgtgtaccccagaacttaaaataaatgtgtgccatggtggtttgctgcacctatcatcccatcacctaggtattaagcccagcatgcattagctatttttcctgatgctctccctcccccaacccccgacaggccccagtgtgtgttgttccccttcctgtgtccatctgttctcattgttcatctcccacttataagtgagaacatgcggtgtttggttctctgttcctgcgttagtttgccaaagataatggcttccagctccatccatatccctgcaaaggacatgatcttgttcctttttatggacacatagtattccattgcagcactattcacaatagcaaagacatggaatcaacccaaatgcccatcaacaatagactgggtaaagaaaatgtggtacatatacaccatgagacaaggtatttttaaattaaagtatgtactttttttttagacgtaatgctattgcacacttaatagactccaggacagtggagaacttttatgtgcactgggaaaccgaaaaatgtgtgtgactctattgtgatattgactctattgcagtgacctggaattggacgtgtaatatttccgatgtatgtgtcataatgtcctataaataagaaaggagtttcctaaaatttatcctcagagccctttggtgaaattgagtcacgtgtctgtgtcaaggtgcaaatagctatcagccagcattttcagtttcttcagtagaaagaaggctcttccagcaaagaggacatgccacagatagaaaccagatttatcttctctacctaacattgtctggaaatcattaagtgaatggagcaagtagaagctgctacagtatccacctatggtaattcatctgagtgtatccattacattagttttctaatttaactgtgaccccatagtaagaactagattttacttgagctgatatacatgcgcatacatgaaacaaagaattcatgaagtaatactattcttgcagcatgtaacacctgcagggattttgtattcttttctattctgtttgatttgtttactgctggttttgacccactaccttatttttaaatctgctaatgatcacagtctgaaatttggagaacgctgttctgttatctgaccacttcgacacattgagacagttatcttaagagacgtgaccattttttatgcaactgagtattcccaatgcctagcacaatggctggcacatgttggcatccaataatgtttgttaaatgaacctgacaagaataagggtggtacacgtcatggttcaacttttcagactgttaggatgtattattgcaacgtcattatctgctctgcctaacacaagttgaaatagaaagtcattgcaaaatatgtggtgtatacgatttcacttaaactttagaatcatagtacaagtctacatttgtactatctacttggtattttaaatttggtctttaacatgtcatggcgttaatccattgaaatatctagtaaattgttttttgcaattaatttgtaaaataaattttgagttatcattccctctggtattgtcccatctgactcgccccctcagaagttgtaacggctataacttatcaagtttactaagtcacggagaggtaaagtaacttgtgcaaatcatagtgctagaaagtggcagggtggaaattggtcaccgatgcccacacacttaaccactgtgcctataggttcaaagagatgaaacactttaaaacttttgaaacatcttatatctttaaaaaattctaaagttagttgtattagtcagggttctccaaagggacagaactaataggatagacgtatatgtgaaagggagtttattaaggagaattgcctcacattatcacaaggtgaaatcacactataggccgtctgcaagctgaggaggtaggaagccagtagtggcagaagttcaaaagcctcaaaagtgtggaggccgacagtgcagccgtcagtctgtggccaaaggcctgagagcccctggcaaaccactggtgtaagtccaggagtccaaaggccaaagtacctggagtctaacgtccaagagcaggaagcatccagcacaggacaaagatgaaggctggaagactcagcaacccagcttatcccaccttcttccacctgctttgttctagccatgctgccagccgattggaaggtgcccacccacattgagggtgggtcttcttctcccagtccgctgactcaaatgttaatctcctctggcaacaccctcatagacacacccagaaacaatactttaccagccatctaggcatccttcaatccaatcaagttgacacctaatgttaaccagcgtgatagtactttccaagttggtctgtggaacgttagtccaataagatgggcctagaaatagggctctgctatggaatagtttcagaaaatctatttgctttatagtctctactgaagattcacaatggacatccacctactaaaggctctgagaagtcctgcagcaagcacgcctgtttcactttgtttaaccaagtgtttctcaaacttaatcatccatgtagctgttgggcctctaacaaggtagctcaattttccaaggaatggttcttctagagaacgttgagctaggcatttagaccagaagttgtatgatgttggctgtgggtttgaagaagtaaaataaaataaaaaacataaaccagaagttgaaaactagccatctgtagaaggcctctagccagagatgcatcttacttggcctacatagtgttttaaataatattttaattaattaattatatttttgaattaacaaagttgatgatattttaaagcaataatatgtcaatacaattctatatttcagacttccccataatgggtagttttgccctatatttccagacagaatgtgagttgtgactgtcccttaagatggggcacccactctccagttcaccaaatgattcccagcagcgcagccatgtaggttgtccttcgtcataacacttgcattggtatttttcttgggtacagttgagaatcaagtaaatacacccatcatggaccactttacttccttcatccttcatagcacttatcagaatttgaagctacttagatgaccatctgtcattccagcctgagagtcaatcaggcagccagtgttaagcaatatataaaaggggtgggaggctgggcgcggtggctcacgcctgtaatcccagcactttgggaggccgaggcaagtggatcacgaggtcaggagatcgagaccatcctggctaacacaatgaaaccccgtctctactaaaaatacaaaaaattagccaggcgtggtggcgggcgcctgtagtcccagccactcgggaggctgaggcaggagaatgacagagcgagactctgtctcgaaaaaaaaaaaaaaaaagtaagtggatactttcatttattcatgcaacaaatatgagtatttcctttgtgccaggaatgattttagattccccagcaggtagaacagtgtacttcatgggagctttccttctagtggagagaccaacaatttaaaaaagaaagagaattaacaagcaaacacttccagagtttagaaagagctctgagtgaaataaacagagttttgagatagaaagtagacaggagagtgaaaatcacaactgggtgaggaacagaaacagagaagtgtttaaacagtcagtgaatagcatgtgactttttctttctttctttgcacgggccaaacaattcttagaaagtctgcaacctaattctggcagcattcaaaactgttttctcgctttggggaagtgtttgttaaatagatgacgaatgtgttctaggctgtggattattagttttttgtatttaaaggcaggttttctggtgtggtttttgtttgttttttgtttttgtttgtttgttttccgtaacattgggtatttttcctttagtaaatgtgaaatgctgtcaccagtctggaaggttgtgcttgttaggaactaatcatggaacagaagaatcttccacaaatcccttttgcccagtgtggcttaccctgggaatcactcttcactcactctgcctgcagcagtatttttccattttaaatcacacatattggccgggcgtggtggctcacacctataatttcagcagtttgggaggctgaggcaggaggatcacttgagaccaggagttcaagaccagcctggccaacatggtgaaactccatctccactaaaaatacaaaaattagccaagcatggtggtgcacgcctataatctcagctactcaggaagctgaggcatgagaatcgcttgaacctgggagatggagattgcagtgagccgagatcgcaccactgcactccagcctgggcaacagagcgagactccacctcaaaaaaaaaaaaaagaaaagaaaaaaaatcacacataagggaactatacttaagagtgtgccaactcatgtgtccttaggactatccccaaagcaaagcctgctgccaaaagggaaacaagagaagaacattttattgcttaattctctacccacattttacttgccattggaactcaagttgacaaattcacttacccctcaagcagaggagttgctgagggagaaaagagaaaatgtacactagctttatatgggaagcaagtgtgcgttgctttcttagatagatttctttcccccctccccctatgtgaacaacagacaatgctttatttaatcttacaaatgtaacatctccacatcagttaataactatggattaatgatgatgtaccatgctaaggccctgggctagacttctgctacccccgtgtgagatgagccttaagtatcctgaggttatgtccacagggtagtaaaacaggtagtgatgttgtgatttacagtagagagtatcacactggataattggtccaacccggcttggttcaattagtataagcagctgaaattaacattgcctctctcttccccaaaagaggaagaaaaatggctaagtggaacatttttatatctgtgttatccagactcaatttccatctcagaaaagatgccagaggacaatggaaatctagatttcttggttttatattttcatgttattttatttccctctgaagtcttagataatttcttaatcaactacctggaccactaagaagcttgtttccaccgtggcgctttggcagtatgcaattttaaagtcttcaaacacacatgctttctgaatgagcaaatctgcatttaagaatttattgattgataggtcaggagggtgactatagtttactgtacatttcaaactagctagaatagaataagtcgaatgtttttagcatgaagagaagacaaatatttgaagtgatgaatatcccaagtacacgaatttgatctttacaaattacatgaatgtattaaattatcacacgtaccccaaaattatgtacatctattatgcatcaataaaaaatgtttaaaaataatgtattgagaacatgatcaatattttatgcatggggctttaaaaaatttccagtattgtctgtaagaaaaaaagctgaaatgatccaataggtctttcatattgattgtggcacacccttacactagacaccgtaaacgagggtgacataaaaatagaattggtcaggtgaagaaagtgatagtataatgttaaatgagaaaagcagatttcaaaatagcatgcagaagaatctcctctgggtaaaaatgatctctgccttcctgtgccatagctctgtcatcccacccaaagagcagcgtggaataaaaaattgcaaattgttgacagcagttgactttcagtaatagaataatcgatgcatttcgttttattctttgttatctgtattttctcttttttataaaaggagcactgtagtgaaccaccaatctaactaaaagtaaaaaaatgccaccatctaggtaatttctcgattcctcctctagactgcattaagaggctgaggattcctgagctgtgttaattagaaattgccacaggctgctagcaacagttcaacaagaggttattttcctctaacaataatttccaaactatgccacccagagcttatgtgacaattcattgttcagaaagaataacaactttttaaatatacttatagctaatgtgtaatcatctccagcaggagatcacaaagagaaatgttgtcctaagtgggcagatttgaagccctttcataattggatttcctatggttgtgctgtctgtgttctttccctgtttttgccatgggcttgaaagatgtgaatgcattataaaaaaaaaactactcattgaatttttatcagttgatgtgaattgggtaggagtagtggaaaaaataaaagtacagaattacctacattaatatatatttattgaccttccttcagtggctttgagcactgtagtaaaacaaacttaaaaaaaaaaagagtttgggcatggtggctcatgcctgtaatcccaacactttgggaggccaaggggggtggatcacctgaggtcaggagtttgagatcagcctggccaacatggtgaaaccccatctctactgaaaatacaaaaattagccgggcatggtggcacatgcctgtaatcccagttactcggaggctgaggcaggagaatcacttgaacctgggaggcggaggttgcagtgagacgagattgcaccattgcactccagcctgggcaacatctcaaaaaaaaaaaaaatcatagtctgcttaggaaattctgagattctgcaaaatatttttagtattggtcttcacattccttcctgcttgcatattaatttgctttcctttctaggcaaattgggggacaaattctatcttcaaaaattaaccaaaccctatttttcttcctgaatctgacaatggctacacgcaggtgacagtgttttcagaagaagaaaaatgaagacttcgtgattgtccagagactattgttgtccagcaaatcgaaccctctgtgctcgcgtgatattctctggggagaggaagcagagccttcccttttatcccaggcagcatggggctcaaatttctgacagatggaaaggagtggagtcatgagtttctgtaccattcaacatttttcacacaaattttcttgtgttcacctgtactttcagtactgattcgtggtgttaagactaagagtaaaatcagtgctacacaatgaggaaatctagatggagtagaggcatcacagatcattccagacaaggctttttaagccttatcttatattttcactttaacaatgtagatctgcttaaaggagtctgaagtccagctgacaatagttgaaagaaagtgccagaagttccatatgggccttattacagacaatcaaattatgataaggcggcattatttttcaacatgacaaattgtaatcactttagcagtgttcctatctgtttgctctttgaagccaacaaaaaagaaaatatatataaacttctcacacagaggtgaaaaacaagctaacaccacggacgcctgtttgcttaaaaacagtttccaggtattttctggagaatgtttctgtttccgtataatgttgtttgctgagaatgattcggaggcctgatgagaatagcagcagcacctacaaataacatgtttaaagcacaggccacacactggtggcctgaaggctggactctcatcacaactgtgcttagcttggccctcttgatgtttttaaatttttttagttaatcatgcatattttgctttagtcttaattttaatacgtaacatattcactctgttcaaaacaaaaaattataaaatgccacccagtagataattgctgtttgtatttttaatgtatctttctagggttcctttgagcatatataagaaataaaacataaattctttttctttcttttttacacaaacggtaacataatatgcactctgttctattccacgcttgttttcagttaacaatactttctgtatctgtagggagcttcctcacttgtaatgcctgcagagtattctgttgaatggttgtaccatgagttatttaaccaggaccccatttaatgcccattggctggcttccagactttcgctattaacctcactgcaatgaataaccttgtacatttgttatttcacacgtgtgagtttaggtttatcctctacatcaactcttagagatggaaatacagggtaaaagaatatatcctttttacagttttggtacacaatgccactctgccctccatcaggattgaattagtttatacttgtaacagcaatgcatgattgccttcttcacacaagcttggccaatgaatgtttttgtaaacatttggatttttttacttttcaatcttccttttcatgacttctggatttctagtcatacacacaaaagccttctcaatccaaaatgaaaagctgttttccatgtttccttgtattatttttaatctatttggattttatcctggtagagggttgagttgtgacaccaagttaatttttttccagatggctgctctgtttttcctacatcttttatttaaaagttcttcacttccatagattttaggtatcatctttatcatatactaaattcctatatgtctttggaattttaccaccttgttatcatcagccatacaacgtatgcatgtatgcctgatgctaacatatgttgtatggttgatggtaacatatgttgtatggctgatggttacaaagtagaaaaatatacagcagagaaaaggaataaagtggcaggaacttaaaataggaaaggacttgctgagaagataatatttgagtaaacatctgaaggaaaggagatagaatcagtgcagcacagcactgaaaaacctttggcctctgaaatcagctgggcctgggatcaaatcccaactctactttatgaccttaggcaagttatttattctttctgtgcattaatttcttcatctgtataattggaattacaaacagtgcatgcttcatgggatcgttgtaagaattaaacgggatctttttaacaagcttagcactgggcctgacacataaaggctgatcatttttacggttatcatggacacttattttgtcattacacactccttaaataattcatggctgcaaaatattccatcacacattgttatgggttaatttcacatgttaaaaccacatgcgaatttatttaactgcagatcccaaaagttcaactttttaagtggttcttcattgttgctcttccagaattatcctatcaagcttttttttttttttttactttttaactttgaaattattgtagattcacatgcagctgtaagaaatacaacagttatccctttatccagcgtcactcaacggtaacatcttcagacctgtagtgcaatatcacaaccaggatattgacaatgatacaatcaaatagagaacatttttatccccacaaggatactgcatactgactgttcaggtgcatccacttccctctcacccccatccttttcttacctcctgcaaccactagtctgttctccattgctatagctttattatttcaagaatgctatctaaatagtatcatacagtgggtacccttttttacataggcttttttccccttcagcataaatctctggaaattaatccgaatcactgagtgtcttggtagatattggtccttttcgactgccaagtagtatcccatgctgtggaagtaccagtttgatgtttggttgttccaactttgaggctattgtaaataactttgctataaacattaatgcataggtttttgtgtgaatataattcttcatttctctaggagaaatgaccaggagtgcaatcactatagttgcatgttttatttatttatttattttaagtttttgagattggatcttgctctgttgcccaggcaagtgcagtggtgccatcttggctcagccacccagggtcaagtgatcttcccgtctcagcccccagagtagctgggattacagacacttgccaccacgccctgcctgcatgtttaattatttaagaaactgtctaactgttttctattctgcctgtatccctttacatttctaccagcaatgtaaagtgattacattgtaaagtgagtaatcgagtttcttgcatccttcccagcatttaatagtcactattttttgctttaaccactttgatgggtgcatagtgatgtctcgttatggttttaatttgcacttttctaatggttaatgagattgaacatctttatgtgcttatttgccatctgcatatcctctgcaatgaaatgccccctcacgtcttttgcccattttctaattggattgttttgtttgtttttaatgttgagttttaagaatttttttcttttaaatgtattctaaatactagtctctcgtcagatacgtggtttgcaaatattttctcccactctctagtttctcttttcatctttttaacaggatcttttacagggcaaaattttttagttttgatgaattccaatttattatgttttctttttatggattttgcttttggtctttggtcttttatggattttttaaccataggtctcagaaattttctcttatttttttcctaaaagttttatatttgaggttttatgtttaagtccacgatctcttttgagataatttttatataagatgtgagacttaaattgaggttctttcttttcctctatagatgtcaaattgctctagcacaatttgttgaaaagactatctttattctgtagaattgcttttacacctttgtcaaaagtcatctgggcatacttgtgtgggtcttttctggcttctctattccattggttctatatgtctatgtctccaccaataccatacagccttgcttactgtagctatataacaaggcttgtgatcagatagactgattcatcaatttatattttaaaaaattattctaaatcctttgtctttccatataaatgttagaataacctcatctatctctacaaaatgtcttgctacaagtgctggaattttgacaggaattgcattaaacctgtatatcaatttggggcagattgacatctttactatgtgagtcttccaatccatgaacattgtgtgtctctccatttatttaggtctcctatgatttctttcattagcattatatagctttcagcatacaagttttgcacatgttttgtgagatgtaaaccttagtatttcattttcgtatgattattatggtattgtatttttaatttcagtgcccatgggttcattcctagtatatagaaatctagatcatttttacatgtttatcttgtattcttcagccttgctgaactcaattattaattctaggtgttattctgttgattccttgggattttctaattttgaaaataatgaaattgtctaattttgccatcttctctggggacagttttatttcttccttttcaatgtgtattccctatatttattttcttgccttaatatacttcctagaacttccactactatgtagaatacaaataatgagagctgacatccttgccttgctcctaatcttaggagaaatgcattcagtctttcagaattaaggataatgttagttctcaatttttattttgtagatcgtctttatcaagttgaggaagcaccctctgttactgtcttccttagagatttatcatgaatggaggattgaattttgttgaatactttttctgcattcactgttgtgatcatgtgatttttcttctttagtctgtcactattgtggataacatcaattgactttcaaatattaatcaagcttgcaaacctatagtaaatcccatttggttatgatgtatacttcttttgacatattgctgaaatctacctgctaatattttgtaaagaatgtttgcatctatactcatgaggcatattgatcagtagggtatttttcatttctttggtgccatctttatctgtttctggtaccaagtttttggtaactatctttataaaataaattagtaagcattccctcttctgttttctaggagatttcatgtagaattggtgtaattcttctttaaacatttcatagaattctccagtgaagtcttctgggcctgaagacttctttcctggaagtttttaaattatgaattcaattttcttaatagttatatggatatttaaatcatttatattatattgggtcagttataatagtttgtgttttttgagcaaatgttccattttgcccgttatcaaatttatgtaggtagcattggttatggcattctcctatccagttttgtacctgatactggtaatctgtaccttgactctcttgctctctcttttttgttgtcatctgttgtctctactaatagaggtttttgctgctgcttctctctgtctctcccattatgctgttgatttcactcactgggctttttgttttcattattatacctttcaattctaaaatttccattttagttatttttatatcttctatttctttgctggggctttctattttttcatttgtttcaagcactgttacaattgttaattgaagcattttattgtgactactttaaaatctttgtcagaggccgggcacagtggctcacgcctgtaatcccagaactttgggaggccaaggcgggcagatcacttgagtttaggaatttgagaccagcctggccaacatggtgaaacccatctctactaaaaatgcaaaaattagctgggcgtggtggtgcacacctgtaataccagttgctcaggaggctgaggcaggagaattgcttgaacccggtaggcagaggctgcagtgagccaagattgtgccattgtgccattacactccagcctgggtgacagagcaagactccgtctcaaaaaaaaaaaaaaatctttgttagataattctagcatctctgtcatctcatttccaggttgacatctgttgattgccttgttttattatgtttgaggccttcttagttcttggtatggtatgacaagttatcttcaattgaaatctgaccattttcatattatgagactgcatcttgcttaaactttctattttagctggctgtcccggacaccattccagcagtactggggctgctacctcattactgtcaggtggaggcaaacatccaggtttctcaccagcctccattgttggggggcgggggtatactccttattactactgggtggaggcgggagttttctgctcacatgaccttcactgataccacagtggaggtctcattaccactggctgacgctaactccactgggtctcttctcacaccaccccagtggggagagggaggagcatctcattgctcctgggtggggttggaagtccaggctccccatgtggtccccgcggacaccatggtggggagggcttattaccaaccggtgaggatgagaatcccagctccctacttagccccacagatgccatcttgcaggggtattgggataacctattacggtcttgtgaaagtggaagtctaggctccccacttggctttctctggcatgggagatggtgagaccacagaatgtcctgtggtatttggctggagtagtatggtcattgtctaaaagttttctgtcttgccagattgccctttcctggtcctttagtcagagagagtaggctttcggaaaggatttgtgagtatgtcagagcctataggtgtttccaggttgctaatttcttcaactccaagtctggggtacttgaggcaaaaagaaaacccaaggaattcaccatcgtgtttttcctcgggtcctcagctggtctgccttctcttctccacctttcagaatccttttatgtatgttttctctataatgtccagggttcttcattgtccttggtgagaggaacaggagaaagtgtgtgtgccccatcttcccagaagcagaagtcttatgttattttttaatgtcaatctaagaagaaaaaaaaaatatttcaaagtaagggcttaagttcaagctgagaatttcacctggaaaggccataaaactctcactcaggaagagccacaggcaaacctactccttgccctgggccggcagatcttgctcctccatagctactgtctgtccaaggcaggagacattactgcagttgggaaatcagggaagcagagaggctagagaagatgtcatggggcaatgcagaaaggcagcgggctcctgtgttcctggagttcttttgaactgtgtctgctccagtagggttctttctccaggttacggaagtactcacagctttcttcctcattcagagggcgtccatcatggcagatcctgatggccacctagatccatagggtccacttgatattttagtaattcctagtcccttcagctgacatcactgtattccattttgttttgagaaagttcaatagatatcccctgtatgtctagccctggaaccacaaaaaagaatcattgccttgcagccctttaggaaacccaatcaggacaggagctgcgggcaacctagacatagccccttttattttctgtgatgagcactggggagcacgtgggctgtcagaccggagtagctcagagcagtggacccaggctggggatcagaagagctacctccttgcctccacgccaacttcagagaaccttgcctactgtctaagtagccagcagcccatcacctcaccctccgtggccttgccttttcttttctccttagcagccctcaccacctgagtcatctgtgagatgtattagtttatctgtgtttttgtccacttcggttttttcccttgtgagaatttcagctccccaaggactgtgagctgtactctcactgcctccatcagtgggaagcacacagtagatatttgatcaaaaatttctctcctaatctttcatgacaccgtaggcaagtccccagacttgctgtgattcaaaagtcctgttcaatccaacttttttttttttttttttgagatggagtctcactctgtcgcccaggctggagtgcagtggtgcgatcttggctcactgcaacctccacctcctgggttcaaacaattctcctgcctcagcctccaccgtagctgggattacaggcatgcaccaccacgcctagctaatttttgtatttttaatagaggcggggtttcaccatgttggccaggctggtcttgaacacctgacctcgggtgatctgcctgcctcggtctcccaaagtgctaggattacaggcgtgagccaccatgcccagcccaatccaactttaaaactttaatcacacattcattataacattcatcccaattcctgctagaaccaagctctgccttgaccatggcctgaggtccttgcagtctggaagaagggggacttgctttttttcctcttctcgtcctcccctaatgcatgtgagtttagggaggaggggttaaggggaaagggctctaggctttttgccttgcagattgttctctctgactctccatatcttctccgttgtgggcatccacatgatgtttctcttcagggaataggtggggacttctccacttcaaaattatgtgatggaaccctctgctgcttctgctgctgtttagcccctttgccctgtgcccaccatcctggtaaggtagagtgaggctgcctgagcccaaacaccttccatggcacctactccttaaatgtcagtcaacacttcctcagtctgactccaaattattgttataaccatcttgcttttcataacccccatacctctgctgaactgaataacctgccccctaaaccctccccaaacccatccccacctcatctttttctgcatttctcacatgccttcctccatgtccacttgacagaaatttctccatcaccatcccgcattcctccctgtttctgcgagtctacttgcaacctatgctccatggccttggggaaatgctgcttcatcttcaagtctccctctcccttctagttcagtcactcttgaccttggtgcacactggaatcacctggggaggtctaaaaatattgacatctgagcctcgcctccaaaaagactaatgtaattggtcggggtggaatctgggtattggcatttgtttaaaaagctgcccaggtgattctaaaatccagttatgctgagacccactgggctgatgaaattaacttgtcttttttttctttttatcttgagacagggtcttgctctgtcacccaggctggagtgcaatggcacaatcatagctcactgcagccttgacctccctggctcaagcaattctcctgcctcagcctcccaagtagctaggaccacaggtgcatgccaccatgcctggctaatttctgttttgttttgttttgttttgttttgtttttgctttgtttcatagagacaaggtctcactatattgcccaggctggtcttgaactcctgtgttcaagcaattctcctgcattgacctcccaaattgctgggattacagatgtgagccactgtgcttagcctcacttgtctttttatcagagtacttgtccctatctactgacctttatccaccataaggctccaagcatctaggagagaagacagtgtcagattcatttttgtaaatctcacagcttaccacagtgctcagtaattaaattaaacacaataataatagctaaccattactgaatgcttcctctgtactgcacattctcctaagtcctttatatggattatcccatttactccctcaacaaccctaaaaggcaggtgctactcatcaccccacttttacaaatgagcaaattgcaacctagagttagggaaagtgcagtactgcagaggtgtagatggcagagcagggattggacctgggcagctggcctctgcacagcttgtatgtagtcacattgagggttaggatttggggagacacaaactttaagtccacaatacacagtgaaagcataacttcagagcccatgctaatgctgtgtggcctctgcacagcttgtatgtaatgtaactacccccacatagttactgagtgaggatgaattcatgaatggtgctcctgggcaacaccttacttaggcctgtggggaatttctcagtctagatttatgtcttgtgccactttcataatgactcatcttcaagacacctgttcagttattcatgtaatagctttatttaaagtttactttatattgaacttcacctacacaaaaatatccataatatgaaaaggttgatgctggacatatttttctagtgcacattgtcttagttcaggctgctatcaaagtaccatagactggatggcttataaacaacagaaattgatatctcacagttttggaggctataagtctgaaatcaagatgccagcatggttgggttcttgtgaggaccctcttctgggttgcagatggccagcttctcattgcaccctggaatgatggaaagaggactagaacgctcgctggggtctcttttataagagcactaatcctattcatgggggctccaccccatgacctagtcatctccccaaggccccacctcctaataccatcacatcagaagttaggatttgaacacatgaattttggggagacacaaactttcagtccacaatacacattaaaagaataactgtgtgtgtgcgcggacataccacctaaaataaaatcgccttcctcatacgtatatcaacactcatctgctataaatagaatttgcagccatccttctaatcaaccagcttaaccgcttggatcccagttatacctcagagttagtttttaaaagttcaactcatattagaacctgtttttaaaaagtacatctcttccaaagcaaaacacttttctcccagaattaaccagaaaacctaacaagactattaagaccatggcttttatttgcttttagttttatgaagcttcagctgctcatgaggcatttcacaagaaatatgcttccatttagaaagagtcctggggctgattgaaacccttgtagaatatgtgtattattgttacttttaaaatactcaccaaaatgtgctttttgtatttttgcagccatttcacaaaagccccatttttaatgcaaactattccaacctggcctttggtgttaggctggtctaagtgcataatctaagtaccaactgagtgctgagaactgtggtatagaaattcagagaaggggacagagtccatgggtggcctgacccagaaaaacgtcggtgggagagggagacttgattccaatcgtgaagaatagatttcaaaagggaagacagaagctggagagcacagtgtacaaaggcatagaaaaaagaatttactccatatcctttcatcctttaacaaatgtttctcctgaatctactctgtgtcaggaactttgcaaattgtatggcattttcattgcttttttttttttttttttttgtctgtttggctaacatttattggacacttctatactaggcattatgctaaggaatttacatgcattatttcttatggaaactcacaacgaattataccaggcaaggtttattattaatcttgtgttccatgagacgaccttgtctcagagaggctaagaccccagctggggttcctcaacctgtgagtggagctgggaggtgaatatggagtctttgtcaggcactggaacttttatcaaccacttgatcttgttgtgaatgagacacacgcagtgcctgtcctcaaatgcccagttgagcaggtgatactggcaattaatcaattatgattcagtatgatgggtactgatgagaggggaattaggaaaacaaatagcagtaagagataatgagcttcaattcttgtttgcaaaattactcaattgaatatcagtctatgggaaagaaagagagattgatcattgacattcattcttcccttcatttattcatttataaataatgttcataatcattatcactaattaatataaaaagatctgctacacccctagaacaagatttattattaattttggtgacaaagttcatatttcaaatacacttattaatttcaaatttagggagctcacttcttttcagacctgatttgatcctcattgctgttcacatgataatgtagctcaagattcatgcatcaccaaaaacgaactcacctgtagccagctacaggaagtcaacactctctactattaacagagtagaagctttcagctaagggagagttacaggaactggctttgccctcttgcctaaaacagatgaaaacttggacaaaaaaaccaaacaacaatttttaagactgttttaagatatcaggcaacaaggataggtgttctctgagagacgggacataagagataatccctgtgtctgctcctacctactgccttgagagggtttccagcccatagcctaggggggaggaactgaggcagagcccagcaggctccctgagcccaaggtggccagagttcatagacaaagcatcagaggagagagagagatacacagagagcaaactccaagggtctgtcaaaggtcctcacatagtatgaggcagagagctgaccaatatgttcatatgaggaaactagcaaagactgaagggggaaaaaaaaaaaaccaaccaccagaaaggcatttacacagggccagagagagtgccttctctcaccagccagactagaaaacctcattattaataaggcactgggtagagtagtcacagggtctttcctcattagcgagaaaatattagcttcctagactagacacgattttggtcctacctaatgtaactgccaatgggttatttttgcccgctgcccagacagagccaatttatcaagacaggggaatggcaatagagaaagagtttactacacatagagccaattaaatgtgagattagaacttttttattactcaaatcagcttccccccaaaattcagaggctagagttttttaaggtcagtttggtgggcagattgctaaggcgtggagaatgctgattagttgattgggggcagaatcataggacatcagagatgtcctcttgtactgagtcagttcttgggtgggggccgcaagtccagatgagccagaccagaatgcagggtctgaaaaatatctcaaacaccaatattaggttttacagcagtaatgttatccataagaacaactggggaggtgaagaatcttgtggcctctggctgtatgactcctgagccataatttctaatgttgtgtctaatttgctagttttacaaaggtggactggtccccaagaataaagggggcttgtttggggaagggactgttattatctttgtttcaaagttaaactataactaaattcctcccgaagttagtgtggcctacccccaggaatgaacaagggcagcttggaagttaaaggcaagatggtgttggttaggtcagatctctttcacagtcataattttttcactcataatttttgcaaagtcagtttcacgaacaaatcttaaaagccagaactaaaaggatcaaactgattttaagtatcttaactacctccaaaaacaaagttcaaaaatatttataggaacaaaaaatatccagccacccaaacaggtaagattcacaatgtctgacatgcaaacaaaaattaccagggaagcaaagaagcaggaaaatgtaactcatgatgtgaagagaaatcaaccaaaacctacccagaactgacacaggtgttagaattggcaaaaaaataaaaaggattagcataaatgtgtctcatatgtttggaaagttaagtagagacatagaagatatatttttaaaatccaaatcaaatttctagagataaaaactacagtgtgtgaggtaaaaaatacactggatgacattaacaacagattagacaatgcagaaaaaaaaattgtgaatttaaatacacagcaatagaaactatccaaaaggaaccacagggcagtgggtgaaaaggaagagggctttttcaaaaagaaggaagaaaggaacattaatgagctacaggataacttcaagtaggctagtaggcaggtaattggagtccatgaaaggagagaaaaggagagaagaaaaaatatttgaaatcataatggctaaaaattgatgactgatactctcacttggattaaatcatttgttcattcattcactagtaatttttgagattgtaccatgtgcacaagtctgggtgctggggaaacataagggagaaaaagaaccttcattggtttctattccagtgaagggagaggaacaaaacacaaaatgacaagtgagagttttaatataattctcagtcttgccactgagagccagataactctttgtcctgggcattgcaggaattttagcagcatgcctggcatctatcctccagataccagtggtaaatcactaacccgctactcgtgacaatcaaaaaaatgtctccagacattaccagatgtccttagggggaagaggagccagtaatatattagaagtgaaatctactaggagaaaaataaagcaattagcagcatcagatatgccgggatatattatagcaacttaaagtagagtggtaaagaaagacctcgatgaaaacgtggccattggctcaggcgcagtggctcatgcctgtaatcctagcactttgggaggccgaggtgaggggattacctgaggtcaggagttcaagaccagcctggccaacacggtgaaaccccatctctactgaaaatacaaaaattagacaggcatggtggcacacactgtaatcccagctacttgggaggctgaggcaggaaaatggcttgagccagggagacagaggttgcagtgagtcaagatcatgccactgcactccagcctgggtgacagagtgagactctgtctcaaaaaaaaagaaaaaagtgacaattgaaaaagacttgaaagaagtaaggtcacatgctcctggcaggcagaagctcagcccagatgcaaaggtcctgaggcaacagcctacttgacatgttcaaagaagagcaagcaggtcactggggttacaaaagagtgacccagggggaaaataaaacaaaaaaaaacgggcaggaaagcaatgagaatggaatggaagaggggcacttctccaggaatgagcaggagggtcctgttgtcacaaggagtgaggaatgctacttaggcaaaaacaaattaatgcttacgcttgccaactgtggccttggacatgatgtttaaacctctttgggcctcagttttctcatctgtaatttgccttgcacaatcttggcaaagattagataagatagatttgtgaaggcacctcgtaactgtaaagctatacaagcataaacaagcattgtttaagacgtaaggatgacatggtttaaacaagttataagtgcagtactttttgggagagttaagttatgaagggtttttactggtggaatttatggatgtagtctatatttatatacactccctatgaggatcttggttttccaccacctggatttaatttatatgatgttacattttactgcacacactatataagtttagcaaagttgacactcatagccaaataatctatagaattttaagatgttcagttctgacaggcctgacttataatccccatattggcctctctcaagctgtgtgaccttagacaagtaacctaaactctctgagcctcatttcattgtttgaaactgttaattgtaatatttgtctcagaagattgttgtaaagattaagtgacatatgtttaatgcatttatttgtatagtggtttgcatgctgtaaatgtaaaatatttgacgtattggcattgtatattattctataataaataataatatattaagattaagcgaccttgttcaaattatactagcttaggaaagagaaagcactggtgtacatgtaatgcttaataagtagttgacgtaatttgcacatctgtccttacctaaatctcatgttgaattgtaatcccctatgctggaggtttggcctggtgaaagatcacaggggtggatccatcatgaatggcttgggccatctccttggtggtaactgagctcttgctctatgttcacacatgatatggtcatttgcaagtttgtcccaccaccccctccactctttctctcttgctcctgctctgaccatgtgctgtgcctgctcccacttctccttccgccatgattgtaagcttcctgaggcctcccagaagccaagcagatgccagtcccatgcttcctgtaaaggctgcagaactgtgagccaatgaaacctcttttctttataaattacccagaatcaggtatgtctttataacaacgcaaaaaatggcccaatacaatcgtccattaaaatgagttgaattgtatctcagtggttgggatagtcaacccatatcaatttatactgcttgtccagacactgccaaccccagaggagaaagtataaaatccaggagtctaaatgcagtgccaccatatcccactctccactactgagagaaggggtcaaaatagaaataccaagtcttctgtgggcttctgccacctcacacactgcgaattgttagaaatcgcttttgaggaaacagaagtgtctcctttcattctcctctaagtaagggaactggcagcatgggggcagggagatggtgtggagaaggcggaacccacagccctgggatgaaaggaaggactacacggggatgaaagggagggcgaagagtgaagacgatgctcaaccagcaggtgagagtcgagtccgcctccctcactccacccacctccagaccaagctccccactgccaggccacaaccacatgcaccaacctgcccagcccggatacgttttaggtctcacttgtcacaacctccggtgcaccaaacagcttctcagatgcaccgatgtacctgcaggacctctctgttgaaaccttctcattttttgcaagaatattcatcaagtttatataatttgcatacctcttgacccaaaaatttcatttttgataatttacccaaagaaaatatagatacatgagtatttaaaaataaaagtgtgagatgatcactttactactgcttataatactctagatgtacaactatacacactgtgaatgtccatcaataaggatattagacaataaacaatgttataaccaagcaatggaataaatgtcacctgagtcgtaaagaatgaggcaggtttagctgtgttgcaatgggaagtttctgtactactttgtcacatgagaatttatgctggtacagatagcactattctatgtttgtaaaattttcataaatgatacatatttattgaatgccttctgtgggcctcgctgtccttggtacttgagaaaagcactgagtgaagtagatattatccctgtctttgtcgagtttgtagtctaatgggagtatgaggaaaagcacaaagactgagaagtaaacagaactgctgacacagcaaagatttttaaaagggcaagggactctggtggagacgacagtggtgggaggacagccttagatgaatgtttagggacaatctctccaaagagatgacacttatgaccttaaggatggatggaaattacctacgggcagacagaggagcagaatgtttcaaacagagagccagaagtttggaaataacctgtggtatgtttgaaaaactcaaagaaagtgggccagaaaatggaatgaaggagcacgtggtacagagaggatggagatttaggcaggggcagaccatgttagacgttggagatcctgcatcagagtttgggcttgactccaagagctgtcagaagctactggagggtggtaaggagtgggaagatgggatctgttgagtaaagaatgtattgtgagggtcaagagcccaaccagagacaaggccagggctgttgcagtcagaaggtggagaggcagtagcttcctgtcctggggtcgtgagaggtgagatggtgaaaggaaggcagattcagaacgcatcctaccctcctgaggaggtcggggagaaaatcagttcccctatcacaccccttgcacagatgaacctcatatctcaaaagcaaaatagttatttttaaacaccagtactttttctttttctttttctttttttttttttttttttttagttgatataatccaactctgtggaaattgtgggaaacgccatctctggggataatgtacacatcatagataaggagactataaagatggaaaatatcgataccttacacaacttctttgcagaattggaagaaaagggtttttgtttgaaatgcaacgtgcactgctgtgtttgttaccctttggctccaaacaatgtccctccaaccaacagcaaatgctgaatatgttagaaagagggggagggaaggaagagtgactcttataatctcatgattgttctgcacgcctgtgggcagaagaagtatggctggaattagggggtaagagagaaaggggtgtgaagcaaaagtatgactttgagagttcacattcagcaagtggcaactgtgacaactgttttgcccctaggacatagttgacggcaaggaaaaagaaggacaagaacttggaactgcggattgctctgtccctggggacccagaaggactggagactgcaaaggacgattcccaggcagcagctatagcagagaataataattccatcatgagtttctttaaaactctggtaagcagttttctcctcttttcccctccactctattgctcaaaagttttgttaattctaagaataatgcacatttgaatgttattgtactaaatgaattatcatggtgctgttggagcatgggagagaacagggacaagatatgcttcataagaaagttgtgttatatcagacttttagcaagagagcccctgaagctcggaaccatggtataagcagtggatgcccaaatcatgtaacatgggctgtgttgtaatggaattctattgcaattgaatgtcttatgttcattgatcataaaaataattgaaaaatatctccctgtgttgtggacatctcaaagcagttttgccactcaagtggcaaataaaatactgtagaaatcattcaaaaaaaaaaaaacctgaatgaatgaatgcatagtgaagcagactgtcccaaatgtgtttgggctattttcaaatatcaagactaacctcaaaagaaaaaacaataaatgtcaacagaatgtgccacaaacaccagagggttgcacatgtgtttggagtaatggtaaaatttattggaagtctgtggtcttccaggagacaattttgaatgtggtcaaactcttggtaaatgtataagatcagatgtatctcattataagatattaattttgttaacttttgtattacccggcggtcctgagatttctattgaactaaaaatacttctcattttattcttgacctgtatggtgaactggaccaccctaaagagttatttatctatgaaataaaaatcactctaaagagcaatgatttctaatatttggctttctcaaacttttaaggtttcacctaacaaagctgaaacaaaaaaggacccagaagacacggtaggtagttggaagtgtgtatgtatatatttgggtttgcgcatagaattggatttggatttgtgtctgcctgcttgttttttgaatacatatatgtgtgtgtgtgtgtgtgtgtgtgtgtgtatcatatctatatataattagcaatttaatagtgctgttaggttgtcattaaaatattttatttacattaacagtagttaaattaaaattttactggaaagcttgaaagacgtgccaactctggctaaataatatcacaataccaatttcttatatagcataagaacagaatactaataattatatcatcatcttagtctttttagttgtgcgtagagggacccagggaatatagtaaaaaacagtccatgtaaagtagaagaaagcttttcagtaggacgtggactctaaaaaaataaagtagaagaaagctgctatatttttgttttctaaaaaatatgttatttttcaatgtaatttgaaaactaaataaatctttactgcaaaggcagtggtttggtgaaatagaatagtttccctggggcacctgccaaacggatggccatgcagaggcgttaggacacgctagagagcctaggttcttcactgtcatccaagaattcagcccactctcctcaaaataaacttggtttgaaataccatcttcctagagatgttctccctttacactggacaaggctcgttacctctagtggaatacacggtttaagtttcacgggaaccatgaaggaagtttaacttggtgacagataagtgtcttgggtccttcttctgatatcggaaagtgctttgaaaaacagtgggatcagatacatggcttggtttgccccctacatctgctacccacatgtgaaggagctggctgtgaaaagaggatcctagattttgtctcaaaagacctgcatttcagctccagttctgctacttgatagtggtacaatcttaatctgtctgaacccaagtcttcatgtctataaaattgggacaaaaaaattctttgtcctggaccccaaggttgaatgaaggtgtggcattgttttgcaaactgtagagctctgattaaatgtagcgatccctatttcaatgatcacagccaagattggttgaatgacatgactacatttgtattgtatttcttggtttcctcgagaattttcttcttccattggaaaaaaatatgtatctgaagcatctacatgcattttcctataaagttattcatttgctccgaggtcatagggtcaagttcaatgaatggttggggcaaaacgtatttcttttggttctatgtcttgcgttgtttgaagccacatagcgtaaaaggctctaaacagtggagtatgggaatgtgtgtgtggcttcccaagtgacctgatgcactcattctctttagctggtcatggaccaagactcctccctgacccagaatgtggtcaaaactgaacgtacccagctgataaaatctcaccgtcctgcccaggaagctgtggggtcacattagtggagctgggtctcaaaagcgggttttgtgaatgtaggttgtccatgacacccacaaacagatgtgttttctacaaacctggttctcataccttgcaattttgatatcttttctactgaagttcttggattcatgcttttgaagtctgtattgttttcagcccactaccttccctacacgaaagtccctgacatttgtaacttgagccaacaatcttgagtggttgtagccaggctatttcggtttcgatctccctctactttgcctcagtggattggttcacactacacattttctctgcctggcgggggtctacccatctagaagtgaattgaaatttttgcaggtgatattgcttccataaagtttctaatagtgaatcaaaggagatcgatttgagactaaaagacattcagcagcagtctttgctttgactccaggatgaaaaagaaatattttgtctgcaggtattttttactttaccatgtagcaatagcatttagatatctacaactatcaagtagagactgcattatcttctcctgttatttgtcttcagcaaatggagatacagagttttgttttgttctgtcttgctttgaggtgtgttcatctgggtcatttaaataggtcactgttgaaaatcactgtatatctaaaattgtgaatatggaagtttaaaaaagataaacatttacagggtgttttgtggttagaagaggggatggtgtaccaacagttaattgtcacagcgtattaatgcactttaaaacaacagaaaacaaaaagaattttgttcaaaaacaaagttctgaggttgtgactgctgttgccccaaaggcatcgaaagcagaaagtgtctgtgatggacaagctggtcagaagacatccgagatccaggctagaggcaccaagaaaaagcacctggatagccccaggctaggactcgcctttagaaaattctttaggcataaggtctgtatcttattaaagtaggaggaaaaacaagaactctggtcttcacaagacatgtgccatcctgagcccacccagctcctctccagtaaaaacagagccttgggtggtggggatcattaaaagagaattaaagatgatatgaattaaacttcagtgatttttaagtccccatagtcataaacatttcaaacaggtgtcttcctagtgcggaccagggttctggaactattcttctaacccagtatttcccaaatgtcaataacttgtgtaccaccttcaccatttttgttagatgtactattatttgatatttttacattgaaattgacctattttctatttaaattgtatctttaaaagaaactttatatcatatatagaaaatcagaataatttttcctaagaggaaggtaagcattaatttggctaattaaaaagacattacattctagctacctcatttgtattaagctctgaatctgatgctctttctagctttattaaaaggtgattaattggccaatggtagaaaaatgttaaagatgtaccatcaccagactgagactttctccagaatgttagtagaaggattaaatgagagttggaaaaggagaagtggtttcactatttgaatactatgtaatatcatatttctgcacaatctataatcttctctgatccaccaatggtatgcttcctacattttgggaaatactcttctaacctcaagtaataatgttatctttctgtggtctgtttcatctatttccaatattaactaagcttacactgaacccaaataaaagtccaggcggaaaaaagcaatgaatgaaggcagagcatgtttcagctccatgtccttgggaagttaggacaacactgaagtcagtttgggaaatattatgcttccaatgtctaagaagacgccagtgtttgtctgaaaccatcagtttaaaggatccctgaattgggttagcatgcttgaaaatttgtttaaaatatcagccattttccaccaagtcaaaagcctgtattaaaaaaacttccctacctggatgtcacagtcccgggattgtatatgcaaataagcactccatagaaagttctcacagctgaatctgtatttgcgtaagcagactatgttatgaagccacctttcaatttccatacaggataattttgttctgtgaagagaaaagaatggggaatgataaatattgcaacgggggagggaagattaaaatgtgctccaacatcacataacttagtaactgctgggaaataacttagtaactgctggtgaaacgcgtcatagatctcataggaaagaatctagtttaactcccacttggagcttttgtaagtaaggggccttgaaagtttaagaagtgtatgatgtttccccagatctgcctttcattatgacattcacttcatgcactacaaaattttacgtctgcagtatctcttgccaccaataaagggaccacccaagttcaatgttatcattcctagggcttcccaaaaactgttggcctcccatcttgtcactgaggtagatggggaaaagacaggattctggaagagtgggaagaggccgcgggaacagccttctggaattctgtaacacagacacaaggacttcagggttttgccttgagtggcattcagtgtatttttttatgtaagtgtaaatcaaagtaagggacacctcccaaatgttctgaattcttatttacgcagcagtttgttagagctcattggcttttacctctgcacctgagatagttcatttctttttctcttttgattatttctgttgtctctaaagataggaaagtagggcctttaaataaccagccagattctctcagtgacattatcatgattttaggaggtgtgatactctccatttccccatgggtttgtcacctggaaaagaaaacgagaaattcaagcaaattgaaggataaaactattttgctattaaaaaaaaagttaccaattctggttaattctggggctttatttctctacatctctatgatccttcttataaaaagaattttctcagttcaaaaagtagggaagtctgaaatcagtaagtgaaatacatttagtgtcagcttttgctgaattggaaccatttttctcggcctaatggcatgtgatgtctcagaatcaaactttttcatgtggccaccactgtttggtgacaactttagacacaaaacagagcattcctttagaatgcctttgccatgccccaaaatgctcccctctctcctcaggtttccccagtgcccaccctttctgtaaggcagctgaagtattagcaagcagcatgcatgatttataagctctaccattcattcattgtttttggttcttggtgtagtgtttacatcttactaacatctcctctctcccacacccaatgtgaaaacaagacgaaaatttattaagaaggtaaggtcatttgacatacaatctccaaattgaatccactagaatttcatgggcagggccaccaggtaaaatatacaggactcagttaaattcaaatttttgataaacaagaaataactttttaatttaaatataagtatgtcccatgcaatatttgggacatgcttatgctagaaaattattctttgctgatcttaaattaatatttaatggaatatctcatattcttattctcatgtgctaaatctggcaaccctattcatgagattgcctctgaaaacacaattaaaatttttgtagtctcctctgtaacgcaaacaaagaatatccagttggttgatgctggcagaactccatctgggggacttctttgggaaggcaggagagtggtgggcaggaatgaaaagactaatggtgttctgactggtactctacaacccagtgagcaggggtgggtggctggaaatatggcatgacaggatcttgtgtgggtgtctgtctctggtccctgtcatagactgtaattattaattgaatgactgattgtctattttgtgccagaagctaggcctgatgggaattggggacgtaatcatgaccaagactttcttggtcttaggatatgatgatgaccaagactctagcaaaagagatacatattcaacaaacaactacacaaataaattagaattatatagttactataactgtagtagggtcatgcccttgtaatgtttttgaagggtttctggatatcctcccaatgcaaagagaaaaaaaaattggtcacttccctatgaaactgatcagtatagatgtgtttcccaatctttatctcagtatcagccctcaccatgatacttttttagactattttttgccctaatcacccttccctccacgaaattttaatgtaacaaatattctttatacctgttaatgcactgtaattctttaggggagacacagaccatgttaatatctaatttggcataacccttctcccaagaacaaatgcaatattattttttgttgtatattgcccttgttgagaacggtggtatagatttccctcactgatgggtggaatagcccagggagcaggaaaccttgattcattggaaacagtgtagtatggagtcactattaatgcttgggtttggggatcagactccctggattcagctgtcagctctgccccctcattagtgtaactgtgggcaagttacttagccaccaagcaactaaatttccctgtctgtgaaattggcataaaaattagtgtcttcctgtaagttgtagcatttgatagtaccattgggaaattacagctaacagtaatttattggatatttcaaaacagctagaagagaaaaattgtaagcttccaacacaaagaaaggataagagtttgaggtgatggaaattccagttaccctggtttaatcattgcactttgtatacaggcatcaaaatatcacatggaccccccgaaaatatgtaaaactatgattcatcaattttaaaatacaaaaaataatcgttcgtcataggacttttgtcaggacattcaggtgcttaaaacagtgtctgtcactgttaccttttattcttgtcatcaaataaaagtttaaagttggaaattatgtcttcaagatgcaacagtggtccagggagactaagcagagagagaaagggtggtggctgagcggtgaaaacggccaagtatgtaatgcattaggtaaactggagctgtcccaggtaaattctggcactccaggacctggggaccttgttttttgtaacctctatgtgactctgagtaagtgggctaaatgcacatcaaagggaacccttgagccagaaaaataacacagcatttagaaaaggtacaaagccaagccacagaagttacaccaaaatagcgtggggccatggagccgcccttctaatgacttcggcagattgatgattggcttaaagcaaccagagccctttcttagagatggggatgaggtcagccccaacccctggattcttggtctaaaatggaccactgggcaaatggagattctcccaggaaagcagaaggagaggttgttgttgaagtagccacgcttggccactctttgctccgatacttgccgaaggaccttagggcagttgttccctgtgcgtggaaaactctcttcttcccttctctggttaattttcagtcacccttcagatcaaagcacaaccatccttttctcagtgaagtcttccctgattttcatgagtggatcaaactccttgatttagctttttatgggattgagaggaatagcctcaaatcgcctccccactcagtagcacttattacagttgaaattttacatttatttgtggaattatttactgtcatcctctccttgaggacatgtaaccccagcacttagtacatatcatggctcatagaggacactcaaagtggattttaaatgaattattgaataatactttctcttattttctgaaaaagaaaacaagctacttagcatgtgtgtgttaggaggaggggtacttaccctttaaccagtcccctttaatttaattaccgtttagagctaaaatagcaccaggtgctcaagagcgtttgggacgtttgtaatgcagaatcttatgagctcagccattttgacttcactgtctataaaatgcaaaggttattgtaaattccaacattttgccattttgtatacttttaaatggaactggagctattccagtatcaactatcacaaaattcatttccagacgtcagttctttatcttaacttgaacttagaatctgctcaatggatgactccttcttagtattaaaaatttcagcaaagaagatgttgtgtcttgcatcaaatagtaaaattcatgttatttgcaaacatcctttggagaagcaatatgctgcctgggaagagctctagaaaggagccagaagttcagacttgaggccaggttgtgcccttgttcagcgttgggcagatcattggcctcagtttccccatccatgaaaattcatgcattggatcagatgggctttaagactctttccaggatcaaaaaatactgtcaaactttctgaatttgtccatattctatattttttttgagatggtgtcttgttctgttgcctaggctggagtacagtggcacgatcatggctcactgcagcctcctggactcaagcaatcctcctgcctcagcctccaagtagctgggaccacaggtgcaagccaccatgcccagctaattttttattatttgtagagatagggtttcaccatgttgcccaggctggtcttgaactcccgacctcaagaaatcttcccacgtcggcctcccaaaatgctgggattacaagtgttgggccaccacacccggcccataccccatttttattgcaatatattttttcttttagtcagaaaatttattcaaggatattacatccctgggaatttaaagggattgagtcataagtatccagagcaaaaaaaatcataaaatgaagatgtttaggattaagaggttaggtcagatgaacctgatgttaaaattatgagtaccaatattcactcatgtcaagataaattctgactataattctcccaactcttcctttatctcatgactcagtgggtggcagagcatagaaattaacacccccttgctgaagaaatcagatgtcctggaattggacttcagtgcagctgctcagagagagagacagaaagagagaaaggagatacggacagagggagagagaaaaagacagagggaaggaggcggaggaagggaagaagggaaggaagagagaggaagagaggaaataaagaccgaatggataacatttcaagaagttttaattgtggagtgtagggctgcacctaaaagtgaagaaatagggtttgtggacactcttccaattcaaaatcccttcaccaagttccagcctagttgccttttactaactttatagtctaactcagtcatccccaaagtggagtatggagaaaaatttcagaagttctatatttaatttaactctcctttaatttctaattttgatcagtaagatgatgcatgtttataatatatacataaataagtatgcatgtattgaaggtggaaattcaaaatgtttttactgatgggaacttgattgaaaccatttggagaccagtggcctaaataagaactccatattctaacagcaaagggtctcttaccaccaccttgattcctaatgagttacttacataaacataattaataatgcttctatgtttattttttgaaagaaaaatatcttaactttttctgagattttaacacaagtccacattcacagtaaaaatttttaaaatacagaaaaatataaagaagaaaattaacattatgtataacctcagcccatgtttattaaaaagagatcttccatttttaaaattttgagaccattttgaatgttttccctccattttttttaactctttagggtgctgaaaagtcacccaccacttcagctgaccttaagtcagacaaagccaactttacatcccaggagacccaaggggctggcaagaattccaaaggatgcaacccatcggggcacacacagtccgtgacaacccctgaacctgcgaaggaaggcaccaaggagaaatcaggacccacctctctgcctctgggcaaactgttttggaaaaaggtaagtctgattttcaagcgttagagagtcgtccgggcggggatgactccagaacttatttctattgggctaactgttgtactcaacaatgtatggaaggtgtttcttcttcttcaaaatgactcggcttcccattgagtagaagccttctaatgtgttcctaggaaaaatgaaacgcctgtcatgttataaacatgtgtttcgtggggaagaaaaggaaatgaacaagtagaatttttcattctttgagtgacttcatttcatgacagagggttgtggtatttcatgatttcattttccttctgaaatggtttaaaaccctgacttcttcctggtctctttgagcactcttactctggcaagatgaactacctaggggctgtctgtcttcactcctccccagccagacagaatcattcattatcagccactaggtctccactatccttttagaaacctagggtgtccatcagttcaccaccagggtaggcaaacactgtgctctatgacaggaaaagtcaaaccactgtctgattttgttcccatctgaggtctgagtggtgcaaggacagggagagtggggctgagttattctagatctattccttaattatcattgctgagcaagccccagctgctacacatgtgcagagcttttgtctgttttaaatttggccaaaagatgagcaagaagttggagatgagggtgtgggtggaattcatagagctggaaaaatctaacttcagaatttcatcaaaacatctatcgcacttggcacaccatgcaaagcagatgatgaatgcagatgccactgtggtgtcagctttactccgtcgtccagaatccagctggatgcggggccccttgcctgtttgcttcctgtcatacagaaaccttccttccaggttcttcccagaacacagtcttcactatttcataaaaactttggatgatgtcagctgacacattctgttgtaatcctttttcttcatcacccaccattacttatcttaaaatatcttttaccagcaatataatagaagaaacaatttccaagtgaggtatatgtgtatattggagacaagagagaagacttaagtggcccatatctgaataattttagttaaataattaccatgtattcatatgcatattcaaggtgtcttaggaaaaatagagttagcacattaaatttgagattaacgtatgttttgctcaaggttaaataagcatattttgtttaaaaaggaatctaataaaaagacagtattacataaataatggttctgatagtagataaataatggtaaatttgggtcctccaagaagcagacaccaagacagaattgacgtgcaagagatttattggaggaagacatctgtgaaggagaagtaggagtggcagagctaggtacagagagccttcagactacagagagttctgaccatctagcaagaaagagagagaaggaaggagaagtgggtggagaaagcctcaaactgaaggtggtgctaagaaagtcctgaccaagccaatggagaatcatagagtacagattgcctgttccagaggcccacactggaccggaatgaatggcccagtactcctgtcgtgcccagtcattggtaggagcccccagggagaggagcagaagctgaaggcatgacaggtggggctgtctttcttgcaggaatctgagcagcacacttccatggctgctacagatgatacaatatggtaaaaaccacataggtggtgtgccagtggctaaagtttgagaaacactgatgtaaaagctaaaagtttgaaatcagacagctctgactttgagtctcagtttgtctctatgagctttcgtttcctcacttgtaagatgcaaatgataatagtacctatgtcatacaaatgaatacaaatgaagtaaggattaagtgaaataatgatggtaaaacctccaacactggacctagtacaaaagtgcccactgaacagtgttacctctcatctatttcctccgtgctcaggagggctgaagaactaaccaggccgacgtctttatctttctatactgtccagtttgagaaagctgctaaactattgcctcaagtgcttatttaatgtttggaatctacaagagatacagtggttcttctttgaagttcaagctattcctttgaaaaacaatgtcaggacaacttgacattcatctccctaatgatagaatttcatttatttcagtctcactgtcttttgagccactatttagctttatttagtatatcattaaaaatatgaagttaaaagaaatcaaaaaccaaatcccctgtgtctctccttcttgcacccaatcagaagaaaaggctcttcgtcaaagttttacttattcaacaatattgtaattactttatttgtgctaagtactttatttgtgctaagttgttttgtgctatatagtttgtgctaaatactaggcattgaaaaagtagcagtaaacaaatgtctgccctttcctagcttatattcttgtaagaaagcttatattctagcagaaagcaaaatgaggacctttgttttcttttctttaaattacaaagactatgattataaaatcacccttgtaaatttttgaagagttttgaaaaatgcaaagggaaattctaggaaattcttacattttcttatattttcactgataactaacctaacctctctttcttctctcatttttagttgaaaagctttcaaacatattgattttaaagtttataagcctgtagttacagacagcagaaatgaatttttcccagaacaggctatggatatgaaagtataagttgttttgatttatagtctttattgctagagtagttattattataaaataaaaaaatacctttaaggaaaccaatttcaaattatgttgtactttccaaaaacgtgtttaaaatgcagttaactggagtaaatatgccatttattgttctgagtaaattggattctcacttgctctgtgaccttacataagttatttacactatttgagtttcttttcctcatttgttgaataagaggattgggatacacagtcttgataattcttgtgtatggcaaggcttacacaacagaatcagaaaggttgagctgtgtatccctggacaaattggttgaccactcaaagaccctcctttctaatctgtaaaataaggactgtgtttttctcacagtgttgttataagaaaccaataattgtacatataaagcacctaatatatagtatgtgctcagtgaatgatgtcatcatttcttcaagtatgaacaatcagtggtcatgactaaacacccacgtgtggcttctggtgttaacaccacctaagtacaaaacaagtataaaattcatttgctagcatcaaaagatttgaaatccatttggaggaacatgatacacacacacacacacacacacgcacgcacatgtatttgtaattaataattgatatatttggaatatcttcaaaatatcccttttctgctttcctttgggggagacaaagagtggagtgggaaaataatgtgcactctgaagccacagagacattatcaaatctcagttctgacagttactgactgtttaaattttagtggagcacttaaactcttgagcctcagtttcttcagttataaaattggccaatgacatctatctttcgtgtttattgggaggatcgagtaaaaaaaaaaaaaaaaagaacgccaaatgactgatattcagtgaattataacccgattctgaaacaacgaaatttgcaatttagtattactctgtggagtacaggtaacaaatgctacggttgtttagaaaagggagcaatcagtgtacgtcaaaatagacttaagaacttaaaaaacgtatctgaatcatttgggtgatttgtttcaaatacagattttaacaccttcccatggggattctggttaagaaagtctgggcatatgtctgggcaattatggaagcacttgaaagatgggctgaccaatctgggcttaatagaaaatgtcttagggctactgtgaagttaatggactcagaagagctgtcacatgatcaaaatgatgcttttagaagactcactaggaacagggcaaatgctggcttaagtgttaccatatgaaagtcttttaaagaaaccttaagaattgaatttgctctttaaaggagaggaaactctgttattctagtttctatggataggttatctgctgtttagctccccattcttagcaatataaatgtccaaacaggatcccgtagattttaaactagattttttattgtcactgttaatgaggctggacctcaactgtggatcatccaccacaacatactcattggcagtagaaaataatgaattgaaaaatgatattcctggctccctagctccaggcttcctgttatatagagaacatacagaaagaagggagaagttgccttcatttgtctttatgtatgagcatggaaaccatgcctaatacaaatacaagttaaatgtgagatccaggcttggctcaaagatgctcaaagaggacgctataatacatcagtcagctttcaaggagagtagagacacacctcaagccccaaaggcagatgtgatgtttgagtaaaagcaacagtttattagatgttccaatagagacctagaaattaaagaagattggtttccatttgaatactagcttggaatacaacataaagcacttaacccactgcctgacaataatagcctaagagtggccctataatgtgggttgtcatcactattatctctattagcattactatttttttcagctctgtgcaattgcatctaatgcatgctaagaagctggaggaatgcaagccgacaaagaatatttattaaggaacaaaacatattgcaaggagctgtcttcgggaagccctctggaatctggcctcagccctgtttattcaaaatttttatcagttaacttggacaacgaccaagttaaaagaacatttatcaagtttacaagctgggtgggttcactagtgcagtccaaaatataaacaatatgaatctcaaaataacggcacaatgggctgaagttagtatgacctagaatttttggttttcaaaggtcaacataacactatgttatggtacttgggtcatcaagattttaactgagacccacattgtcccctacaccattccaactttggaacctaatataacctattagttagcagtgttaaaaatgtctgtttataaggggttccgtagcaaacatacatctggcccaagcagacttaagaacatttcaaaagcaacatagaattactcaagaaaaattctaaataggtctagtagatctagccagtgtcatttcttcccaacatttataaaaattgctgttgctaattgaaaatataccatgtgcaggtactgtgctaagtgctttacataaacaaaataaatatcagcaattttcatagaatgctgaacatacatgaatccatgcccacacaaatcccatccagatagttctaggaatccaagataggtgatcatgaatcagcctgggctgccatatgtccctactgggtggtcacccccaagccacaccactgccaccaccacagccaccaaggagatgatccgtgccaatttatcccactcatcactgctgttgggactcccaagcccacgagagttcacctgtctcttgcaaggcagcaggcagaaaaccttttccttccatgttgtgcttagctctggaaggagaatcccgctgcagctgcttggaccccagagtggccccatttggcaagacccactgtaggcatccatacagccctttttctccccagtagacagccagttcgagagtagctgagctggaatgagttgttctaccagccaccagcaccctacccagaaccactatttcccacaagccctggaggttgctgattctggagttcttattgctcctggtaaattctcttgctagggtccatttcttgaaacctttatttttgctctacttcaatacattctggcttgtagaaaagcctatagaccactgtaccctaattccagacatggtttgagttgttcctacccctcccccataaacataccttccaggatctccaactcccatgtaaatgagggtcttcatgtaagtaccaagaggaaccatgtgggtttgactccagccaccaggcttcagtgagtcacagctgtgcttcagccatgattttccctacacaggccttattttattttttccttaaaacaacgctatgagcagtagatagtctaacagtcagcctttgggtaagtgaactgaggtgcagagaagtgtgattaatttgctcaagattgcatagctgaaacactgaatttgtacctgattccacagtgtatggtactctagacttgggttctgagcagattttcttttacatgtgtcaaacactaaagggggatcagaacctgccctcttattatccatttttgaattcttattttaactggatatttcaacaaccactaacagaaggctacacttgcaggccagtgtgcaaatgtacaagaatagttcaaaattatttagagtgactcttggacacaatctgagaagcatttaatcctttacatagtgcatttatctcctgttttcattctataagaagtctcttcttgatattcacaggcatttattactgtacaaacacctgctgatctcttttttaaagaaagacttaaaaacaattagaacttactgcatgttttttatctattgtactttttaatacgtactactatttacagcaaagatgttgatatgacatttgctgtaatgataaggcatttcttttaaaatatatttaagaaaaaaatattaagtaaaaatatatttaagtaaaaagagagtcagtttaaagaaaaacatcaactgaatagaggtggtacatggacaggtcaagaattagaacatggttttttgttcttgcgatagttgactgagaatgatgatttccaatttcatccatgtccctataaaggatgtgaactcatcattttttatggctgcatagtattccacaaaaaaccaaacactgcatattctcactcataggtgggaattgaacaatgagaacacatggacacaggaaggggaacatcacactctggggactgttgtggggtggggggaggggggagggatatcattgggagatatacctaatgctagatgacgagttagtgggtgcagcgcaccagcatggcacatgtatacatatgtaactaacctgcacattgtgcacatgtaccctaaaacttaaagtataataataataaataaataaattaaaaaaagaattagaacatggtatgaaaatcattgaagtttgagagatgctcaactggattatttcccaaaatgagtgctttgctaagtagtctgactttaaaaatataaaatagcaattccttttgaaaaagacaatatttataatgccagacttaaaacatcagaaagatgtggaggtctgaaaccataatgaagatttaaaaaatctgttcagaagcagccccttctattcctcaccatcatctacattggtgatggaatctactccaagttcccagttgcttctgaaatatagtgagcaatgaacaaccagaaactttctagacacaggcaatcaaagataaaaactagtcttgttgcaataaactgggacaggaaaaagggtatgtaaacctagaagtgctgttcttaaataatggaagggttttctcagtctaatataaacagtataatgattcctgaaacttttgtgggccggccttgaggaggtctggctttaaagataccatttggttcattacgtgttcatggtattaaccagtgtctgactaatctcagagaaaaaggggtgcagtttcaagaaagtatctgatatggtttggctgtgtccccacccaaatctcatctcaaattgtaatccccataatccccaggtgtcaaaggagggacctgataggaggtgattggatcacgggggaagtttcccccatgctgtcctcttgatagcaagtgagttttcacaagatctgatggctttataaggggctcttctcccttcgctctctcttgcctgccaccatgtaagatgtgcctgtttccccttccaccatgattgtaagtttcctgagtcctccccagccatgtggaactgtgagtccattatgcctctttcctttataaattacccagtctcaggtatatctttatagcagtgtaaaacggattaatacagtaacactactgctaatttcttctgaacacattacaatttcctgataatcagaagctttcagaaattcagcaatctcttttaggaacatttttgtgcccagagaaacttcactgtgggaagaagataactagaaataaattatgcaatctgaagatctcatctagagagaataattctgtatgtgaagaaaggaattcacacgattgccgaaaaaatgtgtttctgacccttgaagtcatcatagcaggggaaaatttggcttttagatgtaaaataaatgtattaaaaccatttccaccactttctagctgtttaactggaacaagtggcttcacctctctgaacttctatttcttactctgtaagttaggatcacaatacttaccattttggggtgctttaagtgagatgatatataacgcaagatgcctagtgcagaagatacatttgtaaatatcacttcctgtcttcccctcccctggatgccttaaaggaaaaaaaaaaataggacttagtaacaaaatggatatagacagagttcttaacttgtaatccaagaggagagacatagaaggtctatgaatcctgaaattatttgcaaagtatattgtttatgtgcatttctctgggaggagagtccagatctatcaaatgagtctcaaagtggtctgtaacatccaccaccatccatccagaagtttaagaaccaccaaaagaaagatgcaaaaatgaactccaaagttggctaactgatagaatgattgtggctttgacctttgacagaatcgggataactcctatcccacttggggcaggactgtatatgccagaattactcctgggagtaaaacggtgtttgaatgtggatatgtaggactgcagctctctagccttccacagacatgttttagtcaaattgaactttgacctaatgaacttggcctagactgagggctgacgaaagcagcggcccctgctgctggcccctgtgctatggtcagggtagggcttggaccctgcctattgtattataaagcctgcttgctcaaaaggacaattgaacgagtttctctgcacttattaccagaattttcctgagtagcttctttgttttacctaacagtgactctgtattgaatgattaattgcatttctctcttttcatcaactactaaaaaatataaaggcaagtacattgcttacctacagcagttagcattttctgtgacaacgcttctgcttgctccatttgtatcctggctgcatctgtgttttaattttctctttgttgcattttaaaatacataactatatatatatatatataccgttttcatttttgtaagtctcctttctttttagaaggaggtgtacctaggcaattcagtgtccccgaacgcaccccaagactgtgagcccaactaaccctttgcttttatgtaacaattttgttttctgtaaccttttaactctcacttttgtttttatcttcctttagtcagttaaagaggactcagtccccacaggtgcggaggagaatgtaagttacacacaccacggcagaatcattccattctcatcttccgccatgttgtacaattgggcattttcagctctggggtcctgtgttcttgcatgctgccagtgtgattcgtttgttgtagactctcttatcccgtatgtgattagggacgcatggaggataacattggatgaatttttgtaactctcattgaatcagtgcaaaataaatgcaaaatcagggcacaaatttttataattgttatcagtaggggctgaaagagtctactacacgtaagaacagctttgcgcttccttgagggataatgatgctccgccttctgcttcattccaccttgactgctcgttcactcttatttccatggtgatccagcttcttactaactttgggcggtacccagggcagggagttgcatcaggcatgagaacatcttgcagcaacagacgctgagaatgtcggtctcaggttagagcgctgacttgacgggtctacctctgagatagagacgttgagcctcacagttttcctggcttttaatcttctagaggaattgtcaaaattttcaagacagttcattcatccccgaaagggatggtgctatataaaacatcacaaaaacgtagcttccagggagattaataaattgacctcgtgagtttcagacccaaaacaacagctctctgccttgaaagaagtgcgcagtctttgggaaatttttataagtagggataagtgaattcacagctccttgagatagaaaccgaacattatcatgttgccaaagcaaaacttgttctgggtgtcccttatttacttgccataaatagggcgtgtgtttttatttttatttagttatgggaactgaacagatgttaaacatccaaacacgtttctgaaatgttgtctgtgatgtggaataaaaattagaatggctgtgttatgattcttattggaagaaaaatcttgaaattgtgtccggagttggttccttccggtgggttcttggtctcgctgacttcaagaaagaagccacagaccttcgcagtgagtgttacagctcttaaaggtggcacagacccaaagagtgagcagcagcaagatttattgtgaagagggaaagaacaaagcttccacagcgtggaaggggacccaagcgggttgtggctgctggctggggtggccagcttttactccgttatttgaccccgcccacatcctgctaattggtccattttacagagtgctgattggtccattttacagagtgctgattggtgcatttacaatccttttgctagacacagagcactgattggtgtgtttttacagagtgctgattggtgcatttacatccttaagctagacacaaagtgctgactggtgcatttacaatcctttagctagacacagagcactgattggtgcatttttacagagtgctgattggtacatttacaattctctagctagacagaaaagttctccaagtctccactcgacccaggacatccagctggcttcacctctcaaaatctgtttgttggttttactgcccttccttccttcctccttccttccttccttcttttctttcttgagccaatcttagcccagcaaagctcaggtctctcatcattccagaaagttctcatgaattactattttatagaaagtcaaagtttctattcccgcaacctacaaggaggactccacaagacttctttctacgaactttaagtttaaaagctgcccgtaaaatctgtagcatctgttagctttgaggttctgagttttctaaagaaaaactttttggatgtttgtgtgtagttgcttgtttaaggaaccctgtgtttcccgcagctcagatgctaaaatgcagagttgatctctaacaggcaaacaggagatattctattttctactgtgaaattttaaatagaaatataaacaggaattaaaagttaaattatcgacaccaaacgataacacaaaaactgatgatagggacataaaataaggtaaaatatttgttaaataaaataaagaagcattataaaaattgccttaaatgacttaacactgcaagcaacattttgatttttaaggctcaatatttcatcttctttttttctgtttgtgtgtttgtttgttttcttgagacagagttttgctcttttcacccaggctggagtgcagtggcgcaatctcggctcactgcaacctccacccacccaggttcaagtgattctcctgcctcagcctcccaagtagctgggattacaggcatgcgccaccatgcctggctaatttttgtatttttagtagacacagggtttcaccatcttggccaggctggtctcaaactcctgacctcaagtgatccgcccaccttggcctctcaaagtgctgggattacaggcgtgagccaccactcccagcatcagtatttcatcttctgacagcctatcacttggagggaatgagactgatggttgtgacgttgatcccatcatcttcaggccacacctcttgagcctcagtttactcatctgttaaatggcgataataatatcacctacactttcgggttcttgtgaaaattggagatcatgtctataacgtgcttacttcagtgcctgaaatgtaggaggaactcaataattttagggatcagcaaactgtagctcatgggccaaatacagcccacaagctaaaaatgatttttacattcttgaatggttgaaaaaaaatttaaaaagaatattttatgatgtgaattcaaaattcaaattcagtgtccagaaataaagttttattagaacacagccatgctaattcctttacatatcatctatggctgctttgttgctaggcaacagagttgagtagtttcaacagaaacactgattggcagggactttgcaggaaaagtttgccaccttctgcagtaattgttagcaaattagcaaataagagacaacatagtgagtgagcatgtcccagtaatcggtgattttctttcctagtgaaatgatacagctcacagctgactcagtgtccatgtggattgaaggaatgtgtaaaacagagttagctttaatttcctcctctcttaaataagagagaaggcattagtcaaaacaatgtatagtgctctacaccttcacaacaggacaattagatatgattaaccatattacaagagtgctttaaataacgacttctggctaaaatgtggttgagtttattctttaaaatttctctacctacaactttccagaactaatctatcaacggatgcaaggcccacttgtatttaaaaaaaactaaaaaacagagtgatgtcaacatttctcaaagtttctcacagaaagaaaaataaggattttgaagcctgtggaagtttagtgcttttcctagaatgtgcttctggtcctatcagaaataaatctttttttaactcttgaaatgatagaatctttcagttgtaataaaaaaaatattttgcccattggttaattgagttaatgttctaatgaaaaaaatttctttccttccaataacctgtaagaccatggaaacaggtacttctgttgtttatctctcttaataagtaatctctcagttgcaagtgaaagaaaacccaattcaacctggattagaaagaaagtggcctttactggctctcattactagaaagttaaattgctttcaaataaaatttaattcagggctctccttgggttcagccttcttggcctggctacatgctcagctttccaacatcacatcactcagtccaaagtaaatgagctatttgtcaagtagcaaccctgcatgtcctggagtttgttctgtttcactgactgaaatgcattcacatgctgtattcgtcagcttttgccaggttgtgttgcagtgacaaccaggtcccaaattacagtgcttctcaatagcaaagaagtttgttttattttttcttttctcactcatgctacaagccagctatcagttggctttggctaacccatgtggcctcttcctgctgaggtcagtagagaagcagcagtcccttcaataaggacatgcagttcttgttgcagagagaaaatagtggcatgggtgaatcatgcaacggatcctaaagcttctgctcaggcatggtatatgtcatttctacccatgttccattactaaagcaagtcacacatcaatgggcacaggtgtgtaattcatttacaggaaggtagggtaaataattggagaaataatacaatttgccgcatgctgtcatttctaaaccaaccacagtcaaggagcttgaccatgttgattggtttagacctttttaattggcttaatccaaattacatagtcttgaagatgggaaagattgctctcccaaagcaaaattagagtgtgtaagcagatgagagagaatagttactgagtagaaaaaaaaaaatctgtgggaggtctttgtaatcaatcacattaaaagtcctatcaaaataatctttaaaatattctaaaataaaaacctttaatgttaatatgacgttgtgcatgaagtttaaatggacgaaatctatttgccataaatcaatttccaaaagccacagctctagtaaaaactgtataaccaaatttcaagaataagtgtggtataaaatttgaggcaaaaagggaaactcttcactgaaatgtatattgtcaatgttagatgtacctgccatcttcatgcaatgtctaccatatcctctacagaaatcaagcaggggggatttaattctaaaatgtagcgcacatctgactttaattatgtccattcatgatatccaaaattaaaatgtgcagatgcggtcatatgttctaaataggaaacaactttttccaaagccctggcctaggagaaatttggaaaattatccaaataaaaattgaattcctatgtctgtatatgcaaatcagatccttatttagccaagattgttctggatttccacactggatgtcagtggattttccttggctactaaaagccagcttcttggcctgacttcaaaggtagtggaagtctccagaagtactatatttttttacctactgcaatagttgtgttctggagaatggacttgtggcctaggatttatgggttgatacctctcaacatttggaaaggctcagcaagggaaccactggcatccaaatagaattgatttacagagttattgccatacaatctgatcattttatttatgagtaatttttcctccaggtctttgcacacgaagaaagaactcactgcctcaaagacagaatacttctgaacgcaaactctattccttatctacttaagagctattttctatttctccactcttctacccttagttttaggcaaagttgccaactttatacccccaaagtatttgatcatgattagtctaagttagtaatctcattttcttcactagtaagtagcctgggggtaagtggcctagctctgacccatgaaatttaggtaccctgaggtaggggatcaaaatacagatgtttatttggtgcaagtctttggctgtgaccttccttctcagaacattggattgaggatgtgatatctggaattgtggcagctattttttaaccatgaggtaacaaataaaatgatgaaaatctagcatgccaagaatagtggagccaagaacaaagagccaaagttgttagagatattgtggagccactcaaccaaccccagaacttcttgttccatgttttcattggttaagccactattagatacattgagttgccgcagaaaatgccatccttattgtaatgcctatttatctgtggtaagactctggccaaatcattcaattgttcactctttatctatagaatagggataatgttatatttcctaagctgtcgaactatcttgatgctatttataaaaaaatattaaacacccggtacaataccaggcatagcaagaagtagctattaatataatcatctctaaatattggatatgtgcatggtgcctaatccagataattcatgctcatggactaaatagctctaacattaacacaaataacaaccactagcattaattgagtgcatggtgctaagaacttgacatgtattgcctgatttaatatgcagacaactttctgatgtgtatgcaattcccaccgagaacagagaacacgaaaagcacagagatgttgggcactgagcttagatgagggatatagatgtgatttagagcccagcaagttgttctggagcttgtcctctatgaccacgagttagattgcctatatttcagcctcacctgaagggctcttgtggctcacacttacttttcggaaatgcgattgaattaaatcagttcaaaatgtggaaatccatgtccatgctctattgccattctcagtctctgatatggctccagtctccacctcgtttcctaaagatagattggggtccaaagccaacagcccagcagcagacccttcctcacaaataggttttgtttggccaatccagcatttttaatcatttaacatctttagatgggacagcttgactttactttgtcatcatccctgtcactacttttggtcttaggtctggtcaatccatgctgatattctctgccttgcctcctgaggacttttgagtttgtaaccccccaacttccgtttttgtttacaaaaaagaaaatactagaaattgtgtcagtagcttaagaaatttaatttagcttaagaaatgtgatttagttgccaaatgttggggtgttctgcatgctgatttactgatgggcaactccctgaatcaaatggcaatacagagactaagggttcttctcgatttggaaaattcgggtcattttgcaaaccaatggtatgttctgtatgatgggaaagaaaatagtttctcagcagacgatatttttggaaataactaagtccccttcccctaccccctgacaccaagaacaaggctccaagaagctaggggtctggcccagcaaagacaagtgggaagatgcctttgactctatggtactttccagggaggcagcagatgaaagccatgtggtttaaagggccagatagtaaatatttcaggcttcataggccatttgtggtctccatcccatacattttatcttttaaaatatttcttccaacgctttaaatgcgtaaaatccatcaggcgtggtcgcgtgtgctgatagtctcagctacgtggcaggccaaggtaggaggatcactcgagcccaggagttgaaagccagcatgggcaacgtagcacgacctcatttcttaaataaataaataaaattaaaaggtaaagactatccttagcccaggagccacacagaaacagttactgagctggatttggtagtattttgccagcccctgcctgaggaaacaaaggaaattaaaaaacctctcctggccaattcactctgtcctgtggcagggaacaacacaaatgcagaaactgtcccagatgtgactggggccctgtacaaatggagtgaggcactgcaaaagaacacaagttgagagcagagtgtggtagatgggcccttccatccaagccgccacagacactcagaggcagaggaaatcgagctcactaggtacagtggccagggccgcgaacaacttagccatcagtttcttgccaagttcatttttcttctgaaagcataaacttcaattaagtgaaatggcaaatgactgttctagggaaaaattagatatcgcttaatgaggaagtcaattaaattcagtggtttttacactctcctttctacaaagaggacagtttctttatagttgcaggggaactggaaagagaactggaagctgtcatggttaccgtctctaacgttggactcttaagaaaatgattattcctggtttctagacaggccaaatgtaattcacctacgtggcagattaaagaggtgggcttactagatttgattgggtattgagcatgctctgaatgacagtccccaaaaaggacctcttatctgttcttccccttggggaagggattttgccacttccatgtcaatgtggcagttgagcttggaaattggtgcgttgtacaacataagcattacttctccaagatgtgcctgtgtagaaatggtcatagattcaaaactgtagctactatgtggacaggggggcaacaaggaccccactttgtaaaacatgttttgggggaatgttttgtttttcattttcttattacctggcaaaataatccaggtggtgtgtgagtcaccagtagagattataaagtccaaggaagtagaatcagccttacaaacagtggacctcaacgaaggagatgctgcacctgaacccacagaagcgaaactcaaaagagaagaaagcaaaccaagaacctctctgatggcgtttctcagacaaatggtaagccccttacttccagtataggaaacctaagatacctagagcggcttctgggaacaatgggctcatgccacaggtagtaggagacataattgtagctggtgtgtatggaatgtgaatggaatatggattgcatagtgagaaaattccctttcttccttctgattcaatcatacagaaagtctcagtttattgctaatattctttaacccttctttaatgcctgctaacactttttaacaaaaaaagaggtgcccttgggttggaattttttttatttcaatagttgtgagcatacaagtgatttgagattacatggattagttctttagtgtgatttctgagactttagtgcacctgtcacccgagcagtgtgcactacagccagtatgcagtcttttatccctcacccttctcccaaccttctcccctgagtccccaaagtccattatatcattttttatgcttttgcatcctcgtagcttagcccccaattatgagtgagaacatacagtatttggttttccattcctgagttacttcacttagaataatggcctccagctctatccaagttgctgcaaaagacattatttcattcctttttctggctgagtagtattccatggtgtacataagccacattttctttatccactcattggttgatgggcacttaggttggttccatatctttgcaattgtgaattgtgctgcaataaacctgtgtgtgcaggtgtctttttcagataatgacttattttcctttgggtagatacccagtagtgggattgctggatcgaatagtggatctacttttagttttttaaggaatctccacactgttttctatagtggttgtactagttcacattcccacctacagtgtaaaagtgttccgttttcaccacctccacgccaacatctatttctttttttcggccttttaattgtggttgcgtccaaattttggcatacaacagcatctaactggaagttactattattgcttactattatttatttttaaagtttccttctcttggtggtcaatgatactgcttttcttattatggtaatgatatgaggttttctttgaattacatttgtttacataaagaatatcaggcattttaaggattatgtatcaaatagtccaagttatataaagatatggcaaaaattctgaaggtgacgtgagtgacacaaatttggacaaaactagcttatagataaattaaataaggaaatgacaacataatattccaatagtgaaatatataacttagttgatgaattagccatgcttttaatttgtgtagaatagaaagaatgtgatagatatatttactgtttataaaaagcaatgcacattaaatgactaaacagccaggagcttaaataatataatgcaacaaaacctaaatcagttggagaacaaaaaacaaaaatgcatgtaaaaggtcattagtttaattctcttttaatgaaaaacaagaatttcattatagtgtgactttattttcaggagtatttggagtttaatcctttgagaaagcaactctctaatttcacaggctcaacctgttaaggaattctatctagcccacaaaacaaaacaaaacaaaacccttgccaatgggaactgaggcatattagaaataattatgttagaaattgttgacaggaatcattttcttttcctgttatattctcatggagtaaaaagtgtagaatcagttgtgggcggcccatatggccaaaaccccatctatctcattggccatttgatctgcaatttggcagtgaaaatggagattaagacttgagattttttttaaaaccaatttttacatgatgccaggaaagaaaagaacatttggcctgtttccggcaactcatctaacttacaaatgggatccccaaatagctcatcataatattgagagtgatcagcttttccatttctggatggaattgagaggtacagaaaaaaaaaacagtaaatagaatgatggtctcttccaaataaccaacatgaagctccttcatttaaaacagggaaaagtacaagaaactccaaagaaagcatgaaaaaaaaaaaaacctctaaaccactcacagcatccatctaaaacaaattcttaaattctaatgaggtctcatattacttaaatttatcccccagagctatctgttagatgctgtttgggaaaagtttttggcagtagaaaatgggtaagtctaaattctgagggaaacaaattgaaaagaaaagcgtcctttggaatcaattcgctataggatagggatgaaggtaggtgaggacacacttttccccagcaatccccaatggattcttagaattggattccatgctgtccattgttcttattaccagttgcccacgaaaaggcctgggaacacgaacattatctttgcaaaatttaaatcctgattgttggaatttactttaaaattccaggtattctaattatcgtctttttttctgttttgccttcattacaacactatatttatactgtgattaattcaaataaacaaatgaagagttttccagcttactaaagtccctaccactccctattgccacacccagtctagctcactcatttatgttaccggccctttccctgtgggtatttgagtttgcaatccctgatagagaaccgcctgattctttagaacaacttatttgaatcatattgtctggatttatcatactcaggttaaccattgctcaatggatggacatgtggtatgttttcaactttttgcatttcatgcattcactttttcaacaaataattattgagtgtccactatgttccaggcacaagggatacaacagtgagcgtaaacaggtgcagtctcccccggcggagaataaaacagacatttagttttaactctatcctcatattcagtgagcacacaccaagtgtctcacccacgttatttcagctgcttcgcaagcctgtatgaagatcctcacacacttacttctatgcacatgtgttaatgtccccattgggtagatttctggaagttggctctagcaatcattcttaggaaatactttttagtaacatgttcatagcttccaaactgattcaaagtcttcggatttatgcaggaaagaaaaaacctgccctaacagcttgaaaatagagacaacatctggcccatcgctaagggttttttgagcggttggggatgttgagccaaataaataaacgtttcagacaaattttggatattgttagcaaaatatcgatttgtttaaataattgatttaatggaagagagaactcagctgcaaaacctatgctttgattcaccaaatcattgattttctgctttctatcctttgcatttccctcctttttcttttttttttctttttgagacagtctcgctttgtcccccaggctggagtgcaatggcacaatctctgcccgctgcaacctctgcctcccgagttcaagtgagtctcctgtctcagcctcccgagtagctgggattacaagcgtatgccaacacacctggctaattttgtgtttttagaagagacagggtttcaccatattggccaggctggtctcaaactcctgatctcaggtgatccacccgcctcggactcccaaagtgctgggattataggcatgagccactgcatccagctagagatctttttctctctagaaatttactgctcataaaaataaaaatagaggccaggcgcggtggctcacgcctgtaatcccagcactttgggaggccgaggcgggtggattacgaggtcaggagatcgagaccatcctggctaacacggtgaaaccctgtctctactaaaaatacaaaaaactagccgggcatggtggcgggcgcctgtagtcccagctactcaggaggctgaggcaggagaatggcgtgaatccgggaggcagagcttgcagtgagctgagatcgcgccactgcactccagcctgggcgacagagcgagactccgtcttaaataaataaataaaaataggaaaagtatcatttttaaaataactatattttagggaaaggaaaacagaatcatgtaagtcctaacagtgcattcaacacatagagatgtagcacttcacagaaatcctgcgggctcctgcaggattttaaacaattgcgaggaatatctaagacatctgtcatgccctaaataggaaaagattcttatacatattaattcagctgtatgtcaagaaattgaatatttgaagtgctggtgtatttttataaagtgagtgggtagaatactgcattcatgtgtccacaaagcaggtaggcaaatgaaaccagaaaggtggtagatctagatacagttttatacttcgtcaatattaataacaccttacacttgaaaatgctttcctcctccaaactattttcacctaccttatttcatttactcctcctcatatctttctttggaccattagatttgtaagaaaatctttgttggaataatgttctcaggcttagagaaatactgtgagctttaataatgggtaaattaaaagtccaaatgaggaggcagccatgaaatcagagggttttttaaattaattacattcaatctagtaagtctaacaaaatctgttgaaatgtactattggaggtggaaagagggtggtctgtgacggtagttacaaaacagaaaaccgaaagtcttccatatgaaattcttctctgagcattaaaatgttaatactgatttgctctttaaggaaagatttctgaaggaagcattaatttggtcaattcctgtccctaccaatgacttgcattcctttctaccctaagagggtctctgtagtcgttcagcacttttcagttatcggcagtaacaacaatgagagctaccgtttatttattgtctgctaggcactttgcacgcagtatctcatttattaatagagaactctaggaaacaagtgctctctctgccccatgatggacatgaggacacagagactagtgagtatttatgggatttttccacggtccgggagctggtaagcgggagagccagaattccaactcagtttgttgttttgttgtcattttgttgttctaaagctcaccctttgactcatgtgtaattgctgcttcctgtgcttctgcagctggtattctcagaaaggatacgaaggtagaacaaccacatgctccattgttgtgatttctttagtaatgtgttctatggaagtaccattttgatgcattgagctgttgcacttacctaaaatgacaataagggaaaggagaagaaaattaatatatggcttacttaaagcttgcacataggttttctaaatatatttgtcactaaaacaaaatttaccttggctggggaattttgcctgactagtccaattccatttcaagtgagcattgtggtaaaatactaagctcagatccattacctttgttgatcctagaaattttcagtagatcccattcttggatttgttttcatgagactggtctgataaacaatattgcagatatagtcaccatatattaaattttcagcccaattctttttcttttaaatgtcaattgtgtttgaattatattgccatcaaaatacattaacattcccttcaaagaaatgtgaactgaccaccaaacacttttgctagatttttgaatagctaagtgatatacattggagatggttcaaacattcctcagagtatcaagctataggaatgcatgacaagatgaaagaaataaaaaatgatttcattaatatacaaggcgtgaatgccacaagtagattccatctcaacactgcaggctgaatgccctgagatacttcacctttgactgtcatgaataaaaattaactccatgaagaaagttgctcaatatcacactggaaaatctctgaaattacttcatagtctttaaactgttcttcaaagtattaaatagtctctggaagaattttagtctctttaaacagtaactttgctatttttgacagctggaaaaaataagtttctatgtttatggttcctttgaatacagagttcaacatgaattattctgatttgtctctgcaaagaaaaaagaaagaagggtagaagaaaaggagggaagtgagggagagagagaggacgagaggaaggaaggaaggaaagaaggaaggaaggaaggaaggaaacagttgttattaataataactgctgctacagaagtgacttcagatggatttaataagattctaagtgtaaacccaaacttcagtcacctttgcatacatacagctttacatgcctcaaaataagcaataaagaaaaatcactgaaaagtttgagatactctctctctctttttttttttttttttttttttttttaagaagttgaactttgttgcagtaatctccctgacagcctggaggtctgttttcatgattcatgatgtcagctgagatcagctgctgtcaacacagccttctgattcaatcccaattcttctccaagggctctcaaagaaatggggggaaagaaagcaaattgaaaccttaaattgacagagtccctaatgaatgccaaattgaaacaactaacgggaagtttagaattcctgtctcctagggggcaagtgagagaactttattctctagaaggtggtggagtgctcatgcgtgactcttcatgtccattcggtttttgcctaaaaagccattttgtgcatttgtttgttttttgctgctcaacattcccaaaggttgacagatatgatccaaagccacagtgtaaaggccacttgggaatgggcttgagtaggaagggctcttacgacacagcccgaatttggaggctgaatgaaatccttacgtgtccaaagctttgggtgtgatgggaaggctgacagagctggttatgaggagggaagaaatagccaacagttcatttctttttctaaaccttctcaagcaagactggcctttgtagaacaatgcacaaggcacggaggaaggaaaaacccactttccatgtagacagatctaaattttatggagaggacagtctgatctttgtttgtcaatcttagtgaaacctgcaccaatgatgttcctcagtacacggaacttccagacaccacctctttcacactaagcagtatattaaaaagagcacaacccttctgtaatcccagtgctttgggaggccaaggctggaggatcacttgagcccaggagctcgagaccaacctgggcaacatagtgagactctgtctctgcaaaaaaattttttaaaaaatagctgggccaagcacagtggctcacgcctgtaatcctaacactttgggaggccgaggcgggtggatcatttgaggtcaggagtttgagaccagcctggccaacatggtgaaaccctgtctctactaaaaatacaaaaattagcagggcgtgttggcaggcgcctgtagtcccaactacttgggaggctgaagcaggagaatttcttgaacctgggaggcagaagctgcagtgagccaagatcatgccactgcactccagcttgggcaagagagtgagactctctctcaaaaaaaaaaaaaaatagctggacatggtggtgtacacctgtagtcctatctatctgggaggctgaggcaggaggattgcttgaccatggaggttgaagctgctgttaatgatgattgtgccgctgtactccagcctgagtgacagaatgggaccctgtctcttaaaaacaataataatatcaaaaataaagaagagcacagttgactcctgatgaggggacatcccataaacatccacatttgagtttggtcatcctccatcttatccaagcttttatcattttgtttaatctaacattcagcaacttcatacagtgaatgctcaataaacgtttattgattgagtggtgcctcttgccttctaggggcagtatggggaggtggtttagagtgtggaatatggagtcattgcctgctgtccaacactggcactcaaacctgctagttccatggtgatgctagtatctttgagcttccatttccttgtctgaaaaataaagtaattccactatcttaaggttctgacataatgaataaatgaaataatgcaagttattatctcatttagcacaatgcccagcacttagtaagcactccactaaaaattatccttcataaataataatttgtattatctctaatgtgaacaccgtagctcagacaacaaagatacataatattaatcagtcaaaaagtatttgagtgctttcaatgtttctggctgttcttagtgcatgtgttgtggattcttacggtctgctaagagaacagccatggccataaataacagtggaatctggagtcttcctctttgccccatatggctgaaaccctgctctctatactcctcccttagctgggaagaggagacattaagcagtgatcaaacgtgtgggaattagacctgagtcaatgttgttgataagaaccgaacattttatcaccaggtttcttaggtatcaggcactaagcataggacattactaaatgcaccgttaaaaccacagaccccagcatgagtctgaacctgtatatggccaacttgctgagagcggtggtactcaaactcagacaatcctcagcaccacctggagagcttattaaaatgcagatcattgagcctctgcctctgaaagcttctgattgattagatccagcctgggtctccagaatttgcctttctagcaagttcccaggtgatgctgaagctgctggtcctggaatcatacttctagaaccattagcttagagtgtggagtttaaggagtcaagtccaaccccttttatccctgtcactggtgttgctggctatagggggtgctaaagggtggaaaatgaaatattaaacaaaactcatatctctatcaaggagagaaaaaaaaaaaaacaataaaacacccacagcctaaatattcccagtggaaggctactcatgggtcaattgttcattcagtcttcatttaatatgttcaactatctcctgcttccaacattaattggaaccgtcatcatttatctcagaattgcctaattccaggatttagtacttttgttgttatttttggaggccaacacttgaatttaattagatctggttagaaattgcatggaaatctctatatccaatgagtaacatgtttccagttggccttccatttgtcttgaccccaaacctcaatgataaatgactgagatcatccatttcagaactttcttgcattctccacgtcactgtacttgtggctgaaggccattgtctgtttgttattttagtcagtgaaaggggatggagggatcacccactcagaagaaataaatgggaaagactccagctgccaagtaagtgacctcgaactcagtttggtggtgggattagtggtgtattctcacttcttcacagtatacttttcaataaaattctcagccacagccaactcatttaatatctcaggattaagcacctactatatgccaagaactatgttggggtctgcagacacaagcatgaacaagctagagttcctcagctttatcctatcaaaaaactttcacacatgtgcttccctcttttctgcattaaaaatctcttctcacccttcactttttgccataaatgtcacctcttcaaaaagaccttccatatctgcctctcataactacatattgttcttttatttcatagcgtcatcacaaattgtaataattcatttatctcccctgtttcttctcatgtctgtctggaatgtctgtggagcaagaagtctccttcttctatttctctatcaccttgcatggtgtttggcaagtactagaatctatgtcttgaacagaataaagacatggagtcggggggtcacacagtttgctttcattattttctttattctaaagaaacatagctatgacatatttataactacatgtgttcctttttttaaataggatcatgcagctgcactctttttttaatttaaaaatacacctccacaaaaaatggcatcaaatattcttctagtagttttgacaatatagagaagtggctacaagaatgagtggtagactcaaactgtctggttcaaatcctggctcagccacttttttttttttttgctgtgtgacttaggcaaattgccaaatctgtcagcacctcagtttcctcatctatataaaggagctatgaaaagtacttccttatggggttgtcatacttagatgaatcaatacatgtaaaacacttagaacatttctggtatagagggctcaatacatgttagctactgtattagtcagcacgggctgccataacaaaatgccataggtggttgctttaaaagcagaaatttattttcttgcagttcttgtggctggaaaggataggattaaggagtaaccaaatcagcagggtttggttcctggtgaggactctcttcctggtttgtaaatggccaccttcttgcttgtgtgtccttacacggcagagagagaaagagaataagcttgccaatgtctcttcttataaggacactaatcctattggggcagggccccaccctatgcctttgtttaaccttaattacttcctattccaaatataatcacattgggagttaaggattcaacatatgcgttggggtgggggcacaactctattgttaacagtgtctatatgttactattactattatgctgctgatagggaatttccatcttataatgttgcccatatcacactcacaaatggacggtaatgactgtaaatatgtttttgtatttttatttccataataattggtttatcctacatttttaaacaggaaatatattgctttttactatactcttcatatttaagcttttaagacaagcttaaatatgatggtatattttgtctggaattttacagtgaaggaattatgccaataatcttggtgattctaaaattggaatgacatccatacaaatccaaataagctagaaacatccttctatttatacccacctaggagtgttttcagaatccaattgggaattttattttccggagccttggattcagacttgagaacactggtgtgtcctttccatttttagctaatttaattctcacagcaccataaggtgtcatttcttttattgctcccatagagatgaggaaactaggaggtcagtttatccttggtcacacagcaaggttatggtggaattagaaacaaaccaggtccttctgactccagacactgagttcttagccactcactgcatcttaaaatcttctacacaacaaaaacagttaacaaggcatttgaactgggatctctggtttctggcctttctgaagagcattgtggtgagaatttctgtttcattctaaggagagtatctgctctgggatatctattgtacttggacatccatatcttagcatttgctgcaactctgacagttggggtctgccagaagtgttcaagacatatattacagaagagcttctcaaggtacactggatgcctgttgcttctttctccaaggacttctgccctctgaagagcaccggtggaggccttctggaccggggagtctctgctgtttgtcttcccgcttacttctaaggggcgtgcatgattcactggtgtgaaaagaaagttctcctacagttgatgccttctccatcaaagctgctaccttgttgtagaactttttacctgggtacagtacataacttcatgaatcatgcttatacacatgtatccggtgggtcaagtgtgtttgccagttgccacaatcagggctttaaaacttttgaagtcaatatttaaaagttgacattttgcattttttaaaatttaatttcaaggttgtcttgaaacaacagaagctctgaccacactggggctgcaagcctacgtggtatctcttggctggatcagagcaactgttgccctttggacagggcatgtaacattcagtctcccctgctctaaattttctccccaacatcaaagccagccttgcttgaactggtgcttttcttatactggagaaatatttttttggacctttgttgcttttgcagctggagaaataagatatccacatggttattcttaccccagcctgcatttactagatttttggattttacagcctcatctcatcaaattattggaagcatgtgggattgtaaacctttcagtttgacaaaaaacgatatacattccaaactaataaaacaatcatctcttttaccaccatttcatgaagcaaaaggacaatttcacaccaaaaattagggtagatgtaattatgaagaaaagaatgggcatccccaggaaaacactcgcatgtggttgcaagtgggagtagccccttcaaagctggcttaagcataaaagggctccaggaacagctagatctaggaggcacgcatgataccatcaatgcctggtccctctctctctctctctctctctctctctctctctctccatttctcagctgtgattttctctgtgttggcttccttttcggggagattttccctagaaatattggtggttctggaagctccagtcttacattttcacagcttcagatctaacagaaagggaaccagcctctctctcatttcagcaaagctctgagattagctccagtgttatctgcatttggctatgctgagccaatcacagctggccaatcatatacaatgctctgattagtcaggcctaagtcacatgctcttgtctggaggtggaaatagtttgcctggaccacacggagtagatgaggaagaagggtgtttccccaaggaaaagccaagttctggttccagaataagggataaagagtgctttctgggatagcataaaatgtattaatgaattattagataactaaataaatgtccccaccatgacttcataagtgcacattttacctttttttatattcatttcacctaggattcatgaaaatgtagataccacccaacatttgaacatctctgttttaacatatttattcccttgctattgagagttgtcctgcagccactaaaaatgtactttgtttgaaattgctgtagacatcagactccacagaaaagactatcacaccgccagagcctgaaccaacaggagcaccacagaagggtaaagagggctcctcgaaggacaagaagtcagcagccgagatgaacaagcagaagagcaacaagcaggaagccaaagaaccagcccagtgcacagagcaggccacggtggacacgaactcactgcagaatggggacaagctccaaaagagacctgagaagcggcagcagtcccttgggggcttctttaaaggcctggtaggtggattttttttgcctcttctttctgggctctctccttccccaacaccatctgccccagtcagtttttcaaattctacatgtggctcttcacactgggatcccgggtctatcactcagggtttttgaactgctatgtgacttccagcaggttcaatccttctccattttacaagctgagaccttgagcaaattattgcctctctgaaccagattttttatctgttcatacataatgatgcctaactcatagagttcatgaaacaggtgagatactgcatctagtcacctagcacagtgcctgagacctagggagcaatcagcatgtagaagtaatcgtcatcatcaccatcaacatcatcatcagttttgttcagtgtcttgtgcgtagcagatgctctgggtaatatttgttgaatgaatgaatgaatgaatgcattattggctgattttatttacattatattataccaatttgacgtgttaaaaaaattagacaaatcaaatttaaacacactttatgttgtgagcaaagaacagttcatgaattgggcagcactcaaaacccaaagaggttcagagagcactgcccagtggcatgagcagtaagattttataggccaaacatggaagcaaagtagaaaacttatctgattgggtacaatgaggtgtttgccttatttggtcacgatgtgatgagttgtctgccttatttgggaatggtctgatcaattggttgcctgtgattggctgaagctcagctatttgtgattggctgcaacatggctatttgttacaaaaaaaaggatactcataaggtaggttttggtttgtttacttactaaatgtggttgcagtttgttacatagacactgggagtaaggagactgcctcaggctaaaggcctcctgcttatttaatttaacaggggtataaatgcacaattgtgttactccatggactatagaatcaatggctgctagatgcagaggaaatttttttactgcttgcaattttaggcagactggtggggaggtgttttagatgtgcttattttactctcctctacaaaatggaagcccctcttcaccactggactcccagctccatgagggcagggcaccacctttcaggttcaaggctgtatctcaaggacttgaaataggactgcataaacagcaggtgcttgatagacaaaggaatgaatggatgagattaaaataatagataccaaaatatgatatataaagttggaatacattacttgaaattgttacccttcgataaaacattgtactcaactttaaccacacttaacaatttctacttgcatgtttaaaaaatacccactttgagaatggagacactgaaagtgggtatccactaatcatttgatttacatatggaaaccactgaaatttcttcccttccttccttccttttttcccttcttccttctttcatttttcttccaaaaatatttattaagcattccatctaaagcacattcacactcatagcttctctctcctatcccacaagatgtaatagttccttattagcttcttctttctgggtgtagtgcagtcttcaaactaatcatgtagtccttgcagtggtttcattgatgtgaggaaggcagatgttgatgtaaagcaagaatgccagtttgtagccctgagagaaggacttcacccaagtgggtgaggctgtattggatttgccaacgcaagtcttctcaaaatgtactgtgcacacgaatcacccagggatctattaacacacattctgattgagtagttttggggtccaacttgggatgccacaaagctcctgattgatgctacaaaagctgctgatccagggatcacactttgagtagcaagttcctaaaggaccaggaaagatgttggggaaagtatttggatttcttgtagtttacttcttttgtttttttgagatggagtttcgctcttgttgcccaggctggagtgcaatggtgcaatctcggctcaccgcaacctccgcatcccgggttcaagcgattctcttgcttcagtctcccgagtagctgggattacaggcatgcgccaccacgcctggctaattttgtatttttagtagagacgggtttctccatgttgctcaagctggtctcgaactcccgagctcgagtgatccgcccgcctcagcctcccaaagtgctgggattacaggcatgagccaccatgcctggtcttagtttacacgtttttaacccatgatttattcattcatttaaaatgaacaccacccagggaatgatttacactgtggcttctaattattttaatagaagccagcctctacaataggtacgaaggctgaaaaagaaagatggtatggaaaagttcagatgatttctaataatctggtcattcacttaacaaatatttgtagaatatttagaatcctggcagtgagctagaccaggggtattaaaaatgcaacccttgtttctataaataaatttttattggaacattgccatgttcattcatttacatgttgtctagctgctttcacacaaaaacatgagggttgactagttgcatgactagggttgactggttgggttgactagttgactagactgcatggctcataaggcttaaaatttttgccaactggccctttgcagaaacatgtgccaagccttgaactaggcgctggaggtatattcagcaaacaaaggggacagggtccctgacatcaggggttcatattcgaaggggaagcatgcagctaaaaagtattagtagataagtttaaaaacaaggttaaaattattaaaactacaacgttaaaattacaaaattaaagacaaaatttgccaacaaaattgtaggtctgggagatcactgagggaaataaacaaggtcccgcgatagagtttgcctgagtatggatgggggggtgtgtgctacttttgcctgagtgtgtctggggggcagggtgtgctacttttaatcggtggatcccaaaattgtctctgaggagatacatctgagatgagacaggaaaggttaaaggtgccagacaggaagagagcaaggctctttcttccaggaggaggggacagccctggcaaaggcacgggggtgggaatgagcttagtgagcttagtacatttcaggaagagaaacaaggccgtggttgctgagggtggagaggtagggtagggggagaatgatggaagtaagattggagccgtgggcggggacctcctcatgcaggggctgtgcaaggaatgcagacataatcctatctgagcagggaagctactcacagatattaagtaagaagtcttggcccctgttgataacattcgaagattttattttgctgctgtggtggagaatggctgttgaaggtcattaggagctagttaatacaggtcatatttcttgggagagctgatggagattggcctggtgattcctgaagaagtgacaagaagtggacaggtttgagacactaattacagttctagacaccgagtccctcctctgggaccacactcctttacagacctcatctctttaggatggcagcatcccttcaggctgggactgcttctgccacacctcccagacacataagccaggcctccaagaagctgtgtcttttgctgaacattccacaggttgtcagagacagaggcagcattcagctcaggccccctagaccccaagtcctgcatcgtcccagtgtcacaaggcctccagcaatgatggaggacggaggggggcttccctgccgctttccaaagaccaagcctcgaagactttcaagctggacacattccccagggttgcctgaccgccttcctgggaggggaatgctggcagccgagcctgtcaccacccacagaactattgtggtgcctgttacccacaggaaatgagacacaccgcaggccgatccctgcatgatctttgtctcacagtgacgtcctcgttagtcaggtccttttttcctccttctccatcatgctacttgagttctaactgagagcaacccacttggttttcaaaaatctgaaaagaactggaaggaagcccttggaattcacaaagtccaactgtttgaaaacattttcctttctttttgagcaaagggacttttttgtttacaaaagaaaatgtcacaaaacctgggggtgtgtgtgtgtgtgtgcggatatatgcatatacgcacacacagacacatatgataaaagtgaaactattctgattgatggaagactgggtttctcccttcccctaagcaccacttctttgatggccctttcccagccttcccctttcccattttcatgagcccctgaagtgctagattgtgtgcagcgcaatctgcaggcaggtttagcaggtgaacaaatggaggcttgaaaggggaagacatctgtccacactggtgtgggctgaaccgaggcttgtgacaatcagcgcagtcactgcaaggagcctgagaccgagggttggaaagagcgggcagtgaacagaagagagccggggacaacaggtgagctgagggccagattccaagtcaaagtggccaggccgttaccgcatgacctagtcctaggtcatcttggagcctcagtttctgcatctgtaaaatagggtgaataataatcactgtccacctcactgggctggagagagaacaggtaagagaatgggtctggtttggccttgtgaactgtgacgtgtagtcctggtatataaggcaggaaaggggttgcatttatgtctctggcctccaaggtggagtcccagtgaggccagaagggcatgtgtatgtatgaggccagtgagtcaggtgtggtctgtggctacctgaagggcaggtgcccacctaaagggggtgcccctcctcagcaccagccacatgttaccttgggggactgcagacccattgtggcaggacctgtccatttagtcaagagaaaataacaaaggtggagaatttttaagagcaaatacctaatttttaaatgccagcatctaatttttttttaataaatgaagaaaatgcttgtacaagttcatctattgcaaagttcaggcccgtggcagccacttggccatctgagtttgctgtttagtccatcaagccccaagatcaagctcatggaacctaaaggatggaaacctcggggaagtaagctttaatagaggtgagttgactgggcagggtggagcctgggtgaaccaggatccacggcaaggcacgctgggcaaacagaggcaggatggatggctgccacccgtggccagcctgagaccaggctctagacacttgcaagaagcttgttcctggacttgaacctagctctcatctagtggctgagtgagcttggacctgtcatcttgctgagtttcagataccagatcaatgaagtgaatggtgctgacgtcacagggttagcatgaagatgaagggcagtagtgtacaatgcccttagagcaatgcttgtgaggtttaactagtcaggaaaggctattttgtgagtattatttagttagcccctgccctgggttgtaaaggtgcagagatgagtcgggcaccgctgtgccatggggagtttgtgctctaatcacagcaacaagcgattacaatgcacggtaaatggaggggttggggaatggcctttacccagctcagggttcagagatcggggacagaagccggcaccccacttactggcaggaatttgactgaagtggcttgggctcgctgggcttcagcagcctcctctgtagcctgagagcgacagtggcgtcaacctcgtgggctgcagtgaggaccgggtgggatggcagtctaagacctcacacagatgaggcagcaggctctcagcggtgagggaccggccagaggtcatgcaaccagaaagggatggagcatccccaaacccacagctgactcctgagcccaagcttttggtatttcacggtgtcctggtcatctcttgatgccccaaaactattaataacacaatgtattgtctgcagtaggtcctcaatatatgttgttgaatgaagtagtgaattcaactaccaccactaaaaataatcataactcttttatcacacttactgtgtgacaaagattgttcaaagtacattgcatatactaacacttaatcttcaaaactaccctgtgaattcccattttatcaacggtaaaattaaggcttaagtagagggttaagcaatttgaccaaagtcacccagctaggaagtggcaggtctggcgttcaaagaccagcaatctgattccttggtaaattacatgaaattacactacactatgtagtaaatacaatatactatactatgctagattatacagggcactacacagtctatgtactatatacatatactatatatgtgccctatatacatcatgtatactaaactacactctatttattatgctataatacactctatatactatattacatattatacgatatcatgtatattctactgcattaaaccatatgacactatgtacatatactagaccatacatactttgtgatagtacattatacttccctttcctatactatatactatagtgttctgtatatatcatactatattgtacattatgctttgctatactttatttactatactatacagtggactaaactatactgtgctatagttaccatacttgactatactatatatgtatactatatatactataaaatatacactaccctatattatactatcctatattaccttatactacactatactatctatatatactatgctacaatacgttattatactactctatactatactctctctatgtgtgtgtgtatatatatatatatactgtatacaatatataaatcttatactgtactaccctatactgtcttatagtataaaaggaggcccacaattgatccatgcagcaaggtggatgaatcgcacatccactatgctacatgaaagaagttagtctgaagggctgtgtatactctaggatcccatgatatgacatcctggcaaaggcagaactctagggatgaaaacagatcggtgcttgccagggtctgcggtggggagcggttgaccacaaaaggcacaagaaagatctgaggggggacagaaccatgtgacatgttgatttggatggtggttttagggggctatttgtgttggtctaacctcatagaaccaaatacagaaaaggttaactttactacttataagttatacttgacagaaacggtaaagtaataataataataatagtactcaggctagacatagtggcttacacctgtaactccatcactttgggaggccaaggtagaaggatcacatgagcccagcagttcaagaccatcctggacaacaaattgagaccccgtctctacaaaaaaaattttaaaattagctgagtttggtggtgtgcacctgtagtccaagctactggggaggctgacgtggggggatcatttgagcccaggacttcaaggctacagtgaacatagtcccaccactgtacttcagcctaggcaacagagtgagactttgtctcaaaaaaataaaataaaataattgtatctgcctgacaacattccttcacccacattcagtcaatgttaaggctaggtaccatgtgctaggaacctgcaaggcactgagacacgcagaatccttgcagcttccaatctggtgtagaagacagatgttagacaaataaattagataataagatcatttcagagagtggtatgttctgagagagaataaaatagggtttgggatggggggttgggggaaggatagcattaggagatatatctaatgttacatgacgagttaatgggtgcagcacaccaacatggcacatgtatacatatgtaacaaacctgcacattgctcacatgtaccctagaacttaaaagtataataaaaaaaaaagaagaaaataaaacagggtggtgaacctagatggtaactggggagggagctaaagtgaggtagaattagtaccccctaggtactaagtacattataagcatgaactcactttatcttgggaacaaccctctgagataagtttgtcatttccattttaaagataaagaaaccaaagcgcaaagagatgataagtaatttgtccaagatttcacaaagctagaaagtcatgtaactgggtatcgaacccgggcatctgactggagaccattctcttacccagcactgaggaatgagatatattaatttagcccaacacctagcacagagtaagtgctacataaatggccattgttgctgttgacattacagagcttcaataggctgccacgtctttctgtttttctccagggaccaaagcggatgttggatgctcaagtgcaaacagacccagtatccatcggaccagttggcaaatccaagtaaacaaatcagcacggttcccaccaggttctcctgccaccaagatgtgttctccttactccatctcctccccaaacacgctccatgtatatattcttctgatggccagcaaatgaaattctgcctagaaattaagcccgagctgttgtatattgaggtgtattatttacgtctctggtccagtcttttctggcaaataacagtaaagatggtttagcaggtcacctagttgggtcagaagagtcgatgatcaccaagcaggaaagggagggaatagaggaatgtgttcgggttaagtgatgaaaatggcagtggtggccgggcgtggtggctctcgcctgtaatctcagcactttgggaggccgaggcaggtggatcacctgaggtcaggagttcaagactagcctggccaacatcatgaaaccccgtctctactaaaaatacaaaaattagccaggcatggtggcacacacctgtagtcccagctactcgggagcccaacgcacgagaaccgcttgtacccaggaggtggaggttgcagtgagccgaagttgcaccattgcactccaccctgggcgacagagcaagattctatcaaaaaaaaaaaggcagtggcaagtaagttatagaagagaaatgctgctagaaggaattaagcgttgtagtaaatgcgtgcttatcctctaagcttgaagaagggagacgaaaatccatttgtttaaattcacatctcaaggagggagaacccgggctgtgttgggtggttgccaatttcctagaacggaatgtgtggggtatagaaaaaggaatgaataagcgttgtttttcaaatagggtccttgtaagttattgatgagagggaaaagattgactggggagggcttaaaatgatttgggaaaacaattgcttttgaggctcagtgacaacggcaaagattacaacttaaaaaaaaaaaataaataaaaaataaaggaagttgcacggttattttgcaacacaagggggcggcaaggtccccatttttatcctgtaatactgtatccctaacaaagatttggtctctgctatcttacattattaatgtttctcagatggctgaggggctcgcttcatctgttccgtctgacacttatctcaagtgtgtctgtcattcctaatgttctcaggatgtgctctgataaaaccctccccataacctcagttaataaaaatttacagaagacttctcaaatacctgagttgtttttaatacctgtacaaaggagtaaataggaccctgagtctattaaaatgtaattcaaagtagcatatgattgactgacagtcatgtaaaccgtatctttctttttctgatttaataaaaaatacatttacttctaaagtatcttttaattttcaacttcaaagcagtcccactctatatctgagatgactctaacttctacattataaaatccatactctttctccattatcttctttggaagatcattctctcccagatcttcccggatttccttgtatatgggcacacacacacacaaatgtgtgcagttgtatgtttgcatgtacacacacatgcatgtatagaatagtgctgtcttaggccaggttgcttggagcagagcctgagatggggatttggacgcataggatatactgagagtgggctccgagggaaagggagtaagagaaaaagaagagggcaagaaaagagttgggcaagggttggtttcaactggagcatgaattgcaccacccagatagtttgaccttgagtcaagggagccagcctttgaaccctggtaggtgaattctgggctgccctgggaggtggggggatgggcaagcggcccccattgagctgagaagctgggatgcctaagtaactggaggatgagtgcattgacagtgtccactacagatacacacctatatgttcagatacatatttatacccatatttgcatatatatgcacatattcatatatataaatatatatcatgcaggaatagatccatgcactcacacagtcatatttacatacatgcaaataaacacatgtaactaacacagatccacacacacacattggctcacacaaatctatctcatatgcaattcatcacacattgatcggagataaacattgaatatactctcctgatgtggatggacctcgactctaaggacaagtttgctgcttaggcaaattacaccacggctttggcaaataggcatttggaaaatgtgttcagaaaaatatggtatcactcaaaacccaagcgtaagtgaggagaggatcctgagctgctggggcctattagctcccagcttggacaggtcaaattcgtgtttccaataaagaccagaggtcttttccttgcagctgggttagttttttcaaacctcctgaccatacctcgagattactcacacctgtgcctcacccagttgagaactatctcgtgccgcttagtatcagaatgcttaacttggcatgaagcaggaaaacagcacttggggaagccattggtgggaggcccatcactgccatcgtcagagcacggggtgattcaaggaaaccaggcagctgctattcctttgtctccaaacaccgtgggggttgtctgctgcaacctttggtgagctcctgagctgcagtccattgaggaaggtgacagtatcatttgcaagtttcacctcgctgggtacaggggctttttgcccagataagaaatgcccctaggcaggaggaagagaaacagactgagtagcccaggccagttacttagccagttactaaggcagatggagccctcccaagcccccactcaaacaaaacaaaacaaaataaaacaaaaaaaaagcctctttgctgagaatctctctgcaaagcatgccaacagtttttataactggtttcctatgctcctgggcca

SEQ ID NO: 12274 - DNA, 79988 bp, Human
ttgaacctggggggcagaggttgcaatgaggcgagatcacgccactgcactccagcctgggcgacagagtgaggctcggtctcaaaaaaaaaagaaaaaatctattttctctaacagcctaatgattagtcctctgggcgtgtccctccctcctagtttaatcaccggcccaggcgccctcatttacttgcttccgcggccaccagggccccctgggcaagcagctccgcagagagcccgccggcactcgcggacgcttctaggctgggagcggggaggaaatgtcaccggccccaaactcggccctagggaaggccatccgcgtctatacttctcagtgtccctgtcgtgcgttttccttccaaccccatgcacactcattccaacataaagtcgtggaaacgggcgtgcactgggctgttcccgccgaacaccgggcgcgactcaggctgccggaggcttcccgggcgcggaggctcggcggggtcccctttacgcagcaattccaatgaacaactaaagtccgtacagattttgattggaacagaccctaagactaagagcctggaaagaaaaaggcaaatcacccaataaacgcctgtcttcgcgactctctaacccggtcgtatcgcgagggatccggatattgaaagcccctttgccggaagactcgggcgctgggagaagcccgcatgggacaggctgccccagtgcccgccggctccctagaatcgtgcagctctgaccctttccaacgaggaaaaaatgtttttataaacaatgttttaaaaaaaaccgcacacttttttaaaaagtcagaatctcgctcttgtcgcccaggctggagtgcagtgacgagatcccggctcactgcagccgcgaactcctgggctcaagatttcctcctgcctaaacctctccaatagctgggactacaggtttcctcttgcctcaacctctccagtagctgggactacaggcgtgcaccaccatgcctgtttttaatttttcttttgtaaagacagggtctccctatattgaccaggctggtctcgaacctctgacctcaagctatcgtctcacgtcggcctcccaaatgttgggattacaggcttgagccaccgcgcccggcgataactcacacttttattagtttttcttttcttatctttttttttttctcagttttttatgagggtaacggacggggccagggtcatttatgatttgggatcttggggcagtcaagtttgcaacttcagctcaaaagtcttacgctcggagcgcgcaggctcagcgcgggctgcgagactgcgagtggagggcttgggaagccgcggtcttcgggaaaccgtccacgcggggaaggagaaaggcacggtgggtcctcgggggcactggctctgtggcccgaagtcccgggagcctagtgaggactagacttctttctagtaagagacctgaacgtgccctcccgctgggctgcggacactgggagccgggccggcgggtggcaggacaggcagtaaggtgctcatggggaacactgccccggggagctaccggcctgggccttggccgcgggctggggcggtgcgcgctccccgcaccgcgcgcacactcctgcacacacacctggagcgcgtcccgggggggagggggaggagagccaaaacgagcgtcttaaaatagagagccaggcagaggagcgcgagacaccagagcgggaggcagcgactgagagccgccgggcactaggcgcgcaggtcggcgccggagtggcacgggcgggcgggggcggggtgggcgcggacgcccctcagcacacactccgcacccggccctgcaggaagctcgcgctgattgacagctgcgttgtcccaaaaaggctcagcgaagatgctgatctgcgggtgggtctagacgcgcggcaggcgcgcccgctacccgctctcctccgcgcgccacccgagccccgccgcctccccagctgccgggagcggggcccaggccccgccgtcgcgccagccccgcggccccagcgggccgggcactcgcagccgcgctcgggccggcggacgctcgcgccggctcaccatgcactgccacgccgagctgaggctgagctcgcccggccagctcaaagcagccaggcggcgctacaagactttcatgatcgacgagatcctctccaaggagacctgcgattactttgagaaactttccctctactccgtgtgcccgtcgctggtcgtgcgacccaagcccctgcattcctgtacgggtaagacgctccgctaggggataagtggggttcggtagctttcacgtccgtgtaggtggcctgtgctttgcgatccgagggcgagaggaagggttaagttaagggattcttttcctgcgcctcagcaagcggtgggcattgcaaaggcatctgcgacgtggccgggaaggaccacgcaaggtgtggatggcacgagtggaaataaaggcggcagggccttaggagtgggctgctcgcgcaacgcctgattgtcctgctcggaggagaacgcttcctcgtttcctgctgaaagttcaaacacttgagcaggttcagcgtctaaatcgttgtttcaggaagtggtggtgtgtgtgaatttcaaacttgagcttggcggccttgcatctcaccttgagttaacttgtccagcctcctactgtctccactgtgaattttgcaagtaaatcagtatcctgaggttctcaacaaaatctcgaattcactgagctttgcttacaatgatcgccctctgagaaagtagttctgaagtacattgtctttgtggcacaagccgaaaaggtcaccctcgtttgtcttaagtcaagccgaaaaggtcaccctcgtttgtcttaagtgaccaaaaccagcaatggtaacaatgaaaacattactcacacctggttttctctcttcacgggaggtaagagcaatagtaaagataaagagaacttaatacatatattgaaaacgtagtagagtttctatcgaaaataaatccaaggtacttttaaaattttgaatgcattaagagaagatccaagtttcaaagtatctcggcattgttaggatttaggttatggaacatgggtataataaaacgaaaaagaagtaggagcactttttatcagaaaaaagttattgagtgtgctttccattaaaggtaagcataaagtatttccaaaccaaaagaacctttgagattgttagttgcatgagaggcatgagataaattaaattacacttaaaatgaaaaaatgaagggccaacagttttggaagatattttttggaacatttgagttgttaatgctcaatgcgtggaatcctgtattttctcttggttccattgatagtccctatatgacaatcagtaaacatatgataaatacatacagtgaagttcttttaaaaccaaattgttcctacatgtatttggttgtaaaatgtatactgtattcagttatgcctttttaaagttaatttgtctgtaaggtagaattaggcctgatgtcccataacaagccttgtaatactgaatttttaaaaccaagaaatatatgaaacaaggaacaaataagaaattttagaaacaagatagatctcctgagaactgatatttttacatttgtgtataggtggttgtggacccttggacacatacatactgaataggggtgataagttgaatattgttttgagcacaaatcatcctttgttataataactcaattcccttcgaggaaaaagagaggatctgtttcagtcattaacattgcgtatgggacattcccaggacaaaacagaacaacttctaagcacctaggtagagcctagtgccggcagaattttcagtgactttgtgctgtgttgacttgaaggcagcttttcctggcttataggagtcacagaattggatcatagaagaaaacgtggcagaagaggagtaataaatagctgcagagaatagtcattcagtcagaggtggctgagtaagtgtcgtgttttattgaaccttgtgtgggaaataaatcagaggaaaaaaaaatgattcatatgtagttttgtgagtgttataagtgaaatgcacgtatttcacagacttaagtgttgctcagtcttgtgcttttcgaagttcactgatggttcgtggtagagggtggctgttggcaatggttttctggctccgttattccagtactttcttctttcggattgttagttgaaaatgtgtcgttattttgctctagttgagaattaaaatatagaaactgggatttgctggtggaattaaacccataaaaactggctacaatagttcatactttcagatcataagccttcagtgggtttacagttacagttaaagccttacatgtattagatcatgggaatcccattagtgtcttctcaggggttttgcaaataccatactttcaaagcatttttgtttttaacagttaaggtcaggacaaaaatctttgattagatgaatgtaatcttttttcttattaattaaaaacaacaacaataagttgctggcatcccaaaggacactgtaattttcttcttttcttttctttttcttttttttttttttttttttgctagatggaactaaatgttgagcactggtggtggaagcaatgcataaaaagttcaagtgaaaggcatacattggaattaaagttactgaactttctcagcctttcatttgctgatttaagatttaaagacgtgtaacagaagtgaactgtgtcaggtaaaataatgaaaactaagagaaaaaaaaggcctcaaaattaaaaagttaccagcatgtacaataagtacataaaattgggatggaaagaaaactacagcattaaaaaaaaaaaaaacactgcataatgaaacagttcatgctctgtggatttagtaacctaaaggtcaatttatggtaccaaatatcaggcagaatagcatgtattcaagcaaactgagaaatggaaatagttttcatctcaggcagataatcacctgacaggaatttattgttcgacattctagccttgatggaatcctcaccttccaaaaattgttgtttaacagacgctttcttattataaacacaataattttagtcttggaaagatgtctctaaatttctctcggtttcctagtacgtctcgtaaatcatcctaatagacactgcaaaagggaatcctttccctgtaagcctcaccacagaacggtttatcatcacatttaaactaaaatttaaacagctaagcccaaaagaatgcctccatttgaaaagagttgtgtcattcaggccattggtgaggggtggaatatgcttagaattaagttagtatataaaaagttggttttattcttaaatctgtaaacagtaatccctactcagaaggcagtgtaatgccatttagaaatcagcgatgagctctccaacttcagagcattgaccgtcattacaaaggccaaaagagaggtgcattttaggatatcataaatacacttcatttaggatgctttattttctttttccggttgtgattaatgtttcttggtggaaaagcccacttgaagaaagctggtttcttggggtagaatagtttgtggaagcatcggcgtggtcatttttgaagcctctgcctttctgtctgatctttagaatcaggcagtttctaaatttgaggcgtgttgagaaaaaatggataacttgcttcacaaaaataaggattgttacaattaccctaagggttttcacatgaagatactgataaatgaacctatggtactaattacttttattacaatttttctacttagaacctagaattaccttacatttacacatgcacttttgtggggaggtgagtgtagatacttggacattttacagcctgcgaataggatgagacttttaattattccactaacctataatctaattcttttccccttctctggcagaatgggtctgttgaatctcttacctgtctgatctttggtggttagacctacagagctggagaggctcataaaatcatagatcaatatcctcaagcagaaggtattttttgcaaagtgccagggtcacgtcagtgcttcgttatagtttcagtccactgtatgccactctcctccttgtcatagtactcagaaatcaggaagacttttccaacttggttacacacccgggactaacccgtgcagtcacacccaggggacagtcaaccagccagttagaagggacatttggggaagggtgtttatcttttaggaggtggcatcaagaacattttatcctgtggtggatccaagagaagcaagtcctttggggtagtgtccttgggtgcgtttttatcacaaacattgggtgtcatcccagcaaaaaattaaatgcggtgcaggtatgtatagtgtctcgtttgggagttagggagctggctagtgcttcatggagttagctctggtgactctccaaatctcagcttggtctttttcagtcagagacccaaactcataggatcttaggaacctgagagttggatactggaatgttaatggagaaacataaaccaaggtctgggaaaaatgatcgttatcaacaagcatttgtatttctgccagaggcacataggcttttagtagcaattactcataactgcttctcctgttcccattgtaagggtaaataaatagagggatgcacgggatctgggactcatccagggtcagtatatatttggaactgagctcttttgggatccttaactgttatctcactactcttttgctagagataccaagggattccttaggagtcagttttttttttttttcttccaatagcgggatcttggctcactgcaacctccaccttctgggttcaaatgattctcctgcctcagcctcctgagtagctgggattacaggcgcccatgaccacacccagctaatttttgtatttttagtagagacagggtttcaccatgttggccaggctggtctcgaactcctaatctcgtgatccacccgcctcggcctcccaaagtgctgggattataggcatgagccatcgcgcccgctgtgaagtcggttttaactcatgaatagttcattagcggtgtcttctctggctctgatttttctcaaagcaaatgaaaaaacgattagaaatttcgttcacgggttgaaatgcccctccaaatgtccactgttcactatcatttaattcagtaatttcatgcaacaaatatttatatttgcttggtgatggcattgtcattgagtctattattttgaaacttaatctaactgttgactagcagttagggtgtttaaaaaatccctctcaactacttgtagaaccattgctaagcccttctttgtttgttttgttttgttttgtttgtttgtttgttgttgttttttcctagtgtatgtgagaggcagctcggaattgggataggggaacatctaatacttttgcttactatgtggaattttctctttgaactctacctacagggtgttatcaccagcaaaactgtcaaatcaactttgctacatacaactcaaatgaaactctattatgaggctgatttcctacagatatgtttgttttttgctggttgtatttctggatccaagactgaatttgtgatagaaacatggatagtataaagttgttagttttagcatatcctagaaatcagagtggaaagattaaatgtaacatatcccaaaaatctatatgaaaaggagttaggattgcaaaggattattttatttataaagagagattgaaaggaaaaaaaagaagggaagaaggaaagtaagagtgggtttctttgaaattcttgaggctgcacagattcagcctcatagcacagcattcctccgaagggctgtacaggcaaaacaaagctggcttgtgaaattctgtcgctccatgggtactaaatggctaaagttgattctacttagacgcgtgctggggcctcttcaaggttgagatccagagcttaagctctgcacagcatttagccttcgctctggaagactgagtaaatgttaaaccagaagcaattttaggtgttatttgcactttgttttgaggtcaggtaggaggagcagcagagatgcaaaggtaggtacgtcacatgggctgaggcctcttcatttgtttttgtttttgttttatttttttgaaacaggatcttggtctgttgcccaggctggagtgcagtggggcgatcttggctcactgcaacctctgcttcccgggttcaagcgatcctcccacctcagcctccctagtagctgggactacagacatgtgccaccatgcctggctaatttttgtatttttagtagagacggggtttcaccatgttggacaggctggtctcgaacttctgacctcaggtgatctgcccgctttggcctcctgaagtgctgggattacaggcgtgagccactgcacccagccgaggcctcttaatttgtactgagcttgtgaacgtgcatgctatggagcctgagggtcttccttgccacacgtcctgcccacgactgtagttagcagactagagttggtgggtctatggctaagcccattgacaagctctcagctggaatatggttagagggctgcaaggactcaggtgggatgcataaattaacacctcattttgcatcttctgttggggatgcagttctgttttacactccagtcttgtggaatgggtgtttctagtgtggctctagggacgcactcacagctggattaaccaccttttccccgagaacttgctaaagcccacaggtgctcaaaggatgggcaaaagaccactgtgctgcaggtggcaccctctcttggaagcagcatgacgacgagaagaagagaagcattgagggcattcgtgcaaagactgcaagcgtggagaagcaccttgggcctgcctgtcggtgcctgcctccattttagctgcctgagaggatggaacggtagtttctttccacagcacagatggcaaaatcagaattcacgttaggatttattagtaacgggagtcagaccaggactttgtacaaacttggtggcattcacaaatactctccaggaagagaggtgttttgtttgtttgttttttaaccagaaaacctttgcaaaccctcaggatttaatttatttttattacagcttagtaacagttagaagaaggaaagtcttgttaaaataaatgctctaaataaaaacacagttaattttccattaccatgtctaattactcatcatcaccagggcatttttatatggcaatttaacttcttgaaagtggaaacttggcacacgtttaaggaggaaagccatgcacctagatagatatcagaaggcggtataattatatttgggctcgagttgaatcctacatatgattgctctgaagaagagagaagagagggcctctgtccgtagtcactaaggagagactctggtttcttgagtgccagttgaaattgaatacagagggagagaattctgaagattaggtgatgttcaagtacatctgaaaagggcccctgccagtcaccagttgaagttgatttcagggctagttgagaagtctggagggcagctctgtaagcttcctcctggcagagtgcacacagatgacacagccttcctccatgcacaggtcaaaagacgactgaagagaagccaagctgggaggatctcagcaccaaactaactacgttccatgtacaagcagacacgcttgcaggattcctttttaccgcgtctttccagcttaccaacatgtccttaggaacatattcttctgggtattgaggaaagatgagtattttctgttttttgtttttttgtttgtttgtttttgagacagagtctcgctctgtcactgaggctggagtgtaatggtgcaatctcggctcactgcaggctctgcctcctgggttcaagtgattctcctgccgcaccctaccaagtagctgggattacaggcgtctgccaccatgcccggctaatttttgtatttttagtagagatggagtttcaccatgttggccaggctggtcttaaattcccaaccttgtgatccacctgcctcggcctcccaaagtgctggaagccaccgcacccggccagatgagtattttcacaatgtgcatagaataggattggctgctgcctaggtgatgtcagatcatttctgatctttttttttttttaaaaaaccaacatatgcatttggtaagtgatatgatgcttatcctttggtttttcttattcaaggattacttaccatgtggagaaatggagtggtcttgggcctgatgaaatttcatgaaatagtggctatatttctgtcctgggaagtacctggtactggcaagtccctgatattgataacctgccaacctccactgcccacctttctttcccagagtccttttcactcggtgaattaaccatcactgagactcaggatgatgggcttttcccaaaagaggtcacagtctcgtgtggattgaaggaagtgtaacttccatgcttagtttaagcaatatctaagggagctgactttgcacatttcctaatggtaacttatagacaatggaatgctgatattgcatcttcttatcttgaggaaatatcatgggcaagaagagttgctgagactcctttttctgagtcttacagtacttatccaaggggagccacaaacttgagagaaatgctagaaatactttataccctaaaccatattcatagacagggcaataatagtaatagcgactgtttagaaattacctaacatgtaataggcactagactcagtgctttttgatcagcttcaaaatatccctatgaaataggtttatcatctcctttggtaatggtggaatcctagaagctaaatgactttcctaaagtcacaagatataaagagagctcttatgaagcaataagaaaaatgggcaaaggctacaatcaggcaattcatagaaaggaagatctcaatggccagtaaacatgaaaggatgctcaacctcgctgataagtgggaacacccgaattaatatgagataccatttcacactcactgggtagcccaaaatgaaaggacaaaatcggttgatgacaaggagatggagcaacaggcattctccacactccggcgggagtgctgtatggtacgattattttggagagcaatttggcaacaaatggcaaagctgcagacgcacataccctagggctcagcagttccactcctgggtatgtgcctggagaaaccagtgtatgagtgtaaaaggatacctgtaaaaatgttcacctgtgtgttatgttagtaaaaaataaaaaacaatttagctgtcctttcagaaggaaaaaggttaaaataatatatgctatatccatgcaatgaaattctatgcagcaattaaaataaatgaaccagatacacttgtattaatatggatacattttaggaatacaatgttgagaaaaaaagttgtagattgatacttactgtctgataccatttatttaaatggttgaaaaggcacaaactaatactacatattgtttagagaggcaggggcatgggagtggggagtgctaaccacaggtttttattttcctatgtaatttatttatttattaagacaaaaaggcctaatgtaaatatggctaagtattatgatgtgaagaaacttgggtcatggctacatagaagttaatgacattattctttgtacttttccatatatctgaaatttttcataacatgaagattgaaaagtgatagcacaagagaccgcacatgtccacagaactcttaatcttgtggaacttttgatctttttcttaatagcttttctatcctgaaacagtagcatttaaatacagagcttgttgtacatagtctcacagtgggaaactgagaacactttataactaaacatatgtacaactcacactgaaacaaccactgtggcttctgaaagtggcttttggatcttactaaccttgcctggctgattgagggtattatttatcaccaagataactgctgtttctccagtaatgctttggcatagaataaatagtctctgagttgggtacatgctcttgaaggatgactagtgaagtatttggtcccccagtcgtgcaagagagagttgtcagggtttttctgcttcttcttactgatgtttaaaatcattataaactgcctctgattgcaccttgcttttatgagtatttgttgatatgacaatatactacccttagcatttcaccagtggtcctttgctattgacagtttcatttacagaaattatctaaggacagctgtgattgaaccaaataatctaaaaatgttaacgtgtagcttcttagcaggaaagaataatgttgatattggcatgttattatctgtccaagttctctttatagtccataatcatgatctgattttaaaagtttgttcaatatatggtattggggactgttagaagggatgaatgttaccatggtgatctcacagagatgtctgttaccagcaatcagtgggcatcctattgtttggaggagtaaacctggaccacattttactccctaatgacaaccatagtggcagaaactttattcagcccaacaccaaagacgtttttcttttctcagcaaagtagtcccaatttagaaatgttgctattagacattttggcaaaaacgtggccttttgggagctctatctttctgtgtccttccaaagggaaagtattagtgtggaggaaacagtttgtacaatcaagagtttgccaaagcatttcccttcctgccaccactcctgtctgcctaaacaaatacatagacaaataaacaaattaaagctctggaggggggcctcaccccacccacaggatctgtggccagggtggccagattttctttggtgctaagcacgaggactgtgcccaaactggacgtgatggaaaggatggtggctctatcagtttcattaccagggttcagactttcgcgggttacgggacaaagtccttctgcattttattatacgcagatagtcgcacactctggctgggatcagttaaacagactgacacttttgcttgtgccttactctttcgacctcctggaactctccagtgaaaccttattcctcgtaaaatgaactagccaggcttggggctgtgaatataggaaacattatcaaggaagatattccaaagagctgccgtgggactacataagtcagaaaaaatgcggaggacttcctcctgcaacccaggggagtctgttcacttgcaacaaatctgacagatccacttttgaatcctctgtctggaactacttaggaaaagacaagcaaggatttaggatatttagggtaaattttaaatgtgtttcactgaaagagagagagaggaaggtgttttaatatggttccaatctaagacctttcttttccatgactaaacattttactgaaataattggtaagttaccccagaggagatatttcgggaaggtgttgttaatattgttatccctggatatcatggtaactcattaatgaacctcagcacattagacagctgtggctattggaagcatgttttcaatcatcagttcagagcaaggcatgaaggaacatcctattggagtgcttgcttttttttctactgggagattgggcctttgctggttagaacaatcaggggctaaacagcatatttcatttcttagggaggtgctaaataggagtaacaacaataataaatggcaaccacgtgcccggcactgtgctaggtgcttgtatacataaatgtgttctagtgaaatagttactattaccactgcttttcaggcagggaaagtgaatctcaaggaggttaagaaatgggaacggggtcacacgaataagtggcagggttgagattggaacttgcatctgtctctttcaatatagactccagtactggatatgattatatgaaaatgtgtaaattagaacatgtctgtctcattacatataggcaacatactgtgtgtgtgtgtgtgtgtgtgtgtgtgtagatataaaaaatatatatggtaaggtccaattaatgcatcagctctgttggaacttattttgaacctgccaactcttttacacatatttatactaatttaatgtgtgccagttcgtctttcatttcctgtggtgattggggtttctgaatgattccagagggattccaagaggcggtggggttttgcggggaagggaggtgattgggagattgcagacctgttaccatctggctgtgtgactctccactcctcactgccctggggtctgtgtccgtgtctgtgtagcattcgctaccactctctgggtcacggtgcttccatcagctgtcattctttgaataaagctttcctaggggaatcaagggtggaattcctactcattcattcattatcaactagagagaaagtgctgaacaactaaagccaaccaaatgccttgagagttaacacttcggatatttttcatggaatactcattaggttcagtgagaaaaaatgtctggtcgttgattggcatcacttaaaagaacgagattattttttcacattatatctggctgagctggagtggattctgggaatctctatttttaaaaacctttctgtatgattgcaatgaaaagtcaactctgggaaccacaataatgtagataacagcttaaatatgagattgatgtaatttgcaccccacgactcaaatgtatgaaaccatttagtggagtaatcctactgttggggttttgagtcagacggtcctgggttttattgtattttattgcctgtgtgaccttaggtaaattacttaacttctatgacactcagtttcctcatctgtgaaatgaagataataataatcacataatagggttagttgtggaggttaaatgagataatgtatataaagctctcagtattttattggctgtgtgaccttaggtaaacttaacttctatgacacgtaatttcctcatctgtaaaatgaagataataataatcacatgatagggttagttgtggaggttaaatgagataatgtatataaaactcctagtatagtttgtggtaacaaagtgcttagtatttgatagcttctattaaaaataattatcttacaatagtaacctcatcactgaagtacaaccctttagggaaagattaccattattggtgaattaaacttaagaaaaatttaaatcttgaaaaaccccactttactccagggcatttttctgggttacagcgacactagctgcttttaagaccccttgcaacctgggtggtctgtgaattgtttgagttcaagtcttcatgaattaggtatgtttcattcctcccacttttctgttttgtaatatgaattcagaattttataaattcataaatgagtggcacaaacaggtcagcgctacaacatcacaagatgtgctttgttactttatttttttttttaacaagagtttcctaggattcattgcccctaggaaatgtttcatcacacagctgtaagagtctcaagaactgtcctagaaaagtggcagaatttctcaacacgtttgatttcttttcttctttcaagagtagagttagggatagtcttttttttttttgaaaaaaaaatgaaactattctttttttcttattttcgagcactgagagaggaaaataactccactgagatgttcttttccaattaggtagcatggaaaaaggtagcagtatgacaactaatcactttcctagtatattattgggtctgtgattcagagtgagttccaaatgaagtgcctttgtgacagcttttaaattactggtggggctagcttctgaatgtattctaagtggtaatgatggatggctgtcatgtggaggaactgcctgaggaagagttccatgtggatttttttgggattgtgtttctcagctggtcactagtgtcttatgaagtttagtatctgctggtgaaatactttaattgatgaatcccctccacggtgtgagaagaattctcttgatgaggagttctcaccttctatggtgcaaaggcatcgccagtgaacagggtgatgcctctgtccagccatttataatgatgattccgacaggcaatctctagtggcctcatccaggttctgtggtgggtgggggccaagtgggataagacaggtggatgtgtcatcaccactgagacggagtggcatgtatttatgaagagtgagaaggctgactttgtcccctagggtcctcagaaccatagagtctgagttttctgaattgttgaaaataggactcagtcagagacatggatcgttggcatcttgttgagaatattctattcagcctgtggattcagaaaaacaaaatgcatatgtttgtgttccagtaggaggggagtaggcaggaatggggtgggagtggaaaaggaatgttggccaatggggaagggagagtgaggggtaaggaaacaagttagtccactgaaacagggatccaaatgcttactcagcatttgttgtctccaagagaaaaacaaattgaaaaatgagaatggaagatttcatttggaaatggccctgtgagtacgtgcttattttcagaggcgttccccataactgacagcagtcaatgacttctgattgggcaatggcctggccagccacacaggtagcccaatcatcatatgtattaatggtgcattcaaaaatttcatcatcctgggtcacaaaagatcatgacgactgtattataatacaataatggtattcatgcagtggcgcacagaaaattgtgtgtacttgacgcacaggcggtgtggaagcaggatttaaagtagaactcctgtcaaaaacctttcctccagagcctccactgcctcattctgtgatgtttcaatacgtcagtttctgctgttggtaaaacacatcttacctccccagtatgttggggagcagtgattgatgaaggaggattaatttgctgcttttcgggagggactccgtgcagtctccaggggattacatgtattatggtgtttccacagaaagctagaccagggattggctaaatctggcccactacgaattgttctactaccacaagctaaggatggttttcacattcgtaaaccgaggaaaagaaatcaaaagcggaacatttcgtgacctgtgaaaattatgtgaaattcagacatcagtgtccgtacataaaaatgttattggaacacagcacatgcaccagtctgcgtgttgtctgtggcagctttcatgctgtcacagtggagggagaggttgtgacagacacagcatggcccataaagcctaaaatattgacttgctggccctttacaaggaaggttcgccaacccttccactagactgttggaagcagagctcctcagttacgaaataaggtttttactgatccataaactatgatgtcattccagggcacaaaaatacctcctttgatccagggttctgttgtcatcctgtgacacgagaaagacccgacagtgggagtttagtggggaattttgcaaggactctcttaaagtgagatcaggctctgggctttaaggataaatttccagacctttctagaagtaacacaggattttctgcacggagaggggggtcaaaaatatttatagtaaagtggtagaattcaacaaagtatttttgggactttctctttgctgctgcagccccgaccggttttcccagggggaatctgaggatggcccctgaggagaggctgggcgtgtcagcatcactggcatttttcagtttgagatttggatgacagtttatatgcttcttaattgactttaacctgctgcccatccctagaagtaatagtaatggtaataaaagttacacaatcacatcgccacagctctgtcctgaagggcttgcatagctggatggagcacttaattgggatggtccactctgctggggaagtgcaggagactatgtgcctttggaattttcaactcttcagggtcaggaactgccagacctctcaggaaggatgaagcacgactctctctagttgctctcttatttacattgaggcccttgggtcagggtgaggctttgcgtctccaaggtagcctttgagctaatgaaacccactgtggggtgagagatgcgaaattaacctgatttgctgcaacttcctgtgcactgtcgggcttaccagccagtaggctgaagaacccttgagatctggcccttaccataaaatggagaggagtgtgcacaagtgcaaggtcgattaatgtcagaggagatgactgatgttggtaggtaaaattccacttccaagaaaagtatgtgtggtacaggtgacacctgattttcttactccaaatcacagatgatgttgaaaaaacaataataataacaatacacacacataacaggaaacactggtataatactatgtgccaggaactgctctgaatgctcttatatgaattgactttttttttgtttgattcttgttttttgagacagagtctcgctctgttgcccagtctggagggcagtggtatgatctcggcccactgcagcctctctttcctgggtgcaagcaattcttgggcctcagcctcctgagtagctgggatacagatgcgtgccaccgtgcccagctaattttttgtattttagtagagacggggtcttgtcatgttgcccaggctggtcttgaactcttggcctcaagcgatccacttgcctcagcctcccaaagtgctgagattagaggtgtgagccactgcgcccggctaacttgtttaattataccacagtcatatgaggagatactattattattctcatttgacaggtaaagagacagatagaaggccagaaatggttgttcatgcctgtaatcctaggactgtgagaggccaagacaggaggatcatttgagcccaggaatttgagaccagcctgggcaacatggagagatcttgtctctactgaaaataaaaattaaaaaaaattagctgagaccagaggattgcttgagcccaggagttcaaggctgcagtgagctatgattgcatcactgcattccagcctaggcaacagaggaaaatcctatatctaaaaacaacagcaacaaaaagagcggaggaacagaagacaaatccggtcctgatcaccctttgggaactctattgtctaatgtggcttagactcaagaatttcttattttgaaaagtatggtgctgggtacagagtagatagatcctcagtaatgctttctaaaaatattaaatattaaatatttaaatattttctgattttctattattactgatttgattttcctcatctagttctttctttgtaggccatataaaactatccctagaatgattaggatatcctttttttttttttcctggagcagtaaagttcttacatagctgaagttctagggaatgtattagtgtccaaatttgcaaagtgagttaatgacagggacacagttcaatattttatccacaaccttaggaactattccagaatggctatgatttaaatgaattttatcttactgttaatatttttaaaaattaaatattgagtaaggaaaatgtttataaaatatatgtatgataaaaagaatagtaatacaatgaacacttgtgtctacccaccacccagtttaagaaaaatatttcagctagacagggtggctcatgcctataatttcaacactttgggaggctgaggcaggaggattgcttgcggccaggattgagaccagcctgggcaacatagtgagacctcatccctataaaacatttaagaaataaatttaaacaaaagaaaaagaacatttcttctgggttgcctgggttcccctccctgatgctgtctgcgtctctcccccattagaggtcaccagtatttcagttctcagcttttctctgtagttttgccatgtgttatccctaaatcatatgttgttgagctttggtcatttttgaactttatatagatggaatcacactatactttttgtgacttgcttttttctcatagcattgcatttcccagattcctctctgctgttgtgtgtacctacggttcactcattttcattgatagagtgtccagtgtgtacataaaccatactgtttatctgttttgttgatgggctttgcggttgtttttgctgctttgaacatgcttgttaaattcctttttagaaaactaatgatcaggaggactcacttaagtgaaatagtttttctatgagaaaaacagttctacagtttaatgaaaattgtaatatctgcgccttgaacaaacagatgtagtttttattttaggacgcatgctaactacctatgaagtgggtttatttttagtggcttttttttggttaaatttttttccccagagttgaacaatgatttattttaatttctaaaccaaatcaaggcatttattgtaaaaccactagaaaataagtcttcccaatttaacagcatatgttttataaatattttaataaaatgaattttaaaatattaaataattttagttagaatgtgaagtacttctctaaattaaacattaataaagctttttcatccagagcaacaaaagaattgcattatataggtaaaatggcctctgccctactcacatttatttgcggactggaaaagtaatgtttatttctaacatatttttagcttcaaaagactttagaaaccttttgaaataatctgcagagctgtgcaaaggcaccgaggtttaggacaggcaggaagctatagtccactcagcattttttttttttttttgactggaaagaaaaccaaagcccagagtaattaaattgctcaaccaagatcactcggaggcttgcaatgcctttgaaatacaatgactctaaactagctatatgaatctgtactaccatttctaaattagaagccacaagttgctttttataataatatatattttgttgcttctgtgcatcttaatttattttatataatttaaaaaacaaagtcactaatcaaatccataatgacagtttgggatttgatttttaaaatgcttttctctaccctgttgactgtgccgagcctagagagtctatttagttcccgtaggctggtttctgggattgacaatatttccattgtcatacaactctgctgtcgccagtgatgttcgaggaccagcactacccttgaaggatcctgctgttgtgtcaacaaataatggcacaggcctctctgacagcttgtccacaaactctcctgagggtttctgtctgaaggaagcagcagctttgcaagagtgattttagtgaggtcgtttggattagattgagttagtgggccgtgagttccgtgcatttagggttgtgtgtgaggcttttcgtgttcttgaaatctcctccggccctcccggtcacacccctccagtgccacgttcagccctctctctctgcacccatcctgaaatagccatggttcagcatggaagaaatccactcctctcatctctcagtgctggtcagctccgcatttgcctgggggtgggttttgactgtcttctccttaaagagaatctctgcacgtgtaaaatctgtttcaggaaagtaataggaaggcagcaggacttggagcctgatggtgtggattcagcttccagttctgccgctcactgggtgacctgggcaggctgctcatggtgaaatgggtatagcgacacccgtgctcagggtttgctatagagattgagcgcagtctcctgaatctcgtgtggacaaaagatttcacctctgaaaaatatagaatcttagatgtttctgtctgtttctacagcagaaagccaggaaacacaatctgcaagaagctaggggtgtaataataaccaccagatccatccgtcagctgccctctctctgtgtgctccggtagcaccggcttatttaatgcatgacatcgactgtctctcccgtggggctctgagcttccttccagcaaagactgttccttcatcttggggcccctcacaccagcatacatttttgcacttagtagatggtcaaaatagtacggttttgaaccttactaaactgctcgtgtttctttacagcacttttcttctcttacttgatgtaggtaatatgttttctcttacttgacgtctccctgccctgggatttagggatcgccttggccccacacctgtggctttctgatattgccactcctccccactcacctttttttttttttgtctaagtatttataatatgcagtttgtcacacctagctagtagactatattttctgcagtgatctcttccagcttgggaattcttaaattaaaggatttatttgtaggtagtaaacagtctactttttaagaaaactctctaagttcatattgtctgtacttcatcatgagggataatggttcatttcaagttaatctacacgactcaagtgtaacccatgtggtgggtggggggacggggtgaggtggcagctgttcaacagtgcatagcaactcttcacaacagtttaaacatgaaaaaggaattggagtaatagaatatgctggaatttgatgaggacactgagagctacaggacgtgggatttgaacttgcagctgtagacaatgactgtgtctcctagaacccctgaactcttttgccccaagatgccccagaagaaagactggtggagttaccagctcatggattttacatcctatctattctcacacacaaatgaactcccataaagtagaggctgagtagttcttgtcaccttagtgtcccataaagctgatgataagaataactagaaaacctttaaaaacttacaaggctgggcacggtggctcacatctgtaatcccaacactttgggaggctgaagcaggaggattgcttgagcctgggaattcaagaccaccctgggcaacatagtgagacatcatctctacaaaaaatcaaaagttagccgggcgtggtggtatgtgcctgtagtcccagctccttgggaggctaaatggggaggatctcttgaacctggaagttccagactgcagtgagctgtggtcatgccattgcactcagcttgggtggacagagaccctgtctccaaaaaaaaaaaaaaaattcagagatgaaaagtgctaagaaactgaagtaattaacagtgctgacccatttgaaataaaattattcatgagctcacttgcctctttttgtgcacaggagattgtataggtggctatgattatttttataaaaaattggattctaaacaagtttatcaaatacttagtatccaccttaaaagctttcacgaattaaatttaacccttaaatgatgcagtgatccgcactgaactttctgattaaaacaaaggaaagctaacaacacttatcgtttcaactagagttcgttaaaaaaatattgtggaccatttacgcaccaggcgctatgtgaagactgcacagatgatggtgatgtgagcgtcagagcccctgccctcgttcttgtgggaggcacagatgagtaaatacgcagttaccagaatcatacgaccaattccatgatgggggaaggtgggtgtgctgagggacacctaactgagactgagacttggccgagcagttggtgagggcccagggagggcagcctctaagttgagacctacaagatgaaaaggaaggccgagaggaatgatctagcagaggcagaacatttctgaaatgagttctttttctgaacactatgttgaatacagctgaacattttctgatggttgaggatctcatgaccttcagggtaattgtttttatcaccaatctttagctatctagtgctgtggatgtcactgtataagatgtagtaggctattactgataacacgatctcaactgcatctttagaagttgcatttttaaaatgaacctgtgtaaactcaacctaatacttgtataatggaagcatgatgcagactgtgatggtgacttgggtgtttctgtagttacgtggttttggacttactgttgctccatacgtttatagctgttttgttttcttctcttcatcattgctgccttggagggtcagagtatgatccatgtgtcttgatgaaattaggtagggctttgtgttttaccaggaaaagaggctcactcgattaggctgggtttacttctagttttgtaatgcgcccctggagtagcatggatgagttgtttcacttcttttgaactctgtttctctttttggacagagatatcatgctaattgctgaagtgcctgaagattcttaaatatcaaataagacacttaggaaaacaccagatatgattatgtgtaaaatttgcctattccaagcacatgctcaataaatatttgctgaagtaattctaattgagagtttaaacattcacagttcatggcaaagcattggaatagttgcaacaggtgaactaaaaaataaatcttgttgctgttcccattggaaatttagaaccctgtgtttgagtattttcgattctggttcatccatcatttggttagctaggtttatcaaaattctgcatgggaggtcaggaaatgtgttagctcactttgtgtagaacacagttcagcattgttagtaaaagctaagtttgatttagttccagtagttggcttaatagaaccttaggagaaccaactagctaagcagggcagtgagagaagggatctacgtggctgtgtttgcttgacctcaaaagcctggggataactgtgttttgttcctttataatacagttgctcagagaaagtcatgctgtactctttacctccatgagcaccattctggaattgcagttcaacgtagggatattttcagcaagggaaaaagcataaacacttttctcaatgttcaaggaacatcatgacagactacctatatgatggtcccctgggtcagctcagattggcccaatggattagcctgtcagtggaatattgaattcataatatttagaacttcagtattgtaggctctctgggagtgcagttaattaggcagcttcttaattggattgctgttcttatgggaagaccttcatattgaccagagaggcaaagtgggatgacaagtcgtctggaatgtcaacagagcaagtttgactttaggttggctgctgctttctgcttctcttgaatctagagaccttctctctctctctacctctctgtctctctctctctctttttaaacaagatgaggtctcagtatgttatccgggctggtcttgaactctgtggcccaagcaatcctcctgtctcagcctctccagcagctaggattgacacaggacaggtgagccccagaattggggcttagtctgggcaggttcttggctttgcccagaaaagaattcaagggtgagctggtggtgttagatagcagcttttattgaagtggcagtgtacagcagcagcagagggacggctccctgcagagcaaggctaccccataagcagtgtgcccagaatagcagctcaggggcagttctacagtcacttatacccccttttaattatatgtaaattaagggtgatttatgcagacatttctaggaaaagggtagtaacttacaagtcattgggtcattgccatggaaaggggtggtaccttctgggtgctgcctggcaatggtaaactgacctggcacactagtggtcatgtcttatgggaagctgcctcccaccccagacctgttttagctagtcctcaacttggtctgatgtccaacttccacctgtggtgtctgagccctgcctctggcctcgagtccaacctcctacctcaggattccaggtgtgcatcaccatgcccagctgagacttggtcgttgattagaaccgtagacctttagagccaaagggtacttatgactgcttatctagtgagcaccttcatttgggagaggagaagtagaagtttaactcagctctgaaaacattcgttgagtgcttactttttgccaggttgagaggttgagggagcagctataatgatgcattatcctctcaaagagttcctgagtagtaaaggggtacaaacatattagaagtcaatttaaataccctgggcggtgctgtgaaaaaggtaataagcatggcggcaccatgggaccatgaaggaagtgggacttagcccagtctgtaggggaggctggggaagatcttctggatgagaaaacctaagctgaatcttaaaggataaatgagagttaaccaggagaacgagacttctggagtgaggctttggacattctgagaagaggggaaaatgtgaccaaagataaagtggctggaaacagatagtatgtgtctgggaactaagggtaggccaatattaatagaatgtaaagtatacattctatactcaagaaggcttgtgccgtggagattttattctgtaggctctggggaatcactgaatgggtttaagcaagagaataacataattggatttgggtttggggagaatcattgtggaggatgacgttgacagggataagattgaaggcaggagagcctgttgggaggcttctgccatcatccaggcaagagatgacccagggcggtggcaggcgtgggtcaaggatggagcagagggactcccagcatataatgggcaggagaaaattaggtgtctaagcaaaagcctacccagagagataaagaaagattagaaaagagagtcaagaagagaatttccagaggaacaagtgatcagctgtgttaaaggcagctgaaggatccaatgagataaagactgaaaagtggtcagagccgtgctccttaaaatgtgattcatgggccagcagtaccagtgatatctgggaacttgttaggagtgcaagatcctgctcttcactaagaaacatattctggatataaaaatggttgttgatgaccctgacattatcatcttcattggcatggttgagatagaatcaacattgcagtaaatttaggagttaatgggaaatgagacggtggaaataatatagtcttgcaagaaacttggctaaggtaggaaagagagaaattgttagagatggatataagttaagacatagttttagtatggcagagacttgaccacctgttttttagcttaaagcaaagtatagacagtttgaggtttatgaggaagttggataatgggtgatagtgagtcctggaggaaaccagaggggttggaaaataggtaaagtggctttatttctttaaattattttttaaaaattttagacttcaataatttaatcatgcaattttgtggttagaaagaggttgtagtgactataaattgacataggatatgtagacacaagatcagaaagagcaactaactccagcctgcagtttacacacagtggcttctgcaaggttgatccatttggccaaagttgtccatagcaccttgtaggtagagacttgtgataagtggatcaagcattcaaagaagccgggcacggtggctcacacctgtaattccagcactttgggaggctgaggcgggcagatcacttgaggtcaggagttggagaccagcctggccaacatggtgaaaccccgtctctgcgaaaaatacaaaaattagccaggtgtggtggcagacacctataattccagctacttcagaggctgaggtgagagaatcgcttgaacccagaaggcagaggttgtagtgagccaagattgcaccattgcactacggcctgggcaacagagcaagactctgtctcaaaaaaaaaaaaaagcattcaaagaaatgaaggccaacttccagaacatgtggttgacagtggtttttttttttttcagataaaataaatatgcaaaagacataaatatccttacatagaagtgtatgaacaaatataaatcatcgtagtgtatgggatgaggtgaaatgactgccattttagaggtgtgaagcttggctttccatccaactatgtgtctcagggtttccttaagaggcatcgctgtataccagcagaagcctgcagctttgggggcacagacctggcttgaattctcagtcccttacttcttagcatgttagcttgggcacattgcttagacacactgagcatttgtttccccattccaaaaaaaaaaggcatactcactacacaggattgttatgatgactaaaagacaaagtgtgcatgtaaactgtcagggatatcatactattataggcctgataagcatccaacagctgtttgaatgcataaatgagtgagtgaatgtaaaaatcagtgcatgactaggcaggccgtttaatattcaaatgtcactgtttccccatctgtaaaaaaaagggctaataatggtgccctttcatttatagtattttatacagagaaaaatgagctattcatgaaaatgctgttaatgaaatttaatgtttcagaaattaaagcaatcaatccactattttgtaaatactggggagacttcagtggtcagaggattaactggttggttaactctctttgtctcaggttcccagcagatcctctaaaggagaaatcagtgaattaatcactcagtcaacaactgctacttgaatgcctaagctatggaagatgccattgtagacacagagggagatccaaaccaaacaacaacaaaaaccctgggagtccttgtcctcaaggagcttaaagtctatcataacataagacattccaggaaggaagtgattcaggccaagtgaggagccaaacagcacacagtgaagaaggtattcagatgaggagaatggtatttgcaaatcaactctatatgcaaatgcatatttggagaagtaggcatgtagtaagaccaggtggaatactaatggtgtccttgaaagaaggctcagctgtcctcgtgttgcaatggcctcacctgcggctctgctgctttacagagctcccagctcaagtgggtttttccagcccctttgggttccccagtcaggtggccactgtcagtcatttactttgaaattgtttcttctactgcactcctaattgcttataaaataggtggtggaagaaattgaagtggatatattagggcagtgttgcaaacttaatttttatcatggggatgagatggccttgcactggctcatatttaaaggcttgtgtgaaatctagatgtctctgcatgttattcctagttcctccaggaggctgctactggtttctcagccttcaggagaggcagcctttactcttgcaccaccattttccaacataccgtaggccacagtccccactcggcactctgggagtgtttccccagctagaggtggtggtgccccgcttccccttatgactgtccattttacgtttgccatacaactggctggcatttcctactatagattttatgtggaatttccagtgcctggatgggaaaacagtaacttagccctcatcctgcttcttgctgaaatagtctttggttgctttcattacaattggagtttggatcacatggcaaattgtattttttaaatattttttagagacaggatctcattctgttgcccaggctggagtacagtggtgtgatcatagcttactgcagtcttgaactcctgggctcaagtgaccctcctgccttagcctcctgagtagatagatgggactacagatgtgtgctgccatgcccagctaatttttaagatttatctcagagacagggtcttgctatgttgcccaggctaactagtacttttctgaaaggcacagaaaggtcagcaggtataaggacaccaccagaacaagggtttggagtcctgcactggaaatccactctaatgaatgattctatcaaagatttcatgaaaaataatccagtatctatgttgtcctgaaattttcaacaaggaccactgtggagacccatacctacacacattgctgcactcattgctacacccatacctacacacattgctacacagccattttggtcacggttctgaatgacgttgccacgtcctgaagaaaaccccagtcagcttggagagggcagcgagggaggctgcaggctgacggggtgaacagtgcaccatccacagattacaagggcatgcctgtctcatgcgccaaccaaaatgatggtgggactcagtatcactccatgtgacacttatcaccttgctttgggtgattagaaccaattaagagggtgacacatagcagagatggagaaagaaaacacaagggcatcagtttttccccttttgcccaagagagaaagcaagtgtctgccatctgcccacttcctaagtccactttcaaattgctggataacctttagtttgtcagttgacctttccgggcttttccctgcctcccacttggttgataaaacaacagtgatgttacctgttctgcgagagtaatgttggctaataagcctggtgggaaattcttttctcttctgagggccttgctgttatttcatgtttcattcccaggaagacacaaagcctgtccatttggtgtgagcagtgaatggaggattccgacaggtgcccttgcaagcttcctggtggaggagccattccgagggcatcagtcttgttttgatcttttctcagatggaagacttgaatggagcactctctcagcctgtttagggggctctttgatcttgctgtgcctaataggcagaactctcctctctttttcctctgaggacaaaaataaacatagatgctgagtttgtgaacagctgcataaacaatgcaatttggaagtatgcaaaaatatgtgggttatatatacatccatacgtatagcctcttgatctgacttttgcatccttgtgaccaccgcttgatctgagagacatttccatctgatgcaatgatatccagtcccttttaatgctccaagggatttaaggcctcagagcatttggacagaagcatttctttcctctggatgtggctcaattctgggatatcccgactacagcacaataaaataactctccttaatgtgccaagagtaggctactcacactcttgagggtagttgacttgggttaattttctagaaggggtgatgatagagtttgcaagtctgaaaccaaactcatcacctttctgctaccgctgcctcctagggaaccctttcttttgacatccatccctatttatttaatgggatccccatttgtcccctcacataggcatggggctccaagtaccctttatttatctccttcactccttacctctgattagtctttataaactatagttcttttttgtttatttcttcattgatacttttagttcaggccattattaccagcactagtattgtggcagttccataactgacaatataactttacactttaagatgatagataaaatgtgattgtttggggaatacagatgacagaacagagagtactgacatatcctttaggctctcgggagaacatagaagaaatgatgactttcaataggcaaaaatggtttaaagtttagaaattctattttgcattctgaccctagtctccacgtcatgcatggttttgtatttgtgcctctgttgcgatgtcccctctgcctagaatgcttgcaattctttcttctaccaatcagagttatctctgttactcagagtccagatcatgtaccatctccttccctgaccactccaggcagaagtatttgctcttgctgctgatttctagaatgcttatattctttagtccacatttaagtgattgtcttgctttataggtacctatgtatgttacttatctatctcattactagattatgaattcctggacaaagaggtttttttcttaaacatatttgttacctactgagcatagcacagtgcctcgcctatggtaactctaaatcaatatttaaaaaataataaatggatggtactaaatcatgataaacacacattcatctgaaattccttgtgcccattgttttaaacaaacatttaaggagctcttcattcataaaagtcacacaaatctcatttaattcttacagtaatcctacagcaagtttcttttgtctttattacttttgtcttcattttcacagtttagaaaaatggctcaaagagattaattccttcagggctacccaacttggtagtagcagagtctaaacacaaattcaggtctacccgacaccagagtgcacactcatattcccgggctgtattgttccttgggtgacctatgtagagatacaaggtgaataaggcacagttccagcttctaaggagcctccagctagtggggagacagatgtgcaagcaacagttgtattgcagtaacatagctagtgtaggagaggtggctgctgtgacagtgcttggggaggtggaggagggaggacactgcaggcacctcccaaggctctgctctctgagaagggaccctgaaggaggtggaccccccagtcctgggctaaccagcctcaacggtgattgagttcataactgcctctttagttcagttgagcctgcatgtcatggcaaactaggacatcgaccctcagtttttggattcacatgaaataattgatgatgatgatgttgatgatgacagaatgggagcaaagggaccactggagtaattaaagaactggttttataggaatattttaaaaatcaggttaaaaaaatgcaactgtgactttcttctgttttcaagtatccaacccatggagttggaagcacttagtgggcagctaattaataaagctgacagtggtctactttatatcctactacgggaaggatattctaggatatgttgggcacacacctctgctcttgcgtatattccagtatagactctaagtcctacagcttgcgaatgggacctcagaagtcacttgtttaacctcctgcatgctgtagagccttcacccacagagcctcagagcctccatggtggtctcagtctctgcttgaatacggctggtggagaggacagcttcctataaccctactcagtcacatcagaccaaactcctacatcttcatgtaacacatttgagaaacctcagttgagcacctgttttgcgtatgatgctatttactagtgatacaagttgaagaagacacagctttccctcattaggggctcatttagttctattagcaattccttagatgacgttgtttccaaacccatccctgctctcaataccctcttttgcagagttacaggtcatttaaaacctgacttcaaaattggacataacactttatgcacagtctatgctttgcacttctgttgagacttgcgctaggatcagcccaaatcccatgttttactcatccccacttcacagacagctgtgaaatcagatgtttttcatattatacttattagtggataatacagttcagtaaactttgagtacctactaaatatgcagcactctactaaatgttgtctcgaaaatatgattctggactaagatgcagtttttggattcaagttcagtccagtaggaaagacatgcataaacagaaattatccatacagtgtggtaggggtgtgataaaaatgcatgcaagatgctcatcaaacacggaggaaaggctcttacccctcacttgcagtggaggagggtgtggatggggtcagagaagcaccctggaggatttggcgcctctgttaaaggttggagcacaggctgggcgcggtggctcacacctgtaatcccagcactttgggaggccaaggcgggccgatcatgaggtaaggagattgagacagagccagactccgtctcaaaaaaaaaaaaaaaaaaaaaaaaaaagttggagcacagatgaaagctaaccaagtgaagaaggagaagcgggcaaacagaacaacctctgcaggagtatggcatggaaaggcctggggcatttgggggactgacagaaggactagaacaatacatttggtgattagagaagaagctaaagagattggattcctgaaagccactggaagatatattcggttctgttgatgttagtccattttaagctttaaaaatcccgatgatgtcatgcaatacattactttttttgtgacatgagatttgatagaataccttttttgtttctagacacattttagtaaaaatttagtaaaaatattgaaaaaggaataataaaacaaggaccacagcccctcacaggccctagaagatagccattaatcaacccgcacagggatgcttagctcacagtgcgtcggttttgttcctgcatgacctggccctgcctgtctcttcactgtgcttcatccacatcctctttgctgttcctagaacataagcttttccgtgtttctggctcttaacctatgttgttccactctctggaacactctctggctggtgcttttcagcctttcgatttcttctgaaatgtctcctctttggagactatctcggcctccccaccctcagcctcccccatacatgctccatcactgaagcctgtttattcctttcatggtacagtatttaccccaagtcatgattaaatatctgtttatatatttctttattggattatttgtttatttttctctctctagactgcaagctccttgagcagaccatgtttattttgtctaccacaggtgctcaataaatatttttgactatttattacatgagaaggtttccatgcaaacacccattgaatacgattgaacttgaaccctaagagatgggctgtgacctttgttgccctcaaactaatcaaaggggagtgatattcaccatccagaatctagaataacttagaccttgtgggccaggagctagctacccatatgataatacaagagctctcagagaaatcatggaagttttgagcaatctctctctccctttgctaatttacttttcaaaactgaagtataatggaataacttccccacctctcaaatgtcagcatgctctgaaatttcatgttctctcaggcgagcgattcatgttttccatcccacccaccgttctctgccttgtgtttaaggatgtgagtgatagtctatctactagtctaggatgctactgaaaagtaaagcaaccaaatacttgcttttagtgaattcttcagtgtgttttttttaagggctcaagcacaatttttaaacggtctgttctaggatctctatcatcccccaccacatacacattccccccaccctccaggggcttggtaaccaagctgactaaaccataggcttgtttctcttttatgaaacaggaacatcttttagatgacgtggtgaaaagtgaatatatttgatgggataattgctgtccattcaccatttttaggattgataactttggaagagctggtaaaggttaagttctgccttagagaaacttttaccagtagctgttcttttattgtgcttttattgtgatatcaaaagtgcacgtggcctggtttgattttttcccctctttgcaaacttttaggacttgatttccatcctgtttcctgaaactttaaaatgatctgcattttggtgagtcttttttcattcattgttaagatggccaattcatcttattcacctgcagttaagaaatattctgttatagtcttttatttataatttcctccattattttttcttggaatttctaccaattggatattacaagtcctaggttgatccactaattttcttatctttctcttcccatttctctactttgtattctgactctgtgtcctatcttagaaccttgacttaacttatatgggccttaatagcctcatctataaaatggaattattgatggtacctttttacaaagatcaaatgtcaatgtacatttacaaatgaatagaaaatgtttatggaacagtacctagtgttgttaatattactttctacagatttgtctttgctctactattgttaatattatattctatatccttgcgttttaatctattttttattttttcctcaatttgatcttccagctgtcttctactttgaaaattcagctatcatatttttattttccaaaagttatttcttgttctcgaattgtttcctttttgaaatcacatactatttcctggatacagtattttttctcatctctctgaggatgttaatgacagctttctttataagtttttcttctaccccctgaattccctctgattatgccagtttccttttttccacctgtttgtttgatttctgtctttcatgtttgaggctttcctcagatgtttagtgacttgggccgtctctttatctgcaggaatgaagctctgagacactgaatgggaggggtgtgtggggctgtgtgtacatgaatgaatatgtgcacaccctgtgggccagcaggcctccctatagggtccaggcagggagcaagctgttagttgggagcctataaacaccagagccagtaggtcatttacggtggccatttggtttcactggagaagaatcccccagttttctgccagcaggtggggtgaagatacatgtctgcttctgggattgagagggttgagtcacagcagggttcaccccacagttctgcacacagccatccattaaactctctgccctctgctgtgcctgactctgcctggtccagaccctcttcagatcctgaactattgagatcatgttctcctcacagtatacacggtgcagccacagtatagccaagcccaaattataacaagattgtttccaagtacattcttagacaggcttgaaataggtctgtaatacacagatgtcccagtctctctgttggtgctatggtgacactctatgtggagcagagtgtttaaagaatagcagagtgggccgggcccagtggctcacgcctgtaatcccagcactttgggaggccgaggcgggtggatcacgaggtcaagagttcgagaccatcctggctaatatggtgaaaccccgtctctactaaaaatacaaaaaattagccgggcgtggtggcagatgcctgtagtcccagctactcgggaggctgaggcaggagaatggcgtgaatccgggaagcagagcttgcagtgagctgagatcgtgccactgcactccagcctgggtgacagagtgagactccatctccaaaaaaaaaaaaaaaaaaaagaattaaaagactagcagagtggatattactgaaaataatacggacatgaagaagttatgctcagcaaatagcactttcaggggagctttgcttacatggcaattctgtaagtgaattgcgggctcatgggctggatgatatcaggaagaaaatagtaagaatcgggatgaagcccatgtaaaggaaagttagagaaaaagggtttacatacccaaagacagaagcactgagagacttcattatagtctgcaacttgccaattagcaagtcaagaagaatttgttgacttttgatgtgtgctgggagctgagctacttctcagctctggccacacggcagaatcaccaggcccggccacaggccaattaaattagaatctctgcgggtggggcctcagcattaatattttttaaaggctcacaaggtcttttgaattgcagctgggatcgagactcataggaatggcgcctctctggaagagcatcagatagaaaataggactcctgtcctttcgaggaactcggttggagcttgaaatttaacatgcaaaatttaagcaacatataaagtgtttataagtgccaaagaagtagtttatggccgggcacggtggctcacacctgtaatcccagcactttgggaggccgaggcaggcagatcacaaggtcaggagattgacaccatcctggctaacatggtgaaaccccgtctctactaaaaacacaaaaagttagccgggcatggtggcgggcgcctgtagtcccagctactcgggaggctgaggcaggagaacggcgtgaacctgggaggcggagcttgcagtgaaccgagatcgcgtcactgcactccagcctgggctacagggcgagaatccatctcaaaaaaaaaaaacaaacaaaaaaagaagtagtttataaaatataggtagatgattttgaatagggagttactttggtacttggaatgtttatgattcaggacaggcaagaccccaaattgggactaagcctgggagggttctcggctttgcctaggaaagaattcaagggcaaggcagtggtattaaacagcaacgattattgaaacagcagtgtacagcagcaacagaggtcctgctccttgcagagcaggcagtgtgcccagagcagcagctcaaaggcagtctgcactcacattgatacccacttttaattatatgcaaattaaggggcaatttatgcagaaatttctaggaagagggcggtaacttctgggtcatctggtcattgctgtggaaaggggtggtaacgtctagctgttgccatggcaatggaaaacacgtggcacacactggtgggtgtgtcttatggaaagctgcttctgtctcggccctgttgcagctagtcctcactttggtcctgtatccaggtcccacctcttacctcagttagggactattaattgagtgccaatgatgtgtctggccctaaaataagttctgaagaggttcagagaataatacacagtatatgttctcaagaaacttctattttaggtagaggaaaaccaaaatataaagcttaaaaagaaccggagagctatttgatgctaaattatgtttggaaacttacgtgcagtgggagtttgaagaggaattcttaggtatgtttggaaaaagtttctagctgtaggtagaatttgagttttgccttaaagaactgcaaataattcatttaatttagtaatttaaaaagtgaataatgggtacatgctacttcccaggcaccgtgctaagcatttacatgaattatcttattctcgtaatatatttttgagctatgcattattattatctcttttcaacaggtagaaaaaccaaggcttatcaaacttaaaggaatttgtcaaaagccacgcaagttactaagtggtgaagccaaactcaaaagcagagctgtatggctcttgagctgggcttgtaaccactatctgtaggaccagagtcggcagcagagagaggccagagcgtggcaaatgtatttcttgaatactgagtaagtggcaggttatgctgagtagatatttggttggaaaggtgaattggggcccagttcaatttgtcaggggtcttgactaccatttcatggaatttaactttattttctggacgctggagagtccagaaggtttttgaggcaggggatacaatgttggaaagcattttctaggaaaccgtaaaggccggagataggggaaccaggtaaaaagatatctcagtggtcaaggcatgaagcttaggggcctgagagaggcgggtggaacggaaaatggtggggaaaggtgtcatcggcaccttggagaagaatcttctttatttctagagacagcagggatgtgagaatggacagtaggccgggcgcagtggctcacgcctgtaatcccagcactttgggaggccgaggcaggcggatcacgaggtcaggagatcgagacaatcctggctaacacggtgaaaacccgtctctactaaatacaaaaacaaaaattagccgggcgtggtggcgggcgcctgtattcccagctactggggaggctgaggcaggagaatggcatgaacctgggaggcagagcttgcagtgagccgagatcgcgccactgcactccagcctgggaggcagacggagactccatctcaaaaaaaaaaaagagagagcggacagtaatagctcggggattatttaggtttgatatcagtttgaacttccttacattaccgtgaggaagggaggttttggagttcagaatgtattaatacattcttcagagacttttaaggaaaaggcaaattgtgatttttttctgacacggtttaagttctgtctacattagttctaggcttgtaagtattgtatgacctttgactcaattcagttctggatataatttagtttaggccctgtgactaagctgttttatatggcttatctaagagctaccgagataaaggatttacataagtatagtctttcattctaatgttggactctggtaatacttctcagtatgccaataaaccttatttcccgttcccctgccttcttttctttagtattaatgatagccactaggttgggtgcagatctcaaggccgttctctactggatgagattctctccaagtctcagatgagaaacttccataaatcctttccctaggcttccataaccctatggttacacctaacccatgtcctcaaatcccatattagcattacatgcaaatgacagcactggggagaagcagggagtgaatcagagcctgttgatggctctgttttgattacagccatgggtttgcttaagaaagatattgtgccttcattgtgactggcatcaaaggtatgtgaagatactacctaagctaggtgtgagaagcccaaatacattattactaatgattttcataagggctaaagagtttaggccaaaaataattaaagagaacaatagtgctgtcaataaaactcctcaataatgagatagtaattaatggacgaatggcctcattgttctttttggctctaggcattaagcatctcattttaaaagttgtggtaagtagtgcaatattgctcatttatatttttatttagtactgttaatttatttcactttttatttaatcttaaatcttttattttaatataaaaattggaatgatcctctcctttccccccattataaactttacaagcaagagtggttttggtgctttggaactttctcagttcactccctatgataggtcctgtaatcaggctcttactacatgttttgatggtgttattgatgatcatgatgagtttcaggtgcgtttttgttgcctaataatacagattctctggtgttctctatgacttcattgtatggggtcagcctggccagttctcctcatggccctttctccctttaagccccagaagccatcgggaaaagcctttcaccttattttttcagcaaagcctgcaggatgccatggggggatactcttacaggactattctaggcagcaagttttcttcatacagtggttcagagattttggataagcaataagaatggttctgctgggcccactggtcataacttgtctaattaatgcatgtcccattacttttgatatgtctcccttctccccaggaaacatcagatgcttgcaaaccattttccatatcacagagcaccgggccctggaatctttcttgggccccttcttaagactagattgctcaaagagttgtaggccaaggaatgaatgtatcctgtgttgcacaaaatacatttagatatttatcaagacttaatttaatgaacttttcctcccttgctccaactttactttgtaaccctcctcctgaagaaaaggtgccaacattccactttaagtctaagctgaaatcatagatgatcctaagtgttttagaagtaaattagtgactcaagtcccaccagttttcctctgtcttccaaatgacactttttcctgaggcttccgattggatccaacgtgactggggcttttagcccccttcttaggctcctcagagtccatgctgagaatgactcagccaatttcagagatatggattccttttgaagacccctgtttcatctttgacttttataggaaaggttggattggatgggctggctgttctctgtgtgggcacttgaaaggtaaggccttcgaacttggccttcgggtgtgttcagggccagggacttgtacacagaggaagtctggatgtgctttttaaatcttagcactgtgacttgagttttgccatttcaccttgcagtgtttgggaatcgtgtcgtagattgttgacctagccttgacactcagtggttgttgaggagtgaggagggtgtggctagggggcggaggtgggaatgttggttgagaaagactaccaaaatgttagtgtgttgagaagtaacaggaacagtgcttgggcatggaaaagtttggcatgacagcctcttcctacagaaactttcccagaaatttctcaggaggaaggagttggctcagggtttccaatggattatctttggctatgatgcccaaagaatcttgacactaaggatttatagcttttactagttctgaatattaagaaatagtagagtccattaaaaatgcttggagtttgttgatatgttgggggctggtcatttcctccttgaactctgacctgctagaagctctaatgagtcatgaatgggctaatgagttgtcacctttagtttatatttaaatactaccttagagatgtgaaaacttgaacctgactctcatagcttcattatggacccacaaatgtaaccgactggatggatggtttccactgagattttggcctggtgtaattcggctgctgcttgaggctatttttggaggcttttggagtatcgtaggagtacatctatccagtgtctttgtttttttttttttttaatttttatttatttatttatttatttttgagacagagcctcgctgtgtcacccaggctggagtacagtggcgcaatctcagctcactgcaagctccgcctcccgggttcacgccattctcctgcctcagcctccccagtagctgggactgcaggctcccgccaccacgcccggctaattttttatatttttagtagagatggggtttcactgtgttagccaggatggtctcgaactcctgacctcgtgatccacccaccttggcctcccaaagtgctgggactacaggtgtgagccaccgtgcctggcccagtgtctttatttttattttaaaagatattacagcactcctgtcttctgccagtgctttgctaagttgtgggataataaaatggacacagctagatgggaagggtcactgctctgccctgactcagctccattccccaggacagggaggccacgtcccaggaatatttcttatctcctgctctcagctgtgcggtgaagagggaaggcagatctttcctgaaaggatcaggtggcagctggatggagagtggtgggcttgggtcactagaagagagctggggcccaacgaaaggaacgcgtgcctgcagggcaaactgcattttaaactcttctctttcagggcctaaaagttgcttttgtcaaaaatcctcttttctgtgccaaacctgaatagcagagatgaaagcacgctacagctgttggaggggtgtaggtctgctgcagaatcagagtctgtgttggttgttacacttggtgtgggaactgggttctccgatgctgactgcaagagaggagatgtttggcgaaggattgtgctagtccagagttcctctgtcagatcataacagtagcctccatttgtatggcctttgcagtttataatagtgcctatacaataaaatatgtcaaatattacattgtcattttcgtaagtttctattttctgatgcagtttcaaaaccttgttctggtacccatcttattaagtaggcagaagagatcctgcagtttaaaaatagatactttaaaattctgtgctttgaaataatcttggtaaaattcgacactgcagcttattgaccttatttttctttctgtagagagaatgatgatttttgaccctgtaatcctgagcttagaacctagggagaagaggaagcatttatttgtttttgcactttgttttgtaccacatttggtaggttgttaccagctgaggaagtaaattgactaatcaggggaaacccaaagcactattgatatctatctctaggcgtaatggttgcaaattctataaaaaggcctctctgcttctcatgtggtcaataaggaaatggctcatggaaaatgagaaaatacctgaacagctggctgtaaatctgagttctctgcccacgggtgtggcttggctcagttctttggacttggtaatggggtcattatttctgtattcgatggatttcagaatgtcatgttatttcagcccaagcggttccccaggaaacacaactatttgccctcttcttcccagcactgaaactagagtgccttctttctcccagtcagggagaaacctctccaaatagggcttcctttatcttgtagaagttgcttagcttttctgtatgtgggaacatacatagctttttttagtgtatacatttctacagtttgaaattttctacattgaaacatattgtttcctattgggaagaagttgatgtgatctctatcacgaatgaaaacatatcctttatactgcctttttcttttgggaattgggtaccctgtcatgagaattacgggggcctattctcaagtagtataacgaacgcctggcatagctcattattaacacaccctacaaggttttaactatgttggaatgcacatcaactgcctggaagacagaatgtcagaaaggaaagtctctggtaagttgtacagaaagtcctcaaacaacatcgtttcattcaatgttgtttcattataacgttgatgaaaaacattaatcttggcctggccactgtccgtgtggagtttgcacgttctctccatgtctgcgtgggttttctctgggtccttcagtttcctcccatgtcccaaagctgcgcacatgaggtgaacaggcgtgcctacatggtccctgtgtgagtgagtgtgggtgtacatgtgagtgcgccctgtgttggggggtgtcctgtccagggccggcccccgcctggcaccctgagctgctgagaagcttctggccacctgcacccctgaactggaaaaactgggtaaatacttaccctacttcattttattaatcattcttcaatgtttatgtagttcatatttatttcagtgtttcatattagaaatctcttggcctttgtttggaagtttgatgtttttgtcgctagaaacgtgctgtaggaacttcactcttgtttatatcaattggcctgtgggaaaattggtttcttatattggtttcacttaaagccgaagtttccaagaacctttctataatattaagtgaggactttattttagaattgtgggaggtagcgtgatatatacttaaaggaggatggccatgaatccaacagacttctgctcaaatctcagacatgtgacctcatcatgggatagtttctgtgtggagtgaaggatgtatgtgcaaagtccagcccctagtggtgcccagtgagtgttccttccttttgtccctctgtccttggccttgagacttgtgggggaatctaaaagacaccaggctgatttaggtcttgtggagcctctctgcttgtgggcggttgactcttcctgaggccctcaccacaggtgcagcattactggcaatattattattattattcttgtttttgagatggagtctcactctgtcgtccaggctggagtgcagtggcacaatctcggctcactgcagcctccgcctcccgggttcaagcgattctcatgcctcggcctcccaagtagctgagattacatgcattagccaccacgtctggctaatttttgcatttttagtagaaatgaggtctcaccatgttggccaggttgttctctaacttctgacctcaggtgatccgcctgcatcggcctcccaaagtgctgggatgagcacaaaggcatgagccactgcacccggcctatcaatattattttttagtgaacaaatcagtgtcagtgttgtgggcctttgggttgtaacgcaatccaaggtctactgttcctttcccccctcctcctaaacatgtattagccaaatttggggaaattttccaagcagaagctttttggattggctgttaatacatcacatcattagctgtgaatcttggatacactcaagctctcccaaaaatagaccacatgaaggaggaaaataagaacccgaggccatgcaagcactcagtatttggtggctcttgcccagaaaggcaatacagtgatgtgaacagaacactcgttttctctcctctggaggcctgagctctgtttctagttcggacctcagctttcttctgtgtgactttgtttaatgccctctgcctcatccatcaaagactggattagaaaaaataatctctcttctgttatttagtgtgttattagctataaatcacctaatctcaaagtcttaattgtgcatggtgcaaatatagtcttttgcctttcgtagttacagtctggatcacccatgggaatatcaggtaagtaaatagtttatagtttattacttcacctccttgtgaactgagatgattgagcagagctggagaagttgatatgcatgcattaatattttgttctttgcacacgtattcaactaatatttgttcagttgataccctgtgcaaagtacaggaagaacactgtgggagatagaagtaaaaggcaaaaactttaaatgtggttgagaaatattagagagacatattgtttcctagtgtaatattagtcataaaatcattgtaccttggtaccaaaaagggaccttcaaaatcatctcattccctcatttacggatgaggaatattcagagcaagaaagacctcactgtggcccagaggctgagcaagtttaacggggttgtcaaggccagagttcaaccttcatagacaggatttggctccgtgcaagggaagagaaaggccttcttgctgtagggagcaactgtctttggtcctggtagccagttggataccgtggtttgcgaaccgatgtgcattgtgttgcaaaatcttattgctgttattcctgtggttaccccttattatagtagtgtcttcaagaggaagactcaaacatgagtaaatattgatgtctcatgtaaaaattttccctcaactgtttggggatgcactggctgccatttattcttaacagcttaaataaaagagaaagggagaggaactctcattctatccaacaaaatccttccatcaaacacagagcttccctttcctccttacttcaacaggtagattccttcaaagttggaatcctttttgtaacatagtttgatgacccctgtgtgcattggatgcataatcactaaggatacacatctattagaaatgaatagaataccaaaaagagaaaatcaatgggattccatagaagtcatataactgactgcgtgagatggaaacatcctgatggaaatgcctgtatgatgccagtcatcacagtaatgggaaatcttccgatcactgactatattttgggggccttgccagacactggtttgtttgcaggtgctccggtttaatgacttgccttcatgttccagcaacgagctcttcctgcttgtccttactctgtggaaccaattccaacatcagaagttgaaatgaggcacaaatgccttttcctctattttctctactcctcaggtttttggttttacttttttttttggacagttataatttggcaaatttgtatacttttatactggcatatcttaaacttttacctgttgctttatatcattcagtttggatcacattggaatctcagctaacctcattcttagaatgtcagttaaatgccactctttcatgagaatcctgatggcctatacttggttagatcttcctgaatactctttttcctccccttagagatggggtcttgctctgttgtccaggctggcctcgattgcctggcttcaaatgatctcctgcctcatctttcccaagtgctagctttacagacatgagccactgtgcccagcccctcaacactctttatagcacctgaactactgctttttaaatcatctgccatcctggctagaccctacgctggacaaggacctggtctgtcttttatgcatttatttaattaaattttcttccttttcctttttttagagatagagtctcactcttgacacccaggctgcagtgcaatggtgcaatcgtagctcactgcctcctccaactcctcggttcaagtgatcctcctgcctcagccccccaagtagctaggactacaggcacacaccaccacacctggctaatttttaaaatttccattgagatggggtctcactatgtcgcctaggttgatctcgaatttctggcttcaaacgatcctcctgcctcagcctcccaaagtgctgggattacaggcgtgagccatcgtgtccagccaggacatggtcttctcgtgtattgttttatccccagttagtgtgtagatctcttgtgtgtacagtagggattccacaatttatttagttgaattggattttattctctttttttttttttttgagatggagtttcactcttttcgcccggactggagtgcaatggcaccatctcggctcacggaaacctctacctcccaggttcaagtgattctcctgcctcagcctcccaagtcataggcattacaggtgcccatcaccacacctagctaattttgtatttttaatagagatggggtttcaccatgttggccaggctggtctcagactcccgacctcagatgatccacatgccttggcctcccaaagtgctgggattacaggcatgagccaccctgcccagccagattttattctcttttatctccctttgtttttaattctttgcaactaagtcaagccatagagagatttaagtcaggattagaatgtgtagggagaagaatgaaatcagattggatttttttttttttttcccaagacggagtcttgctctgtcacccaggctggagtgtaatggcgtgatctcagctcactgcaacctccgcctcccagattcaagcagttctcctgcctcaggctcccgagtagctgggattacaggcacctgccaccacgcccggctaatttttgtataattagtagagacagggtttcaccatgttggccaagctggtctcgaactcctgaccccttgatccacccaccttggcctcccaaagtgctgggattacgggcttgagccactgcacccggcccagattggatttttaaaattacatatttttttgcatgtaatcaggaacttgcctgtggacccagggggccacatgcagaaaggtaatctccagtggctttttctagtaactgggtccagtgccctgacattgtgcacatctccccagcatgcctggtggagattcctaaaccagggctatagtccacttccagggccatagtcagagaaggggagaaagtttcaaaacttatgtgaaaaggctaatgagtaacctcattgaatgtttatcattcttgaaattctctttggccattttactagtcctgtactctctggcttgtgctgctgcctcttatgctatataatgcctgtctcttctattgatgatttcctcttccagccctgttgatgaagatgtactccaaggtccagtccttcatcctctgtttctttctctctctctccttttttttttttttgttgagatggagtctcactctattgcccaggctggagtgcagttggctcactgtaacctccacctcctaggttcaagcgattctcctgcctcagcctcccgagtaactgggactacaggtgcctgccaccatgcctggctaatgtttgtatttttaatagagacagggtttcactatattggtgaggctggcctcgaactcttgaccttgtgatcctcccaccttggcctcccaaagtgttgggattacaggcatgagccactgcgcccagtccatcctcttgtttcttaaatctttcttcttgggagatgaattctgctttcaacccttcaactttggttttgagtgaatttatgcattcatctcagagcccttctggggagcatcagcttgtgactgtctctgacacttggatgtgtgattgtcacttcaaactgtaagcctcatgttttctcccaaaacattcccacgttgcagacatcagatttctctcaatggccctaaatccagcagtcacctcgagcgtcttgagtcttccccttcctgtgtgtctgcctgtcttctccccaccctgcaggttgtttccagatactactggattttcctcgacaatgcctctggaatccatcccttccttcccctcttggaactcagttcctgctcttttcacagctcaccctgtcaccaggcactgtactctctagaattcctacacttcctacaccactcagcctttgccacatgtttcttcatttccctctttacctttaaataattagtttttttgagggcagagatcaggaattgcttctcttcttgtctctaccagtcagcacagagctgagtagctgttcaacagagttccctaatgatgatgacagtgaaccagaggattcctcccaggaaattttgtgtgtggactttgcctctgtgaatgccaggatgtcagctagaaatgattgagcacaagctatgaggcagagggatggatgaggttagcacaacaaagcagtgttgtgacttcttagtgaatagagacatctttacaatatggaacattcactggatctgctaagttgggtgattgaaaaaaatcagtgccttttttggaatagttcttcattgtctttcatactcatttgcaatgttatcccccaacaagcttgtagagaagtattactattgcctttttatagaagagaaaacagaagcttcgaaatatgaccaaggtcatagagctcaaaggtgtcagaaccacatctctagccctgaaatcctgattccaggtaaaatcaattcaacaaagcatggagttaagcaccaggaagatggagtttcaaatttttttcctaaagaagttttcaatctcgtgagaaacagatgggtaaacaacataactcctaattcaaggtttgaattaagtaagagtgaatcaggacacaaacagaatgtgtgggtgcatgaaggtaggagtgagtgattctgtctttgtactaaacagcagctgttcctggcagctttccgtcagggagtgcttgtgaagcatggatgaaagcaggtgtgggtgtatatggaaaacagcatggccgggaggagaaagaccacaccatgtccatgtgctaactggccaatggaggtgaagggtggtggaggctgcgggctggatgatgactgaattaggtgatgtgacattttaggcagcatgagaaagtctagaaacctacctgttgggctagcttaatcgatctcacttagctccagcattgctgagtggttttgtgggtgtctacatttctagtgatattgcagggataaggtgataagacttggcttgtctctgcaaagtgaagaatatgaaaagaaggtgtgaagcaatcaggcttccaaggtctctctgatgtcctttgcttattttccaaactttcttcatttttctaaatctccccaatcttttctccccactccacctctctgccctttatttttaaacctttgtaaacttcttaagtttttatttaactggagggttattccagagtctctatcatggtagtctaatatggattttagaataaatttattccgtgtttctaattcatttacatttaactcacaaaatgcccttcctccttttttttttttttttaatgaggtagttaatgttgctaagacattttgtcagcctttgagttggcctcttaaaacattttctgttttcttcagtcacacaaaactggaatctgtagagagtgcatctgtttcattcactcttgctggactagaaacttggtgaatcacagttaaaaggctactcagaatctctttgtatttcctccctccctctgtcctcctctctcctaggcttacagattatgcgtatggggacacggtcatggaactttcacatctggtgaccaccaacactcagctcgctctcagcataagacagggcaaagtaacttactttaaccaccctgtatctgttttccatgctggtttttttttgttttttttttgagacagagtctcactctgttgcccaggctggagtggagtggcacaatctcggctcactgcaacctccatctatcgagttaaagcaattcatctgcctcagcctcacaagtagctgggattacaggtgtgcaccaccacgcctggctaatttttgtatttctagtagagatggggtttcaccatgttggttggccaggctggtcttgaactcctgacctcaggtgatcctcccacctcagcctcccaaagtgctgggattataggcgtgagccaccacacctggccccgctgcctgcagtttttagaaattggctttggttctgtcttgtgacccccaactccatccttccttgcctgttactaaccttgagaagggctgtgccttgggaccctcaaacttttctgtggatttttttttttttaacagatctactaaacccaagtaactatttggggagtgttggtagttttaggaagatgtccagccaggtgagcccttcctctgacttctctgagctccctggttgctgtcagtctcggtatatggctgcaagggcattggaagacttccattgagcaaagagaaactggccgactctgctactgctgaatcttgctttgcatgtgaatgcacagatgataagaagatacgtatgcatgcttcacaagtaggtgtgctttcttgataagaaaattaatctactttaatttggctcaatcactgagcattatgaaactaagtgaagggagagaaagaaagggaaccaagtgccccctgggcacttcacatacattaatgccgttaatcctcacgataatccaggagggagaactgttattggcctaactttataggacattgaaatcaagaaagacttggtaacctgctcactgtgtgagtcaggaatagaggccttattttttccactacctcaaactaccagccagttggtaggaacgggagcttaggggaatacttcggtgtgggtgattttatgttttttttctaggaaactcagctatagctgcccagttatccatggcgtacatcttccaggttatctgcatacttctggaccagtgtctttgtgtgtgcgttgtttatgtccctctgaagctttctgtgtatatataggtcacacattcctgcaatgtaaatcagtcaagcaggcagcttagaaattcttatccattcagacctttggcctttgcttgtgtaaactggaaatgtgggtgtggagagtcaatgtggggactagaatgttggaagaatagaagagaagcccacaggaggtgtgtgagggcagaaactgtacttgggggattttgccctgaggttcaagtatggctgtagctgcggggacctggcttctgccatgaaggaggacttagatggaggagctgtgccaagaaccagcaaccctggagtgggtacatgcctggcccaagcatgttcacatgcacgagttcactgacagctttcagaaccagcatgactgaaaatactctgtttagcctaccaaatgttccacatctccccaagctcccaggatgtctccggcacccaccaaccactcatgtactcaggttttccagaatccaaaaacagattctcaaaaaggccgaacatttggcagggaagtatttctaggtaaatgatatgcacagttatgtgatctccatcccagagggaaacattggctaagaggattggttgaagaaaaacaactattagaaaatgtgttcaatggggtcatgtttatgctccttctgtcaactaaaactgtgtgtttaaacaatgtctttggtttattacagtcatcacactgtcagtagcagataatgtgcttgaatttcacaagtgtatgtaaatgatctagggtagcagggcagctgtccccagtcaacgttttcacattgtgataattctcaggaaagagaaagacatacttaagagttgtacgttatctgtcttctcagtaaccaaagtgtctcctaatgtatgcattaatttataatttggcactgtttttaaaacctgggtttgatttttagtcaaaatacagatttatggtgggatttatttcacagtacttttttgcaagagtaggaaatgttggaatgcaagcgctttgtgaaattaaagctctgggtcaatgctactttgttggaaatcaagtcatatattaaaattagaaaagacagcaagcagctggctcaagtatattttgtctcacttttctgctccccatgggcttgcttttcggagagatccagtggtttgtagcacacacattacccaccaactcccattccagccgtgcctgttcttctgaactttagagacacatatcaaataccaagagctcaagacagtgcctcattgcgattctatttgttgacaatggtgatccttttaagatcctgaaatgtttctcagcatcacggcagctttgtgtgtgcgcctccaacttcacgggggcgctctcagccagtggggaagagtacactcttagagcggaatttgcatcagaacgttgggtcaagattgctgaaacaatggactttggtgattaggatgttgctttaagtcactattatttattagaagttgtgtttttttttttttttcatgaagatttttcattaggtttaagctttatggaaccaaattgcccaaatctctggaagtcatttttaaataaccagcaattgcttttcagcctactaaaggataggatcatcagtagaatcatttctataaattaatctataaggttagtgtaactctaatcaagtttttaatgggacttgctttctttagagtctaacaagttgatttctaaagttcaactggaggccgggcatggtggctcacacttgtaatcccagcactttgggaggctgaggtggaaggatcacttgaggtcaagtgtttgagaccagcctgggcaacacagggagaccctgcctctaaaaaaaaattagcagagtgtggtagcatgtgcctgtagtcccagctacttgggaggctgagacaggaggattgtttgaacctaggagttcaaggttacagtgacctatgattgcaccactgtactccagcctgggtggcagagggagaccctgtctctaaggaaaaaaaacggaagttcaactggaaaaataaattaatgtcaatagccaagaaaattctgtaagcaaaataaaggggggactcgttctaccagataagaaaactccctaaaaccccacaatcattaaagtggagtgatcctataataggatcatatattagttcagtagaacaggacaaaatctgggaatagacccatgtatacataatataacccaactatttctagggccccatatggcctagtggatgtaaatcagaaatctgactgtggaagccttgaatatgaagatctttattttacttgttcctaaaggagtatattcatggatttcacaaagtatactccctaaaatattttccagaaatcttgtctaaatagccttcactctcctgcaaggtgcaaactcacggcagcctctaaaaatgtgtccccatctctctggtcttcgtggttttctaactttctcttcccccaccattccctgccccccatacattgtgttcccaatttgtgaccacctccacagagggcagcccttgggaagggtagtttttttccccagttggctgcttttctggagagcgggatattcccggaattctgctgatggaaattccccaggagactcccagaattctgatgagcaaaaattcccaacttcatttctttgggaatttactatatcttaaccctgccattttaagtcactgaactagtcaatatatggtgttagggtttttggctatccattcagaaaaaatgtgacatacttatattttgtaaaataaccattttgtaactatatgtttcaatagattaatatacatattactggatttaggtcatatatatatatgtacataggaacaattctgtaagtttatctctaagatttggggttgaaagcagtgaggggagtcttctactttatgtagttttgaattgttttaaatttattttgtagcaaatgtgtgtaacattttaattttttttgaaatttccttttaatttatatttagtaaaaattcactattttggtagaagagcaagttttgacaaatgcaaaaaattatataaccaccaccgtggttaagatacaaaacaatcttagcacctcccctggcatctcctccagtcccagccagttctcctgtgcttcccctttgtggttaagctcttccccgacccttaacctctggcagtctattctctattcctagttatgcctttcctgtaatgtcctataatagaatcatatagccttttgagtctggcctctttcacttaagcatagtcatttgagattcatccactattcatcaagttttttgttttgttttatttttttgaaacagagtcttgctctgtcgcccaggctggagtgcagtggcatgatctctgctctctgcaaccttcacttcccgggttccagcaattctcatgccacagcctcctaagtagctcgtattataagcacgcaccaccacgcccgactaacttttgtatttttagtagagacagggtttcgccatgttggccaggctggtctcaaagtcctggcctcaagagatctaccacctcggcctcccagtgtgcatcaatcgttttattgctttatatttctgagtagtatttcgttgtgtgtctgtaccagtttttgtttatccatccccaaatgagggacatttggattgtttctagtttttgataattactaataattctgctataaacatctgtatacagggttttgtgttctcttttcacttgggttaatatctggggggttttgctaggtcaaatggtaagcgtttgtttaactttataagaaactactaattctctttccaaagaggccgtaccagtttgcattctcgccagcaatgaaggagagttccagttgctccacatcctcaccagcacttgatattgtcagttcattaaaaacgtcaactgttctagcagctgtgtaacagtacctctctgtggtttttaatttgcatttccttcattagaatcttttcatgtgctaatttgccatatgtagaacctctttggtaaagtgtcttttcaaaactttggcacgttgttatagggttattttttaattgtcaaactttgagagttctttatatattccgggtaaaaatcatttgtcaggtgtgagatttgtcaggtctcacagtctgcagcttttttcattttcttaacagtatcttttacagagcaaaaattgttaattttgatgaagaccagttttttgcctttttattttatgcatcatgcttttggtgtcatggctaagaattctctacctaacccagtgtcacagagatttttctctaatgtttctttctaaaaattttataggtttgtgtttctactgaaggtctatgatccattttgagtgaatttttaaaataatttatgaggtcaaggctcttattattttatttatttttatttttatttttattttttgcatctggatgtccaattgctccagcaccatttttttaagcaattatttttaaaaatttttattttacttattatttattttttgaaatggagtgttatgagtgcagtggcatgatctcagctcactgcaacctccgcctcccgggttcaagggattcttatgactcagcctcacaagtagctgggattacaggtgcgtgccaccacaccagctaatttttgtatttctagtaaagacgggctttcgtcatattggccaggcttgtctcgaactcctgacctcaagtaatctgcccacctcggcctcccaaagtgctaggattacaggtgtgagccaccacacccagcctcatttgttgaaaagactactatttctccacattaaatgatgtttcttttaaaagaatgaatgtgattcaagaacccaaacatcttttgacataaagggagaaaattgacataaagcgagaaaattctctagacctttggattctgaatgggctaaagagcccccctttcccaggagaacacccacaatgtttgttttactagaagtgtcataaaactaaacacattttatactcaatttctgggatttctagactgattttctttgcctagcttttagaagaagttttaaccactccttgggatcaagggtcaatgaaagattattctttttgacaaactgaacataaaattaaactttagaatgggaatgaaacttataactcatttaatgtaactttcctttttaaaaaattttaaaaaaaagatacgcacctgtgcaaaatgtgaacaatgcagaagtatcatctagatttggggatgccaagggacatgggctttcctactgcttctctgtcccctcctcagtgtctttggccggctcgtcttcctctctgtgacctgagatgttggcgtgccccagagttcagcccttgtatttcttcatttttttattccacccactcccttggtgatctcatgcaatcccatggtccaatatgccacatagactcccaggaattgtgtctctaacccaacctctatctgactgactcctcaacatgtgcaagatgtctaatagcaacttacctaacacagaaatcatggttttctcacttaatcctgctttttgcccagtctttcccatcttggtaaagggcaccatccttcctccagttgctaagaccaaaacgtcaggcctctcctggcaactctctctctcatacctgacattcagtccttcaacaagtcctctcaaccttaactataaaatgcaccccctctcactgctgtagctgctgcctctggtctactggcctcctcactggtttctctgctcccaccctggcccctgcagtccaacctccttagggatcatttaagacatcagtcagatcatgtcctccctcagctcacatcttgccaatggcttttttaaaaatcacattttgaataaaatccaagtgatttgccctgacctacagggccctgcgtaatcgggctccaacagatctcttcccagttttctctcctgtgacttctgcccttgcctactctgcctttctgctggtctttcaacccatgctcattcggcctttagggctttgcctgtgctggttctggggctggggtgcttgtcccgtaccttctccaggctctcctctgcgtgggggtgcttacctgcagaagggtcatcttcccaccatggccttccctgactcctcatccccaatactgccctctgccccacctgccccatcttcacactttgctgtatttttcatcatagtttatcactacctggcactatttacatatttacttgtttatttgtttgctgtctgcctccccaaatggatgtaagctccatgaaggtaggactttatagtattcgttgctatctccccagcttccagagcggagtgtagcccatagtagatgctcagtaaatattcatggctggattgaatgcaggattagatgcaaatgtgtagattccttttcaccctgttttattccaagcccagaggttatcactgttaacagtttgataactagccttctagacttttaaaaatgcatttataaaggcagacaaaaaaaaaatcatagttttaaagaataatacaaatgattttacatcatatttttctcaataatatattaggtattttctcgtattagtttatatatagtttatccatctattcatctctctttctcatcagtttatatgttttttttttaagagacagaatctctgactgggcacgatggctcacacctataatcctaacattttgggaggctgaaattggaggattgcttgaggccaagagttcaaaaccagcctgggcaacagagaccctgtctctactttaaaaaaaaaaaaaaagtaagtaaaaaaaaaaaaaaaaaaaaaaacagagacacggtctcactctgttgcccaggctggtcttgaactgctggcttcaagcagtcctccagcctcagcctgccaaagtgctgagccaccacacctgaactagatagtactttttaatggttacattgtagttcatactatggatgtaccacaatttatttaattattttcctgttgagagatattaatatataggttatttcccctgctcatgattataagcaaggctgcagtgaatatgcttgtatataaatctttgtacgcatagacctcaaattacgaaattcccctgtcagtgacttggtagatactgcttaatttgtcctcaaggattatactgttttatactcccaccaacaatatatgaatgcctatttccccgtatgcttgccaatgctagatattaccacactttcaaaatattattcaatgttgggtaaaaaaatatttaactctcttacaaaagagaaaggtgatacaaagccttccttacaggtggattgttagtcatttcctataatgataagcttcttagtttctagattacacattagcctgctaaagaaagatagtctcttttgaaagaagtgacagacttaaaggagtaaggtgatttaagatgagaaacatcttatgcctttttaagaagcttccaacttcttttccaagaagtatcatttcaggatgtgtgctgtgagatccaaaccacaagcccacatatcctcattttcttgctctaaaatatcactcccaggtgatttttttttcttaaaaagaatccacagcacaaaacatcaagtgttggagttggctggagagttaatggaagttgtagcaagtggtgatttattgttatttaaccactttgtggtttctgctgggcctagctagaagtgtactcaaagaataagagaagctatttgttttatcaactgtgactgggggccaaacaaaggcatgggaaggaataagaagagaaatgccaacccagagaagagagctggagcacaggtagtacctggatgcttctgtgatgttagtcggtttcaactcagagctagtgtgaatgttggttggctcagatgctggctgtggccttgaagtcacttttcagggctggactgagtcccaaagggcagtccctgggtcttctccattttcatcagatatcaaatggggaggatgagaggtcctttcgtggcatcagtatattagagtttgaaggattctttagaatcagctagttttcttactcaccttatagatgatgaaactgagagataaaatgattcacataggtaatgatccagacattttaagctctgtgttgaataatcaaagggaaaagctctttacttgaactttacagatttaacagattgttggacagaaaagaactcttgccttgaaattcctaacgcaggagtggcatataactggtatgtatgccaccataccctgccccggccacatgcccatagcagacattgttaatcgacccagcaccttttcctcagccaagctctggccagcctgagaatcctccttaacatagtgctggaggcgccagtcataccgatctgagctttcatgtgatttaaaatctgtttgcctccctcttctgaatgatgtatccatgtgattcatgatgtgctgatagcatgggacttcaagtcagaagaacttggtttgactcctccatctgctgcttcctagttacgttatcttaggcaactcacttaaccttcctggggcaatttactccctctgagatgagaaagttgaattaaataatccgaaagcatcctgtcaagctctgaaaaatgctatgcttcaaggtacacagacttctcaggaagaattcatagctacaagcatgtctttttataaagaccacaggtggttctcaggaagtttgcatattacaaatctatttcgggtttctgaaatatgtgtctctagcttttcctgactacttcttttcatctgcctggtcccatggaccaagaatttagggattccgaagggagagaggggaaagatctgcttaaaaccagaggacttgcaggaacctcttctgggccgtgggcttcatcttcccacacagagcagagcagacctctgtgcctgccctgcagctgtaggtcttgagttacctctccttccccttcctccatctgtacctccttaagagcagggccctccctgtcagacagacctcagccagcggccctccgcaggtcctggcctgcttccccacaccgttccctgtggtgacctgcctccctgcttgttttccaggctccccttccctgcgggcatatccgctcctctcggtgatcacccgccagcccactgtcatctcccacctggtccctgccaccccgggaatcgcccaggcactgtcctgccaccaggtcaccgaggcggtctctgctgaggccccagggggcgaggccctagccagcagcgagtcagagacggaacagcccacgccccgacagaagaagccccgccggagtcgcaccatcttcaccgagctgcagctcatgggcctggagaagaaattccagaagcagaagtatttgtcaaccccagacaggtgaggacgcagggaagggactctccgcagtgaaggcccctgggaacgggagacttgctcccattgtgggccgtggagccacagcactggtacagtgaggcaggacactatggcggagtccactccttggctcaaatcatctcaaccttggttaacagaacccagcccacatgaatccaccacacggtccctggagcctgcctgcggctaaacttaactcaccactttatctccatatttgaacttaactatttcagtatcataaacaaggtccagtttagcaaatggttgctcaggcggtcagctgggaaacaggcttggtttttaagccactcactcttaggattggaggcagcaggactagatttggaattgggattcatgatcttctcaatcttctccacagcctccagctgattccccactgactcagtttgctggcctggctattgcttgggaaggactggagggatccagttgaggaggtcagacatgttagtgaatttgctggatgtcaagtcagaaccatttgactgagacccaggaggacctggctgagagccccttctttgaacccctctgagatccatgttggggaggctgtgacccttgctttcttggaggcctcaatgcctcacctccttttctttaatttactattttaactgaaacatatgccagagtgtgtgtctgggccgggtattgtggcccacacctgtaatctcagcagtttgggagactgaggcagtaggatcgtttgaggctaggagtttgagagcagcctgggcaacgttgtgagaccccgtctctacaaaaattaaaatatgagccaggtgtgatggcatgcacctgtagtcccagccactcaagaggctaagatgggaggatcacttgaacccaggactttgagactgcagtgaggtatgattgcatcagattgcatcgctgcactctaggcgagaccctgtctccttaaaaaaaaaaaaaaaatagccgggtgtgttggctcacgcctgtaatcccagcactttgggaggccgaggcaggtggatcacgaggtcaggagttcaggaccagcctggccaagatggtgaaaccgcgtctctactaaaaatacaaaaattagctgggtgtagtggcaggtacttgtaatcccagctacttgggaggctgagacagagaattgcttgaacccaggaggtggaggttgcagtgagccaaaatcatgccactacactccagcctgggcaacagagcgagactcagtctcaaaaaaaaaaaaaaaaaaaaaagtgtgtatctcagtgtctcatcttgttctttcagactgactctggagatggctgagctaataatgtgtgatcctatttattggggagatttctcaggtccttcttcctcttcttttgcctgctgccttggacataccaggttggacaccagtcctatcaaaaagtaaaggaaggaacctcaaatgaatctcttaagctgtgtagtagctctttgatacaaatttaagtgacagaggagtctgcatatcaccgactaaaagggaatttagcttctgattctgttaatgaggcaccgtcagctgtttggtaagggccttctgggtgccactggggcactgtggcagggattacgggtccagaaagcagtcgagagagtcctgttgtgacagaaagggatcatggggaaggaacgactacaggaacaaagacgcagcaagccaggcgctggtgcctgtgcattgctgagtgcagtaggaacacaggatattgctgagcgtgggagatggggttaggggaggcttctcagaggaggtaacatttaagaagagctttgattccaggagggacaggaagtcccgcactgaggggttggcacacacaaggcaaagaagcgtgtctcgccgggtatgtggaggaaactgcaagtagccaggacatctccagcttaaggtgtgaacaggcaaatggtggacctcgtatgcctggctgaaatgtgaacttggttgtttaagcagttggcactgcctttatgagctggaggtgacatgatcagacttacattttagaactgtctctctggtggcaccataaatgatggatgagagaggccagagacggagcagggaccagttaggagagaatccagtgatcatcacgaagacttgaattaaagggtggcagtgggaacagagaggcaggaatagagaggaggacaattttttttttattattatacttcaagttctgggatacatgtgcagaacgtgcaggtttgttacataggtatacacgtgccatggtggtttactgcacccatcaacccatcatctacattaggtatttctcctaatgccatccctcccctatcctccccacccccaaacaggccctggtgtgtgaggttcccctccctgtgtccatgtgtgagaagaggacaatcttgaagagagaattggcagaatcaacattgcggaaggaagcaagaagggagttgagaattctgtggtttctggactgggccagcaggtggatagggacgccatgaactgaagtaggaagacagaggacagagtagacttaggtggggaaaggttgagttctgttctagacctgtgcatttggagtgtctttgggcagatgatggagacaggtctgtgaaccggaggttagtagatgggctctccaggtatgacatggctgtttccacttccctagcatataattgagagcctcatgaacttgtgcacccagtggagtgggcacctttgtctatggtagcacggtggtatgtcagacgggcttcagcgtgcatgactaacatattaggctgatttttcagaagtcagagaattttttttttcagaaatattagttcttcttaaacctcctggggctccctgatacctgcccaggcatctctcaggtcacctacacaggattgattcacttatctgggaggacaccattggctggcatggaagctgccatcttcacctgccctctcagatgttcctcgcctccctacgtgaccagggccatgagcactccctcctcccacagctctcaccctcctcctctgtgtttgtttctccagtttcctaggtgaccccatttaagcgaatatgcagggaagtgagaatttgtaacggtggcaggtaatgagagaaagctgatgacagtgaagcatgtttctgtagccagagtgagtcagggctgcatttttcccaagtgagctaacactgtttgctaatgcagttgcagagctgtgaactgagccttccattgactaatgcacctgatggcctcaggtgaactgggctcgggaaggcaccgccagccagaaccatggaggacccgtctccagggaggcctgggagaccagaagtctgtggggtggccccctgggttcttggttctcaatgagcgactgcttgggaagcagtgcttcatttgtgggaagagccaagtgctgttggcactgggaatttattggctttagcctgttaatcactttcaataaaactgccagcttctagtagctcttctacagggatgaccagagggatgtgagtactgatttaagaccacttccagggtcccctgaaggaagactctgtgtattattggggctttaaattatgcagcctggtcagagcagggcaactgggcagctgcacctgagatcatcagggccggtccctgtgggcctccctgatagttagatctccccaggtggagagctgcagctgaaaacccacacctgagactccccatggagcaggcaagtgagactgactgtgggcccgagattcacagacggcaatcctcagaaacctagggcctttcaaaaagtgggggttgctgcccaagctctgtcaggggtgattgtcccaagctgctgcattcgaagtccacactgctttgctgagcagggctggcgtggcagtgaggcagcttatgttggcttaaggaggtggctctccagttggtgctgaggtagacctggggttcttatcctattaggtcaatggttgttgtctcaaggactgatgttggaagtctgactgcagacttccctttctcattctacttgtcccacccggttgtttgctgcttcctgggatgaagcatccctgcgatcccctttgacaggttcaacttgtgcagatatattgtgagtgggtgtgagccccaatgcaggagctggtgtacaggtcagacatcgtgggtttgaatcctgccccacttcttaactctacgatcatctgccagaggtcggtaaaggttttctgggcagagccagacagtaaatactttacattttgtgggccatatggtctgtgacaactacccaattctgatattgtagcacagaagtaatttatttttatttatttatttattttgacaatgtctcactccattgcctaggctgcagtgccgtggcgccatctcggctcactgcaacctccgcctcccaggttcaagcacttctcttgcctcagcctccttcgtagctgggattacaggtacctgccaccacacccagttaatttttgtatttttagtagagatgggggtctcaccatgttggccaggctggtctccaacttctgacctcaggtgatccacccgcctcggcctcccaaagtgctgggattacaggcatgagccactgtgcctggcctgttacaataaaactttatttacacaaccaggtagcagacaggatttggccacagttgctgagagagtctaatctctccaagcctcaactctcttatctgtaaaatgggaacaattacactgcttcactgcgttgtgaatgggatagataagacagcatgtcaggggcttagcatgtaccctgggatgccgtggtgctcaggaaatggtgggtgtgttagatttagccccagaaatggctttgacttttaggacttttcagaagactacagagaagtacagcaccatgattagcagtagaatggaaaacaggaagggctgtggatttaatgtttcttttggaatctttataatatttatttatttataacattttaattgttataacaatttaggacagctacagcgattgaatcaatccattaagaagtattttttgagcaccggttctggatttagcagtgtgatgggcactttcatgggtagaaaagaagtggaaggtatacgctgccctggctactgagttagggaggcagaaataacacagttggagtgatcagagaacagcaggaaacgtgggaccatctgggtgactgctggcctgtgggagggtgcagaggagacgagctgtgggagccaggagaatcacctgccggaggtgggaccggggctgggtctggaatgatgagtggattcccatcagcaacatctggctttgccttttgtttccagtctggacgatgggccagagggtcagagtgaatgctcttgtcaagccaggaaaaggactgtgtgatgagaagccccaggcatccttctcaggtcccttgcagaccgtgaatgtttcaggatggggactggcccaggtgtcctcaggcatgggcatctgtttctcagcttcccagagtttcctctgttggattcttggaaggaaagaaaagcgctttggggaagacctcgtttaatgggggaggtccgagccttggtagccagtgctggagcctgtctggagcctgccagcaggatcccatctctcctgctgcctcccattctgctcacctttcctttgtatcttgtgccttctaggttggacttggctcagtctctgggactcactcagctgcaggtgaagacctggtatcagaatcgcaggatgaaatggaagaaaatggtaagaaaggagtgactaaccatgatcccttcctgatgggaaggacttttactccagggctgttgggagggaggccggaccatttggcagtttgggctgcagagattggaaggccttctatgctgctggcttgcggggaagctgttggatctgtaggttgagctattcctcttgacctggagttcctaaacagagggatattctttttctgtttccttagaaatcaaaggaaaaaaagcttacaggcttttaacttgctagttttattattatacttaagttctagggtacatgtgcagaacatgcagttttgttacttaggtatacatttgccatggtggtttgctgcacccatcaacccgtcatctacattaggtatttctcctaacttgctagttttaaccctacctgctagccttttcaaacaacttccttcttcctcccaccaagagctaaaaatagaagtcagtactctttgtttataatgacgtagaggatgcatctgttcttttggctgtgcgtcctctaacgcagtgatcctcaaactttggtgggcattagcgtcccctgggtagcaggttaaatgcagaactctaggccccctcccaggattctggtcccagaggtctgggccaaggctgggaatgtgcgtgttaacaagagccctggttattctgaagtgcctggtatgatgaccacagtttccatcatcctgctctagtgcctagctaatgaatatttccatctttgatttttaagtattagaatagatacatccctacgttgtgaggaactcaatttcattatcatttattcttttcactaaaaagggcactattaaatcaaaattttccaaagtagttgagtgtttcctttctcagctttgtaaaccactgagacaaggtcaaagcccagagcaaaagaaaacgaggaggggtggcgataagggaagaagccctgctgttctctggagcccaggtgccaccatgccacctgccataggcttcttaccccctcaccaaacgttagtggctctttctcctctcgtccatgccatgccttcatgatgacattctaatttgctaacctgtctggtcacaggccctatgtcttggtgtttcagggctaaaatatgatgtttttcacaataatcaaataactacggggttctgccaaccccagttttcaggaaaaaaaaaaagtcagtggatagatgttttctcaatgttgtggttttgtccaatattgttttttcttaagcttttagttcttgctattccttgctattttctgctaacaatgaggagaaaaaaaaaaacaaaataagtaaattgcagatgaacatcaatgggaaaaattaggaaaaaagtcaacaagcagcaattattatattcccaaaaaagaaattcctgggcaaatcttgtaatttcctctggggggacctgaccctgaaatgaaagggttttcaaaatggaggcgacttggctcatgaagtgcccacgaattaagacagagatgccagttatgtgttcaaacatatggatattgcatgagtcagcaaatatatattttgtgtctcttgtgagccattccttgtcctaggcactataagaagtaattaaataaaatatcacccttgccttcatggaatttatgatgtagtcagagaaacaaggcccaggaggtagctgccgagcatgttataattaagtgctggttgttacggatttataagcccatcggagttcagaagagaggtaatggagaaggtggccgggagaagttgaaattgaaggaagtggcccggcacggtggctcacgcctgtaatcccatcagtttgggaggccgaggtgggtggatcacatgaggtcaggagtttgaaaccagcctggcaaacatggtgaagtcccgcctctactaaaaatacaaaattagctgggtgtggtgttggttgcctgtaatcccagcgacttgggaggctgaggccagagaatcacttgaatccaggaggcagaggttgcagtgagccaagatcacaccattgctctccagtctgggccacggagcaagactccgtctcaaaaaataaaaataaaataaataaataaataataaaaataaaataaaaaaccaagaaattgaaggaagaatggattcggttaaatagtcttccaaaaactctacagtgccaagcacacatggacaccttttgggggattggtctctaaagaactagacttgagagtgagaagcacccggccgtgttcccatgcttgcccttccctggctgattttgggcaagtcccttcactgctttctgtgcaagatccaccacccaccttcttcctcgtcagtcatcagcattgaaatcaatgcctcctaagtagcagaggcattgtttaaattggttatcagcaatcttttcgtgagtcagatgattaaggaatcgacaggcagcctcctctgccagcaccgcccagtgcccgtgggccaatgcgtgtgccttcgtctctgacgtcacttgtttttcaccagcaacagcgttgctggcatggttgtgggccagttattgatgggtatcaatgccatgtaaaccaaaatggaagagtaacttagcagatctaacctcagaacattctgcaagccagtcaccttcaggtccctttaggagccaagaggcccaagctgtcagttcacttttgagataattcattgagcatttaacattcatcaggccatggagatgcaaagataagacatgagcctgtccaccagaaaataaaattataaaaaggtactcagtcaagtgcagaagacacatctgcaaactggtattattatttcacggagcggtcagggcagcagcagggaaatttataggatcagcgcagagagtggaatagcaaggctgtgttgtgatcctgattgcttcatctagtttcccagtaaaactcttttcaaggctatctgtttaggtaccagggaggaaaagaaaaagataattgagtaataaagatgtctcaaggctagtaacctaattggaactggaaaaagattagcagttgattctcagacttattcacatggctgccaagggtaactttgccagaaccgagatagcatctctgacgaattctgacccgtcagcattggtaacctatagcgggttgggtaaatttaatcttgcatatttaagatgggatgcgcaccctctattccatgtctgttggctttagttcccgcaggacccacagtgttttgcaacaggctgaaagagcctcattatttggtggtctctttgagctctaaaatgcaattctcttccatgagaggatccaaacagatacctcctttctctcctagtgacagaattgcgtgggccccacactattcatggtcattatctttctcatgaaaagtccccaaatagttaacaactccatgaattgttaccagtagctctctgtgtaatcttgggcaggttacttaacctctgtgtgcctgtttcctctccagtaaaaggcctaacacgtaccttgtagggttgtgttattaactgagctaatctctgtaaaacacgtaaataggacctgccatataggatacagccaagagatgttattgccgttattattatcattattagtatttttattacctagccacaaaatccatgtcttcagagaatccaaatatttggaggccaggatacataagccaaaagtgaattctatgagtttcagggactccgcacagccctgagcatttgtcctttctcagtccctgctccccagtcatctccaagtcagcgccttggcatttggggccttgcctgaggtccagtggaacatcacatcttcaggctgagaaagtcagctaatgggagcagcagtgtctgggaggagattcatgctggggaatccaaacttgtttctcagcttcatggaaacagtcatcagttatgtggccctcgctgccctataaagctgcagagagagacagagaaaaaggaacaaagatcacccccactaataagtctactgcctggagtctgctgggaggttgggtaattgcaaataaataaccagacgtagaacagtggcccattttacatatccctcgcgcattatgctgaatgcaatactgctaagactgttagactcaaatggtcaggaggtttgtgttcaaatcccagctctgcccttggcttgctctttgatactgacaaactctgtcagctcagtttcctatctgaaaagtagagggaaggagagagttccttcctgcactgacattccctgccccctacccaggctgcttggagggaagcaaaagatccggtcttaacaccctcagcaacagaacatctgaatacctcgttgcagagtttggaggagggctgtcaccaggcacggctaataaaagtggatggtgtcctaggtgttcttccgagaggcagaaggaggcatgtgacctcttagacaaggagctctctggcttctctggaccaacgggactaaactggctctaagaataaatggggagagggctcctaggaggaaggccacagggtgcatgtgaatgggcagctcctgatggagagtggttctgagataattgcatgtctcaggtgtgctggaaggcaaggggccagaggttgagtgcagaaagcagccaagagggtagttatctcctaattattgcttgtgctggaatgttttattccatttagaaaatggtctaattgttttggggatttttttttcatgcagtaggaaaacagccaggtggggtccgtccaaaccgtgtgggtggtgttctctaattgctgggctggactttcttttgccaattaggtggcttccatagacctgcccttttctagtttgattactacatggggcaacttacttttgtataacctctttcatactgagtggatctgctttcaacatgtaaattccatcttggcacaattgggtgctttcaaaagcctgcactcagactgaaatcaaaatcagataatgacttacgtgaaaagaaatacagggaacgtcttctccccagggttggtttctgtcagcatctctacctcgttaaaggtccccttaatatctgtgtgttagctgttgatgcggaaaggacagtggttgagcagagttttagctaaaaggaggtgtttactgagaacttcttggttttcttacttcatactcaaaaattaactcaaaatgaatcatcatctaaatggtgagagtgaaaactataaaacttagaatatgagtaagtatccatgacctcggattagacaaaaccttcttagatatgacagcaaaagcacaagcaacagaagaaaacataaattgggcttcctcaaaatttaaaaattttgtgctgtgaaggacatcattagaaaaatgagaagacagcccacagaatcagagaagcttacatctgataagggacatgtatccagaatatttaaagaacacttacaactcaataataaaaagacaaccaaatttagaaatgggcaaaagatttgaatagacaatttctccaatgaagatatacagctagccaataagcactatgaaaagatgctaaacttcattagtcatcagggaaataaatgcaaagcagaaccacaatgagataccacttcccaccctctaggatggctgtggtcaaacagccatcaacaagtgttggtgaggatgtggagaattggaaccctcatatgcagctggctggaacgtaaaatagtgctttggaaaacagtcctcaaaatgtgaaacatagagttgccaaatgatccagcaattcaatttcacttctttcccatgttcacagccgcttcattcacagtagtaagcaacccacgtgtccatcaactgatgagtgaacgaacaaaacatagtatatccataaaatggaatattatttactgataaatgctacggcatggatagacattgagaacattatgctaagtgaaagaagccagtcacaaaagtgcacatattatatgattctgtttatataaaatgtccaaaaataagcacatctgtagagacagaaagcagactagtggttgcccagggctgtgggcagatcgggtaggggctgggggaaaatagggactgaccgctaatgctatggggtttctttttggggtgatagaagtgttggaaaattgcattgtggtgatagttgtacaattctgtgactatcctaaaaatcactgaatagtgcactttaaatggatttggcatgtgaattatatctcagagctgtatacaaagtaagttatggttttatccttaaaattcagcacctggaggtcctctgctgctcttgaaggaaagaggaacagtcagtaaatatttagggactgcatagaagttagctggaagtttgattcttggagcatggagtaatggagagaagcagggtttgtcttcaaggagcttatatacaaatatagaagacaagaagattaggctaggtttataaatagcgaaaatatctcccacccctaatcatctgtgctaatccaggtcctctggaagcccttctcactaactgcccagaaaatcaagaactatgccaagccagtggaggaaggagtgtctactacattccaaagcaaaatataaatatttttaaaattatccctgtctgcctcctgggactcttgtgtgggtcacaaattgggataataagggtgccaggcctttgaagtcagccaaggccatttagggtccagttatttggcttgctttatatcttttctcgactctagggaaaggtttgttgagaaagcctagttcatttggtaacagttgtcaaacacctgctatgtgcaggggctgagtgagaggggcagcaggtaaacatgcagtgaccatagtttctgaaaagtgctctggccagaacagtagaggctgctcctagggcacacggcagagggcatttaacctagacctgggggatgaggaaggcttccaggagaagttagccaggagaaggagggcggatggtatatatattctgggcaaaggaaacctaccattcaggtgccgttctggtcctttcatacacattatctgttggtcaccctcactgtcaccctgtaatacaaggtattattattcccattttacagattagaaaacggacactcagggcctttaaaggacttcccaaagacaaagatgataagtggcagagttggaatttaacccagtttttctactatcaaagccaaaatgctttttaaactctgctgtactacttcttcgaacgctacaagactacatgttttataacatattttttctgattacagaaatacttatgtttgatcattgttgaaagtttagaaaatatagaaaaaacaaagattaaaaatgattcatgatcctgcaaacaaggtggtgtacagatcactgcagacaaggtggtgtataggttgtctagcctccaaactggattatgctaagaatctgttttttacaaaactatatgaataatattttctgtgttattaaacattctcctatatagtaattgtaatggttgtcaagtattctgtctttgggatttactataattctacccaattacatggctaaacttttaggatatcacccccctccaacttttgctgttataaccaatattgtgatgaatatttttgcagatcaatctttgtctcagtcttagataattttttagaatttagcctaaggactttctgtgtcaaaaagccatgcacattttaaggcttttgacttgaactctcaggttgtcttgaaaagtgtgtaacaatcacactttcatacagtgtgttttttttcctgcttgctacaaatattattgttgtctttttagcttgtcaacttgatagttattgcattaacattttaattttcatttctttccttattgttgaagttgaattctgaagctgcctatgattgttgtattaaatgccaaaatatataatgttgaccaaaaatgcgttgagcatttaaaaaatggaggtgtctttgtagaccagaggtgatgggttgagaatatattttgccaaatcctgcaatttcactgctggaacagatggtttagatgcaacgtgaggttatactgggagtggaaaggtggagggaaggaattatttcttagattcaataacaattttttactcacgtaggttcttaaaggtggacaggaagcacccacaaaacccaaaggtcgccccaagaagaactccatccccacatcagaagagattgaagctgaagagaagatgaacagccaggcccagggtcaggagcagctggagccctctcaggggcaggaggagctctgtgaagcacaggaaccgaaagcacgtgatgtccccttagagatggcagagccaccagacccgccccaggagttgccaataccctcttcggaacccccaccattaagctaaagtaaaacccttttgagggaagagggagactggggagaagggaaaagagagaaggcagggagagtagggagagaaaaccttccagcagcccagtaaactgcgggcgaagagatctacccgtctccctccctcccacagttaccattggccttgtcatcgcaagcatttgacaaagacttgcttgtcttgggcctgtcacctcctgaaaggctgctttagctgtggatgcccttgattaagggagagagcgcctaggagctgcctgccccagctggggtgacggctgtagggctgggtctatgttgcaagccctatatcctagcatgcagtggaaagtgcttagctctctccctcctgacctctgggcagccagtcatcaaagcagagagacgtggcggcatgtgggcagcatgcccaggttccttgctgactcagcacttatttctgtagttttaaaaaagaatttaatgtttttggttgtatttttttgggggggtgagggtgggcaaaaacatggggggagttctgagttgttagaaatgtttctgaatcaagtttgtttgaagacacgtgtgcctttgtacccattataagatggtcataagacccaagaactgataagctttggttttttttttgttttgttttgttttttgcttcatttacccattcatgcctagggttccattattggaaccctaagcttgtgggagttatttctatcctactgctcaaggtcatcaccaagatctgatttttcataaaaaacatttgtgaccttcggcataaatgggttaaggtgccatccctgaaactgcaatgcagatatgttcagataacttttattttttaattaaaaataaatctttcaaaaggattgagtgttttgtgtcttctgaggagtgtatctaacccttcctgaatgtgtcctatgggaagagagatccagagagtgaaccaaactaggggggccaccttttccccatctataaaacaaaggattgggccaggccattggtgtccaagtgctgagagctgtgggagtggaaccgagcctccgggatgaggacagggcagagtagctaggctctcccttccacctctcccaccgccttctgccagagcagctcccttctcagccgcttcacatttggggcgtccaatggtcttacttttttaaagaggtaagaaatgtatatgcttcaaaagtcaaaactataaaaaaagaagtcttgggctgggagcagtggctcacgcctgtaatcccagcactttgggaggcccaggcaggcggatcacctgaggttgggagttcgagaccagcctgaccaacatggagaaaccctgtctctactaaaaatacaaaattagctgggtgtggtggtacatgcctgtaatcccagctacttgggaggctgaggcaggagaatcgcttgaacctgggaggcggaggttgcagtgagccaagatcatgccatcgcactccagcctgggcaataagagcggaactctgtctcaaaacaaacaaacaaacaaacaaacaaaaaacaaaaaaaaacttgcttccaccctgccctctcctcccctgaatccccggtaggtaattatttttattggtttcttgttcatctttccagggtttcttgactaagtattcatttggatgatgggctctgcaacttttaacaaaagaagacctgagaactacttgactagatgtgctgggtgattttaaatttaaaaattgtgttccacgttaatttaagaccaaaaagaaggaggctctagacttcctagcaggaggactctgcctctgttttttttttgtctgattctcatgcattctggcccagagcctgatctcagaggggtcacctttatgatcactgccccagcgtgctcacctgtgatggcttacagggccgagtgcccatttagtggactctcagttattaattacacacaaactctgcccagttgcaggcttggagaataccaactttcaacagtggcctcaacaaggaagccaaatctgttactacttctgtaaaacaatcacataattcatttcaaagttaaacaggaaagatccgcgtgttttccatcacctggcaggccgcctgcttttctccattaacaatcagaaagtgactgcaattttgactttgccaaggcagtgcctcatcccctttgttattgagatcaacagagaaagcagtctttttcttaactcttgtgaatagacaaaggaggggaggatttggcttctgagaaccagtttgagcagaccacacctagctgcctgtgcgaggttgcttgcaccaagcaggcagaacgctgtctcctccacctgtagcccaccccatggtacagttttatgatctgcctaccaggtggtgtcacaatgagccaaagaatgtgcacaatggccaaagtaagccggtgggtcagtgttagttctgtgtcaatcctaaggaagtgttctgtcccattcgcgccaccccagagaggcctcctg

SEQ ID NO: 12275 - DNA, 9653 bp, Human
gacccgaagcgcagtgggaagggcttacagtcatctctcaactccccgaacttgcagggcaggggagcgcagaggtcagtgaaatccccagccaggccttattttagtcatgagtttccactggctccctcctctgactgtatcagcgctgctcacaccgcgggattggagtttcagctgttttccctgctcccggctgagtgagaaggtcacagagcccggacctttccgggggaggtgggtggggccctccggcagcctaagtgagattgcagagatctggggccgctggaggaggtccttccgccccgggcttggggctttgggttagcttctcccccgcttctctacctaggcatctcggttacaatgaaattaaaaacaaaacacaaagcaacacaagttctcattgtttttcccctctgtcagccagtggcctcgatacaattttcccagggctgcctttcctttattgctcaatttaacctcttcctagaggttctgcaagttcaagggcaggatccgtgtcggattcatcaactagtgcagcgcctagcgcagagcagggggctcaagaaatacgtgtcgaccgcatgattgctaagatttccctgtaacaggcggtttttttttcttgtctctctcatccctcctgccctgggtgcagaccgcgaacagcgccgccgaacttcccaacaggcagggagagggccgatccgggctggcacgccacgtccccggggtctcagtccctgggtcaacgcagagaggctcgcggtccgcggtgctacgacctgagcccggccacgtgaagcgtcacgccctgcgctgctgcagggcaggcgccgccgccgcggttgtgtaacgctgcagccggaggggaggcgaccggggcgcctctgctccggagggggcagaggagggagggagcgccgggcacagcgcccggtatctttctgcgcttgactggccgggaggaagggggtgacactggggcacccagggggctgcgcaaccgggtgcccgcccgcccgcaggttgtgcccaggagcggagctcctgggagcgaggggccctcggctcacaccctccacggtcaggtgcgcgcggcgtgctcggcggcagcctcagctgcccctgcgcttggccgtcggcccgcttcccatggggtgacatccgccccgcccctcggtccctccccaaggcgggcaattcctggacgcgagggtgagcagtgggggcagggaagccaggacggaaagaaaccccagcctctggggaaggctggggggccgggcgactccctccgcagcgcgccggttcctccaagcgggccgggcgggggaggaggaagagggctgggctggagctagcaaggggatattcctctcccggcttgagtcagacgcgggcggatccgtcctcccccgttccctcccaggagacgggaacttacttcatttccctggggcaggttcgcccacgttaccaacttctccccctcccccagcacccccgtcccttccagcttccgcgccccccacccaactgggcaggacccaggtcgtgctgccaccccctcttcggggaaaggcggccgcagccgcagacacctgggggccggggctgggggtgggggctccctagcagccgccggagcgttgtccaacacgtgagactcatgtgatgaagccgggggagggcgggcaggtcgctccttccctccccggcagtggccagacgtgcctggagtcacagggtagaacacgtagctccaacccacccactcgctcccatttaacccagcccgcagcctctccattactcctcggcttgcccccccacccccccactccgccctaaccgcccccccctcacccgctccctcccgcctccccgcccgccccacttctcattcacttggctcgcacggcgcagacagaccgcgcagggagcacacaccgccagtctgtgcgctgagtcggagccagaggccgcggggacaccgggccatgcacgcccccaactgaagctgcatctcaaagccgaagattccagcagcccaggggatttcaaagagctcagactcagaggaacatctgcggagagacccccgaagccctctccagggcagtcctcatccagacgctccgctagtgcagacaggagcgcgcagtggccccggctcgccgcgccatggagcggatccccagcgcgcaaccaccccccgcctgcctgcccaaagcaccgggactggagcacggagacctaccagggtaagttggcactccttggcccttcaagcctcaactgcagccccatgttatgcgccactctcaacttggagcagctccgggcgcaccgggaggttcttgcccggcagaacgcctgcagccgtgcgcaagcagtcacgacccttcctggtctctcttcctgcaggatgtaccctgcccacatgtaccaagtgtacaagtcaagacggggaataaagcggagcgaggacagcaaggtaagcaagtgcacccctagggaccctgcgctcagcccctcgcgcgcgctgagtttccaagaaaagttttctcgctttgaggttggcgaggggatgcagggtgtgggctcggtgcctcttctgagtgacttggaaaagaaagggcagacgatggttctgggtgctactctgctactctgctcctctgccggactgttgctgcggggctgggaggataggcttctcatctccttccccaagcgcccaccgcctccccgtgcgtcttgcaggagacctacaaattgccgcaccggctcatcgagaaaaagagacgtgaccggattaacgagtgcatcgcccagctgaaggatctcctacccgaacatctcaaacttacagtaagtgagaagctggcccctttccaacccagtcctttgcccagagggcgggcgggtcactcgccgcctgcaggttccgcggggaactgcagaccagactggcggatcagagctggcgggtggctctgcggtggggtcctcctccacagtcctggcgttttctggctgactcatgcaaatgaggcgagaaccacttggacctctccaagttggctccaacaccaactggccttccttttcaggagtttaacttctggtgattttcaggattccctagtttttctcacttaaaggaacacgccaagaaacacacacattttatttaccccttcccctctaccactccccccaccttttttgttgttgttgtcaaataaggggacttgctttggtgtgtgatttttacggcctgtcctttcttgacagtagccctcggctacttcgcagcctttggttggggaaatggaaaaaaaaaaaatagtatttcgggaggaacaaaaaagcctggatgagctggaagttctgaaagggtgtaaggaaagaagtagggaaagcctcttggctgccagacgtaatagaggtccctctctgagttgacaccactgcaggaaaatgttatctctggattcccctgagttaaggtcggcagaggctgctggagaaatttatctgtcaaaggattttcctgaggtagttgcagcttccaaaatgcctccaaagacaggtggcacccgtttttttaaattatttaattatatatatatattatatatatatatacacacacacacacacacacacatatatgagtgtatctgtctatctttttaaaagcatgacctacagacttaaaacagccaaccaggaaacactattccacttttttttttcttttctcatttctcattgctaataaatgtcccaaaggtgggacttctctgacctcaccgctgactaaggctcttttccttccagactttgggtcacttggaaaaagcagtggttcttgaacttaccttgaagcatgtgaaagcactaacaaacctaattgatcagcagcagcagaaaatcattgccctgcagagtggtttacaagctggtgagtgctgattctggctatgctctctttaagagtttgagtgcaaatagagagcccgtgggctcaacatctgatgtaataaacattactgcaacaaattgcttatgcacgttcattgggggagatgcagttttatctttcctaaaaggtcagacttttcatttgaaatgcattgtgccacctggcatgaatacgtattagtgaaatgataagatattcctgtggcattttagcttgagagtctctgggttctgggagatttccctactcccttttaaaatgccaaggcacctataatttgcattgtgggtgttttacagttggtcttcttagccctctttcattggagaagaaatcatgggtatgccccagcgttttcctgtttctttgcttccttgtcacttggtgtgtggtgtgatcctggcaggatacagcaggagtttttcctgcatttcatgtggttccctgaatagccactaggtatcttggtgaattgcacaatctagcgaaaccactgaagtttcatcattcgtttctactgacttccagataatcggagtcaaccttctaaccttctagtctcacttcttccaaataatactgtacagactggggagaattattctacccactccctcatttcatgcttgtctgccttcctctcgaaggctcgtatgatgaaaattgcaaaaacccagctagtgcttctgcctgtttcctcattcaaaataggaagatggtcatacctaatgtcttgaggatcatggatagaatatgtggagaagacatagaaatagcctaattaaaggtcacagcatgactgcaacttttacaaatcattgaaaataagtttactttaggtgattgttgtttcttcattcttttcctcattttataactatccagcctctgcccattttgccacggtgcaatgttgtatgcattgactcttaggtttataaatacatcagaatgttctttgctgcctcgcttacatggaaaactcacaaaccacctatacaatccaaaagaggggaaacagctcatctcatattaattatggtccatttccatgataggatattatgcaaccattaaaaatcatattttatctgagtgttagtatatggattattttaattatttatacttttcagtgtaattcttctctgagcatactacttttggagttaggaacacaaatcagtaaatgcattttttttttttaacaaaaactaaagcacctggttttttggagtatagtttccaggtgcgccacaggccttctgaaacgttttccttcggatttttctttccccaggtgagctgtcagggagaaatgtcgaaacaggtcaagagatgttctgctcaggtttccagacatgtgcccgggaggtgcttcagtatctggccaagcacgagaacactcgggacctgaagtcttcgcagcttgtcacccacctccaccgggtggtctcggagctgctgcagggtggtacctccaggaagccatcagacccagctcccaaagtgatggacttcaaggaaaaacccagctctccggccaaaggttcggaaggtcctgggaaaaactgcgtgccagtcatccagcggactttcgctcactcgagtggggagcagagcggcagcgacacggacacagacagtggctatggaggagaatcggagaagggcgacttgcgcagtgagcagccgtgcttcaaaagtgaccacggacgcaggttcacgatgggagaaaggatcggcgcaattaagcaagagtccgaagaaccccccacaaaaaagaaccggatgcagctttcggatgatgaaggccatttcactagcagtgacctgatcagctccccgttcctgggcccacacccacaccagcctcctttctgcctgcccttctacctgatcccaccttcagcgactgcctacctgcccatgctggagaagtgctggtatcccacctcagtgccagtgctatacccaggcctcaacgcctctgccgcagccctctctagcttcatgaacccagacaagatctcggctcccttgctcatgccccagagactcccttctcccttgccagctcatccgtccgtcgactcttctgtcttgctccaagctctgaagccaatcccccctttaaacttagaaaccaaagactaaactctctaggggatcctgctgctttgctttccttcctcgctacttcctaaaaagcaacaaaaaagtttttgtgaatgctgcaagattgttgcattgtgtatactgagataatctgaggcatggagagcagattcagggtgtgtgtgtgtgtgtgtgtgtgtgtgtgtgtatgtgcgtgtgcgtgcacatgtgtgcctgcgtgttggtataggactttaaagctccttttggcatagggaagtcacgaaggattgcttgacatcaggagacttgggggggattgtagcagacgtctgggcttttccccacccagagaatagcccccttcgatacacatcagctggattttcaaaagcttcaaagtcttggtctgtgagtcactcttcagtttgggagctgggtctgtggctttgatcagaaggtactttcaaaagagggctttccagggctcagctcccaaccagctgttaggaccccacccttttgcctttattgtcgacgtgactcaccagacgtcggggagagagagcagtcagaccgagctttctgctaacatggggaggtagcaggcactggcatagcacggtagtggtttggggaggtttccgcaggtctgctccccacccctgcctcggaagaataaagagaatgtagttccctactcaggctttcgtagtgattagcttactaaggaactgaaaatgggccccttgtacaagctgagctgccccggagggagggaggagttccctgggcttctggcacctgtttctaggcctaaccattagtacttactgtgcagggaaccaaaccaaggtctgagaaatgcggacaccccgagcgagcaccccaaagtgcacaaagctgagtaaaaagctgcccccttcaaacagaactagactcagttttcaattccatcctaaaactccttttaaccaagcttagcttctcaaaggcctaaccaagccttggcaccgccagatcctttctgtaggctaattcctcttgcccaacggcatatggagtgtccttattgctaaaaaggattccgtctccttcaaagaagttttatttttggtccagagtacttgttttcccgatgtgtccagccagctccgcagcagcttttcaaaatgcactatgcctgattgctgatcgtgttttaactttttcttttcctgtttttattttggtattaagtcgttgcctttatttgtaaagctgttataaatatatattatataaatatattaaaaaggaaaatgtttcagatgtttatttgtataattacttgattcacacagtgagaaaaaatgaatgtattcctgtttttgaagagaagaataattttttttttctctagggagaggtacagtgtttatattttggagccttcctgaaggtgtaaaattgtaaatatttttatctatgagtaaatgttaagtagttgttttaaaatacttaataaaataattcttttcctgtggaagagaaagatggtctcctgagttttttaaaatagctcacttggtgtgatatggctgactcccatgtccttctttcttggctgaagcaaaccagttaatctcagtgtaatttcattcagcttttcatgtgctttgtattcaatcagaataagcttagtcaacctggcaggtaaatattggttcaatttttgtttaacccttgccaggggttcatgatcatcctctacctctttccagagttaagtaaaaagcatattttcccctgcctgctttcatcgtggtccttggaacttgacagaaaaccaaggtatgacaccgtgggcagcagtgtctggggagcctgctggagggagaggcacattgagaaaagatttactggattattatgcaatactaattgatgctaggatagcacctctttgccaaagcagtctagctttttcaaatctagcaaggtctaatggatttgccatatcctgtcttattcctgctggaggcaacattccataattattttctacatccttcctggacttcctctccggtatgtttgtgcgtgaatgcatattgggtgttccttcgacaagtgctcttatttaaaaaaaaaaaaaaaaaattccatgggaaaggtgggaaatgaccctgtcgtgtatttttgcctctctcctttgccttgatttgcaacattcctgtgggatactccctgtcagaggtgtcctgatgtttcctgatggccagcgcctgactcaacacgctccggctcccaaagcatcccagtctgccaggactccctggttgtctggagtacagcagggaagctgcccctagggatttcttagccaggcagaggctccatctgaccatgaagactgtttgcttcacatgtcaccttccctgtctcctgatgggccagcaggtgaaagtgagcattgtctgcttgtgctggatgcatatggaatgcacgtaactgtccccaggccacaggctgttgtgcaaggagccgggaccaggaggtggaagcctggcatcaatagctggtggtctatcacctccctctccacgcctgcttttgactagataaaataagaattccgagcccttctcacaagtcccagagcaggcagatggcaaattctgtaagccactctttctcccagcccaacgcctgggcttccaggtctcatgcctgtgaaacacctcaattgctccatgagttgccagacctctctagctagacttttttggaaaaaacccaacaaatcaaacttaccctggtgatatagccgggggttgaaaaatcaagaccaaactctttttgcataaccctctctttttcccaggccactgcaggaggagtagctttggggaaaggaggaagtggttggagcaacctgaactaaaaaaaaagatttgagggttccacacacagtcaacccagaatcccgctatgggaacctgcccctgtcaaacagcgcctcaagttgcagctgtccctccacttcattttttgcttccagctcgcccttaacctctcttctagcccagttctagcggcatccaaatgcgctcagagggaggtgcgggggaggggcgcgcaccccagcctaatgcccactgcggacaaagaggacttctgtttaaaaagcggggtgtgtgagtgtcagggggcgaagcgctggctccggggccaaggagaggtggcaggaggcaggggagcggaggctgggcatctggccgccttcagacagggcgtgatccgccgggcctgccgggatggtctcacccagcgctgacctgccccgcctgttgacacaacgtcacgtttccgactgcagccctttcatgtgcggcccgcggctaaaagcggctgccggttcctggaagcagacgtgcctggcaccgcgtcagcagaaacctgatccccggggaagctcggcaaggccttgggatcgctcggcccccagaactagggcctggcagcgggcacgggacgccccccctcc

SEQ ID NO: 12276 - DNA, 171700 bp, Human
ctatatctggcttctctgaaagtgtagattggagttcattagactatttactttgtgcaattaaaagtttatgaactgaatgagaactctgacttctatttctaacgcactttttaatgaaaaattgttggggaatttgaatttagattatgcaagaattttaaatcagcatcttcggaaatacaacaacatctttggatttatttagccttttaaacaaagtgggcaagtttatcgagagattcatatactttgtttttccctatctttcatataagaaatactagattttttttcaataaaataatttgaggcctggcgcggtggctcagcctgtaatcccagcgctgtggcaggccaaggcagggcggattgcttgtgctcaggaactggagacgagcctggccaacatggcaaaacccggtctctacaaaaaatacaaaaattagccgggtgtggtggcgcacgcctgtagatccaactatttgggagaatgaggcacgagaatcgcttgtactcgggaggtggagattgcagtgagcagagattgagccaccgcactccggcctgggtgacagagcgagaccctgtctaaaacaaaacacacattaaaaaaaaaaaaaccacaaacaaaacctgcaattggccctcgaagggctggttccctcagtcagctctgcacgggtgcgccccctttctccctagaggtcaacaagcgactgcgaaggaaaacgccgccacaagtttcttgctgtttctggagagacctctcagagcgcatgctcttcggatagtcggtctgtagcgccattttcgtatggaagggactgcactctgattaggtacagccttaggacgcccagcgttcaagttgttcaaacagtacgtagagcctcgcagagacaagtcaatggcctcttttagcgggactcctgcctggagcgcttcagctgagactatgtaaagaaattcctttgtgttaaccttcctccttggaccagtggactctcctctctctcctgttccctccgcgcccgcccaggctggctcagcggtctcgccccgcccctccgggaccggagcactgtaaagattaggcatctgtgatgcttttgcgctcacattggcggcccagatgagagggcgtggagaaccagatgggaaactttttgtcccgtgagaacaaagtacaagttatatcagagtctggtatgtgtagaggaaaccaatacatgtactgtgagctaggagctggtgcttctttttcaattgtattttttataaagatgcagaccccctcagtgttgggcgtggggggtggctgaaatgttagctagaggcgaggcagggcacggagatctgaggtttttacgagtgtgtgtgtgtgtgtgtgtgtgtgtgtgtgcgcgcgcgcgcgccctacaagagtttagaagagcatgggtgagtgggcgagaaagaaagagaatgagagagagagagaaaagaaatctggagtgggacaagacttagagggtgcagaaaagaaagggggcgccagcacatcctagcctccgaggccgcgacagcgcctttggcgatgtccactctcaaccccgccgtttcattcataagtttctggcctacaggccccgcccgctcccctgggccgagggccccgtttcctgaacagcaattggtggacggcaacaaagccttagcaaccggctcctagtgacccgcggggcgcctggtaactggggctgctgcggagaaaggagcggggctgtccctttaagggatggccgcggagtcgtgaaagtggagggggctgagggagggcggggaggaaggtctgggggcggacccagggggaggaggaggaggaagagtaactgctgaaaggaggtggcgaaggaggatccggagcagctgctgccagcccgcgggcactgaagtcctcccggctgccgctcgagtagccacgggcgcgatcgggaccagaagtctcctcctccatgatcactttggaagccgggggaagactttgccctgccctgagagctggtctgcgtttcccaggcgcggcggcggcggagcagcagctgcagcagccgagtccaaataggagcggccacagccaggggcgtgagcgccccgcgcggagcgagctcgggttcccctcggaatgtccccggggcgcccggcgcgctgaccccgaagccgcctccgccttcggcgcctgctgcctccctcggccaggcttgttgttcgggactgtgagcttcctggctcctgggcagtggggaagcccccgggggcgagtgacctcagctggccacgacccagccctcccccgtgcgtatctcgcttaagatggcagcggagtcaggggaactaatcggggcttgtgagttcatgaaaggtgaggagcagccgccccgcatcttccaacgctttcttgcccccaactcttcacttcccgcgccactgtccccaccttctcctgaggctgccagtgtcctgcagccgctgcgcgcgctctcgtcccctctagggactctcctttctccgaggaccccctgcttccggcttctctttcttgtgtcccttgctccctctgcagctccctcggatggcctctcggcctcgtaatgggacagcaccggcttctgcccgtactccggcactcagcagctcatggggagcctgctccggatgctcaccggtcacctttactccaccatcgcaggcttcggttttcgggacacccccaaccacaccccccaagtctctctcccttcctctttttcaaatctccgaagctgcgtcgggaggctcacctctttcttccccttctcgcagctgctgaggtctggagatttgggaaccaaacttgcacctccagttctgcgggtacccccagctcctgcctactctgctggcctgaaacaagggaaatgtgggtgctctgagccccgctgagttcctcggtcaggtcctcctcttgcctaactgttgtgctcttgagtctctagctttctgggagggatgaggtttctgcaagaattccacgtgttaatggggtctttaaattgtgatccttcgtatgttaccacccaccttcacttccacttctctacttctcatatgttttttctgtcttttaaacttgtctttcagatcggttatattttgctactttaaggaatagaccaaaaagcacagtaaatacccactatttctccatcgatgaggagctggtctatgaaaagtaagtttatgttttgtttttttttctcttggccattcagcttgttctttgacgaggaaacactatgcacttttatggcagttttattcatttcccccccaatgatacgagtaacaatatcaattttttaagactcaggtgcctggggagaagttcagagaaaattgacagaatttgaacctttcaacacttcagttcttttagacatctatctgttttagttcttcctaccaccacaacaaacagcaactggagattcctaacattccccagagtaggaccagggagacacactgtcattgccagactcagtaattggcctgtgaatcagtcactaagtatttatggagtggccatagggtacagggcagtgcatgtattacaggtgcttgagctttatagtttacaagacttctgttctatctcaggatgtttttgtttgtgcagctctttttcagaaagtgggacacattaactgcggggagctgtatcagagtcacatttatgactaacattttatctgacatattattgattcttttatttgggtaccccaaactttttgatattattttctttgcttctaaggaaatgatatagcagtgctgatttattttctttgattactttgcttctgtgggattaggatttgagagtgtaaaataaaagtagggaactgttttctgtgaaagaccactgatctacaggaaaaagatatcttaatacttcaggcatagtaaaacattaattgaagagagataaatctttattcagtaaaagtatcagataataagaaataagaaggctgaattgacttggttatgtacttttatgaaaagagctggtgtttcagaggagtctaatatattctattttaaacgtttaaattacttgttatctttaccaaatgtgcagataaatgaacatagttaaattaatcataattagcttccttggacttgtcttgttagaaaggttattggcagttctgcctaaggatttgtgggtactaccaggtcttcgaagagtaagtgttctggaccttcaagagcatatcttttatttgggggaaaacaatctttgtcacttcatcatagaggttcttgaaactgaggtctgcgacatttctcttagtggtgctgggaggagaatgcttcttgaatggctaaagtaagagtgggaatgaaagagccctttgctgctgctcatgaatgcccagagttgctgaggcaaagaggtctgagtccctggtgtcagattacagctctgcttctagacaggatggagttatgtgcggctgtgtacctggatgatgtcactgccagcagtgtttattgagtgttcactctgttgttgggaatgtgcattgttgtgcctctgtttttgtgattttaggttttgggggtctctcatgagtctgagagtggggatggtgtatatatcattatgttcaattctacagtacagtggttgttaatatgtcattgaatgagctctagccatggagatctgagtcacttctcttgggattgctaggtggtagatctagcagaaaattaagccaaactaaacactgtgcatgatggctttttgattttaatattgatagatgagggaaatttttaatgtgattttcatgttggtattttgggataggcctacaaatcatattcctcttatagtctactgtttttctggtatcttataaggaaagacttgctggagaaaccatccaatttatattgtgagttgggattgacatttgaaatacgatgaggacttcagcctgggcagagtgtgtacttttcttagtttgaacttaccctactgtgccacagtaatggctgtggctctgacacctccaactccatcttttttgttaccccaacatattacatggtgctaggtgatgcagagaataaaacaatgttgaatgcatatgttaccttcaaagagctccaagcctgtagggaaaataacagaactgcagtttgaggtataggaaagatacctgcccaaagagaaatacaacctctatgctaggagaggcattcacaggcaggtaggggcacatctggtggaagggttcagcaaaggcttcgtggaagagttaagattggcttgaaggatggacaaggtcttatcaggcagagacatgagaggagggatcttggaaaacagcaagtgtgaggaggggagaggcttgggacgtgtgttcagggaacagtaagtcctccagtttgcctggtgtgtattcagggaacatgtaggggatggagaatgtgaaattgagatgttggctggggacagaatgaatgtcagggtgagaaacctgcagtttctttggtacaccatgggactcttgagggatttggggcagccatggtatgacttgatttgtgctaattacaaacaatgggaaacatttattgagcatttaaatgtgtgccagatgctgttctaggtgctctataactattaattcattgtgttttcacaacaattctgtgagacaggcactattatccttattgtacaaaaaggcatagagaagctgggtcacttgcccaaggtcacagaagtaaaagtagcagagctggagtttgaaaccaagtcatctagttgcagaggacatatatccttctcaaaaaattaatacagtagcatcatttaagaggggttgttaaggagataagagcccacttaaaaaaattcaggggggaccaggcatagtggctcacgcctgtaatcacagcactttgggaggccgaggcaggtggatcacgaggccaggagttcaagaccagcctggccaacatgttgaaaccccgtctctactaaaaatacaaaaattagctgggcatggtggcgtgttcctataatcccagctacttgggaggctgaggcaggagaattgcttgaaccaggacctggtaggtggaggttgcagtgagctgagattgcgccactgcactctagcctgggctacagagcaagactctgtctaaaaaaaaaaaaaaaaaaaaaaaaattcaggggaaagaaacaagtacctggattaggatggtgacaatggtgatggaaagaagcgatctgaagccatgtgacctggcaacacaggagggtggcgtggaggggtgctgaggaaaaagagggatcaaagaagtccttaagacagcttaggttgtggtgagcctactggagctcttaactgaaataaggaaggagggtggaataattggctttggtgggaagatcaggcattccattttggccagattgaatttaagaaatttaagggatatttacatcactgttagatatcacatacatttgaggttcttaaatttgggaattttcccaaagagactaataaagctgtgagaatgatgcgatttctgggaagatagagaaggtctcaaggtctgtatttcacaagtagaaccaggatgggaggagcaagggaaggtggaagtacgcaacaaagaggtggacaaacactgaaggggaaaggagaaagggagaaggactgactccatctcgtcagctccactttggggaagtatagaatgagagagactgcaaagcccctagaaggatgtctagtaacccgggctctgtctggaggacgtcctacagcgagaaagattttgactatcacatcataatgtgcatgtctctgaggagaagaatatatttatattcattatcacacaggcctttgtactgtgtaattatttgctgaatgtttaaattaaatgctgcttttccagctgggtgtgcttgtagtcccagctactcttgaggctgaggcgacaggattgcttgaggcctgcagttgaactgaaaagccagcctgccagcctgagcaacatagtgagaccccatctcttaaaaaaaaaaaaaaaagaaagaaatgctgcttttctggctaaattatcaccttagaagcgattgtttttgaatcaggaagtagactctttaaatattaggctgtggatattctggccacagctgtgttttgcgcagatgtttctttagttatgaaaggaggacagcattccatgattgaaatgtcaaccttctgagatgctggtggagaaaatttaatgaggtggcctcatgaggtaaggctattaaaagtgaacgtttgaattatctgcttgattttttaaaacagaacttattactataaaggcctgggcagctttaataaaatgaggatgataagaaatcatcctttgtccttgggttatgatttcacaggtcagagttaaaatcaaagtataggctaacacactagtggtacaaaaatagctccacaaaaagggagcctttcaaagaagatttatctgcatttgattaagctacaaataacacaccactccctggaaaggcttgttctttggtattggaattgggccccgtaatccaaacaggcgcttacttttaataacttggcttacttttgtgtggctaaaaagttagtgaaatgaaatatattacttgttatgacatctgtgtgcccctcctagtggtggtcatgggtgtagggttggatgttcatggcatagaaagccagtttgctgggaaggatagtgtatagggtcttcattttcagcctgtccattgtcatttcttctctttttgagttgtgaagaaaggtattgaaagtgcaggaaagagctctttagggagaaactctagggactgaattttaagcagtttctgaagtgacttgaagaatttcaccaaatgttttagcatgttaagaatgagcagcctctaatgagaactaattagctaaatggaagatttaaataatttaaaacattcaattttcatttaaacttaattaaagcagcctgatattaatgcatccaggaagttttggataagtaatttatagaaaaatgatttcttttatcttgtctatagcatagttttgagtcaaaatgtgaacatagaatatttatgagagaagcatggaaaaactactcttgcctagaaatatttgtgggaatgcatatttaggttagaggtaggtcaggagaaacccttttggtttttaaatttttatttcaaattaaatgtatagcaagtaggataatttaatggaaggttgaatgccacttaagcatatacacacatacacatatatatgatctgatagagccttacggtcatcatttagaacctcaattctcattataaattgctatgatatagacagaagaggagatttggttgaacctcgagacaaatttcattgtgggaataataataaagccatagcaacaacaacagcagcagcagcagcagctaacatgtatagccctgtgccaggcagtgttctaagtggtttacacgcacacattaactcaattaatcctcagaacaagcctaggagttagatgctgttattatcactacttaacaaaggaggaagtagaggtccagagagggaagtatattgcctaaggtcactgagctggtaaggcagagcagggatgcaagccagaggcagtccaccctggagtccaggcatttcccagttggcctgagactgatgccaatggggagggtatgggacaactttgccccttcctgacagacttgatccctctaacttgggtggtgatggctcttgggggaaatgtgccactgacagtatatgcacaaactatgaccagctcctatctgggaatgtgtggtggtaatttaaacatttttctttgtaatttcacttttggggggtataattttgccttttttttcctatcagtgcactaccaaaaagaaagagaggaaagaaattgagttaattgtaggacacgtgaaaacgaaagaagcccagtttttataagcctatgataactgcttttgtaggctgtctggtgaaatgttctggctgcttacctggtgtaacttaaggtgatttttttttttaaggtattctccaaaaaaaaccctcagaaaactgtttactttctaaaagatggtagtttatagtttcttcccccctttttcttctcttcatccaaaccttggaaaagtaatattgttcagggctgctttttttcaccttcttctttttttttttttttttgagttggagtttccttctgttgccaggctggagtgcagtggtgcgatctcagctcactgtaacctccgcctcctgggttcaaccgattctcgtgcctcagcctcctgagtagctgggattacaggcgcgcaccaccacacccagctatttttttttttttttttgtatttttagtagagacgaggtttcaccatgttggccgggtggtcttgatctcctgacctcgtgatctgcctgcctcggcctcccaaagtgctaggattacaggcatgagccactgtgcctagcctttttcaccttctgttttgaacacatgacagccagtgttatgatgtagtatatgttaagaggaagtagatatatctgtgtacattcatagttagttctttttttttttttgaaacagggtcttgctctgtcacccagactggagtgcagtggggcaatctcggctcactgcaacctccacctccggggttcaagcaattctcccacctcagcctcccgaatagctgggattatgggtgcatgccaccatgccttgctaatttttgtatttttttgtagagacagggtttcaccatgttgaccaggctggtctcgaactcctggccttaagtgatctgcctgcctcggcctcccaaagtgctgggattacaggtgtgagccaccgtgcctggcccacagttcttaattctgtaatccaggggaatcaaatttaccttctagataatgatttatttaaatatctgctgttttgacctcttaggcattcggtgtagagttgatctctaatcttcataatgataaattattactctgttttttcagtttgcttgagataaggctgtgaaaacaaaaaatgtagccgaggtgctaaggagagttatcttaacagggctagtcataatcatgcagcctgagagagagctccaagtgggctgcaggagatcccagtggggagctgtcagccttccaagttctttctgtgccaggtcaccacagggcggcttcattattttgtttgaagtagattcctaagacatcagatgttctcatttgtaagttcataaacacattcccaagccagaagtaaatgacttttacttagccacagctcaatacccctttgtgcttaaaaaaaaaaaaacaacaaaaaacaaaaaacaaaaaaactaaaaactaaaacacaagcctcacaaaactcttgacacatttttatgggaagtgaaaagcataacttaaaactttcataagtggttgaaaattgctatacaagaaacttagtatttagatgggatagattttgatgcagaacactgtactaatgctttggagatatgtatttgtaaagaaggaagtagaaacacatgcagtacaggataatacatgaccaaagctgcaaatgtatgtgttaggagttcaagaaaggaagagattattgctacccagggtgataagcactgagctagtttttgaagggtgtataatagcaaagagtacattttatgatctctgtgaggaccagtactacctgtttttgctcaccattatgtcccaacacctagcactgtgcctggcatagatatggggctcaagaaattttagttgaatgaatgaatgagtgagtaagtgaatgaggaagaaaggaaagaaaaagatttcaggcagagtcctgagaaaaggcacaagaggtgtttgggaatagcaagattctgttagaggaggtgtaataatatttgaatggagaggagtcacaggtcacagcagcagtcacttagttggggactggattgtggaaaactgtttggatgtcagtaaattgtgcttgcttgtaaatggcagagagtgaccagggctctactttaggacgagtgctgccatcgctcgaaggtggggtcagttaggctatggaagaattggattagggttgcagcagtggggaaagaaaggccagatggggagaggctggaaagaattggttgactggatttgggactgagcagatgcgggtagggaggaggaagcaaaggtgaattcaaagtttctggcttgggtgactgggagagagggacacctttaagtaggtgaggtacgtaaatcagaaggaaactgcctttttgctattctgttttgttttgaggattggagataggaagtaaaaagggggtcattataatggagtctttgtcttttgtgatctttaagcggaaaatagaccgtgtctgtcctggatatttaaaatgtggggaggtaagtggcacaactgatctcaagttcctttctggctttgtgatttgagctgaattttttatactgaattgtgaaattcattgtgtcttagaaatattttttttaatttttcaaagaatattgcttttctacaatgaagaaattcaaacctacagtgctataaatttttaattggcataattttgtatatgcagttttaaatgctgatttttttaatcatacatgagcattgtaaaccaatgccatttttcaaaatcaccataaatgtctctatattaataatatttcggggaaaggatataccatactgtattgaacatttttctctctttggtcattttggttgtttcctatgtcttgtcattttaagttgttccaattcacattactgaagcaaagtagagctgtgaataattctttttaaagctttagtttcaatttacttaaaaaatatattggtttgttttaatcaacgaaatacttccaggagcaccaaagaattttatgtggattgagagtcatcaaaaatattgctctatttattaaaaatatgtaacatccccagttcttgacaacttgaaaatgaagcagcattgttgcctggggtaaatacccggggttcttcatctcatcgaagattaacaataggtacacgtgagtgggttaaggagcagagactttaataggcagaagaaaggacagaggagagagtagctctccctctcttgtgagacagaggagtccaaagggaaaagcgggcctgcagctgaccgcaacaggttttatagtctggcttgaggaagcggtgtctgatttacatagggcccgcagattggttcaaccaggtgtgacgtttacgtagtgggtggggaaggctgatcaccccaccctaatcttattatgcaaatggactttccactcggccagtgccgtcttgtctgctcctcactgtacatgtggctggcaaaaagagaagatggagctgccattttgaacatgcctagtcccaggtagtagtattcctactggcacaactgccgacattcacctgtgcaagtttccagcttgcttgtttacgtgtgcagctctcttttacaggctgctgtttgttaaaagagaaaatgattttagggctgcttttcattaaaaggaaacccttaccgagggctcccgaaccctcagtacctgcctaagtaatttctttttaactcgtatatcaaaaacatctggtaaatgatcacaattatttgttgttgacagtgaattcctttataagaaataatttgtgtaaactataaatttgaataagatatttcctttattgttaatttaattttttggtcttaaatattttcacatcctagtgacaaattgaagaatttgccagtttagacttctctttttttttttttataaaatttaattttcttttgagaactggaaaaggtagtttatttcaaatttggtccccatgattgatgtactttagtaatgcatttattcagttttgtgtatctggatatgtggcatttcagtgagacagcttctacagagaattggaaaattacattctgaaatatcaaagttttataatttgaataatttacggaaacctttctaaaatgaatatacatttctgccttcttaaagaatttactggccaggcatagtggctcacgcttctaattccacgctttgggaggccaaggtgggcagattgctcgagcaacatgctgaaaccctgtctctacaaaaaatacaaaaattagccaggcatgttccacatggctgtagtcctagctactctggaggctgaggtgggaggatcacttgagcttaggaggtcgaggcttcagtgaaccatgagcatgccacagcactcagcctaggtggcagatcaagaccctgtcacaaaaaaaaaatttattgatcacaatttactttttttctgtcatacacagacttcatcattatggatgatcatcttttttttttttaattttttatttttgagatggagtctcgctctgttgccaggctggagtgcagtggcccgatgtcggctcactgcaacctctgcctcccaggttcaagcgattctcttgcctcagactcccaagtagctgggactacaggtgcatgccaccacacccagctaatttttgtatttttttttttaatagagacagggtttcaccatgttggccaggatggtctcaatctcttgacctcgtgatccgcccgcctcggcctcccaaagtgctgggattacaggcggagccgttgcccccggccctgtgatcctcaccacaaattttagagtaattattttccttttgagagcctcagccactttatgaaatctgagggttagccttttatgtatgggggaatcgctcatcattctgttttctaacaaagctttgcatatactgtctgtatagctctcctgccttcagtactagccattgaataatggagttaatttacactgcttgagaatatttctgtgggagtgaattttaattttcccagtgcattcctgaagaagtctccttttgttttcgttaatctgagtctctaagggagtttttattaactgaccttctctaacgagggatgttagaattacagaccctgatactggaaggtttcttgataccatctggtctgttgtttggctttaaggcaaagtgaaagcactcacttattttacagaaacagcagctgacacctgacctgaccagtatttacctcgggttaagaaggtaataagtggagaatggttcctcaccctctggtgttgtaaacctgaactttcttagaaatctagacaatgcatcaagggacaggattgatagttgatattggggttctctccttcctttatgatctcaacaaatgtcagactttttgcagacaagtaagtaataaagatgataagtttcctaatacatgtagctgctttgtagtctgtgggtttgctttctggctgtgcagaaaacagtgaatttcatggaaaaagttgtgttcttttccttcctcaaagaggagacactctgagggaaatgttttctgtacccagacccaatgcactgagaggacagacagaacagagaacatcaaatagggcaagtagaccttgagaaacatttgaacagttgaatgggtttgtccaataaggataactagagtcatagactctgtagagtctatatagcggctagaactgtgatatatgatattacataagagctggaaagaactttaggagccatctaattcagtggcttcatttgatagatgaggacgtggagtcccagagaggctacgacaccagattagggacactgagtgaccaaattgggactggaaccttttggcacccagtgatctttagttctgcatcagactgctgtgtgtgtgggaagcttgttagatgtgcagcaactcttccccaagaagttggcatcagtgtgactgtgggtggttatgctaaagggcttgagcaaaaactcagactagtgccctcatctgaggttggtatttgttatgcagttaggacctttttaaaatgtgatcattatgagttcagccataataatcacgtctcatacagaaactttatcatctgactggaggggtgcggatagtattctagtgatagggaaactgttaggtaatgtgtggcccagaggcattgctgatcaatttcaacaaaattttacacacacacacacacacacacacacacacacacacggtctcattgtgttttggaggatactgctattttagcatttatcacattgtaataatgtctttacctgtcttctcagtagatagtgagctccttgtgggtagggactggtgaccaataggcttttagtaactatttgagtgagcaagtgaatgaagagacaaaaaacgtcagcagtgctggtaaaacattgaaaggttggcatgccttataacgatcttatagaatttattcatcctgtttttaaagcagttaattttttttgtattgcaagtactctgtgatgaatatgctaactagtaatgccttgctcagaataggtagtcataaattttgttgaatgaatgagtacttcttggaatgtagcttatctttttgctgaggtgttgggaattttcacatgaagcttctaatgtgtagaataaggtataacaatacttcaaacaatgattcctctgggaattgactcacttaaattatagtttattagaaaaaccgaagacaaaataatggtacatcataaacttcataaatctgtgagaagagctgcacatgttgagtatgacagcaaggcttttaggcccagcttctatgtcccttcaaatttgtaggacctgcacctgtggggtggtgggtgatcctacccttgtgaatgtttgctctgatccttgggctcctgtttctttgttctcctggtaaggagatgaacctccttcctcctccacttgcaggactccaaatgctccaattcttttagtttctttcctgtcaaaacagaaaagggtttgattttagctatttacacttactgaataaaaagatggatggaccgattttcccttaatagttcatgagtttcattgtaggcattgacccataatttgccaatcttcttagaagaaatctgcaaataggtggagagaatcattcgttcatttgttaattcatttggagatgaacgcacgggtactctgaaataataaaatgtccgtgtttttccctggccacatgagaccaaaagactactcccctctgccaagacaaagtggggacccgtgcttggctgtggctctggaagccttttcctaggaaatgccagagtggagaagactctgtccattgtcattaacttcaagtttaggagtgcactcagccctcagatttctgaatagtctctgaagtacttatttctaccatctcctcccttttcactatccccaggttgatgaccttccatttctcctcttccaccctgcttttgttccaagctgcccaaataaatctagcacatttgattattttcattgattatcaattaatttttattttgaatttccctctagctaatagtatgtattataagtatgttttcatttttccctcaactctggtgaagaaggttcttacaaaggagcatgttgttggaagatgtcttctttattcacagtatttcattataccaaagttggtgataacccagcatggtgtgaacaactatcagcaatttttcaatgatcttgacatttaaaaatatatttattaatagtaagctagaaaactatatgtataagactatattattttaaatacataaatagtcttacaagtgtaagtattgtatcaaatgaccttaagataagatagagcttgttggctttatatttgtgacaattctgacttttgaagacttgttcaaaattgctcttggttgtgcaaaacttttgactgaatttttttagtgtaacttgaagctcatccgtctttttgtgggatataaaggctggcccactgagcttcaacatactgtggggtgggaagtcctctgggttaggattgcttattttttttctacctttaacctgaggctcttgccaaaagagaggcataacttcttcattgttgctatctttggatagcagcctactcttaaaacagcctgtctttttgagagacagtgaaggagggtgggaactagatcctcacctatttttccattctcttatgttccaagtcccaactggctttttggaaatatgaccctcttgaacaaaacaggataaaaattaccagggcctattctcactgttgggaaataattgggcctttgtagggaaaggatattgtcttcaaacattttatctatacttcgtttatggtacttggtaatttcttttatcttttatagttattttgatatgtcttttcatcttgatcagtattgtccatcagtgcagaacattgttgaattctgtagccattagctacgtgtggcttttgaacacatttgaaataattgaagaatttttaatttgtttcaccttagttaatttaaatttaaatagccatgactagtggctaccatgttggagagtacagatcaacttaaggataatgtttgtatttgatttactttctcctgtgttattgtagtatgccaattttatttcctggtgtttggtgaaataggttcatatgtgaaccatattgctttcaaaagtacatgtggctaagccaatctgattgttagaaattgtacatctttgaatttgagtttgaagttggattgtaatggttagtatgaaactggaatttgatgacgaattcttttttaaaaaatttcaacttttattttagattcaggggtatatgtgcaggtttgtatacaagcatattttgtgatgctaaggtttggggtataaatgatcctgtcacccaggtagtgagcatagttcccaatagttagttttgcaaccctttactcccttcttccctccccacttcagtagtccttcatgtctattgttgccatctttttgtccgtgagtagtcaattgtgtagttcccacttataaatgagaacatgcggtatttggttttctattcctgcattaattcttttaggataatagcctccagcttcatccatgttgctgcaaagatagaacgatttattttcttttggatatatacccagtaatgggattgctgggttgaatggtagttctgttttaagtttttttgagaaatctccaaactgcttttcacagtggctggactaatttagattcccgccgccaacagtgtgaatctgttgttttttgacattttttttttttttttgagatggagtctcgctctgtcgccaggctggagtgcagtggcgcaatctcggctcactgcaacctccgcctcctgggttcaagcaattttcctgcctctgcctcctgggttcaagcgattctcctgcctcagcctccaaggtagctgtgactacaggcatgtgccaccacgcccagctaatttttgtatttttagtagagatggggtttcaccatgttggccaggatggtcttgatctcttgacctcgtgatccgcccaccttggcctcccaaagtgctggaattacaggcgtgagccactgcctagccttgactttttaatagtagccattctgactggtgtgagatggtgtctcattatggttttgattggtgtttctctgatgattagtgatgttgatcatttttcatatgttaggtgcttgtgtttcttcttttgagaagtgtctgttcatgtcttttgctcattttttaatggggttatttttctcttgttcaactgttaaattcctatggattctagatattagacctttgtcagatacatagtttgcgaatatttttccccttctgtatgttgtctgtttactctgttgatagtttattttgctgttcagaagctctttagtttaattaggtcccacttgtcaatgtttgctttttgaggacttagtcataaattctttcctgaggccgatatttagaatggtgtttcctaggttttcttctaaaaatttttttttttttttgagacacctaagttggagtgctgtggcataatcatggctaactgcagccttgaccttctgggctcaagtgatcctcctgcctcagcctcccaagtagctaggactatagatgtatgccaccacacctggctaattaaaaaaaaaatttttttttttggagacagggtctcattttgtcacccaggctggagtgtagtggcaccatcagaaatcactgcagcctcgacctcccgggctcaagcaattctcctgcctcagcctcccaagtacctgggactacaggcatgcactaccacacccagctaatttttgtaatttttaggagatggggttttgctatgttgcccaggccggtcttgaactcctgggggtcaagcgatcggcctgccttagcctctcaaagtgttgggattataggcatgagccactgcacccagcctaaagttttttttttttttgtagagatggagtctccctttgttgctcaggctagtctcaaactcctgagctcaagcaatcctcacactttggcctcccaaagtgctatttcataagcatgagccacggctcctggcctcttctgggacatttagtttgagatcttacatttaaatctttaatctatcttgagttaatttttgtatacggtgatagataggagaccagtttcattcttttgcatttggctagccagctatcccagcaccatttattgaataggaagtcctttccctagtgctatttctgttgattttgttgaagatcagatggctgtaggtgtacaggtttatttcggggttctctataatgttccattgttctatgtgtctgtttttgtaccagtaccatgctgttttggttattatagccttagagtagagttttaatttgggtaatgtgatgcctctggctttgttctttttgcttattgctttgactatttggccttattttggttccatatgaattttagaatagttttttttctaattctgtgaaaaatgatactggtagtgtaataggaatagtgttgaaactgtagattgctttgggcaatatagtgattttatccatattgtttcttccaatccatgagcatgtaatgttttttcatttgtgttgtctgtaatttcttttagcagtgttttgtagttctccttgtagagatctttcatgttggttagatgtattcctaggtattttagttcttttgaggctattgtaactgggattacatttttgatttggctcttagcttgaatattattggtgtatggaaatgctactgatttttgtacatgaattttgtatcctgaaaccttattgaagttgtttatcagttccaggagccttttggcagagtcattaggattttctaggtatatcattatatcgtcagtggaaagagatagtttgacttattttcctatttgagtgccttttattttttctttggttgcttgctctggctaggacttctagtactgtgttaaataggagtggtaagagtgggcatccttgtcttgtttcaactcctaaagggaatgcttccagcttttgttcattcagtatgatgttggttgtgggtttgtcatagatggctcttattattttggggtatgttcctttgatgcccagtttgttaaggatttttaccatgaacggatgttggattttatcagaagctttttttgtgtctttgagatgatcacattttaaaaaaatgtttaattttgttaatgtggtgtgtcacatttattggtttgcatatgctgacccaaccttgcattccaggaatgaagcctacttcatcgtgatgcataaactttttgaggtgctgctggatttggtttttggaggatttttatggataacttgaattatttttgctttcccaaaatttattcaaagtgagtttaaaaagctgaaataaccatagctaaaacttcaaattctaccagtgtcaatattcatatacaagtagaaaaaaaacaagttatattagtcaaaagtgttgcttccattaacccaaggataagaaaatctcttatttagaaaaaaggttaccttaatcaatactggtagatgcatatttatacacaggcatactgtggagatattgcaggtttggttctagaccaccacaataaagcaaatactgcaacaaagcaagtcacacaaggttttttggtttctcagtacatataaaagctatgtttatactatactgtggtctattaagtgtgtagtagcattgtgtctaagaaagcaatgtatataccttaactaaaaatactttattgctaaaaaatgctaatgatcatctgagcctttagcaagttgtaatcttcttgctggtggagggccctgccccagtgtgatggctgctgactgatcagggtggtggttgctgaaggttggggtggctgtggcaatttcttaaaataagacagcagtgaaatttgccatattgattcactcttcctttcatgaaagatttctctgtagcatgagatgctatttgatagcattttacttagagttttcaaaataggagttaatcctctcaaaccctggggctactttatcaactaagtatgtgtaacattctaatttttttgttgtcatttcaataatattcacagcatcttcaaaaggagtaaattccatctgaagaacccagtttctttgctcattcatgagcaaaaggtgtgagcatgataaagttgaatgagaagcaactcatcattcaagttttatcatgagaatttagcaattaggctctacttttaattttagttctcttgccatttccaccacatctgcagttacttccatcactgacatcttaaacccctcaatagcattcatgagcgttggaatcaacatctttcaaactcctgtgaatgttaatatgttgacttcctcccataaatcttaaaccttatgaaccaacctctgctaacttcatacttttattctgcagcttcctcacctctcttaaccttcatagaattgaagagaattagggccttgctttggatgaggctttggcttaagggaatgctgtggctggtttcatcttctatccagatcactaaaactttctccatatcagcaataaagctattttgtttttgtatcattcatatgttcactggggtagcactattaatttccttcaagaacttttcttttgcattcacagttggctgtttggagcaagaggcctagcttttggcctatcttggctttcgatacaccttcttcactaagcttaatcatttctaccttttgatttaaagtgaaccatgtgtgacttttgcttttacttgaacactgagaggccatgatagggttattaattggcctgatttcaatattgttgtgtctcagggaatagggaggtccaaggagagggagagagatgggggaatggctagttggtgaagcagtcagaacacatatgacatttatcaattaagtttgctatcttatttgggtacagtttgtggagacccaaaacaattacagtagtaatatcaaagatcactgaccatcataacagatacaataataatgaaaatttaaaatattgtgagagttaccaaaatgtgaaacagagacatgaagtgagcacatgctgttggagaaatggaactgatagacttgcctaatgcagggttgccacggttcttcaatttgtaaaaaaatgcactatctgtgagcatgataaagtgaagtgcaataaaatgagatatgcctatactcttcattttggttcttttgagttagtttttgttgacttgtcttggactggtcagtaaggggattataggtatagttcattttggattcgtgggtattttgtttacatttacaatacaacaccacactgggaagttaagaaatgagtctagaacttttatttcaaatcactgctgctttctttctttctttttttttattattattatactttaagttttagggtacatgtgcacaatgtgcaggttagttatatatgtatacatgtgccatgctggtgtgctgcacccattaactcgtcatctagcattaggtatatctcctgatgctatccctcctacctccccccaccccacaacagtccccagagtgtgatgttccccttcctgtgtccatgtattctcattgttcaatttccacctatgagtgagaatatgcggtgtttggttttttgttcttgcgatagtttactgagaatgatgatttccaatttcatccatgtccctacaaaggacatgaactcatcattttttatggctgcatagtattccatggttgtatatgtgccacattttcttaatccagtctatcattgttggacatttgggttggttccaagtctttgctattgtgaatagagccgcaataaacgtacgtgtgcatgtgtctttatagcagcatgatttatagtcctttgggtatatacccagtaatgggatggctgggtcaaatggtatttctagttctagatccctgagaaatcaccacactgacttccacaatggttgaactagtttacagtcccaccaacagtgtaaaagtgttcctgtttctctacatcctctccagcacctgttgtttcctgactttttaatgatcgccattctaactggtgtgagatggtatctcattgtagttttgatttgcatttctctgatgcatctctgtgttcttctcatgaagcctgtgtaaagggacagctaaatttggtgccacctgtaatataaatttcaaaatattaccaacctgcctaatagggatgaaatatacaaattcagcattctttatttatctaaggcaagtggctattggcagattttatgtaatgtaatgacatagttatgatagtgtcatttgggtggcagcaaaaaaattaaatgactaattcaaaggtcttttggggatggattttggaaatgtgttggtatttagtaaatttgtggtctagactaaattgaacttaaagcattaatgaacaaactatttcataatgaatacttgtttctgcttttgtattacctgtaggacattcttctaatcataagtatatgatacagtccctgacagagagacttacattgtagttgattaagtagaatcaatacttaaaataatttgcaatatttagtagtatatgtagtagactaaacgaatgactcagacggtaagttttgaaaactttgagagaaaggtgttccctaggatgattggaaaggcttcatggagaaggtgggatttgcactggactttgagcaaggtagagtgtagcagaaagaaaaggaggacactctagacaaggaaaccgatgtgagtggaggcttagataaagaatacatttagaatatttgggaataaggaatggacatgtttgttggaatgcagatttcctatgggacctctcaggagataaggtcagcctggaagctaggggaatgttgtgtaaggctttgattgctgggccaaggaattattctaaaggcagtaagaaaccattaaacatttttgaatagtgggaggatatgtgagaactgagactttatgaagactaatatctttcttggaatacaggatgattgggaaggggagagagattttaaaaagtacaggcatttctcaaaagaagacatttatgcagccaacagacacatgaaaaaatgctcatcatcactggccatcagagaaatgcaaatcaaaaccacaatcagataccatttcacactagttagaatggcgatcattaaaaagtcaggaaacaacaggtgctggagaggatgtggagaaataggaacacttttacactgttggtaggactgtaaactagttcaaccattgtggaagacagtgtggcgattcctcaaggatctagaactagaaataccatttgacccagccatcccattactgggtgtatacccaaagaattataaatcatgctgctataaagacacattcacacgtatgtttattgcggcactattcacaatagcaaagacttggaaccaacccaaatgcccatcaatgatagactggattaagaaaatgtggcacgtatacaccatggaatactatgcagccataaaaaatgatgagttcatgtcctttgtagggacatggataaagctggaaaccatcattctgagcaaactatcacaaggacaaaaaatcaaacaccgcatgttctcactcataggtgggaactgaacaatgagaacacttggacatgggaaggggaacatcacacaccagggcctgcctgtcatggggtggggggatgggggagggatagcattgggagatatacctaatgtaaatgctgagttaataggtgcaacacaccaacatggcacatgtatacatatgtaacaaatgtgcacgttgtgcacatgtaccctagaacttaaagtatatatatatatataaagtacaggtgtgagatgaaaaggatctggacttctgttggcaaaataggaagagaaagggaaaggatgaattatagtagtagcttgtttgatatatcagaattaaatatttatttgttggcctactgtgattgagagatttaatgcctgagtgactgggagaagcaaagtgtttttttgtctggagggatgatgtgaaggaaagatgggttgagttttagatattttgagttccaggtgacggaagggcctgtagatggtggacccagcaggtagccgagatggagaagactgacactggctctcaagtggaagagacatcacttttccatagggtcgtcagttaaattcatgatgttggctaagagagaagatctacagattgatgactgtatcctggagatgttaggggatgaagagagggggaggagccagtgtgtcttataatacagaaagttcatggagaacgaaaactgaaaaaataccactggatttaagatacttgagaattgtgagctatgtttgagaggaatagttggaatccaaagtacacaagtaagattatgactaaaatatatgataaagaaataaaagcaagtagtacaggccatgtacttgttatattcctgttggttctttctttgcctgttctttagtgtgtttacttaaatggtctggcaggcagataaaaggaggtggaacttaaaactgtccaattagttctgttttttttttttttgcgatggagtttcactcttgttgcccaggctggagtgcagtggtgcgatctctggctcaccgcaacctccacctccacctcccgggttcaagtgattctcctgcctcagcctctcgagtagctgggattataggcaagcaccacactgcctggctaattttgtatttttagtagagatggggtttctccatgttggtcaggctggtctcgaacacctgacctcaggcagtctgcctgccccagcctcccaaagtgctgggattacaggcataagccaccgcgcccggccactagttccctattaagagactagttagagtaactagagggcattaggacgaaaccattagttatttggattataccatggatcagattagttataagataattgaaatttgattgtaaatttaatgaaattaaagatgaacattgatgttactgaaaattatactttgactaaatactacgttttttgtttttcttgtatcttagtttctatgcagattttggaccgctgaacttggcaatggtgtacagatattgctgcaaactaaacaagaaactaaaagtgagtattgtagtgatatttataatttggaattaaaacatttgaaccataggatctgctcagtggggttggtgtgcacaaaacatttagtcaggtgatcttgatctctggaaatttatgtgagtagttcacctagagtttgaaagtgatcctcctgattataccacaaaggacatgttaacctctttcagttttcagaatgaattgcaatatgagctgaatgaagtcactggaatagtgatctaagaaagaaagcacaaatccttttaggctgttgttaatgagtctctatcaaattccctcctaggataatttttctgaaaccttcagatatgcctgtagaccctgtttccaagtgatgaacagggcttatcatggctggagctgtgtgcataacattttctgtttggtcaagattgaaattttttgcatgtttcttaaatgttctgtgtagttaacagccaggtgagattgatgaaccagcagcaacagagaatggaatttacctgagatgatagaattctggtcatacatttagtattcatctatagttttgatttcacatgggtatctggtttccttttctgtacttttatgtggattttggcatgtggctttttttttcttcttcaagcatatgaggaaactcatctatatacctagttttagtaaacttattttatcacacagaaagcaatatttatctccttgtcttccaatttctaaatgaagatctttactatttcagtttgaaagacaaaatgctatacagaggactcttaaggataaatactaaattatattgctcaggtattttgctctttctgctgggtaaaatgttactggtgttacatagtacaatgccttggacatattaactgttctgtgattattttttgatttgattggtttttaatgaacttaggtataaaaagcagtctgatagagaatttcctgtagaatatgttgtatccttatgaatttacaaatttttgccattgatttcaaagtgagaggtggacatggaattataccaaaaagaatcaataatcatataacatattaggttggtgcaaaagcaattgtggtttttataattacttttaatgttaaaaaccacaattacttttgaaccaacataataaaatctgttttactcaacttttgtaggaattaacttacaaagttgtctgacttgaaaagatacatgtaaattcctttaattaagccagatctgtttttaagaaaagaagccagtattttagaaagtaaaatagaggtttttgcaatcacctaggaagtaaataatatcctttttatagaaaatgaacttttaatggctgagtaaacaagaaaaggataattaataaataatggaagtctatttttttcttttgaagaccaaggaatttctttgctgtcttgattagtcattagtatgtagttggtatgaattgggtattataattaatctgggaaccgagtactatctagggtagccaaagagaaaggagtcattatcaggaaagtaaaatcactggtctgactcagtgttctacttatagcagttgcagaagagtagatgggttgagttgagagtattttttctaccattttctacactgaacagtatggtaagtatatgtatgtaaacttgtttctatttgctttcatttataatgctgtgtttcgacattattaataaagtttaaacactctccttggttcattttagtggtaaggtaatctgttggttgtctggaatgacatatgtagctttaggacaattaatgggcactgcattacttgctgaatgattgaattttaaaaacccaaatgttgataagtcatgagttgtctcaatgaagcatactacatagaatctctaattaggagaaaaagatttactgtaccagtccaaagttggaattgcttcagttttgtggaatcttagtttcttcatctgtaaaataggaattatagaactgtcacagggtggtggttagtattatattagaaaacatgtcttagtctgttttgcattgctataaaggaataccagaggctaggtaatttataaagaaaagagttttatatagctcatggttccacaggctgtacatgaatcgtggcaccaacatctgcttctggtgagtccctcaggaagctttcactcaaggcagaaggtcaaggggaacagtcatgtcatatggcaagagagggagcaagggagaggggagggaggtgccacactctttttaacaacaaaatcttgggggaactaagagtgaaaacccactcaatcccctcagaatggcaccgagccgttcatgagggatctgcccccatgacccaaggccccacctcttaacactggggatcacgtgagatttggagaggacaaatatccaaactatatcaatatgtaaaagctttgtacattttaaagtcctatacataataaagttaccaatgtaacatttgtgaattctgatagggaatataataaagacagttcttctacaaaatcgatgaacacctgtttctcagccttaaagctattgtttatatatgggaaagctgtccaatataattttaggaatctaaatgaccatttagtcaagactcagaaagggaagcctgggaaaggtgtgtgacttgcccagtgcagcaggcaaagtcagggctagatttcatggctcttgaccacatttttcctgttcttctttccaccttcagtaggaaccatagcctctggtttacagtcatcctttgttcactcttagcattgccccagctacctgaccttgttgtcccacgctgactttgaggctcctctgcctctttcattccagtaagtgttagggccattctgtctgcttcacttccacgaacccagactccagattctcccacttggaaaatgcctttgttactcactttgcacattctgtccctctcacactactgggattgctagaccttcagtctccctgttctctcagtccactggcaccctgctgatgtctcttgcctgcagcccatggtcacttacttcagtaaggtcttgggtactttgctttcttgtctttctgccttgccagctctcacccttgttgttttcccagtggatgatttcatgcactaatttactgggaagcagcagtacccttgccactcccagccttgcactttactctaccataccagctgttccatgcatttgctcatgaagaccagtctgactgggatgcccttaccctctggcttgatagctcttcattctttaataccttgtccagccaccaccctttaggaagcatcttcttgtccttttggactggattgagggtgcctcccttgttttcccatcattctctgtgcagatctgtatcgttgatgaattgtaattacctgtttgcacctgtcattctcactagactatgagcttctagagggtggaaggtggaggatgtcatgtatctttgtgttctcagtgcctagtgcagggacaacagacacacagagacttcttttgactttgtcatgatccccttcatttgcagatccccctttctccttttgcttccagaggtttcagaagaagagcctgcctccatccttcctgtgtgctgatttcttaaccctttgttatctaacttttgccttccctactctaccgaaactgctctaataacgtcttaaatgctgaatctgatggcacttgctggatcctcaaactcctttacttctctgagtaatttcgcactgtgttaactagtaacttcgtcttaggattcttctcttgtgtgatttcccagttcttttaggcacatttcattttttagtttggaaatttttattccttccaagaaagcttgtgtgatttttcttcctcattctgtgctttatatagataggtaatattttgctgtacattttattccaatcccaaatttctcatttttgaaatgagaagatgtttttttccagttgatgatttgagttggtgatttatcgctatttttgtgtttctgtgtctatatgcattctattcccaatgtccttattttaattatgtcaatcagaatggaaaattatcccatcaaacatatgcttagattaaaaatccaaacataaaatgcatcatcaccaataaaaaacctgctgcttatttaaactgtactttaaaaaattgtcagtactaggaattaggcagtaataggttgctgtttggtctttcccctaggataggggaagcaatcaaaagagggaagatgcattgaagtgagaacaatttgttaaactgtgtatgttatttaatgttaaatgtcatcaatgattgatagccttgagctggaattattattctggtaattcaagggatccataaacccttgaaattatacaattttgtatgtatttacatttttcttctgggaggattcatggctttttttcaggttctcagagggatccttgacacagacatgctaagaacactgggctaaagtcttctgaaaaagaagactttactaacaaaagacaaagttgtggtattttgaaaaaactgaataccttcctctattcttttttttttttttttttttttgagagggggtctcactgcgtcacctgggctggagtgccatggtgcagtcatagctcactgcagcctcaaactcctgggctttgatgattctcccacttcagtcaactgactaactggaaatataggtgcacacttctgcaccccacccagctaactatttttttttttttttttttttaatttttgtagaggcagggacacactatgttgatcaggctggtcttgaacttctgggcttaagctagcttcccgcctgagcctcccaaagtggtgggattacaggcatgagccactgtgcttggccgtcaatacagttttaattattgatttcattttcctctgagaaaaataaaacctgagcttggagaaaaaaaaagtctctgaaaaaaggggacattttctagggcagtggtttttcttttttttaatacctgctgttatgaatcaacaggataattacagtaatcttgaggactattttaaaaaaggattaaaggagtattcacagaaatgtaattttaaatttacaaaacatcccatatagccctttcagggtaaaaggggaagtgggtgggtatcatgaaaccaaccattatattgaagcattggaagtacctggcagatggtggggcttagggaatgtccttgttgctgaatgaatcagtgccataatcctatcctgtaaaccaggcacctgccaccctatcgggggttatatacaccagaactcttttgatgtaatgactagaccaccctattataactacaaaaacatgttgagatttcttcatgtggttcttttctgtttctggctcataggtttgtggggaagaaaagcaagctacattctggagatagttcatgtagtttaaagaggttctaggggctccaaagcaatgtcaactcccataggagcgagcatataccgagtttgcaaggcaagaaccccttatgcctgttaggaatcctcaggcaggaagaaccccgtttatagagaatcccacgtgccttcaattattgattattaacacgatgaaatcatcttcatgagcaacttttctctgacattttgacttctgctttaatcaaatgtgccatttcattaatgaaatgtattgggtttgaaacaaagtgggccacacagagacacctttttctttttaaagaaatgattcgatctatttcatcttggcactaaataaaaaacataaaccatattttgttttgtacagccaaagaacattttccagagtattcctttcctgagaaagttggaggtaaaacttgtaaaggtcatggctgctcacaggaagacctgctcattttatcgcttttgcagtgagatgaccactgattgctatggagatgctgattgctgcggccattactgggctagcctagccacctgtaagagaatgatgccttggtcattgcggtccctgtgctgtgatctccttaatatgaccatgatcattgacagaacttgcatgtttaggaggtgcatgggctctatttttattaaagagcatattatccaggctgcattaatgtcttccttagctcagtcagactgattcatacagcttaattaaatacagcattctaaccaaataacttgaagattttacttttctgtgtttctttaaattgacctttaactcttttttttttttggctttggctttgagcctaattgcatcaccttttgttattgaatggttaagtagtttgtgctctcctgactgaagctgaacaagtgcatgatttgtgtttgttgccataatccaagtgtagcctgagctatttgttatttgtgcagcttgtcattatttttttctctctccaagttgctgtggcttgtgttttacaaggagtgatcccactagaatataacctttcacatagcttttctttccaagatagaaaatgtctggggtcaatacccttatcttaatttgtattgttctatcatagcagtcattgtactttggtttataagtaccattaagtatttatgatatacacttatgatttacataacaggggcaaaactttgactctcaggtaagcaatacagaaatttctataggtttgattatgttaattgatagtcaatactaaattccaccttttatctactatattttttccttgttaaatgaaacacttactgtacctgtaattagtatcattttattggtccttgtgtgctgtaaatgcatcctatacagttattctcctctgtttttaataagccttggccaatattttgcattaaatattcattagcctttgaggttagagagtgggtttcttctccccttgtcactgcattgctcagcaaagtgtttgacacacaacagctactcaattcatgctgatggaacccatagaaccttcttcagccgcagtatcctggcacccagatttagcaaattggtcacctgtggcctgcattctgtccacagacatgttttcttgagcttaaacactgtttaaaaaattttaattcatagtcaacatctgcagtttatgaaagcttcaattttgtcttcttttaaatattgcagtatctgaccattctgcacccagattccctcacaagagcagtaggttggagcttactgcactttggatagggaatgcttttcttatttaccagctgccccacttcagattcttggcacctgagaacatctgaatttggaacttctggaataatgacatttaaggcagcttaattacggaatcattaaagggacttgttcctaaggtgttatcacctggaatgcatgaatttacaaattgtaataaggtttgctgaggaatctggggaaatgtgttttttgtaaaatgcttttaaaaggcttattgcatgatttagaattcctttttaagagaatgtagagttctttcgagactacttgaccagatggacagtgttttagcttcatataaaagattcccaggggtgggaccagttacatgtttatgtagtgcttctccaaaatttagccatatcttagagtagtggatttcaatgtgtggtgtctggaccaacagtgtcagcattactggaaaacctgttagaaatgtaaattctcaggccctactgaatcagaaattctggaggtgagacccagcaatctgtgttttaataagccctgcaggtgattctgaaccaatctgttaagagaatgaaatataatacaataataatataatgtggtttagagttagatttagttatttctgaaaagtcttagtactattgaccaattcaacctgagaattattcaaattctgaagcatgaaacttgttatggcctcataattaagatttacacaaattatcaggctctgtgagaaagttttggactgatcctgcttactactcttactgtgtaaatgttcgtcaaaggccctctctgactctgggcttatgttctccttgtaaaacacagtgtgctcattatattttagccttgcccaggacccctagtctgggagacgttatgtgtctgattaaactggacccctctggtgccattcctattgctttggataatggtggaatgtcacaagtgagcaataaatgcgagctgttgttgcggttattatagagggctggctatgtccacttcagtttagaaagttcagaagggtatttgctttgtaatccccgcactttgagaggtcggggtgagcagatcacttgaggtcaggagttcaagaccagcctggccaacatggtgaaaccccatctctactaaaaatacaaaaattagccaggcgtggtgtcacctgcctgtagtcccagctactcaggaggctgaggcatgagaattgcttgaacctgggaagtggaggttgcagtgagccaagatcatgccactgtattccagcctgggtgacagagtgagatagtatttaaaaaaaaaaaaaagaagagtatttgttccagtttcaagatagaaatctaaaacataaggtggatagtggctggctgcagattgtgatttgtaatgggtcatgtgctgtgctgctacagagctggcaaatagtccagaggtctcagtattctttctgtgaccctctctattttatatttacactgtatttattggaattgaccaattttaaacttcactttgctatggcatacagtgtttttgtaacctgtgagcttcttgtgtaaagcagaaaataatctgtaatagagcaggtagctcattgaaagcctgtggctatgatgtaaccttgcaagtgttctccttgaagggcccactcatcatatttgctttgtaatccctgcactttgggaggctggggtgagcagatcacttgaggtcaggagttcaagaccagcctagccaacatagtgaaaccccatctctactaaaaatacaaaaattagccaggcatggtgacaccttcctgtggtcccagctacagaggagacagaccagagtaaggaagaggccactgtccaatttagaggcatgatattctcctgatattagggcagaatctgagaaaacattgactgggctcatacatagagtcctgtcctattgtctccaaactgtgactttgtctgcatggtaaagttcttccatgaaagatctcaaaagagaagttaatgttccatagaaggtacttcaatcatcgatgtctccactgggtgttagtattgcttcttctagggtgctttgattatgtaatagtattttttaagtgggggacatgcttaaaatttgagaggaaaaaacattaaagagttttttttttttaaatcagcccactcatataaaacatcagctaaacaacggacaaaatattttgttacccctcaaatttttattccaataccaaagtatcttctctgttgaacagcatcactggtagaaaactgtgggccaggatgaccataagagggaggcccagttgtgaaaaggaaagacattagcaaaaggcctaattttgatattagcaaatttgagattaattagaaaattaattaggaaattaggacaaggtctaattttgagattagtagatttttctctgctctcattaactttgaattcgttttgattcctcgagtgagagaactcacctctcagtgatttgacctcggagatgctggccaagcttcgctaagcaggaaatcatttcttggctggtgtgcttttgaaacttaaccgaggaaactgaattccaaaaatacctaagcaaagtaaatgctagcagctttaaacattttcctaaaaatcaggcagaaagctctaaaaagaagtcagttatgtttgcttcctgtggggagtttctcataggaaatattttaaaataaagtttctaggaagattttgtgaagatcattctctatctgatgtaatttatgaaagcttataaagtttaagcattcttctaaaatctttaaagtgttaatttgtattatatttacttaaataatatttatagctatacagtgaaaagaaagtcttcctcagagttctgtcctttagttttatggctcatgttccaggataagtctctgtattctatatactttagaatgcgagagagaaaaaacgaaaccaagtaaacacaaaagattctactccccccaaccccctccaaaaaaacccaaggaagaaataagcatcagtgatgaaagaacagcactataacttgtccctttcagcaagtagatttgtaaaataaatacagtttcacattattaaccaatagcagtagtttgtcataaaacctaaattcttagtagaaaagagcatcaaaaatgataatccagacttgaagatagactgttgatattttcttccccacaggtattttagggaattaggaaatgtaaatagggagaggctgggagccataagagcgtcgagtccctatgctcagtctgactcatgtttattgagagcctggcctgtgtaaggcagtatttagatatttgcaattcagagatgataggagatgcttaggtctgaagagcctttatttcctttttggtaaatcaaacataacttattgatggggaacaaataagtggcaaaaccaaccaaccacccaacagacaatgagacaatgaaataaaacagaaaaaggcaatgttcaggcagtcagtagttccaaattgagaaagcaaagaatcaagtgtcagcaccattggttgtaacctttacatccctaggtaacttcaatgcatcaactcaactgagctgaattaaatgctgtgcctttgttctctctttatttcataggagtatttgtataaacctgtcaggaaataagggcattggcaataagatactttctttgagtcaaatactaattttttttgtttgatttttgtttgtttgtttttgagacaaattcttgttctgttgcccaggctgtactgctgtggtgtgatcatggctcactgcagcctccatctcctgagcttaagtgatactcctatccagtctttttgtagaactgggtctgtctatgttgctgggctagtctcaaattcccagccctaagtgattctcctgctttggcctctcaaggtgttggaattacaggcatgagccatcacacctggccttacatactaatttttaaaagtttaataaaaagggcactactggctgggtgttgtggctcatgcctgtaatctcagcactttgggaggccaaggcaggtggatcacttaagcccaggagttcgagaccagcctggacaacatggtaagacctcacctctacgaaaaatacaaatatttgccaggcatggtggcatgtgcctgtggtcccagctactcaggaggccgaggtgagaggatcgattgaggctgagaggtcaaggctgcagtgagccagatcatgccactgcgctccagcctgggtgctgggtgacagagcaagaccctgtctcaaaaaaaaaaaaaaaaaaaaaaggtaaaagataaaagggtacagccattttcagataatgtgattctaggagttcgagaccagcctggccaacatggtgaaactctgtctctactaaaaatacaaaaattagccgggcgtggttgtgggtgcctgtagtcccagctgcatgggaggcaagagaatggcttgaacctgggaggcggaggttgcagtgagccgaggttgcgccactgcactccagcctgggtgacaaagcgagaatctgtctcaaaaaaaaaaaatatatatatatgtgtatatatatatatgatttttggttataaaagaaatgcctgacttggagtgaagatttcctggctcattggagggatacactttctgtggttacatggtaaagccagagtgttgcagtttcatcttagaacgggcttcagagatggaagagtttttttttaatttgtagacaatagcaggatcaagaaaagtacatagttgagctctatttaccttttttaaagaggttctaaaagcagggattttctgtgtgttgtagtcaatgtataagatagaaaaagctgcttttatagtcaatgtgaatttatagacaaatactgaaatgtacttttgtgcctgtgttttttttgctagctcattaaagacagtttatgtacctatatttagaaaatcaattgtcaaaatacataaattttgaaaagtgaggaaatcaagcagatttcattgagttacattgtgttctcattgtcttatacttattcgagttttgattaataatttgatttcattttaccagatctttttgtcatttcttttcatgtttagcatgtgtacaacataccatgttgattattttgaacttagttaaatacttgagcatgcagcatattgcctggcatataacaggtgcttaataactgtctgaattcatgaatttaatagatggctattgtaatgtgttgtattaagatgtttgctgatataattttttaatggtatttttccattaaccaagtattttcagatattaaaagggggttgttatataacatcccagaaataaaatactaatattggtcttcaaaaatacgattttttggagatcatagtaaactggttgacattttaaaaaattgtgttatatgaaaactatagataatattcctgggagttggagtggcatgtagggggtaacaaagtgtgaagagactttctgtagaagatttagaataaatagtcaaaaatgtttccagttaatagagatgccaatattttaattattttccaccatattagtttcttttctgggagagaaagatattaattatattgttgattcttacattatgattgggctgtacaaaatctgagctagtaattctctaaccctcaaatgccatagaaattaaagttgaaagttgttaaattttatgggttgtagcacatcttgaaggttaagagatgatgtttgccttctgtatatgttaactttgtctctatggttacactaactctttttatctcctctttctagtcatacagtttgtcaagaaagaaaatagtgcactacacctgttttgaccaacggaaaagagcaaatgcagcatttttgataggtgcctatgcagtaagtaccttcttcatgattattttctataatcaggccagtgaaatgctaacactgtcaaagaaaatccaaaccagtttttcagtgggattgagagacggtggagattattagcagtttgggaattgatctgtagtgagaaatatggactagcagtggtggaatgtttactctttagattttattttctactagttaatgagagaatcttgaaactgcaatatgtagcttgaattccacagttatataggtattttaataaaaagaatacctaccaaggacatttctaggaaaaaaaaatgtgtgtgtgcatgtgtgtatgtttaaatgcatgaaatatgatattatggaagattttaaaagacttgacgtgttcgttttttgggagaagaggaaaccttagattgcacaggggaggattgttattatttttatcaatccattcattaatttatacaattgtttgcagtaggcaaactgaatataaatcctgcatatattatagcttccctaataactacaagagacttttccaaaactaatttcaattagaaattttgttctctgcagacactaacatgtcagtatgaattccacatgaccatgctgtagagttttaggtggtgattctggaattttctatatatgctgtgattgggcaaaagcttagaaagcagaaaccatcagagctaaaacatacttgcagggatatgtgtgatatcagctgggaatatgctggtttaaaggcagggagcagagaggtatcatttcccctcatccttggggagggctcgtgctcctctgaagccatggaagcaaccctgctgagtgacttttcaagggcctcattctaaggaccttgagggaagagggcaccagctactagacctcaaactctgccccatcaacccaaaagctctaggggaaaaagcccagcagtattgctggaaaagctgtcagctattgcagggtgcaggctgagaagagtggcagactgtcagccaggctgtgggctggggccttgcttgtagcactgaggtgcccagccctgcccaccttttgtcccttgatgtagctgcaataaacccttggcctaccccttgtggcagcattctttcttgctctgtagatagcatggtatagtacaaggaatagtgtctaagagtcagaaaacatgtttttcatcttgaagggctctgtgatgatgcactttatctctctcagctttatttagtttccttatccgcaaaatgagagggttggatgtaatgacccctacatttcctttcagttcttaggatactgagagtatttgtagtgccagccaggctattgcttttattttaagagcatacatgaaaagctggcagttagcatgaaggttcagtgaagttctggtaagctgaatattttttaccttacattgataatgactactcatttgaaattgatgattgacactgtgattgaaatatggaaaaagactgtactaatttctggattcaagccctgtaaacaaacgtgtttttcctgcagggttttgtgatgctttgtaagcgtgttatttgtggatcctttctcataaaggattgccatcaagaagaggtcatttgccactcttcgcacgtctttcttttttttttttgtgaggaccaaatgatttttattcatattcgtctggtttatctacccaaagtgttcaggacagtgttcagcacatattaagcttgatatagcagttatctatgatgatgatggtaacgatgactctgtatagtcactgtgtttctgaggtcttgtttggtaatcaagaatgtgtttagaactatctctttattagacaaggtaataaaccaaaagtttccaacttcctgtacatgttgaaagttttgaataaagatccttggatacaaaacatggcccacatggctcaaaattaattctgtgacataatattattctgaagtcatacttattttgaaagcctaaaggtttttcttttttatggctataaaaatatcaccaagctagacattttaattctgttgagatatacaaatagaattaccgcagcagcccacacattctatgatttctaaacatttaaacatcaatggttttgggaagttgctgttgtccttaacagttcattaaaagttcagatgccttttgtgagagcccaacttttctacccgcgaaattgtcttttcagaagtcttgccggatgttttctttgtttgcctttccatgttgctgtttaatttgatagatttcattttctagttgaaaaatagtccgttcagtctcataattcttactacagatatccaatttgactccatttctctcaatttagatccagctgtgagttgcatgttctttctctgccagtttaaatcttgaatatgttttcttaacttctgaagttctttctgtgcatgttcaatcatatgaactagattttcattgtatactttccaggcattacatccatgctgtgacattagtttcagattctcagttgtaactgcttgatgctctaactaggccatagaattgtttacacattcttgccatgcagtaatgccatttttttgaccagaggaaggggctggaagttcatatcgtttcatactgagcaattcagttggttgtcgagcagccagtctctcaaattcatttctcatcatgtcagtttcaaaagcagaataatccaggactgtcaggtatctcaggtagttcatagtaggttggtatctgcgagtttacttctccaccagcactgcagctgcttcctgcacaccagaggcttcataaccttgatcaaaatatggatcaagtggtcaatatcaatcaagcggtggcacacgactgtaatcccagcactttgggaggctgaggcgggcggatcacaaggtcaagagacggagaccatcctgaccaacatgtctctactaaaaatacaaaaattagctgggcgtggtgatgcgagcctgtagtcccagctactcgggaggctgaggcaggagaatcgcttgaacccaggagtgggaggttgcagtgagccaagattgcgccactgcactccagcctggctacccagcgagactctgttccccctccccaccgcaaaaaaaaatatatatatatatagcagtgcatccacctcaacctctccagccaccaaacctgtgcctgccattctggggacctcaggtttgccctactcttctcatttctttacccctttttccctcccttgcatcttctctctcttctttccttacttatttatttatttatttattgagactgagtcttgctctgccccacaggctgcagtgcactggtgcgattgtagaccattgtatcctcagactcctgtgctcaagcgatcctcctgcctcagccctccctagaaggtgggactgcaggtgtgtgccaccacagccagctaatttcattttatttttgtagagacagtgccttgctttgttgcccagcctggcttcaggactcctggcctcaagtgatccccctgctctggcctcccaaagtgctgggattacagatgtgagacaccacacccaacctcttctttcctttttaacacctattcttcctgttttgtttagtgtggttcttcattttagcagggtgcctctagaactttgaaaggattaaattagatgcgttgagcttgtcacaaaatactctgtgacaaaatatgtcttctgatggagaagtttccaccactttaaagcaaccaaaaggggaaaaagcagtcctagcatggtggaagaagtgctgagtacagcatgagcttgtcttacacactagttacagtcttgagaagcagtgtgaagtgattattcttgaactggtcatgtcccaattgatttttctaattttgtaactgtattccccagagggctttttgacacaaacccttaatacacacggaactaaaaattggcagtggatccttaaagagaattttatgcctttcttcgtattgtttgtatgtatttacttgttgacagtcttgtaagatagtcaataatatccattatacatatatctcagttaaaatttacatatattaaatgttgctagttggataagtgtccgttttctgggggaatcttctctggatacaaaagacctttaccttcggagcagccatgtaacttacatgaggcaagctaggtaggtaggtatattttatcaaacagaagtctttaagagtgaaggtgttcctgttcctaaaatgtggaatcggccctctgttaagtggcattgactgactaataaaagtattttgtactaagacaaacctttttctcaaagccttagttttctcatttgtaaaatttggataatacctgagtttccttatctgcttcacaggattattgtaaagatcaaatatccaactgcctgtttgatagctccatattatacatctaaatgatacctcaaatttattgtgacaaaacagaagtttttattccttctctccctaaatgtatttatttcccaagtcattccctttttagtaagtggactaccatcagtgacttgctaaatcaaaagagtagtcattttgatttcttttgttcgctcatcccacattctacttattcgtaagtttggtcagctctacctctaaaacatattgaatcagaatgtatctttccatctctgttgctatcacctagcccaagccactgtcattgttcacctggattatgaccacagctttatatgttgtctcctttttatattcttgcttcccattaatttagttgccatacaactgtcagagtagtcttttaaaattgtaaattagatcacgtcattaccctgtttcaaatctgttattgctcactgatcttggcataaaatttatccttaccaatgccattaagatcctttctgatctgaccctctctacctctgtggtctccttgctcaagttgctcccctcatgctggacttctaactgaaattccatgcttgttcctaccaaagagccttgatatttctgttctatctggaatgttcttacttcagacctctgcatgcctggctctttctaatgttactttctcagagagattttctcttaatttctaccctgttacctccacccctagtcatcctttagacctttgttgctttattttctttacagcatgctactatttgaaattactttgtttatgcatttacttgcttattatctctttcccagactagagggtaaggactttatctgttttgttcgtcgctgtgtgtggagggtgataaaatatttaacaaggggttaggccgggtattcacccgttgagttggaagctgggacagggtcctggaggcttcttgctttgctgaatcttggggaagtctagggcctagggggtgggcgtgggtcccaaggaagagactaggatggccagtgtggagtggagtggtgtgctgtgggctgcagctatttaccaactggtatagaactatttcagtatttgaacactatcaatttagagctgtgcctggtatgtaatgggtgctctgtaagtatcttttgagtgaatgaataatgggatgacaaaacatgaaagaaagaaggtaatatatgggaaactcctgaaaataatgaagttggacgtaaggtataaagtggtgtcttcccctttaccagaatatttgtagtcatgactgagccaactttggtttttaaagatacagaatcaaagtaaagagcatagaccaagggtagtaacaagtatacaaaattacatcactacctagcctttttttaaaaaataaacttgtattttcccaatttttttgtggtaaaatatacgtaacatgaaacttgctgtcttaaccattttaaaatgtacagctcagtggcattaactacttttcaactgttgtgccacaaacaccatggcttacttttgagtgtgccatcttgtggcacttttggtttctctgttagataatgacttcaagtatttcacagcttttgtgtttctatttccttatatctaagtggggggagactttttatgctttctctcatagagctgtcataaggatcaaaaaggagataaaatatagaccaagcttgtttaacctgcggctggctttgaatgtggcctaacacaaattcataaacgttcttaaaacattatgagattttttttttttttaaagctcatcagctatccttagtgttagtgtattttatgtgtggcccaagacaattcttcttcttccaatgtggcccagggaagctaaatgattagacaccctgatatagaccatcatgttcagtgatcttaaagccagggttgctggaatgatgtgggcactggagaccacagtgacacttagcagatgctaggcacccattttagggatgcctctactagtagagcatctcttcaccccctgcattgtgacattgtgctccttgagatggaaggctcagatttaagaagagaccagctttgtcagaaaggtgtttcccttccagggcaacactcagtgcagttttgaagttaggatgtttagatcattgtagcatctaaaacactctgatatgagtttgaaaaagatggctttttaaaattatgagtatgaattaattaggttcttgccatgtgcttaaagaccaagtcttcactagtacctgtgttactatattgttttcagttttgcaggcctaggtcaaggagaatttggatcaggtcaccgtgactgaagaattggaaaataatatgtatgagaagatgttaaaataagtgtgactgtatagcttagaaaattaagttcagagttaaagaaatacagtttttttttctgttatgtggaggatgcttaaacagaggtggtagccacattatatactttccttacccacttgttaagtctttgcattgctaaattagaggtctacattgtggattaactgagactagcctgaaccagatgtcatgtctgaattgggaataacaagcctgaggtttttagactgtctaaccatgtctgtgttggctatttattttgtagactacacttaagacctaagtagttatactctactgctaagtctgtgactaattgcaaagaagccattctccatttggcttagtggttgtgagcaatgactttaacatagccacaggctcactgggctttgaatccaattgttagttgtatgccctgagcaagttaacttatccaaactcctgtttttttcatctttaaaataggcataataataccctattttacttgcggtgaggactgaaggaggtcatttatataaaggtgtcatcggtgcagtgtctgacgttgtatgcacttaggaatgtctggtggccctggcagggaagctgtgtggccttccacaaagttttctgacccagtctcctacttcctatcactcacttttgtgcgtagaccctttgggctacctccctgatgatcggacagctacttcccctctttctgtctgcccatcttcctcttgtccatcatatttttcacttaaatacttccttggctcagtaacaacactcatatggttgttaatctgattattgcttagtataattcactggaaggtaggagtatatttctctccaaggatgttattttaagggaatattttgtttaaaccaaatgaatttgtgagatctgtagtcaggtattcattagttcagtaaatctttgtttagctactatgagcccttcctagcactatggtaggttctagggaataaaatatatatacatataaacaatgcctagcttaaaatgtgggacaggtgagcaataaacaattgtttaaagcgggcaataggtacaattgggtaaatatgaatttatctaacaaatgtttttttgaggtattttcatgtaacaggccttgttcctggagttgaggatactaaggtgaatgactccctgcctgttggtgtgggtgtggagggctgggttcagacctggagagaggggaggttccaagatggtcaatcccagcaggccaggttgctgaggaaccatcagacagggagaatagcatgaaggtgatgatgctttttctggtggtaggggagtgaagggaggctggaagaaaactagttattttaaatttttaatttaattttattttaaatgtccgttttgaaaaggggataatctaatgagaagataggggtgtttttttcccttacaattaaaaaaactttaaaaagtggagtaaccacattgtagaagaaatgtggaaaaattctctcgcagttctaaacctgaattatttattaggtgtgattgcagtgtagttttttgagccttttaaaatttagcctatgtatgttttgccattttgctattcaggtgaccaaataatatttcatttagagagaataccattgtttaacattttagatttctttcaaaattttttataatgtaacacatctctttctatattataagtgtttcttttcgtggatttttgtctttagagtgccagaaatagggtaaataattttaaatttcagagtttttaagactcttggagcatattgctatacttaagcaagtttatactaaatttggtattatgtgaaatctccaatttcatgtaaactttgcatattgggtatgaacattacagttttagaaatttaattggtgaaaaatgctacctcattgttttagtaatcatttttttgattaatgaggttgattattctcatgtttttatttatagatttattaactgtttgaaaactttgtgtttttatatttgtttcctatatttagaccattttagagtggataagtgctattagcctccattaaaaaagtaagttagccaggtacagtggtgggagcctgtagacccagctacctggagactgaggctggaggattgcttgaggccaggagtttgaggttgcagtgagctgtgatcacaccactgcactccagcccagaccctgactcaaaaaaaaaaaaaagatgaagtcattttatctgtgtctatttgtttcaatagatacagactactagaaatcatgcccatcagtccaagtttctgtaaaaaattaggaagtccatagacctttcctgctgttactcattagaatgtcagaatgctctattaaatacttctgtatacctgaatataaatgtgcttaattggaactgctgataatggacctattgatttttgaacattaagccgtctgctgagtatacagaaattttaacagaacagtattatttaaaagtggttagagtgtgtgtgtttaaatcattggacactgatatacccagacaattaactgtgattttgtttttgtttttattgtttggaccaagtatattattttgcttatattttgactcacaattctgtaaattctgatttcagaactactttacattgacattaaaaaactgtagattaaataaatgtcatttaaaatgtaggtaaaattatcaaaaagttggttcaaaataataaaggcatttactttaaatatttattgaaccaataatatattagatgtcagctactagtgttctgtcatccttctctgtggcttgttggtaaatctaacggcagtgtttgcttctgcttatagaagttagtggagaggaagggaggggaggcacatggctggggctgggcaatttcctgtttgcagttccttccttttgtagtttgataggcaactcttttgtgatgttgcctgtaaatgggccagtcttttatctttgtaggcttgtatttttggtggctttgaaacagatcaggctccttaaactcatacagcattttcaatttcagactctttgagactggacattctgttagccttctgcatatgggtagagcagtgtcacctcttaacttttcttgcctgtttcatttagctgtgggcgaggaaaattagctgtttgcttttcattactggaagatttatcaagttaaggtgcatcaatcttttcagtttttttttctttttttcttttggcatcctgataataaacttcctttgtgttgtaaataagctctcaaatttatatacacatacacagctgcacacacaggcatacatactcactgcatttagtactatatatttagtagggatgcactgtgtatgcttacagtaatttactcacaaatttctgaatcttatcagtagctttggaataacatatactttctgtgtgaagaagctaacatccatttgtttcattttaggttggtgcaaaagtaattgcggtttttgctacttcaaacaatatatactgaattaaggggatgtacttttttttagcacttgaaattatttatttaccagtttattatctctccctttaagggaaaggactttgtcttattttccacaatagccccagtatctagaacaatgtctgacacatcctaagcgttcaataagtgtttgtgaaatgaatgactgtttaattgataaataagtcttggttgacttccacagttttgtggaagtttaatatggagtaatttaaaacctgtgatgtgcttaaagataaattatgaagtcggtactaattgtaaaaataacagcaagaatcagtgttgcaaagcattaactaattttcttaaagttactgagtaaaacaaagtgtgttatatagaactgaaatgggctttgttaatactgtacatacaaacatttgaaattaatattgtggataataatgttaattttactctcagcattgtttctgtttttctcaataggtgaaactacttatttatacatataagtatttgctactaagtgtcaacgatttttttaacagccatccttgcagtctcaggataatttccagttaagaattaattcatggggccggccacggtggctcatgcctgtaatcccagcactttgggaggccaaggtgggcggatcacctgaggtcgggagttcgagaccagcctgaccaacagggagaaaccccgtctgtactaaaaacacaaaattagccaggcatggtggcacatgcctgtaatctcagctactcaggaggctgaggcaggagaatcacttgaacccgggaggcggaggttgtggtgagccgagatcgcgccattgcactccagcctgggcaacaagagcagaactccattaaaaaaaaaaaagaagtaattcatatgcttgaaagaggaatactagaaaatttttaattagagttggatcttgaaaatttttagctgcatgcattcattatgaaaaaaaaaaaaatcggaaaggaggtactcaaagccctgaagacattatccattatcagagtgtgacttgaaattgtttgccgtgcctgatatgagagcatgttctgtacatgtctacctaggcttcacctggcatttacccgagtgaggactatcagtgttccattttatacaaatatctgaacagagcaggctcacatttagacgtattccccatgcagagctacaggcttccaatcaatgagatgtttactagaatatatacagaaactgaaggtaattctttaaattttttgaaaaatgaggttatttggctgcctggtaattgcagcatggtaaaatttgatattgaatgtatttgattgtgtttactgttttcttttagttttaaaaataaacatcttaattagaaaaaaaagacccacttttgcaagactggtgaagtatctccacagaacactcactaggaagaacccttctgcagtcctgctttgtcatatttcagttggagaatctgaacccagagaggtcgagtaccttgtccaagatcaaacccagctaatggagaaggactagaaccccgatccctaagtttctagctgggagctttatccagtcatatagcatgtcaccgagcactgctggtcttggtatattatactacatctaaaccataatagtctgcaaaaagattagaaacagcatgcagtgtggaagagtagaattttctatttagaaagcagtgttgtagtgtttcaaatacactagtcatacagtttcttttccaggtagcttctgagctttgattctggctaatggggctaacactgccaaaactttcgtgtaccaaccagggacaatggtggttgttctcatgtttactttggtgatgtccatggatgtgttggggtaggtctaagtgcaaggagtgatagggggataagagaagcaaggaatgatataaagtaggttgggctggtatcttaggacagagttttccaagctttattcactgtaattcaccataagaaacacattttacattgcagcctagtacacacacatacacacacgccattcacatgtataattgaaacaagaggttcatgaaacaattcttacaaggtgtaaagcatactgatattttatattctgttctattttatttaaaatatgtctttacccatcaaattgacttcactgctcactaatgggttgtaacctgcagactgcaaaacatagccattggagaatctacttactgtgcttagatccagaaggttcttgaatgttcttagggcattgatttttggcattgaatgagcaggtgattgtttgattgctctgcatctaggctagtttgcaattaacatgaatggcttaaggaaaactgaaagtattctgaagactgctctctctaaacatcaagatgcatacctgtctctggatggtttttattcagttggtacttgactttttgggaaaatctgagtttgttttaagccttcaaataatatgatttatcttttcttatctcactttcatttgaatcactgtgttacccttaaagccctctcatactcctcccttcttcctggcaaccaaaatgtgcattgattcagtttgggagaaccttgattgagaagcctgtagctaggtcaacgttgtgggccctgaggagccagcgctgagcctgccttactgggtctgtcattttagtatctcattgggcttagtttctaagtgtgggctgaaaagttatataatgtcccattcacctcaagacatcgaatcttaaaccttaggtttataagggttttcttgattgaataattttaatttatgtaaatttttatttcaagaaatgttttctatttgatagagtgagtaaaattgtggcctttcccctattttggaaagtgaataaattcattaaacccctcttcatgagcactttctgaaattttaaataaaagaagagctaaccgcttgcagtgagctgagatagcgccactgcactccagcctgggcaatagagctagactccgtctcaaaaaaaaaaaaagagctaactgcaactgctgttgagtttgctgtgtgttcagttatttctaagatttttagtgttcaaaatagggttgccatgctaaaaaacagactgtggccatgtaaactactaggttcccacgtcaccaacactctgtctctgtgtctttcttaattttcttccttgttgctcttctgccttagctttgcttttcctgtgcctatcttcccaaacccccgtaacaaatgcttgtaggggctttgaattttcattatggaaattcaaacttttaattgatgaggacttaaagccaggggtgtagttatacagcaaattcatgggtaataaaactaaatagtgggatggctggcgtggtgtctcacgcctgtaatcccagcactttgggaggctgaggcgggtggatcatgaggtcaggagatagagaccatcctggctaacatggtgaaaccccgtctctactaaaaatacaaaaaattagctgggcgtggtggaaggtgcctgtattcccagctactcgggaggctgaggcaggagaatcgcttgaacccgggaggcggagcttgcagtgagctgagattgagccactgcactccagcctgggcaacagagcgagactccgtctcaaaaaaacaaaacaaaacaaaacaaaacaaaacaaaaaactaaatagtaggactgggaaagtgtaacctcagcctcaaagaaatattttaggagggctgcagtacctcatagagttatttaataagaaataatatttgtggttcatagtttcaaattaatgagcagacagacaagcctttccatgtgaatatacatactgtaggatgaatcagacaattctttcaagagtgggtgtacgagtcatttagtgggcctgctttgggaaatttcttaatttaagaaaccataattcccttctctgataaacctttcctgatgttttctccctagtttttctgcctacccctcactctctgcctcccagctcttcactgtcattttcttactatctgacttagaacatggctcatttatagcttttcttacttcattttgcaattaattgcacataatatgatctactaggatgagctccttgtacttacttgctttgcacactcgcccttgtaagaatgagctttttgagtaaagggataactcttacatatttttttttcttcaacttttattaagttctggggtacatgtgcaggatgtgcaggtttgttacataggtaaatgtgtcccatggtggtttgctgcacagatcaacccatcacccaggtattaagcccatcattcattagctattcttcctgatgctcttcctcctctgaggcacagtgtgtgttgttcttcactatgcgttcatgtgtgttctcatcgtttagctcccacttatgagtgagaacatgcagtgtttggttttttgctcctgtgttactttgctgtggataacagcttctaactccatttatgtccctgcaaaggacatgatcttgtttctttttatagctgcatagtattccatggtgtatatgtaccacattttctttatccagtctattattgatgggcatttaggttgattccatgtctttgctattgtgaatagtgctgcagtgaacatacacgtgcatgcatctttgtaatagaatgatttttattcctttgggtatatacccagtaatgggattctgggtcaaacggtatttctgcctctaggtctttgaggaatcgccacactgtcttccacaatggttgaactaatttacactcctgccaagagtgtaaacatgtccatttttctccgcagtctcaccagcatctgttgttttttgactttttagtaatagccgttctcactggcatgagatggtatctcattgtggttttgatttgcatttctctaatgatcagtgatgttgagctttttttcatatgtttgttggccgcaaatatatcttcttttgagaagtgtctgttcatatcccctgctcacttttcaatggggttgtttggttttttcttgtaaatttgtttaagttccttacagactctggatattagacctttgtcagatagatagattgcaaacattttctcccattctataggttgtctgttcactctgatgatagtttcttttgctgtgcagaagctctttagttcaattagatcccatttgtcaattttttcttttgttgcaattgtttttggtattttcatcatgaagtctttgccccctgcctatgtcctgaatggtattacatagattttcttctgggtttttatagttttgggttttacatctgagtatttaatccatcattagttgatttttgtgtaaggtgtaaggaaggggtccagtttcaattttctgcttatggctagccagctctcccagcaccatttattaaaaaggctgttctggccaggcacgtttgcttatgcctgtaaccccagcattttgggaggcagaggtggatggatcacctgaggttgggagtttaagactagcctggccaagtggtaaaaccccgtctctactaaaaatacaaaaaaaattagccaggcttggtggtgggtgcctgtaatcctagcttctcaggaggctgaggcaggagaatcacctgaacccaggaggtggaggctgcagtgagctgagatcgtgccattggactccagcctgggcaacaagagcgaaactctgtctcaaataaaaaaaaaaaaaaaagaaaaaggcagtcctttctccattgcttgcttttttcaggtttgttgaagatcctatgtttgtaggtgggtggtcttatttctgagttctctattctctccattggtctttgtgtctgttcttgtaccagtaccatgttgtttggttactgtagccttgtagtacagtttgaggtcaggtagcgtgatgcctccagctttgttctttctgcttaggatcatcttggctattcaggctcttttttgattccatatgaattttaaaatagtttttttttctaattctataaagaatgtcagtggcagtttaatgggaatagcattgtatctataaatgacttcgggcagtatggccattttcacgatattgattcttcctgtgcgtgaacatggaatgtttctctgtttgtttgtatcctctttgatttctttgagcagtggtttgtagttctccttgaaaagatccttcacttcccttgttagctgtattgctaggtattttattctttgtgtgctaattgcgaattggagtttattcactgtttggttctctgcttgcctgttgttggggtataggaatgctagtgatttttgcacattgattttgtatcctgagactttgtggaagttgcttatcagcttaaaaagcttttgggctgagatgatggtgtctcctagatataggatcatgtcatctgcaaacaaagataatttgacttcttctcttcctatttgaataccctttatttctttctcttgtctgatggccttggcgagaacttccaatactatgttgaataggagtggtgtctcactcgtatttgtatctccagtacttaacatagtgtctgtctgtgctattttaaaaatttatatttatttttattttttaagttgacttcgtaattgtacatattcatgggatacatactgatgtttttttaaaatgtacatgtaatgcttttatttaaaaaaatcttttattttaggttcaggggtacatgtgcaggtttgttgtagaggtaaatttgtgtcataggggtatgttgtacagaatatttagtcacccaggtactaagcctagtacccaatagttattttttctgttcctctccctctgccagcctccatccccaagttggcccaagtgtttgttgttcccctctttgtgtccatgtgttctcatcgtttagttccagcttataagtgagaatatgcagtatttggttttctgttcctgcaatagtttgctaaggattatggcctccagctccatccatgttcctgcagaggacatgatcttattcttttcaatgactgcatagtattccatggtatatatgtaccacattttaaatatccattctaccattgatgggtatttaggttgattccgtgtctttgctattgtgaatagtgctgcagtgaatgcacatgtgcatgtgtctttatgacagaatgatttatattcctttaggtatatactcagtaatacgattgctgggttgaatggtatttctgtttttaggtctttgaggaatcaccacactgctttccacaatggttgaactaatttacactgccactaacagtgtataagtgttcccttttctctgcagcctcaccagcatctgttatattttttgactttttaataaaaaccactctgactggtgtgagatggtgtctcattgtggttttgatttacatttctctaatgatcagtgatactgagctttttttcttatgcttgttgactgcatgtatgtcgtcttttgaaaggtgtctgctcatgtcctttgcccacataatgaggttttgctacatgtgatatatagtgatcagaacggatccaggcaatcagcatatcaatcatctgacacatttataatttctttatgttggggacattcaatatcctccttctagctatttgaaaccatatattactgttaactgtagtcatcctacagtggtatggaacactagaacttaccctatctattaatagctataattttatatcctttaacaaatatctccttatcccctgtattagtcctttttcacactgttgataaagacatatctgagactgggcaatttacaaaagaaagaggcttaatggacttacagtttcacatgactggggaggcctcacaatcatggcagaaggtgaaaggcacgtctcacatggcggcagataagagaagagaacttgtgcagggaaactctcctttttaagaacatcagatctcatgagattcattcactatcacaaacatagcacgggaaagacctgccctcatgattcagacacctcccatcgggtccctcccataacatgtgggaattcaagatgagatttgggtggggacacagccaaaccatatcattccactcctggtccctcccaaatttcatgtcctcccatttcaaaaccaatcatgccttcccaacagtccctcagagtcttaactcatttcagcattaactcgaaagtccatagtccaaagtctcatctgagacaaggcaagtcccttccacctatgagcctataaagtcaatagcaagttagttacttcctagatacaatgggggtacaggcattgggtaagtacagccattccaagtggaataaatttgccaaaacaaaggggctacaggccccatgcaagttcaaaatacggcagagctgtcaaatcttaaagctccaaagtgatctcctttgattccatatctcacatccagtcctgcccttgactcctgtcaccaaggttgcagttgcaaggctttcaatttgaaatcaactgcttgttaaaacataggaatggacccatcctgttcaaagaatgtaggaatatgtgataactctcctaatagttatcagttcctaataggaactggagaatccttgaatctcatcagtttgaatgtggtaaagtatttatattcccttcaaaaatgtctgaaattttgagaaattcatcagtacttgcaagtgagttggagttttagcagcaagctatgtattttatccagagtcaaattttaagtttttagcctgggacctgggaaacatagtgaaaccttgtctgtataaaaaataaaaaagaattaaccaggtgtggtggtgcatatctgtagtctcagctacttgggaggctgaggcaagaggattgcttgatcccaaaactttgaggctgcaatgagctgtgattgtgctactgcactccagcctgggtgactgagtaagactctggctaaaaaaaaaaaagaaaaaaaaatttttattttagttttttttccccaagaaacatatctttgaaatgtaatgaaaatagtgacaaaatggggataacattttaaaagtttctaaaatcattttttttccaagacggagtcttgctctgttgcccaggctggtgtgcggtggcacaatctcagctcactgaaacctctgcctcccaggttcaagcgattctcctgcctcagcctcccgggtagctggattacaggtgtatgccaccacgcccagctaatttttgtattttagtagagacagggtttcaccatgttggccaggctggtctcacactcctgacctcgtgattgcctgcctcggcctcccaaagtgctgggattacaggcatgagccactgtgcccggccagatatataaatttttaacaaaacccaaaaacatttggaatatcctggcattgggctgtgtttaaaaagtatattagactttacacatgtgtactgatgaaaatattttacttctgaattaatagaggaaattaaagttgttaagatccttttattacaattaaaatttgggggatttaaccacgatggtgatcaccgaattctcgctattaattcaatttaaaaaatttttatctctctcctgctcctttttattaaggaacattggttgatctagacctcaggttaagtacaagaacttcaggatgagattggaggtctctgacttttactgtgttactctagcaatgcggagaataatttctcctctgaagaactgctctggtagagctgtatagtgatttttttttgttcagttataggaaccgatacatcttagagaagatctctccctgacctacctaaccagcccacccttctccactccccatcctcaccatactggtaaacctggataaattaacttgtcacaggaggcagaactgacaggcccaagagcctcctatattattggcattccagtcctttgcctctaccttcgcagccctcagcttacttcgacacccatagtgcaagggaacactgttgtgtgaataaccgcttacctcttttctcctctatcactctttcttgttgtctctgtgtacctttccctctccatttttgtttttgtttttcctactggttccatctctttctccttcctgtgttctgatcacttctctcctattgctttaaaaagttttttttcttcagacaagaatgaaaggaatctcctattggtttgtttttccttccttttcctcctttcttagttggctgtcggagttttttgggtgtgtgtaacagaaattgactctgacttactgaagcccaaaacttagtaatgaatttcctggaagtttagtcaaaagagggtagtagagggctgctgtggccttcccttctaataaaaactctttcttcattttaatgggaaatagtattttcctctctccttttgtgtgattcatttgttcattctttcattgaacaaacagtcattgagcacctgggccagacaccccttctgagctctaaggatatggtaatggacaagagagagaaaatccctgtcctgacagagcttagattttgctgggagaaacaaacaaataagaggtcagtgataatggcaagttggtgatgtgctggtgactggctggctacttcagattggaagttcagagatgccctctttggggtggtgatgctgataaagaggaagaacattctaggcagagaacaacacatacaaaggctttagagtgggaatgaactaggaaaggctgaggaaccaagacaaagctgctgtggctaaaaaggctataatgcaggcgatgaggccaaagtctctgctagggcttgtatgtgagagcaagttcgaattttattcttcgtgacctgtgggtctcttagggagctgaaatgacctgacgtacacttaaaaacactttaaaaactcaccttttagaatgtcacttgaagctctccatggtacagttatctgtatcgttccgatttctcttatgctactctgccataatgctctgattacttaacctttaaaggtttttgtgaggagtacttaaagtgggggatctcctgggattagatctgaaatgatatacaagggatatgccatgaggtcaggaacatacttgctttgttcttggtattatccatggtgcttggtactggtaagtctttgctgaatgaagaaatgaattacctggtgtgtagaactgtggaaagctctctgtttttctccttttccttcctccttcttcattttccttactaccaggaaacctgccattcaagtcttgttgctcataggaagatgggggtgagaaattgctggccagggtgaaggggggctgttttctggaagtagtgaggtctgcctacagtagtgagccagaataggagggaagttcccagttactgcagggaaggtgggtgaacttcctgtatgttttatatatatatatatatatatatatatatatatatatatatatctcttatatatatatattttatatatatatattttatatatatatatagtatgtatgcaatggatctgttgattgggtttaagttacttttatttaagctgtaattgtttcagttctgctgtttgtggaagttagtaagctaaagtatgtagggaacatgtttacttaaaaaaatctatgcacatttaagaacgattaattctgcagctacttgggaggctgaggcaggagaatcacttaaacccgggagatggaggttgcagtgagctgagatcgtgccactgcgctccagcctgggtgacaagagcgaaactgtcaaaaagaaaagaaaaaagaaaaaaggatgattaatttctgttatcttctcgaaggacaatactgtcatgtggcacatgtttgaacagttggggctaatgcacagaaaaattgccacagaatcttttctgcaaacacctgactgatgggcaaaactcttgtttctcctgctttctctaagcaacaactcttgtaaatactggaagagaacaaccagttccttgtttgtgtgcattgttagttttctattcttcagtgagttcaaagaacagtagcttacaagttactatgattctagacctgagatttagttcacatgctttgtggcttttgtgttagaagtttggataacatctcacctgtaaacttcctgaaatttgaaaaagaataaaatgactatatatgaaaaggcttcttaaaattttaattttaaaaacaattctatgtacagttccttaagtatatactctagttactaaaataaatacattgggttgctggtctaccaccttctctcttcgaggagatcacagactgcctaaagttgccataagtacatgggaagcaacccccacaagtttggttccatccctggcaagtttggtaggcttcctcctgttattcccagaaagtttatgatctttcttgttcacttttctcctcaattactttccttccagtgacagcaagaaaatttcctctcatatttgccctgctttccactgcctcagatttgaaatcagctgtaatcacaatgccaaatactgaggaaagttatgcattttgaagcagaattgtatataattaagtaccaatcaaaacattagaaataattcagggttcactttaaagccattatagatgtattccttgatttcttcaagtttttctaatttagctttccctcaagtattagcattgagggaagataattaacttaagaaactaacacacttacttaattattttagttttaattttgaaaatagtgtcttctactacattttattttagatatatgattttaatgataatagtgaatatattatcatgtttggactagcttaggaaacttaaaatcctaagattttgtctttgggaaaatatttccagaagtcaaaatattatccttggcaaggcacaatggctcatgcctgtaatcccaacactttggaaggccaaggcggtaggattgcctgagcccaggagttcgagaccagcgtgggcaacatagtagaccccatctctactttaaacaacaacaacagaaaacaaaacaaaacaaaaaaccgcatattatcttttacagataaatgtttggagtataatgtatttgcaatttaaagactttctataattgctaacaggtgttaagaggatttaaacatccagtcctggtctgttacagtggatctgcatcaccatcttcattacaaagttatggttccttgccttgtaaacttgatccaattcagtcctgggtttaaataacatacttttttttcattttctttcttcatttggaaagttttatgaaatgaagctcatgatatacccagaagtaagcagtgaaactcagcaccaggagtttttaacatgaaaccattcagtttgggagtatgtattattcaagtgatattctggagtgagtctgtttttgcgttttatataaggactaccttttgatgatgaatgataaatgttctacagggttatatttagctgcatgttgtaacataacagtattttgctcagcttgcgtaagactaagggactgaggttattttggggcgacacattttctcctttcccccattaacgtgtccttttaggtttctgtgtgttaagaacattggcttggtgtttcctttgtttgctttataaggggttggactagtttactgtcacacaaccagctcagtgaggtctatgctggtacatgaactcacctcaggcagaagagaagcattgtgtcactgagacaatgctagcaagagatgtgcatttgtgctggctgtagctgtcagttctggaaggatatctttttaggctgattatgaaaattctggttgtaatcaaattagatgggaagacacacatggctaatattgtctgccattctccctaaattgcccatcaaaaagctcccactggtttcactctaattatacccatgagaggggtgagagagtatttctattctaaacgaattgtcaaataaataaagtctgctgtttgttgactgtatgttaaatcccagcttcaaattaaactgtaaagagatgtcacatgagggtatttcagagcaaacagcacctcaaacaaaaaacatactcatttctagacctcattctcatgaggattcaaatactgaaaattgttaagtatttttagggtagaaataagtgatgtctatagagacctgatgtcaggttctgcttaacttctatgattagccttgcctccatatttgttaagcaggtatattgtcttatgctttgctgacttcataatctgtgatttataatggactcaaaacttgaagaacaggaagaatgactttattttacaacatgttcaaccaaagactgtaggaaacaaaagacattcattcttactctgttttaattagactatttagcatgatagatttaaaatagactgaatataatacaagttttaaatacagttgtgtttctgatttgtaatcagactgactttcctaattcatatgtgattaacattgaatatttctatttccacaagcaattagaacaaagtggaattgtttatgcatttgagaaatgtataactttttcctatttttaaaaaattataaagttgaatgtagatattgttttctgagtcactggatataatgggaggaaatgattaagaaaataatgttgctaaaaataacaaaattaaacaatttgtttgtgtttgtgtatcacaattaatgctgtctttaggaaaaaacagtttataaattaagtgccctgacatttaagaagtctgagaaccaagttttgggagccaaggaagagactttaaaagttttatgtttcagctttttgcagagttttttgccttgcagtgcatttttatgatggacttctgtttctatgctggacttcttttcatggacttgtgtggttcattctttgcaggtaactggtgagtgctttcctttcctaaaaacaaatccaacttgggaatctaattcttttgttcatgagacattcaaatagaaaaaatgaatacagtgctagtaacagtaactcgcttcttatttcatgtactttgttgcagaaagacatggcccacctcagggatcttctgatattttgataatgggtttggtaaagcagggaccagtggcatttattttatggatgttgatactaaggcatcaggagactagggaggctgtttaaagaggcagaactgagagtaggatcaacatctgtactctataatcagagggttgaactaaatcatggtcttattagggacatttacaacctcatattctgatgtttgtatacatagacgggctttagggtgaaggtgtgagaaataataacagtgtgggtccagattcacccagagacagatggtggaaaggaaaaaaaacattttgggaccaaagtttatctcctttttgttgtcccttgctgtagaagagctatgtgctagatataattttgagcactttacatacattattaattcatttattcttcccgacaaacaaccttatgtgatagttacaattattatcctcagtttatacctaaggcaatggaagcatagagggttagtttcatgccactaatggggaaagaacctgtgtctatgtcatgcttcccctcgtataaaacgcccactatttgtgcaatcgtccatcattttttgagtgtgtgctacatgccaggcatagtgttgagtcctgcagataaaaaagagatggaaaccttgctgtcattagtcttacagcctacttggggagacaggctcaatcaaataaccacagaaacaaactggtatacgaatttgaaggagaaggcagagagctttgagaacataaggcaggggcctgatcttattgggttgccaaaaagactgtctcactttagagctgtgatcccaaggaaacggaggaggtggcatctaaacactgcgatgatgcaaggtaggctcaggttgagtctggtcacttcataggccattcccagccccctttagagtccttgaagtcagtgtctttaagctccataatggagatttcagactatctctgtgccctcgtatatgtgcaggttcctgtgcaaattgtaagcgttaagtaaatatatatgctgattgaattacagtcatctgtggtgatttgtgctctgttccacctcctgctggctgcgttgtatcccatgttggaagtggctgagtgtggcttcagaatagacacagaggaagtgggagagtgaatatttggatgagggagtatgccttgactaaatactttctataagcaaatacaaatcatatgacctagagcttttattttttaaaatcagtctattgctttctcttgaagcacatcattggtgaattgactctatttggcttgatgctttcatacaactgggctgagaaagttcattttacccctcttttgggcattcccactatagttgtagtgatatagtcttttaaaatctcattcaccaattattaattaagctgaattaacccttttgggtagatgcattcttatccttatatgtttaaagtagctgttcattaaacataggttttttgctgagcatctatctgacaggaggcatctgaaggtttataaaggtatgggaagcttggttacttgagctccagaagctttccactttagtctaaaggaaactaattacaaaagagctgtgaggggcccatcaggatgtgcttatgagtttctatgagggagccagactgactgtgtgaccttgagcaactaattctcagtgcttttcctgtaaaatgaaaatgggaataataatggaacctaactcggggtgatgtgaggattaatgaaccaagttatgtacaatgcctagaagagtgcctggcacatggtatatactgttaactttttgtttttattgttgtcattattgtgatcattatcacctatagttgagtgtcatattctggagtctaaagggtaagggaaaaggttctgagttggagaagaaaggcatcatgggacatagtatttgagtttaggtctaatgaaatataggtctaataggtagaaatggtgaggaaagtattccagaaaaacaacaacaacctcaaataccagagatatcaggtatgtttagggaagggtgaggagtccaggctagcgggtagggttcatttgaggaaaaatgacaaatttacctgaaaaggcaggctgggacgatatcttggtgaagggttggcagtctggactgggctttttgagcagggttgagactttccgagccctgctctggaactactggagtaggcaggaggtggaggcagagagaaatggtgttagtcctagagtacggtgataagggtttggataagggtttgaaataacgtgatgatgattgtcatggaagaaaggtccaggtagttcactgcggaactaatgaaatttaagactcagggccttttcttgcttagttccgtctctcaagctgttgaagggaaaattttttgtaaaatatgaaaagatgtttgtatcctccgtctttgctccccaaatgatgtgtttcaggctcccaaacctggatctaccccataattgaaagagactgtggatggccaggagtggtagctcacgcctgtaatcccagcactttgggaggctgaggcgggtggatcacttgaagccaggagtttgagaccagcctggccaacatggtgaaggcctgtctctacgaaaaatacaaaaaagtagctgaatgtggtggtgtgtacctgtagtcctagctacttgggaggctgaggtgggaggatggcttgagccttgggggtggaggttgtagtgagctgagattgtgccactgcactccagcctgtgtgacagagccagaacctgtctaaaataaaataaataaaaagagagagactgactgtgactgtgaagagataatcagtctgggtattgacttgatgtggctatcacgtgatggagaggccaaggtcaaagatgacttttgagattctgggtctggctgactgggaggaacccctcatgagaaagggggatgttgggagcagccagttagggtgcggtagtttcaagccaagtgagtgctctgcactggttagcttcaccagtaaaagaaacattttcttcttatatctgcccacccccatcctcaattgcagttttgcaagcatgataattgtaagttacacagtgctaaggaaaggactcagcatttctgctgattaatgggcttcagcccaaagcacacatcatagtgatgtctttgtaatgtccacagttagtattctgtgtattctaaacctagttgtctgaaacttgtaaatggagtctctccttttttggcataagtcttccacatttggtaaatcatagtgctttaagactattttaaagttgtaacatcagttttctggaaattgtattttgaaggaatttaattgactaagacatggttgaaatgttaatttcaaagctatcgtgccaatgttccagtggcagcacctacctgggaaaggctattgtcagcatttgtttcctctttttcacacaagtaaaatattaaacaaataaaattgaagaatactctttcagatggccaaattgaatcctcaagagtattttcactttccaagtcacaaaatataaatataattaatgtaggggcacagatttcacttttaaatatatatatatatacatatatatatacatatatacacacacacacacacacacacacacacacacatatatatatatatatatagtgtgtatgtgtgtgtgtgttatgctttgctgaaaaggtttttttttttttttttttttttttggaggaaaaatagcacctaaaaacaaagctaaaaacatagtaaagtttgaggcaaatgtccccagagaaagatcattagcaaattcatgacccagagtctggttgagacttctctatgaagccatttattgttttaagaatctccccttgtgtatcagagaggttgaattatctgagtagagaaatacagttgtaaattccaaaatgcttcagaaattcacatattattttggagcaggtattaaggatttaatgactgcaggatttagtttaaaaaaatgatttagaagtatttgcagatgaattctaagaggattctatataacttctcatgttggtctggtgttcctctataaaattagtacagacttgatatttgttacattgtttctcacggtgtagtaaacacaaatatttaaaattataagagttatgcattttaatattcatttatgtatagactcagtggcgggttttcccatttatagcaatgatataaaacattttacatcaaattgatttaagtcaaaagtaaatgtgtgtttaaaaagaatgaatggtagtacatggtggtacctacggcagaagttgggaaagtgcatgattaactaatgggcaacattggcttactggtaaacaatataaattgtgctggtttgtagtagggtaaattttattacgctgtttaataaaacctcatagctgttgataatatatatgttaagatactggctctttaagaagcttttattaaagaaactaaaagttatttaagttcttggtacctggaagttaattaaacagaaaaaagtcactttaattgggtgactcctgctcagttaaaaataaaagtatatgttaaatgctatattattaatatggtttctaggacttcttggcaaaagtagggcaattttatcaaagtcgtgcatgtaccacccactaaaatgatgtggtacaccaaacattatctgtgcaaatgcttttgttaagttgtattagtcaaaagtttggggaaagttctggtttgggtttatatatgttaatacctagcgagaaaagtagacagcatattctttctttccccttaggagcacaagagaaaaaatcaagatatttagaagatgctttgaaattaatttcattcagaaaatatttttatgattctgctgagagaaggcaaaaatatttttagaaatattagaatatctggcaacaaattttcgagcattaaatatggattttatttttagaaagagtacacatttgacattgcataactaatttacttacttcacatttaaaaaacagatttgtgtatgtctgtgaaaaagacaatgtgttgatagtagaactataaggtagaaagttcctctttctccttctgatccttcccctgcccttttcctcaaatgtgactacaaactgttaacagtttgaagtcccctaagttttaaaatcaaatggaatgaaatggcatttaggaacttggaagagtggaaaccttttttccagacctatgctaccaactgagtttatattttcaggcagatatgatgaaattgctgtgggctttggagtcagcccactgttcgaattctgttttcatcctagagcaacaacgcgagtttggaaagttccttacctttcttactaaatgtcacttttcttctgagctttaatctagcctagtctgtctctctcctctctctctttttaataagcagacatgtctaagaagatctggcataagaatatgtgacatattttgtcctggaaaaatcgaatttggtattttaatgacccagcatgcattcatgcagtaatgcactcactcatcaggagaacatttccccactttgcccaaatacctaccttcaggttgtgaaaggtcaacctgtaaaagatgccccaggaatcttcctggaatttagatggcctctgttgggtttcactttgcacttattaataattgagcactgggataaaaataaaaacaaagggtctcatcttgcagtgtgagaacatgggccatgtgtgctaagtcatgcaggtaagatgaggagcaaagccctgtggggtagccaatctaaagaagcattccatgtgggctggtgcctccctcttgcagaatgactccctccaaattaaagggaattaacgtaattgctcctggggaggaaaatgcatttttgcttttcaaaggttgttgtctaagctttaattatctaatccacacacagaagctttctacaagcagccctcccttttagcaaccagtcacctttcaaatactgcggcatctttaggcttaagaaatcactgcattataaccaattctgttatataacctaccccttagggtacagtaaaacctgttgtaatgttggttactgaaaatggtctttagagctagtgttggtttaaatggagttttgtaattatttgagctgcaactagagtgacaattctccatttttagaatctgtgcctcttgtctggcagcacttttagttatttcctttctattgctttttgtttcacactcaataagctttggttggtgtgtgctttatcagaccttcatgtttacttgccaaatgaatatggggttttgttactaaagttagtatttttaatctatttattttatttttctttctttagaaaactcagaatggactcgttttctagtcctgaaatattaataagtaaacatgtaatatattcctagtgaaatagcttaaagctcaaagaaggtctgtaagtagaggaaaaccctactgttaagaaccaagactctgccattcttgtcattgaaatgcatagggttttgatgttgggacatactaaggaaatagtgccactaattttaggtagagaagattgtaggaattaagctcgtttctgactatagaggaaaaggaccaagaccatcggctcagaattaaaaaattaaattgctcttggaataaaattgagctctcccagtggtttgtattgctcttcacattccggccactgcctggctttctcccgccccctgtcctcttctctcagtcctagccacactgacctccttttcctccaacttaccaagctctttcccacctcagggaacttgtctttgtcattctcatgcctggatagccattcctccttccccttagctcttcctgtggttctccccatctagagtctagatcttaccctgaacatcacccagagacccctccctgactaccttgactcaggtagctgctttccaggcccctgtttatttacttttcagcatttaccttagactgtatttatttttgttgattattgtctttgccccacaagcataaattctattaagggaggtgccagtacctgatacagtgcctggcatatactatatactcagtatctatgtatattacctgggagttgttcactggttttaaggaatccttttttgtttgtgtctttaagattagttcatcttgtcagactagagggatttaagtagctttggtatcaaaatccaagataatatgttttccaatactcttacccatacacattttcacccattttattgtgattttattgagtgtctagagagcaacactggctttcctcaagagtaggctgaaaattcagtagataccccatggatattgtgctcactgtgagaagtctttcaaaatttaccaggcactgaaataactcacctcaggtcttcgatgaaggtcagggaggtgtgcgttggtctttggtgagcacacggtatattatgagggtacaactgtcgctgccattgtgtctgttcagtgtgcctttgtaaagagcctgggatggcctcttcatggatctgccctctgtctctaagcttacccatggagaagacaaaggctgctgcgcagcttcatgctgaaaaggaaatgttggcaagttgttgctttgtaaagatcaacactatcaccgtaacagctgtcactcaaagtggaggaagtgaaatgcaaatttggtgagtaattagttttgtgtcattcttgggtgttctaaatgttactatttatctgtcttaggtaatctatttaaagaagacaccagaagaagcctacagagcactcctgtctggctcaaaccccccctatcttccattcaggtataactcctggtgagacttgggttaaacttttgctacagagctggacactttagagttgggttgtagtgttttttaattgtcttaagataataaccattatgttatatggaatgaaatgagatggtagtttttattatttcatttcgtagagttttatccccctagctagcaagaataaaagagctttcttcttgtaggaatttatttttttctttgaatcctttctatatctttacagtttatgtcaagcacaaaaagtgcctcatttataagctaataatcatgtcaagatttgttggatttcagtaatctacatcattgattcatccattcattctttcatttcataagcagtgattgagctctggtcacatgtcagaggccggggatatagaataagaccctctaagattcttcaggagcacctgtttagtggggaccctaaatcaccagtttggcacacaaatctgactggcatccccaggaagcctttctctcattactgtgttttctaagtatcatcaaaagaagatcttttaaaaatttggggtgaacttgagctcatttaaaaagtagaaggggactgggtgcagtagctcatggctgtaatcccagcactttgggaggctgaggctggtggatagcttgagcccaggagttcgagaccagcctgggcaacatggtgaaaccccgtctctactaaaaatacaaaagttagccaggcatagtggtatgtgcttgtagtcccagctacttgagaggctgaagtgggaggatcgcttgagcctgggaggtcaaggctgcagtaagctgagatcgccccactacactccagcgtgggtgacagagtgataccgtttctcaaataaataaatacatacatacatacagtagaagggaccatacatcaaaactcccataacacttacctctgctagaattgtgaatgattctaatatttttgccttttttgcttgtgtgtccaaatctgcaagcatgtgtattgcttattgcttattattattaccataattaaccaacacaatgagcgaaaggaatgggagtgactgagaagactctgcttgtctgtcttcctcattctgctgtaaactctcagagggcaggccccagtgccttatacttaaaagcacttttagtgaatatttgaatgaatacattaagactaaatcccttaagagtcaagggattctcattctgcttctgagatcacaggaggtagctgttagggtaagacatggggagggaagaagcaacacctattgtgcttaattaaagtgaagtcaaggagtaaggcattgggatttggaccctgaggggaaaatattctgaatcaacctagagtctgaggtaatcagccgtggaagggcaaataaaaaatggcagataatgtagatgaaagttttaatggtgaagacaaagcttatttttccttccacttctaatggctcctatactttgaaagtcctttgtaaaatataatcctattttttcagaaaggggtaataatgctgataattctaagttctaagcaaagtggttaggagtatatactttggaggcagagaaacttcaagcagtttgaagcctcattctgcttcttgctgtctgtagtaaataagtatctcggacaaattacttatcctctctcagccacagtttccttatctgtaaaatggcttcaggtctaaactaaggatcaaatgaagtaataaatttatccttctgcctagtgcaatgtttggtttttgtttttcttgttgttagcattatactattattactgttagtaacataattaatagtagtagtaattattattacagggtcttactctgtcgcccaggctggagtgcagtggcacactgcaacctctgcctcctgggttcaagagaatctcctgcttcagccccctgaatagctggaattggaggcccccaccaccatgcctggctaatttttgtatttttagtagagatggacttttgccatgtctgccaagctgctcttgaacccctggcttcaagtgatccacttgcatcagcctcccaaagtgctgggataaaggtgtgagccactgcacccagtcaagaactagaattttaaaataataataccagaatagaagaaaagatagtaagataattaatactacttaacatagaattgatttcaattctacataaatactaaatttatagcctatttttcaaatatttttcactcaaatacttttatgtaaatatttgaaaatataaatacattaacatagttcagaaatttaaaaaatctatataggaaggtttaagtgaaaattatccctcccatccttgatcctcatctgtctagtcctttccaggtaacttctggtattagttgatttgatatcagtctagaatttctttatgcacgtataagtaaatgaagatatgcacccatttcctactaaaagtatgcctttgaatgtaactctaagttctatctttttgatatcttaggataccaagagttgtatttacattaagcttcatttctaaatctagaatcttcataaaccatacatttgaaacagaaaataccacaaagtagtacatttataatttagtgaagaatttagttgaaagaatactactagttttctggaaacttaatttttttattatgctaagataagatgtgagttgtttttagtctacagttcaggccaactaagactaatggacttctatcaagaatcatcctcatactaaattctgggcagccatcattgcgttggccttcattataatctgggttttattatcaccaggtttaaaaaaaaatcccatttcttatgaaattacacttttgtcttcattgtctagattttttcaactgctgatatattaacacttttaattaaaaatgagaagccttaaaggaatttctatttggatgtaattgttttattatttaaaattttttaaaaatgaagatgattttgaaggcttgttgaaggtgtggttggtatgttcatatacacttttcactgaaatgtctgtgttcccatttgtgctatatattttagtttctttctaataaaagagttttatggctactgtgaatttaaataatgctgtttttcaaatttttttcactttgcaaacatttatctgagcagtcacttctgtaaagccttcctcatttttctggagaggcttggcaggtcctttgcctgtgattccctattacattttatgtattacaaggctacatacaacgttaaagcaaacaccttgtattataattatttgtttgcatggctgactcttctcttgagggctgtggttggttcttttcctattgtgtcctgagggagcaagtatactaaaatatatttattgctttttcagtgccagtcactgtgatagtcctatggatcaaaagatgtttaggacaacttggtacctgctgcaggagagctcagtgtatagtctgtatacatgtataggtgtgtaaaacagttacagtgctttgttagaattaggagagaggtgttatgggaatactgaggaaggaggtttaactctgaaatgggggggtaggagaagatgttaggaataggccccatggaatgcctttcatgttaggatgaaaactggagaacagcaattcaggcactgattttaggtgctaattttatttattcgtatggcataggttgtataatggtatgttaggtagtatatataatacgaagttcacagtatgggtacattattataaccaaaagaatgatctgattttattcctacttagattctattcacctagttaaaattaacaaaaaacgagaattgtgtagctttaactgcctattcttgattaaattaagtatagttgactttagagatagttgaatttctggcttgtgtgacagcagtgagtgttgtgatgtcacttgtgagtcagtctcaggatgttctgttgaattggagggtaggtgtgtcaaaaactgtattcacttttactgagaatagccaatgtgttgattaagagtgactttaggtgaaaatcaggggaaaggggtgtttttcatctaccttaattctttgagtcatccattttcagtgttggcttggcagttagccttcaagggaacaagaggcctttcagttctggggtcagactcagcagagtttgaattgacaaactaggtatgaatctttttaggttctcttcctttcagtgtactactaaattatagtgtatactattgagcaaacaaagtcgtattaatctcagcttgtctaaaaccccaggagaccagtgacccttagtggaatgtccagattgttttcatggcagtcagtggcagtggttttcaaatctacattgttggtgctcacaaaacagtatttgtgaaaatttaaagtcccgcaaaacattgaaaagataaccaatctaaattgtacaattcttatttaagatgtctcttgtgcttttaaattcattttatacttatttctttgtttattggtccatatgtatcaggttggtacgttttttagtattggtgataattcctaaatctcctaaaagccagtttttaaaatgacatataggccgggcgcggtggctcacgcctgtaatcccagtactttgggaggtgggcgatcacttgaggtcaggagttcgagaccagcctggccaacaaagtgaaaccctgtctctactaaaaatacaaaaaaaagtagccagccatggtggcatgtgcctgtagtcccagctactcgggaggctgaggcaggagaattgattgaacctgggaggcagaggttgtggtgagccaagatcgcgccactgcactccagcctgggcaacagaacaagactccatctcaaaaaataaataaataaataaataataaataaataaataaataaataaatataaaataaaatgacatatacaattaaacagggaataaaattatgctgacaataaataacatccagggatctagttctgaagacatatccagagagcatggcatgaaaaataatgactaagtctggaggtaaggttaggtagggtaatgtgctgacagtaatggaataaagctgtgaacattcgatgtcttatccctttagttttttcctaaagcttggagaagaggctagaatttacaggtgtttctcaaagttatgttgatcctcaaacttatctgcatacgtggggagctttaaaaaactactgatccctagattctgtgcccagaaattttgctgtaattggtcaagggtgaagtcagagttattgggattttgaaaaactgcatatatgatgccaatatgtgtggtcaaggttgagaactcctgctctgtaagatgtaccatggcaaaatatatatatatatatcaagtatatttatatatatattatatatatatcaagtatatttatatatatattatatatatatcaagtgtgtatatatatatatcaagtaaatttaaaactctccatcttggagatttacaaagcaaatttctgttttaaagattctgaatggttctgagtaatgaagtaacctgtttagctctgtataacccagaattttctttcttctttttgtttttttgagatggaggtttcactttgttgcccagggtgggcttgaactcttgggctcaaatcctgtgtagttgggatcacaggcatgcaccactgcatctggcccagaattttacaaagtactgattttcttcctcctgccccatactttccattaatatccagcagaactcctgttctgaaacactctgaggcatatttcctgatccacacctgtgtggaacaaaaaacatctcttgggattaaaataatatgctagcattttgtggaacattttttttatgctgtttcctgagagtcttggaaatagatggcttatcaaatcatggtattttatttaatgtgaacaggaatatccaagttttcttgctgttgtgaggccagacaatcttctctaacagaggattcacacccctcccactggcaatccttttatgacatctgtcattaaaatggatgcataatgtttgtgttgagggaggtgtttgttgtgttttgggggatgacccttagtgatatcccagttgctgagctctgtggctgagtcttaatgggaaatctcaaaagtaattattttagatcttctgggcatgccagaacttgtaggtctttaaacaaaggctcaaaagggtcaaccactgtaggtctttaaacaaaggctcaaaaagttggtcaaccacttaggacttggcatcaggctgccttctttttcataaagtaaacatgtgctggtagacgttagatgtaatcataaaatatatttccttacataaaacattgaaccagatttttattagcttaaatatgatattgtgatttttgtcgaagtttgtttagcaattaactgtacttcaaagggaaagttctccttaccgtgctttcctcttgagtatcaaaactgtggaaacaatattttatcctcttttaagatgttcctttcattctcaacttttcctcgctgtttctcagtcttgatctttggggtcatttctgccccatggatctttagtaaacttttgcttttggtgcttggtataatggaagctaattcgcgttagttttgactagtggggatgtgccaatttcctgagtgttgaaaatagatggcttttccagtccaaactgttgaatccattcttaacagctggggcatattttgaataagtgtacccccatgaaaaaagactctttgtcagagttttcttgttaaagtgctaagtaagctccgctatacaggacctgagaagagaaacaagtgtaagtgtctccatgacccattaagaactcacatggaggtgagttatattattctattttttgtctgctggaacaagaaggtgctttggtgatttgtgttgcgaaaattcgctcagactactttttttttttttattcctacctttagggttccagatcagttttaccaaacttagtgaagtagggtaggtgccaaagtttttgtactctttacggtatatttccagtagccttagttgataaatatggttttgaataagattgcagtcatttaccttaatgaacatagtaatagttattattttgttgaatgttatgaaaagctcttaaatacctgagttaaaaccaatttgccattatttttatttttaaagaaaaattgttggccgtgtgggtggctcattcctgtaatcccagtgctttaggaggccgaggcaagaggatcacttgaacccatgagttagagaccagtgtgagtaacatagtaagacctggtctctacaaaaaaaaaataaaaataaaaattagtcaggggtagtggcacacatctgtagtcctagttgcctgggaggtttaggtgggaggattgcttgagcccagcagtttgaggctgcagtgagttatgatcgtgctgctgtgacagaatgagtccctgtctctgaaattaaaaaaaaaaaaagaatagaaaaattactggttaaatgggtgtcagtcagatgttgatgaaatgcccagagtacaggtcttggtctgtttttctggtgttattgctagttctagacagattttattctgctgatttcaggtgaccttttaagccatgactttagaattgaattttcatgtatctctgtttctttagatgagtaaaatgattcctgtatagccttatgttaaatctgaaaagctgagattctgtttttttgttgttgttgttgttaggtacaggtcacgttcaactttgggccctgcctcctgaggcatgtggttttgctctttcatgaatgggagatggttttgtcctccctactaattctcaatacagtttcgtcttgtaggtctcaatgatataagctctttcttttattgtagctggtacatatatgtcatagatttgttcagaggctggaaactaggatgtactttggacaactgtgtaaagtattttgggcattgtctagctctgaagtatacggacaatatagtctgcagctgaactgtccagtatgttagctagtagctacatgtgttattgaacacttgaaatcagtctagtccaaactgagatagactgtacatttaaaatacatattggatttcaaagatgtagtataaaaggcggggtgtggtgactcacagctgtaatcccaggctgaggccaggagtttgagatcagcctggacaacatagtgagaccctgtctctcaaaataaaaagatttaatataaaagaaaaatgtaagatatcttatttataattatgttcattaatgctgaaatgagaatattctagatatattggatgagcaaaatacactactaaaatttacttttttcttgttagtttattttaatatggttataaaaaattaaaattatacatgaggctctcttttgaggatggcattatatttccattggacagtgatgatctagagtgtttttgctattgtacatagctcataattaaagattgttctatatactttctcctttatttatttgttttcagaaatagagtctcactctgttagcaggctggggtgcagtggccaaattgtagctcactgcagtcttgaactcctgaattcaaacaattctcctgcctcagccttctaggtagcttgctaccactcctgtctaattaaattttttttttttttaaatagagaaggggtctccctctattgtccaggctagtctcaaactactgggctcaagcaatcctcctgccttggcctctcaaagggatcacaggtgtgagccatcatgcctggacacatttttgcttcaaaaggtcaatagttcttagccaccagaggtgttcaggcataagttgaatgaactcttggtaatgatcatttattcattcctgtattaattcatttagcaacatctataacatactaattttcccaacactgtactatactctgggccaatagacataaaagacacgtttcccgtccttaagaagctcatcttcttgtggaggttgtgaagaggggattcagttcagtgcttataagggttcttagatgacctttatgatcctttccaacccattgctctgcaatttttgcatacctcctaactacttgttacccagagaatttagagaatcaaggacttaagataattgtagatcacagtcatttccaaaatttcttagtctcttttctatcagctctttttgtattttttaatgtagtctccacattgtagacactgtgcttctgttctccattctttcttcttcgagtaacttcattattcataataagaaatgctttcttattttgtgtaaatatgttctttcatctctggtttcatctcccattattaatatttataaggttgcttcattctgagtgatttcttagattctcaggttacaagcagtggtatgttggtaaactggctctataagtaaaaagtatttgctgatttccatggtacaaatacttttaccactgctgatttgggctctcaaaatttctgaatatttaacagttcactcttgagagcctatataagacagtgctgggacaccagtgaaacaagctctttaacatttaattgtggatgttgattctagttttcttaaacttaatttttttcctgctgtttttctgcaaaataaacactaaacacaaaataaacaacaagtcccaattgctccttctatttaaatattattcatttagtttttcattcaagaactatttattgactgcaaattcttcctatggtcatagttgtggatttttataaccactgtataatagctgtatagttcagttgactagtatgccagaagtcacatttagaaagatagaattgtggccaggcgtggtggtttgaaggttgaggagggtaagtgggaagatgagggtgagagggaagaacatgtgacttgcagatgtgcaggttctgtaggaagagcccagtggctactggggagctcagggaagatggggccagatacccccaggccttgtggccacagtgaagatttgaactttcccttgagagcaatgggaagtcagtgaggggttatagctgaagagtgatcagattagatttgccttttaaaaatatcactctggcttcagtgaagaaaaccattaaaaagttttaagagtgggtgtaggaaggcagtggcaatggaattggcaagtgatgcattcaagagatatttaagaggtgaaaccaatggtgcatagtgagggataggataaggggaaagaaaggtgagacttctggcctgtagcttgagtgactgtgggagcttttacccagacagggagcgctgcaagactggattatcgttgcagttgtttttttttggagtgggagcagattcaagagattcttcttacatagtgagtttgaggcatctttaagacacccgaacggaaatgccatgtaggtggttggctgtactatttttgaagctttaagaaggagtttgtgctagagagatttgagggtcattggcagatagatggtaatttatggagatgtctagggcagtgattctcaaaatacatgcctttctagcggcagcctcagctccacctggaaacttgttagaaatgcaaattctcaggccctgcctttggcctactgaattagaaacttgaggtggggcccagcagcctgtgtctgtggaactatccgggtgatgccaatacacactaaagttttagaggccctggtctagagagagagagtatggagtgagaagaattttggtctagagttgaaccttgagaaggtttgacttttaaagactgggaagtgaaggatgactttgcaaaggaggttggaagtagtgtttagagggtagaaggaaaatccaggaaccaagagaagagagcaaagtagggagttacttgttgctgacatattaggctaagatgatgcatgcacaatgttctctgggtttaaaataagtaaatccagacagacagaaaataaattagtggattgccaggggctggaggaaggagaatggggagtgactgcaaatgagtccaaagtttctttttggggtagtaaaaatattttggaattactggtgatggttgtacaacattatgaatacaccaaaccccactgaattgtacactttaaaaaggaagatgagactgggcgcggtggctcacgcctgtaatcccagcactttgggaggccgaggtgggcggatcgcctgaggtcaggagttcgagaccagcctggctgacatggtaaaaccctgtctctacgaaaaatacaaaaattagccaggcatggtggcaggcgcctgtaatcccagctacccgggagggtgaggcaatcgcttgaacccgggaggcagaggttgcagtgagccaagattgtgccagtgcgctccagcctgggctacaagagtgagacttcgtctaaaaaaaaaaaaaaaaaaaaaaaggaaaaggagtaattctttagagaaatcttgttttagagaggagtccaaaccgggtggaagctgaaggaagatgtggagcttggaaaattttggttggcttgttctttttggagctagtagggacctgaaaatgtttaaattctgttggaaaggatccagaagagagataaagagatgaccaatggtgttgtatggtggtaaaacctcagagtaggaggggacttttgggttcagtagtctgctgttttcctaactcctgacctccatttcatgttataatgcaggtgaaaaaaattccttagaagggatcttccaattccaagtttgaacatcatgtggggcaggtatctttctgtctcccagggccaaccattagatggtcccgactatattggtgagttgaggaaaatcaacagggaaaattgacttacaaaatgggagggaatgttgcctcttaaatggactttcaatcttattttagtcatttcctttatcctcacttccaggagaacacagtgctgccaattcctaagccttttgagacttacctggtattaattgtgttggttatcatttttttttttggtttttttggagatggagtctcactctgttgcccagactggagtgtagtggcacaatcttggctcactgcaacctctgcctcccgggttcaagctattctcctgcctcagcctcccgagtagctgggattacaggtacctgccaccatgcctggctaatttttatatttttaatagagatagggtttcactatgttggaccaggctggtcttgaactccttacctcagggatccacctgcttcggcctcccaaagtgctgggattacaggcatgagccactgtgcccaactggttctcagttttttcattgtcagtttagtattcagttttcttggtcttctaacttatttaccactcatctaaatgatttctagctttcaaaattttattgttttgtctcttctcttattctcctagtctttgttggtttccatttaaaaaacaaaagcctttaaaaattcaccttttggtcaggtgcagtggcttacacctgtaatcctagcactttgggaggcagaggtgggtgtatcacttcagctcaggagttccagaccagtctgggcaacatggtgaaaccctggctctacgaaaaatataaaaactagctgggcatggtggcttgtgcctgtagtcccagctaattcaggggctgaggctggaggatcacttgagcccaggaggtggaggctgcagtgagccaagatcataccactgcactccagcctgggtgacagagtgagaccctgtttcaaagaaaaaaaaatctccttttagtggggttcggtagatgcatgggttcaatcttccatctttatcttctctctttctcccccagagaatacataacatgttcttgtgtcccttcactgttatagtattttcctgtgactacgtatgagccacatgccacgattaagccatttctttcttgtccagtctttggggcagattttgagaacctgttggcactatgtggctgtcatgaggattaaatgcgctatgcatataaattacctgacacagtaggtgctcaaaaaaggcatgccgtttccttctctcaatctggaggatatgactaaattctattgcattccttattagatttcaatttgtaaacttctctgtgccttttcagcctgtggtgactgacttgcctagttctgtcggatggcatgttaactttccctcccaactttggaggcctgcagatttgaccaccgggtcaccagagctctccttttagtcactggtaacaattgtggctgtgatggggtaggaggtatcatggaagcctcaccatactttgcagacattcagaaagaataggcctggaactttttctggtagcttacattagtgacattgtttagctgagtctaggggtgggaagacatacttgaaagaataagggatacctctacatcttgtaattttttttttttactttttttaaatataaagaaatttttacccccttttaaaaaacgtaaagcagtagtttttaatctagggtctgtggaagagaattcagagagtcagtgaacttagatgagaaaaaaattatatctttatttttactgaccttaccttatcaattataaagttacatccaattataaatgttgtaaataaactgtagtagcattagcaatataagtgacaatttaatatcacttacagttattatttcttaaaatatttatgctcattccttcctcaaaattgtagtggcagttatcagacttgccactagatcttgttatataatatattaatttgaaaagtgcattttggggtattgcaaatttgtattttagtatatttaaaatacatatttaaactttatttaaatgtaattgaaatagttttctgttaatcctagtttatgcattaaaaacattattctgaggaaatgggttcgcaggcttcctcaggtcactgagagtccatggcacagagactctgaaccccaaagacaagtgtctgcaaaggaatttatggttgtttatataaactaatatttttcttagatccctagtcactcttttctctggcatagcccattaaaatttgctttctaacatatagtttacatttttacaagatatttgaaaagggggctattttattttttgctgacatgtgagttcagatgatatttaaaaacacaaaaacaaagatccctccttttgaaatgagacataaatatttggaataattgaagtttcaggacttaagcattctgttaagttgctttgctaacttcctagttttatgttaggctttcgggatgctgaaactcagggatgatgaagttacatttcacttcatggcttagcagccataggttcaagtgaccttgaatggttgtaaaagttggttttatgttaattataccttaaagcccttaaaggtctattctccccttggaacgtcttctggccccttcctgatggctgccatatgtgcctttcactttgtctagataggtgtctgcctgctctgtttcttgggtcagcagtggaggctgggcagagagcctggagccttgaggtcaagtttcctacctcggacaccttggaacactgtagtgttaaagctctggtgccagttcttgcttaactgacctgaacttgatactttagttttatgttgcctaaagcaggtctgctaaattgctctaaaaacttaaataaagtatgaagcactcaattttcaccacggtaggttcccactccttttgaaggagtacttcatggtgcattagaagctctcgtggctcccagtggctcagaggagattgtttggaagcctgactacattttcctgttttctttcttttcttttcttttttgtaggggaaggatggcatttaatccatgaaaacacctgctaggttctgttggcctacatacattgtctctcctatcttttaagcttgtttttatcatattcctgacaggaggttattcctctgccagaatacctcttgcaatgatgaatgttttacttaatcaaacagttcaattcactgttaataataagaatagtcataatatttatgaagtgcttcctatgtaccagccactatatgaaggactttacatattttaaaaaacataatctgacaacagtcctatgagtgatagctgctatcattaacttcatttcacagatgaggagaccaagattcagcatagaggtaaaataacttgcttaagttcctgtgcagtacctggttgaattggaagtggaactaaggcagtcggactcaggaacgcaggctcttaaatcagcctcttggattaaagcaatttcagaagtgcttcagttaagtgtggtagttaattagtaggatctaatgtattatataagtttaccatgttgatagctgtgaagccaaacaagcacatctccagctgactttggtgttatattttattatttgaatgttctaaatgcaagtttttaatgttgagtttatttatgtttatagggatgcttcctttggaaattgcacttacaatctcaccattctcgactgtttgcagggaatcagaaaggtaataacaattctccttgctgtagttgacacagtagtttaaaaaaatatgagaaaggaataatctcaacatccttatttgttattggagggaagaaaggggagccagtaagtagaaggcttttcacttcttgaaggatgattgatttgtaaaatacaaacaccaggaaaaactgggaggagggagtggcaggggcctttctttgtcgtttaaactatttgtgttccagggcagatttatcaccactatcagctgcagtgcctgtgacattgctttgtcacatgcttagcttcattatcaggcttgatcttggtgtgggagagtcaggaagttatctaagccactgtgctcctctgctgcttggtcccaccccagacccactaaaacaaaaactctgggggtggagccctgcggtctgtatttgaacaacctctccaggtgatttgatgcactccaaagtttgagaaccaagtcatagttatttaattatttctgtatataatggagaagttaaactagaagatttctgagagctctcggaacatgttttagaaacataaattcacaatctgagaagttatataagctatactgtaaattctaatgagggctcaaagtacataatctcgaacatataactatggtttattatcagtcaggaatgtacatattacataacctattgatcataggacatatataataatgtcacatggactataaatatattatcagtagcaattctagttcatttcttggatgtaatataaaactgatttttgctgtgttttgagttgagaaaattggtgtgataaatgtgctacctgttttatacatggttgtttctatttaatttaaaatgaatttaaaccctatcaaactttaaaatggttttcaaatctttttctttctacttaaacaactacagagatactctagcccactcttgcaacaatattaccaaggtgcatttccagtaatgccagttaagagcttctatggagacgttacccaacatataacagttgattatagcatttggaaaatatgcctgagggaaaaaataatttatttatcgtcactattattattttgccttttctaccatctgctacaggccatttgttttataacacttaaaaaatttagaaagttcacactggaatatcgctgcctgtaattatggtaattagtaactcagtatagaaagttgtggcatccttcctgttgtagaggaaaggtatgtaaacttgtttcatcaaatgttggggttaactcaaagacaaatgagattttggaggatctgatagattgtgcagcatgtctttaagcacctgagacatttcctgtaagttcattctcttacataaggcaccatattctgggctatttttgtgtggcaacgagtagtaccattccaagaacctatacagagtatggccacatttttgcctttttagggagcacatttctctgattttaatgtattggcattgtcataagtatagtttatattccatgttatgtgaactactatacatggatataagcaaaccctttgaaaatacagaggaaaaaaaagtgaatccttcagagagtttgtatatttttctcacttttttgtctggaaaggtgcatatggatgaactcagttttttttttttttttagaatggactaatttaaataatttgttctgcttattctgtaggggttgtttaaaccagtgttatcagaattttgcatttctaagaatcacctgggaagctatgctgaaaatggtgatcctgggccccaaccacagcaaatatgatttgatagttctggggtggggcccaggagtctgcttctttcatatgaattaccctaagtgtttctgatgctgatggcgcatgttctgtgttttgaaaaaacactgatagatgtactggagcttggcttgctagtttctttttctatttttaatgacttgatcatgtaacttttaaatgtacctgtggttttgtattctgttgtaatctgtatagcttcatgatttataaaataaaagattctgttctctttaaaatattagatctgagctagctggatagtttttaaaagttctaagtcattgtttacaaaactgagtatgacttttactttgtgataaaaatatgtttttttttttaaattgtaagagcagtcaagtataattctactttgtcagaaactatctcatgaaacagattctcccaaggtagagttttaggaacaaataagggcctattaagtagaaatattaagaaatattacatatatattatgtattgtatatataaatatactatattatgtattatatataaatatactatattatatatagtatatataaatatatactatatattatatataaatatatatattctctcatcaaatattattaaggacctattaagtagaaatattaaggaagaaaaaacagtaaaagatgcagggtttttttggggggctaaatatctccctatgataaaaggaagacaaaaactcataagaataattgatttttcttctcctaacaaagaagttaatcactatgatctattctgtcatagttaggtctagttcccaacaggttctaactataaatttgttttatttcattttgtatacatataattttacatacaaaactgatgtaaattagaaatcaaggcatcttttgtggggctttttcatgttattctaagtgtttttttagttccagtaagacagtcttaatgcagtataaccagttttataaaaagatttctagatatgcattaaacatcaaaggtttcaagctgtctcttcagattagtgaggatcatttctgtaagtaggagttccagaaatgatgagtagagtttatcaatttagcatggaaaaactaattcaaattctgcttttagggattacaacatggattttttgactttgagacatttgatgtggatgaatatgaacattatgaggtttgtacatttaattttttttacaaaacataatttcatgttgattaattttttccccctgtcacactcatgtattgcaaatcgagtgggtgctaaataaaagcattctggagttttccatagtggtcagttttgtcctttcagccttggttatttcctttgaatcaggagtcaccaaaattttattttggaaaaacaacatatctatatatattctctcatttatatacaatcactttgcacctttagtttataagaaaaatctagtagggtagtaaaattatgttacttttattttagaaatcaggttttatttaaaataaaactgaatttgtaccttttatttatttatttttgaggcggtgtctagctcttttgtccaggctgaaatgcagtggcacaatctcggatcactgcaacctctgcctccccaggctcaagctatcctcccacctcagcctcccaagcagctggaattacaggtgcatgccaccatgtctggctaatttttttttttttttaaagacaggatttcaccatgttgcccaggctggtcttgaactcctgagctcaagtgatcctcttgcctcggcctcccaaagtgctgggattacaggcatgagccaccatgccaagcccccttataatatttttggttgtataaattttattttgaaatatggctgaatttacttagttctaaaagttcactgaatttttttttccccatggcatcattacaagacttttgattaatgtcttgactgctcaaaatgcaggcaaaggctatctccaagctggtttgcgctgtaaggagatgttgaagcagagtaggataaggaggagtctagaagtcattaactttttctgaaagatgagaagcctgtacaatgtgagtaggttcaacattctcggaaggtgaactcatccgttgggtttccccagaggagtaatacaatttatctctatccttagtaagataaggacagccctcacatttggggccctagtctagaatagggctgtttggatattctgtttccatgttaaatgcaacatatctgaaaagaaactgatcatcttttacccaaacatggtcctctgctttgtgtgtgttaccacattgccatcctactgagcacccagcctcaaggctagaaacattgctgttttcctccctaacctagtgagtattcggatcacttctactggtgccacaggatgtattaattatatctgtctttcctctctgttctcacttccttccctctgactcaggtctcacgtcttttcctgtggacctttcattttaatagttctctaactgagcacggcccttctcctcccaggctgccttacacacacctgagtgatcctaaaatagagttctcatcttgcttgtcttgttcttggccccaaaccggctgtttctcccattgccctgctgaaatgtggataaactctcctgtcctggcattcttagctgtgatgagctccagcctacccttctagccccatctcctgttacttcactgtacgtactctgtgttccagctcctcaaactgcttagttactgtttcttgaatatccctgttgcttggctgaggttgctttttcccagattcccatccttttaacctcccgctcctccatttcgtttgtgttaaaatcctgcacagattacatctcacctctggagtactcttcttccctgccttcaatttcatgtgttacaatttgtactttccatttttcttatatcatggctatttgtgtacaagcctaattttccttattaggttgcaaattccctgtggatggaattatgaccaaatagaaaaacatatactttgttcttggatagaaagacttaacatcataaagctgctacttttcccaaaattaatacatttaatgcaatttatgaaaaaaacccaaagagagttttttttaataccataaaagcattttagtagtgacaaagtaagattcccctctaaaatccccaagttagaaacaaagggaatatgtacttataagaaagaaggtcagataacttgtagtacatctgaatcactgaatgttatgcagtcattttaaaaaatgaattgagctataccacttatcttggaatgatttctataatgtttgttgaagagaaaggatatggaagagtgctttaataaaatccatctttgtaataaaacaaacaatagtaagacactccctagcccacacatctaggtgtctacattatatgaccagaggtgacttactttgaagctaatgaagcttaaattttagagagcctcaccccctcaacttgtatgggcaccttttacagtcctatacccaattttgtgttaataattttttactctaagatggaccctcaaattaggtgagtttcagaccccaccaaaacctggatctctgccccatgtatatgaacatgaagaatgcaaatggcccattgtattaattattaaatatacagccaaacactaaagccatttcaattaaaggagagatggaggcaggagggggttggaagcggtgagagagaagaaggaacaattcaaggagaaaacttgtggatgttttatttattccttccttccttcctctctgtctaactttaatggtgatgctgagggttagttgaaaaaaatcttgaaaaacctgaagcagacagtgcaattttattcttggaaaccaaccagccaaacaaacaaaaatctgacaagaaggtagtcatggtttcaccttgacaacaaccatctaggtgatgggaggggagcagtcagttttggtgaagacttgatgttgtcaaacaacttcttttttttgagaatgatttatctgttctattataaagcctataaaatagaaaaccactattgtgattggcaggtggtaggtatttcttaatttttagtttcttaatttcttaaatgtttaaggaataaatgaataaaggaactcttttctgacaatctgtgggcccagtcatttcctgtcagatttctcttgctgtttgccctgttctagtgagtatgatatttggtgaacttgtggaatagctgaattcatacattttattagctccagtaaagtcagtattccagtgaaggcagtgtagttttcaaagcaaaattttattgttgacagcaatttgtgagactgtaagccttagatgattaggggatgttcaagatgcaacttttctttgctaaagtacatttagtaaatgatatggctcagaaaaacaaaaaacaaaaaaaccccaaaaaagcctaaaacaataagactgtatctctatgtgagattaaaggggaatcttatagaaagagtgctacttataaatgcttctagtgatgaggtcaacagaatgtgggaaatgctttgttgtgtaaagtctacagataaacctctgcccatcctgcaaaaggttatatgcatcttcctcctgcaattccagggtctaaagcagtgctgtccaatagaaatgtgaaagtcatatcatgaaattagttttaacaatacattttacttgttgtaaatatgttgtttacatatttagtaatatacctaaaatagcatttaacatgtaagcaatacaaaaattattaatgatgtatgtattttgcattttttttgaattaagcctcagaaacccagtgtgtagtttatttattttatttattgtgtttttttgagagagggtctcgctctgtcacccaggctggagtgcagtggtgcaacctaggctcactgtagccttgaccctctgggctcaagccatcctcccacctcagcctccagagtagctgggaccacaggtgtgtgccaccttgccctgctaatttttgtatttttttgtagagatggggtttcgccatgttgcccaggttggtctcaaactcctggactcaagcaatccgcccaccttgtctttccaaagtcctgggattgcaagtgtgagccactacgcctggcctccagtgtgcagtttatactatagcatatcttaatttagactagccatatttcaagtgcatagtagccacatgtagctagagtatggattctgtaaggacaggctagccaatgtactgtcatagtccatcagtgtgacatgaagcctaggttatatctccttgcttcatgtgatctgtggttcacatgagagttaatttcaaagccctgttctatttagaaagctcgaggtgagatacctcaggctcttgctttattttcatgtgacttaaaaatggcccattgtattaagtattgataaacaacaccaggtgttggcttccgtcttggaaaagtatcttccaaaatgtggtctttccaggtcctttagcaagctgttgtggaactgtacagttccttacatttgccccgatcagacatgaaatttgggcagctatgctgggaaggtccacaaaagtaactgtgagatggtggtccaaaaccttcctctaggaatcagtgtcaaaacatttgtacttctccaacagcttcttaaggtattctcaaagaatatgtaccttgagaaccttgagaacttttactcctttgaaatctagccatttcaaatctagttcagaaaaatgaaagttgaccttttgtcctagggaaaaataatgaagatgatagagcttgaacattcaattaaattaggtagctgtaggtatgtgaggaactatgctcttcagtagtaaagttagtggtgaatgctagtgtaggctgatactctgcttgtaagacctggaagtggcacccatatacagagtctaccttcagtcagctttcttctgtttttttggggggtagctgtccttaccaaacaagatgttgcccaaacaccagtgatcattcatgatgctactgttaagcagttattatttatcagagagaatttgaagttatgtctctagtttgttattttgcttgtccccaagggctttccgctatttaccaaaaggcttgccatggtttgatgatggaagtgtgatgcggtagcagtgtcctgttcttagttgggtttgggggaagaaatgcagagaaatggtgcttcagtggcaacatcggaggttcctcatcactgtggcttacatttattaccccattcaaaattcagcccatgcaatttcaaggagtctccttaaatatctatttggggattaggtggagataaaagttgaaaaatgacttcaaaactgagaaagtactttgactttttttctttgagctattttctagctgccattatctgccccctgccataactcattccttttttgggtgtgaaaaacaaaattatgagaatattttccagaatatcaagctattgtggccttgatcctatacttttaaatgtgaacaaacccaggccacttctttaccattgtcttgatagaagttagagccacatttggcctgcaggcctgatgacagaggcacctgttactgccttgacaacagtcaccgcacagggcttccttttgttttttcatcatggcatatggagaaaatgataatatttgctcaacaccctgtgatgatagctcatagctgttggcaagtggcctggggactctggctgctccagtctgcccaggcagctccattctggtcacactggctaggaagctttgttttacagaaataatgatgtgcagatgaacatttcttatttgaaagtcaagtagccacaccatgctccttatggcctcattctcatagcttttcagttcatttgttgaacagatattaaatgcctcatgtttgctccatatatttgctaggcccaatgtttctttttctttttttgttttttaggaggctaccagtaatatcatctctccatgtgtagggttaaagcctttgctcttgtcacctggtaccatagaatccatgtattcttgtgcctcattctgcagaagttgccatatttgagtcttgcttcaagcccctacttttatgcttatcaatttagttgtgatacaaaatttctcactgatccatgacaggctgaaatgtggactattttgttcctgagatattcaagcaattcacaggttatcattattgctatcttcacctaaagggtgctcttttggggaaagaccatttctattctagaaagtgatttcacattattttagccacattacaatgtagcgcatctgggaactgtttgtgaaaaagcatgggttcattctggatgcctgggattgagtctttcttggatcttgggcctcttcgatcaagacttcacattactatcagggtgtaggttttaaaaattaagtctgattatatcattcccctgttttatcatttccccttcatgggctccacactgactaaaggtgtggaggaaatgcagactccttactacagcacagaaggcccttcttgacatgggcttgtccttcctctccacccttgtccttttccactccctccccatacccaaatccacgcagcttacccggtggcggcttctgagcttttgcacatgctcttgctccctcctcctgcctgtcagctcttctttctggtccactgtatttacatggttgactgttaagtccttctcaaccccatggaagctcttctcatgtagccttgtgtggtactctgtttacacatctgtgtctttcctgtatctgcgggtacttttgggcagcaactttgtcttattcttctttgtttgaataagtaacctactagcacagtacactcatagtgggcagtcattatttgtggaatgaaagaactaatgagtaaatgtgtgaataatactaaaaacaggagtatagcacatttcaagatattttatatgatctgttttcagtggaaagtgcctaaaacatgttgattaagaatccattctgattttgcagtaatattccaagggacaaatttaccatggtagacaacttcttcaaatgatgtttcttttatcagcagccaatctatgctgcaagagtgaggttttttttttttgtttctaagtcagttatttacaacacagattgctagatgttttaatctaagaccagttctgtatggaacatcaatttagtttaatatgtgagtggggacctatctccaggttgactctgtcatccttcactgcataagtaaattttcagattgaccaggtggtgtagagtcctaacaattgctctttagcacctaccttgagaaatagtaaagtttgttaggcctcctgtctctcagcaagtcacattgggtcaagagcaggagtcaatattgttgaacactgaagttatgatgcttcaagactttgtttggattagaatttgtacagcaaactaaaatgtaatctggatgctgcttggtctgccttctttacatgttggtggattatggaactggaaataatgggactgccataggactggggtcaagcagtcctcagaatgcaagtatgtgggcatgtcctcaccacctggagcagttatggaagtacgcctcctgtggcaatttgaatattggaagaactattagaagaagcattctcctggagctgtctggtagtgttcattacaccactccaaagcctcaagtttaaggaagcaaaattacttcctggccaccgcaactgcaaaagtgaggggacccagtgtttccgtatctgttacacccattgctggttcaaagctcacgttggttaagtctataaaatgttttgagacttaccctgacctaaacaattccccatggcttttttttcttcctctttaatgattgtttggtatcttttccttctttaatctccaaacttcttaagagagcagtctcgactctaattatggtctggcctctactgaaactgttcctgctaacacaagcgttcgtaaaaccaagtggccatgcttgttcttcttcctacttggtttattctatggtcgctctctaattcgcattccttccctgatttataatgtgctgtcttttggatttctcctccctccatggctagccatctttctcagcctccctctcaaatcctttctcttcctttgcccaccctgatttgctggggttcttgaggacctcatgatttctggttatacacactttgtatgattaagtgcatccagttccaagtttcaacaactatgtttgtgctgctgactccaaatcatctttgcgtcttgaacattggagtggcatctgcaaatgtgcactggatttttgcaccctgctgttgtaccagcagaggtgttcactgatctggacttttggaatgggcctccacatgttttccaaccccactgtctccctgctgtagctgatgctagcagaggtgaagcagtcatccacatgggacactcctcttttgctccaccacaccgtctccctcaaaagcaagtctaaattaataatctagagtttgattattatttaaagccagatggcatgtcaacttaaaccaaataattcaaatatttactttgctttaagctcataaagtgcctgtccttacagcatatttgcatttatgtaatacaactatactgtcaacactgttttgttgttttagaagttagggaaatataaagaaggcactttttaaatgaattttaaaatgccactgtggttctaccttattaaatttcaaaatagtctttgtgtcactgtcattcctcttacatacttttagtatcgcatgttcaaagtgtaatgtgactttttctttaatggataaaacgaagatgaaaataacatctacctcatagggttgctatgagaagtaagttgtatagaatacactagtgtttaacacagagtcagtggtatccacatatttgctgccatttttgttactgttatttgtcattcccacctgcctttggactctgtaaaagcatagagaatgctttttattattttatgtttgacaccaagttacagtccttgatatataataaaggctcagcaaatgtctaaatgaatgttgaattgcgcttcaaaactgtttctgcatgttttcctagaaaacacatctgttgatataggaaatcaaccttgtaatcgtcaacctcaaagactatcttttctatcttattgtaggtttgttacagtagtaaaaaggtcaaatagttttcagtgtttggacagaaaaatgtatttgtgaccattactatagagtcacaaatgcatttcttagaaatcataaaaattggccgggtgcagtggctcatgcctgtaatcccagcactttgggaggctgaggtgggtggatcatgaggtcaggagttcgagaccagcctggccaacatggtgaaacccggtctctactaaaaatacaaaaaaattagtcgggcctggtggtgtgtgcctgtaatcccagctacttgggaggctaaagcaggagaattgcttgaacccggaggcagaggttgcagtgagctgagatcgcaccgttgcactccagcctgggcaacagaatgcaactccatctccagataaaaaaaaggaattgtaaaaattcatgttttttagtcaaattatattttgagtgcaccaggagagtgagttattcaaaagaaagctgtgaatcttttgtagattggagaatcctatagcacagtgaataacaacacctaaatgtatcactttcaggaattcagatttttttattttggatttttcttacagtgaagaacatctatagttttttttgcatagtatttggtaggtagtaggctttagatcagaagtggtaatatcatactcttgcctcatccttgcttaggtatttgtttacaaaatgtggtagggttggaaagtaccttaagttcctgtctgatctagatttctttgaagtgtatgtgtgtgtttaattagaaaaaccaacttgggtcatataaagtattttattattgataaacattgacatttgtataattcactatgaataaaggcacaaatattaactttggaagactaccaaagtaagcgtatattatattaggtcagttaaaagctgtaacttccttattaattttttctcagatttaggtctaagacctaaatctttttgtttattccatcagccttatcctggctgctgaatataacccaatattatctactatttatctttttgggtaggaggatttgcaaacatattcttttggttctgtgaatgaatgtatcttagggatccccttgcctctctccatatgattaattataaaaggttgctatttaaccaaatggatttctgtaatccaaataagcagatattgcagagcgtatttatctaacctacttggtggtcaaggatacagaaatagtgaccgtagaaacctgttttcttttattgttcataaagaattggttttagtctcttgatgattagtgcatacctttattcttggattttcaaatactgtgttaagcttaataattacttgagagatattggataattaatttgagacttttatttaaacaagcaaattttaattgccataattagattctttatttaagttgttataaatagaagctatgcttgaggtttaatttcacatgtgcaatcataacactcagggtttcttagattttacttagggcattttggatattttttttatttcctttgagacagagtctcactctgtggcccaagctggagtgcaatggtgcaaactcggctcactgcaaccttcatcgctggggctcaagcagttctcctgcctcagcctcccaagtagctgggactacaggcacacaccaccacacctggttaatttttttgtatttttagtagagacggggtttcaccatgttgccctgggtggtcttgcactcctgagctcaggtgattcacctgcattggcctcccaaagtgctgggattacaggcgcgagccgccacgcccagctggagatattatgtttattacaactagattaaatgcagttcagatgtttataagatggtatgcacagtttcacatataactttttataactgggaaaaaaatctgcattaaaaaatgacaattatattttatagccaagttttgattttcatggaaatgataatgggtaatataagtaattaaagtaatggctccagtttttttttgatggccatattccaatttgtttaacaaatatttattgtgttcttatggtagagtacagagtctatattgggtcagttttctactgttgaggtccttgccatataatggggggagaaagctttttatatggatggtaacggatggcccagtgaagagaacaacattgcttccctgccctgaggatggagacaaggagggcaagggtaggggtaggtggggagggggtggtggtggtaaagacagcgtaagtgaagaggtgatatatatattttgtgatgcattgcacaaatgccttctaatgactgcaaaatttggggtaaccttactcgtgccccagtgtcccatggttcggaggcacatggggaagggaagaaaatgggggagatgatggagccatgggaatgtgcttggctactttcttggtcttcttaagccttttctgaggatctcttagcgtgtttagactagaggctgataactggtgctcaaagtcagccaatgggcatgttttatttggtttcacaggagttaaaaacctaatttaaaaagtcaacattttaaaaagagagttttcacatgaaaattcagttggaagatcagctgtgttcagttggctttcctacaaggtgtctcattagctggagtggaggagcacctgactctatgtatgtcccttgcttgaatcttgttatcctccagagtacagcttggctgactctggtttgtggaatggatgcgccaatatcactcgctcctgccttttgccatttccccctctaaaaatcagcattgacaagagataacagccctataaaaagagaaaaaaaattggaagtgtattcatcaggagcttgatatttacagatgttttttcattgtttaaaatatgtttactacattcatggaaagttttcatatttcccattttctcttatttatcgccaagacaagcaatgtttgtttccatttcatttctttgcagtggccaggaaacaaacattttatgcaaaatacctctgccgtaaataaaagtttctaaacatttcatacagtctagacacaagtttttctaaagcggattgaattcctaaatagcattttgagaatcaggtgcatgtttttattttaagctatgtttgtctacatgtatgtctaattagtactaagagtgaaaagcagttttatttgtaagggtttcctaaattgtataagaattataaaatatttttcttctcttttcttacaaaattctgccagcgagttgaaaatggtgacttcaactggattgttccaggaaaatttttagcatttagtggaccacatcctaaaagcaaaattgagaatggtaggtttttttttcctttaccatccaaacatttattttgatttatctttctaagtttcttaacttcctcagataattattttctttggtaatattctccaaagaatatttattcataatttaaaaaattgaacagtagtaatagtgtgttaaatattgtatttccagtaggtggagctataatcactgttttagaacttaacaaatttttagcttgccataaataggatgttcactttacctgacccccaattattagagaagaatctgagaaacaaactggtcaaactcataagcagattgctgtattctttcagtggttctcagatttatttgttggtagagtgctacacatcaagatgttctttgggtaacaccatgttgaataatgatgatgaagacaatctgtcatttactgaatacttaggtgctagttacacagatcacagcatttatctcttttaacactcaacacaactctatgagatacagatattgttatctgcattttagggaggagtaaattgagccttattagtagagaatttgcccaaggtcacaaagtaataggcagaactggtactccaaaccagaggagggctcctaaacattgccactacactgatacacttagttccattgtgacaactaggtacaattttctagctgacagtggttaaactacttatttgcagcataatttattgccatgggcatacatatttaggaaaaaaataaaaacaaaactaaaaataaaccttttgaatgaaacatgatcagctatgcaagttttcccattaagacttattttgtacttactaattttttctatctactaatattccctagaaaacaagtaatgatagacaacagaggttcaagaataatttacaagagaagtacataaaattgaaaaaatatccatgaacaaaatatccccccccctttttttttctatctgatcatagaggtggaataccagtgttctgagggaacctaacttgaaacctctggtctagatttattcttcagctgggcatggtggcatgtgcctgcaatcccagcactttggaaggctgaggtgggaggattgcttaaggccagaagttcaagaccagcctcggcaacatagcaaaaccctgtctcttaaaaaaaaaaaaagatttatttttctttaatcatcatattctagaatctagtttcattgtatattgttattcatgcatttaggttttataatttgagctttcataaatatgcttatcatttcatacctgtgacatatttaatagggaactctgcttgaatcatgattttaccatgcgaatgggcaatccaggtctagagagttaagctcacaaacaggatacctctatggtgaagtcagaatttgatcttcttacttataagcttgctaaataatcttttttggtctggacattcaataattaacctctgtcattttgggttgttaggaattacatgttgagagcctgaggaaactgctttctgacaattggcctttcaagataagactgattaaacctgctttctgtgcaaattatctgactcaggcccaggaaatgttagtagggatattgtttcagtagtagttttgttgttgggtatttggcaaagtcgaaagactttcaccatttgtgattcatgtgtttgactacgttttcttaatgagaaattgagagatataattgtaaaagccatttaaaagtttttatgtatatagacattgtatattctatggatacatgcattttgaaaaaaatttttttttaacaaaagtggcatcataacatagttaatatcttacagccaggtttcttcacttaacatatcacgacttctttttatagcagtaaatgaagatccatgtaatcattttccacgactgcattgcattttgttctaccatatgactgtgccatattgtgttaatttatttttggtttttgcttttgtttatttagagacaggctcttgctttgttgcccaagctggagtgcaatggtgtgatcatagctcattgcaaccttgaactcctgtcctcaaatgatcttcctgcctcagcctcccaagtagctgggactacaaggcacagcccaccacacctggctggtttttttttttttttttaatttttagtagagatgaggtctctatgttgcccgggctggtcttgaactgctgggctcatgtgatcctcctgcctcccaaagcactaggattacagatttaagccactgagcccagcctgttaatttatttttggatgagatctaagttgtttatctcttattcttactctttttttcctttttaaatttcatcatctatttaaccagatgaagtttttcactttttaaaaactgctgtggttggcataaatgttcatacatctttttgcagctgtagtttcttctctaaattgttagaaatagaatcactagataaaaggatacgcaattttgtataataagttataagtgtcaaaaatatttaaaacaatttttggtcctatatttaatatggggaaaaaattatagccaccattcgcttacctgccaggaagggtgctaagcctcttgcatatacatcatctatttaatgatcagaacaaccctctggagcaggtggtatttattttatagaagagaagctggaggcttacaggaattacctaacttgtccaggttcataggccagtaattgttggcgtgtggattcaaacattggtctgtttaattctgaattttgtgttgttttaaattttattatagaggatgtacatgctcactctagaaaatttaagtaatataaagagtaaaactctttaaaaacatcatataatcaagaaataatcactttaagatatcgctctatatgcatattttattctatgcatgtattgtgccctgtcatattgacataaaaaaatctgaaagtacatttatctcacctttgtcagcttttatgatgcctagaacaatttcatttaaggctgccattggtaaaatattgctattttactggaatttccattttaagatctaatattcactagaagcttcactatacttttttgtaaagtactttaactttgtaaatgctttttgaagttgagaaaataattttgtgatggaattaataaacctgatccaattacagtgacgtcttggtaatttttttttttttttgaattgagaaacctgtgtttttctgaggaggctgaaagtcattttagaggctcgttagaaaagctgaggttttaaagaagtgatcaagtagctgttgctaggaggtagctaaaggaagctctaaaatcttgggatctgggcagaatgtattataagagccttaagtgtgtgtttgtgtcaatagggaacactaggagtttcttttagccattttgattcacattgttttgacagtggggaagagaagagccctacttttttttgttaaacatttttgaattgataaatgatggataacagcagaatgaaacagatattttggatttcagattttctgtaaaaatgtctcttaagtgtcactgtcattctcacttctatttaaacacacacacacacgcacacacacacacacacacacacacacagagagagagagagagagaaagatagcttcagactgagaatcccgaccatttgaggcatcagcctgctcctttaatgagagaagcccagtgtcccgtttagtaaagagcctgggcaggttgaagcctggctccattcctttttggctgcgtgaacttcagtgagttccacagcttctctgagcatcagttttcctatatatcacagtgggagaaatatgatcctcactgcaggcacctagtgaggattagagatgttatgtgaagtgccttgcagagtattgggcacacataataggcgtttattagatagcaggtattatggttacatttttatcattagctggcctaatcaacagattttatgtctttctacatttgcctgctcagtttgcagtttttacttttaataatgactgagtgaactagtcatttgactctgctgttcttcagttttcgaactttaaaatgagggcctgggaagagatgaataaaaacatctcttttgactctgataccgtgttcatgtgtttggtcagcttaactccaggactttgttgtggttcagtgatgccagcgcaccatcttgtggccagatggagtaagggtcggatgaaggctccataagttctgggtcggcacattatacacattgctaaaaccaatctctcgcaaaaagcactcacgtacatccgtaaaagccacaaacagttgttcacaggtcataggacatttccattgttcgttataatttattctaaacagttttaaggatttttataaaacctactcaccaattctaaccgctcatgttcatatcatgttctcttatttggagtcttaacagatagaatcaagttgaatcttacttgaaattagccccagcatgggtgttggaatctgactgccaggattgaaatactggctctacctcttactagctgtatgtgtacgggccagcttttccaggcaccagaaattgagtaattgtaggttttaatgagataatccacataaagcacttagcatagtggctagcatatagtaagtgcttgataaacgttaggtgcaattattgttgttattattatttcagtgccctgttgccatatttggacaatttctgtccagtgttttcttctcaaaagatgtatacatcgtttctcttaatagtctatttaggcatgttagctatgctgccatttactcatgatggaaattcatatatgaaaagagagattcttgcagcctttgttgcagggaggaaggggataggcactgaaccaattgctaacacaacgtgtgacaggtgctgtcatggaggtcccaggcatgctagcaacccagaggcagaagctctcaccagcccgccacaccagggcaggctgcccaggtgtttatgagcccttctcctccccattcctcacatgatagaaaaaccgttacttcttaatgccaactacagttctttttttgctttaggctataaatctgttgcagggaaataatttgagcaagtaaaccaactaggaaaacagacttgatttttgcagttagaaaagcatgttttctccatgtttgtgtaggttattgtttctacacagaagattttaaataagctctgttttacctgtttgctcaaaagcaacatagcctgtgaaaatcacatatctgagctgtggattaattggtcctgccttccaattctgtcttcatcctttgtgtgacctggccaagtgtaccagttatggctgtccaactctggtaaaaggcagtttttggaatatgttgggtagctcatagactttaagaaaaggctggagaactaggcttagaagatgaacaggacccaagtgggaaaatgggaaccacactaggcatttcaaacataaagcatttaatacaaggagtttatttcaaagaagactaaaaagtaaaaaggcaacactgaagaaaccagaatatgttggagaaaacagctagtacctttaaggctggggggacaaaagggacaaaagtggagttagcagaacctgctcctgttttctgctgctgaagtgatgctgccaggaggacaggaagaattcccttcctcctcctcaggttgaggtttagtgcctcccatttttacaaccaataggaagccagatagaaaggtagtctgggaaatgtagggcgtagtatatggactccagccccagtgtcacagagcataagagtcggcttggagctgagagctgactagcataacagggatccaaggcagcaagaaatacagccaagcacacagcgtggaaacagtctggttcactttgctggctgccgccacccctggaacctcccatcatgaatgggttccaactgagataattgcactcagctggtatgttagggttcagtgaattctgaatgggttacagatgtggccatcagtgtgctgggaacttagtcccctgaacttttggagctgccattgcaaggcctgcaaaggccaaagcccccagtggttgccttggctgattagctaaggctaggtctgtaacccagctgactgtgtagctcccaggaatactcacatgatggtggagccactcaaaaataaaaggggatttaaaggtggagcatcttcctccctcaaaaaaaggaagtgtccacaaaagttattgtttatttttaactaaaaaaatttatattttaattgataaaaattatatatttatggtgtacaacaacttttgaaatatgtatacatcgtagaatggttaagtcaagtcttacttaagtattcacatatttatcattttttgtggtgagaagacttaaattttactttctaaatgactttaaagtatataatacattgttattatagtcactatgttgtacaatagatctctgggacatactcctttctaactgaaattttgttttctttgaccaatatcctcccaacaccccctcttttagtttcttaatctgttaaatggaattagccatacttaagagatggttttgagaatttgaaatgatacgcaattgtgacttgtacatagtaggtgcttaataataattgcttctggggagcattgtactacaaattaaaactatacatatggcaaaaaagcttcagctgtagttgaaaactgtttgtcaagtagagaataaagctcaagagagaataaagtcaccattctaggtctgttatgcacatttgattacttcaagaatgcttttgtcttgggagtgggaagagtatgctcccaggattcgaatctagaggttgagattttgaactttaatgatgtattttcagtacttacagaagttttctttttaacctcctgtggtgcttacagttatgcagattgatgcttgtaggagcttgctgtgacctcttctctcacacaacacactttcctcccaagctttgttgagatttatacacttcattgttgagagttttgtatttctgggttgtggaagatgaaatgcatgccttttgcttactgctcctttgttcctttaggttatcctcttcacgcccctgaagcctactttccttatttcaaaaagcataatgtgactgcagttgtgaggctaaacaaaaagatttatgaggcaaagcgcttcacagacgctggcttcgagcactatgacctcttcttcatagatggcagcacacccagtgacaacatcgtgcgaaggttcctgaacatctgtgagaacaccgaaggggccatcgccgttcactgcaaaggtgtgtgcaaggcctcggtggtggtggctgtgcttatcgaaggggcgggccaaggaagagcaaataacataaaacaaaacctgtttagtgtcttagaaaaacaatgaggttttaaatttcagacaactgggacacaaactcattttaataaccccttcttaaagaaacgattgcttgggtgtggacaattggtggtggtgtggctttcttgatatgccagtttttcagaccttacctttccaggcccacgtgccacaatgaggggaaacacagtagcagtgtctttaggctgcaggaacacctttaaacaggtaaaattctcaagagacaagggttgttagttttcctctctcctttgttttttttcagaattgcccatctcttctccatcctcttgcactgtcgtggttctgttttatgacccagttatctggacccccattccagtctctgcttttccctcccctcctagtctttggcttcatggagcagagcgtcttccatgcctgttgctaggggcaatccgctagcttacaatgctgctgatgtgatgctgcctcatggaataaacttaaagagtttgttttgcaaaaatctctgatctctgggggtggatactttggggcaggaattgttcagactatagaaggtttaggattgccagatttagcaaataaaaatacaggctgcctaattaaatttgaaagttagataaacaatgaatacttttaaaacaaaaagtataaatatgtcccaaatattgcagggaacatgcattctgtattttatctggcaaccccatgtcagctactcagaaaatatgacatgccatttgctctaagcttgtttgacttcgaggaggcttaaaatccactccattccagatctttcggtatggataatactggaaatattccagatattttactgggtctttgatttcagcgaggagaaatcactagggccgccctgggctggagcctcgagttcctcatgtgcagctcctcctagtgtcgctgggtggtgctgtgcttatggttttgggtctagacccggtttccctctcattttatgctaatcatctagtaggtgttggggagggtgctgttcttttcatgtgcctagtgctgctgtaactgacttattcagacgagtatggctttggttctgacagaaattaaaatgccgttttgtaggcccttgtttctatgtttaagatttgagtaggtggaggtactttgtgaacatgtgagcaaaaatgggaagctgcggtttcccagagacccagagagatggaaatgagcagcacgtggcctgggtttggagcagggctccccatgccaggctccctcctcctgggtgggcagagctctccctccccaccctccccattagctagcaggatgggccctggctttgtgggatatcttgtctctggcgtggagtctgttaggaaggtgtcacttgctggctcatttgtgggtgctgctttcaggccacagtggggtgccagtgtgttggcttgtccccatgtgattcatttgcaccctgtttgcttttccattgcattttgttcagtattgcccaggtccaagaaaaagcccacatgtcacgtattttaaacagcaatagaacttgagagctaatgggaacgtttatatcaacgtttagcaggagataatcctatcttctctttcaaactttagttttgtgccataaaaattgtattttttcctgagattaatttggccttatttcttagttcaagtagttttattattactacgtcgtagagtttatctgtggattagccatccgtatcttggattgacacattcaaaggagaagaactgcaaagctttcattaaaactcagtgtgtttcttgatagtatttctcacctgagagaccttgtgcaaagaaaactctctggtgttaaacattcttattacagatattttctctatatccttgacctgtgaatgtttaccttttaaaaaatatatgtatttattttatattgcaaatttcttttcttttcttttctttttttttttttttgagacaaagagtctcgctctgtcacccaggctggagtgcaatggtgcgatctcagctcactgcagcctctgcctcccaggttcaatcaattctcctgcctcagcctcccaagtatctggaattacaggtgcccaccaccactcctggctaattttttatatttttagtagagatggggttctgctggccagaactggtcttgaactcctaacctcaggagaatgttggccaggctggtcttgaactcctgacctcaggtcatccacctgcctcagcctcccaaagtgcggggattacaggtgtgagccaccgtacccagtctgtattgtagatgtttttattttaaatcagaacctttaacattgaagtcagttcttgtataggatagtcacatttacatgtggtaatatctttttgagattgttatttcattttcttccacttgcacacacacgtaggattcttttataaggattacacctttggtttaattacagctgtattgcttttcacagcatacttatctactataggcttattaattattttgacatctgccctaattaagtcagcttagttttctgggaattcaagcagcactcagtcttttaattgaactaaaagaaggaaggagaaagaatcttatcctatgtcaaatgaactttggtggctactgaaaagggaatgaatatgtcatgcctcaacgtaaagtattttatacagagataaactagaaaccaatttgctggggattacatttcaatatctgcatttcactttgtggttgataaaagagatggctatgaattcttgaaattctctaccacaaataataatctaaaatacagcaacgttgtgatagtccagtatgtgattatcgatgttctatagggctttcagaaaatgcctggaactataaagcaattggtgtttgacttggtataaatagaacacttttcaacatcttgtcatgctgtgccagggagccctttaattacaaatgcttaaaaaattttgttaaagtttttatagaaacttagtgaaatgttcctattcagttcagttgtggtaagagctcctaactattgagtgctaagtgcgttctttttatagatcaaaattatagactcttttttaaaagggggaagctgctttagtttcagagaaattggaaaatttcctgcacctcctttttggttgtgagtgtgaacaggagcctaagtgagggagccatccaggtctttgcacagtggggagcagtgagagagagtgttgtctccataaggaaggcccttttctctccagatagacacccaaattggtgacttgaaggaagaactctggaaactcactgggctctggcttctgctccaggatgtcacctgtgttttatctatacggttgcctatagtcttgccaggcatctagggaattaacaacgataggcactgggtgaaatagaaggcaaattacgcagaaatcttaatcataaagggagagccccactgagaccaaaattaaacctcactcttcgaaagaacattgatgtttgatctggggcaagggttccttcagattaaaacagaacacacacacacacctcatctaatgaaacagagtatgaatacttcttaaaaaggaagggttagccgggagtggtggcccacgcctgtaatcctagcactttgggaggccgaggagggcagatcacctgaggtcaggacttcgagaccagactgaccaacatggagaaaccctgtctctactaaaaatacaaaattagccgggcatggtggtgcatgcctgtaatcccagctactcgggaggctaaggcaggagaatcgcttgaacctgggaggtggaggttgtggtgagccgagatcgcactattgcattccagcctgggcaacagcagcaaaactcggtctccaaaaaaaaaaaaaaaaaaagaagggttaatgggaaggaaatgtcaggcatctgtagacacaaaattgttgttttagtgggatgaaaaactttttttttttgtataaagcacagatttacataaacagatatgcagtctatctgtgacagtgaaatttcatggggactgattaggaataaaatatctaaagaggctcctggaaggaacaataatgtaaaaaaggttgaggaacactgatttaaagacatacatttttcatattttaacatttctgaagttagaatggatcttaaaattgatggcatgtcatagtttaattttttctttcttagtggaacttacatactacacgactgtagttttagatttgctgaaatgctgtgtgctcccaattactgggagataagagaagactacctttattgtttgatcagggaaagctgacaaaaggtcccctcaaaagcagaagattcttgaacatgtaaaaaatgaaactatcaatgtttccctactttgttttgttttacacacgcgcgcacacacacacacgcatatgcacacaattttttttctttctttttctaactaaatgttttcatggatgaagtcaacattgtaccagttttctaggtcagaaatgtcacttacctataactttccctgtgacccagtcctaatggatttctaattgagctttacatctttgttgcagttgctcaccctcatccctttccaccctcatcccaaccccccagccacccttgcttccctgccccagccttccatctcatctctcttgcttccatctctggcttttccactccagccagtaatgctgctgccagacccatttgctttttatcacatcactttcttgcccccaaatctatggcaccttcattttgcccttttcattgtttaaagaaaaattgggttttacatgatagcagttatgtttactagctgttgataatatcatcacacttgaatgcagagcagtttctgggcaaggtttgatttcagtgtttttgtggtagcatttgctagactttatatttcttattctgtttcattctcttacagctggtcttggaagaacagggacattgatagcctgttatgtaatgaaacactacaggtttacacatgctgaaataattgcttggattagaatatgccggccaggctctattataggaccccagcagcacttcctggaagagtaagtatattgtccccattaccacattatatcctgttcttgatcctttctacctcttgttcccctggttgtggaccatgtcagcctgtggttataaaatggctgcattgttaagagaagtgtgtgcctctaatagaatattgttgatttgacagctaatgcattctaactttgtaccttttatatctcttagatcaggtgagagtgagaagaaaatcacagagccatctctgcctaccctttttctgtcattttctatgtgtgatctggctacagtgcaattttcttatgacatcccacttggcacttttcattcttttcttttgtttgcatgtcttaaagcataatgagaaaaaaaaaaccacaattaaggtcactcagtgattttggtaagattgctgctctcctgacaactaactaactaaactgctaatgtaggtacaacttatgaatatacccaagaagttaccacagaagaaaaaaggaggagaactgagttttagttctggctctccactaactagctttatgaccattatttagaagaatacttatgtattcactcattcatttattcccacagccattcattcattaactttttgtccagcctcagcccaagagagagagatttaacctgtaggacacaatcctttcttcttagaatgttagaacgtatctcaatgtactcattaataaaacaagaagatgaagttagtactggttgatctaagtccagctctaaaatactatctattagtgatatcttttactgaaatttcatttttttttctttttatgctgggttgactctattttattttaattttaattttttattttttgtagagacgggggcctcactatgttgcccaggctggttttgaactcctgggctcaagcaatcctcccaccttgacttcccaaagtgcagggattacgggtgtgagccactatgcctggctgatggctctcttttgaatagcattcttttccatataattatttatttccaatttaaatataattattcctttccagttttaatgatcatgatcatgtgtgaattcgtaaagaaatgatcatgaatttcataggaagatgccataagtaaactcttagcatctgaaatgattaagaggatttgagcctgctgagggattacttactttagttgccagtcctagaggtaataactgattaagaagtgctgaaaaatgagtggttatactttagcttaaaagaatgatgcagatgtctaatgaatgcattagaaaaaatatccaaggacaggatcattacaaagacagggatttctctctttttacccgtgaggtacaaataagataattctgttattttggagctttattcttgatcagattctcattgtcttcctctatttctctgttttgcattttatgtgcctgtagcctggagctttgtgccatgtatctgccaggttctcattatactaattgctgaagttgaagaaatggtcttagggttaaaaaaccaaatactcctaagcctagttctttaagccatttaatcaatgtcttaaaattattgcttgtcatttaataggtattgctatacctattgccccaggcattctgctaagtacagctcgcaaggtgaggagatatagcagagaattctaccagtcaaggtcacctagctttctcagggtgtcagataacacagccctcatgtttcatggctgcatactccctccaacctccctattatactctttctctctgccatatctcaaaatagtaagagaagaaattagagttatgaggcaaaggcactctaggctgaagaaaggcttttaaatttatagatacttaagctgtatataaagaactctcaaaactcaagaaaacaacttaatataaaatgagtaaatgatttgaacagaaagtcctccaaaatgatatacagatggtgaatattcctcatgatcataaacacagagttcttaaagaaacattgcatatcaaatccagctgtataaaaaagatagtgcatcatgaccatcatggctcaatattagaaaatcaatataattcaccaaattaacacaaaaagtagaaaaattatatgattatcccaatagatgtacaaaaatttgacaaagtttagtacccatttttaatagaaactttcaataaactagaaatagaaggaaatttcctcattcagataaaaataatctatgaaaactctatagctaaaattatatttaatggtgatgcttttcctgtaagatcaggaacaaaacaagggtgtctactctcactacttctaatattatactggaaatcttaaccagtgcaatgaaaaaaaaagaaagaaaaaaaaacttagaactaaagagtgaaattagtaagattgcaggatacaaagtcagttttcagaaattttagcaaaattttaaaattctgctaattaaaagacacacagtatatatatctgacaaaagacttgtacacatatattaaaaagtataaataagcaattttaaaaattaatttttgaatgggcaaaagccttggccagatatctcatagaaggtaatatatgtatatgaaaagatgtccaacatcattagccatcagggaaatagaaattgaaaccacaatgagatactattttatgtcaaccaaaatggcaaacaaaaaagaagttttactacaaaatgctggcaaagatatggagcaactggaactctcatgtgttaaccaattggtgtataattgtttggccatttctcataacgttaatctatatttaactctatgacccaatgatttcatttctaggtatttaaataagggaaatggaaacatttgtctacaaagacttgtacaagaatattcacagttgctttattcatagtagcccaaaattagaaatcatccaaatgtccgtcaacaatttatgagtgaatatatcataatatgttcataaaatgaaatactagccagcaataacaaagaatgaattactgatatactcaacatagatgaatatcatattattgtaagaggaaaaaaaaagccagacacaaaataatacatgctgtatagataaagcccaagaacaagcaaaaccattctgtggtgatagaaatcagaaagcaattgcttctgaggtgtgtcagggaaaactgaccccccaaaaaagcatgacagaactttctagagtgttggaaatgttctgtatcttatcttgggttgtgtttacacaggagcacaatcagttgtaattccatatactagccttaaacaattagaaaataaaacctaaaaaattataccatttacaatgtatctggtaacttcaggttagagatgtgcaatatctctacacagaaaaccgaagaattttttttattgagagaaattaaagaagatataaataagtgaaaagataaagattatcttgaataagatcaaagctggaggatttacactcccagatatggattcattttaaaactgcagcaattatgatattgagatattggtgtcaagacagacaaattaaccaatagaatagaatataaagtgcagaaacaaattcaaaaatatacagacacttgatttatgataaaggtgacatgttagagcaacaggaaaaggtctttttagtaaattctgctgggtcaactggatatctatatggggaaaaagaagaaccttggctcctatctcacaacctattttttaaaggaattcctgatgagttgttgattcaaatgtgacagaaaaatcagtgaagcttctggaagataacataaaataatgtattcatactttgaagttaacaaagatatcttaagtggtacatggaaagcattacctataactgagttgaaattgtaaaattctcttcatcaaagacactattaagagagtgaaaatgaaaaccacaagagtaggagaatatttacatcacataataatgggcactgtacttgtacccagaatacttacactcctacacattaacaataaaaagacaatctgataaaaaatgtgtaagaaacatgaaaagacatttcatagaagagaatgtacaaatggccaataaacatacgaaaagcgattcaccctcattagctatttcttatcttttggtacagctatctgttggagatatacctgtgagtggaacagttgggtatgtgtgcattcagagttagaattattaaacagttttccaaagtagatatgcctgtttatgttctcatcagcaatggtttgtcagtctcttaaatttaagccattagattttttaagtgataacttgctttatagttttaatttgctttttcttgatgactaaggtcaatctttgtatattctagatactagtcctttgtctggtaaatgtttttcaaggtttttttcagtctataacttgtcttttcatcctcttaatagggtcttttacagaataaaagttttaaattttgatgaaatcccttttatcacttttttctttttgatattgtctgagactcttagtttagccctagactcaatgatttctcatatttttttttctaaaaagtttatagttttacattcacatttaagtctgtgatggattttgaggtttttgtttatttcataacgtgtgagacttaggtcaagcttctttttttttggcctatgcatgcccagttgcttcagtaccattttcgttgaaaattcagtttctccactgaattttttctatagcagcatcaaaaatcatttggatatatttgtgttgatctatttctttgttctctattctgttccattgacctatgtgtctccttccttcaatgccacactctcttgattactggacctatatagtgagccttaatattggaagagtgattccttccactttctccttgtttaacaaaatattcttagcaattccactttcttttccttttcatatacattttagagtaagcctgtctaaatctacagataatgtttctgggattttaataggaagtatgttaatcctctatatcgatttggggagaattgacatctttactattgttgagtcttctaatccataaacatgatatgtcttttcatttatttagatcttctttgatttctttcatcagcattgtgtagttttctggatgcaagtccttttttgttaaatttacacctaagtacttatttttttttagcaattataaatggtatttatgtccatatgttcattgctggtatgtagaaatacaattgatttatctttttctttctttctttttttttgagacggtgtttcactctttttgcccaagctggagtccaatggcacgatcttggcttactgcagcctctgcctcctgggttcaagtgattctcctgcctcagcctcccaagtagctgggattacaggcgtgtgccaccacgcccggctaattttctgtatttttagtagagatggggttttaccatgttggccaggctggtcttgaactcctgacctcaggttatcctcccacctcggcctcccaaagtgctgggattacaggtgtgagccaccctgcctggccacaattgatttttctgtttattttgtatcccgaaacctaggagttttatatgggagtgtgtgtgtgtgtatgtatgtgcaaattcttggggattgctttttcatccacaaataggacaattttattttctttctaatctatataccttgtgtttccttttcttcccttgttggacaggctaaaacttccagcgctgtgatgagtaagagtgataagagcagacatccttgtcgtgctcccagtcttggaaggaaagcatccaggcattcacctggattaagtatgttaattgaggttttctatagatgttctttatcaggtcgaggcggttcccctctatttctgtgtttctgagggttcttatcatgaatgagtgttgaatcttgtcaaatacttttttggcattgattgatatgatcacatgattttcttcttaagattgttaatatggtagattgcatcgattgttttttgtatattgaagaaggcttatgtccctggaataaacaccatttggtcatggtgtgtaattctttttatatattgctgaactctgttagttaaaaatttttatgtccatattcataagtaacattggtttgtagttttcttttttttgtctgttttgtctgggttttgtgtcaggataatactagtttcatgaaatgaattgggaattgttcttctctgtttcctggaagggattgtgagagctggtgtgaattcttaaaatgcttggtagaattctccagtgaaattatctgggcctggggatttctttttaaaattatgaattcaatttccttaatagatataaggctatttgaataatccatttcatattgggtgaattatggtagtttgttttttgaggaattagtccgtttcatctaaattgtcaaaattatgtttgtggagtgtgtttttttttttttaaagtattcctttatgtttgcagagcctgtagtgattttcttggcttcatttctgatgttagtaatttgtgtatttttttttccctttgtcagtctccctagaagttggacaattttattgatattttcaaagaatcagctctttgtttcattaattttctccttatatttttgtttttaatttcattggttcatgtttttatatttattatttccttctgcttccttgtagttttcagtattttggcaatgtgtctaggtgtggatttcattggaattatccttttttgaggtttactcagcttcttgaatgtttaggtttatgtcttgtcaaatttggaaggttttcagctattatttacttaagtgctttctcaaccctgtcctctttttcctttccttctggaactctgttgacatgagtgttaggtttttgttatagtcccacagctctctgggactctcttcatcattttatttttagtttattttctcttagttattcagattgggtagtttctactattctatcttcccctttacaaattctctcatctctccattctgccatttaacccactcactgaattttacattttggttatatgctattctaaactttctgtttggttttctttatatctatttctttgctgaaacttcctattttgtcagttgtttcatgtgtctttgtaattgtttgttggggcatttttatcatggctacttttaaatctttgtcaaattattctaacatctctgtcatcttggtgttggcatttagcgatcatctcttttcattcagtcaatgtcaatgtgagaaaatgttaacctggacattttcctagtatgttgagactctggatcttactaaaacattctgttgtatctggcttcttacactgcttcagcagaggaaggtggtggcagctgggttggggggcagggggttgccacattgctactaccaggtggaggcaggaatctggattctgtactcagcctctgttgatgtccaaggctgaggggcttcttgttgctggtgggtggaggtgggagttctagttttccatcgggtctgcactgacactgtgataggggtcaccttgttactgaagggtgttggtgaaagtcttcactctccactaggcctcctgtgacaccactccagctgacagaggagggttgctggtcactgcctggttgaggtggacttccaggttccaccattactaccttagtgaggagtggggccgaaattgggggatctcattatctgactcccaacttagccttctttgacacttctgtggcgagggattgacaaagggtaaaggggtgcctacctatagcctggcagcgtggaaatccaggatcccctctcagtctttgctggctggcagggttagggccacagtttatttcctgtggggtttggctggagaagagcagttgttgaaatgttttgttgtctactaggatacccttttcctgttcctttgactagacagagcaggcttttcttcgggctttaaaaatatcagctctgggctgggcacggtggctcatgcctataatcccagcattttaggaggccgaggcgggcagatcgcatgaggtcaagagtttgagaccagcctgatcaatgtggtgaaaccccgtctctactaaaaatacaaaaatcagctgggcatggtggcatgtgcctgtaatcccagctacttcggaggctgaagcaatcaattgaaccttggaggcagaggttgcagtgagccgagattgtgccattgcactccagcctgggcgacacagcaggactctgttgaaaaaaaaatcagctctattggcatttttgaatcatatcttcttcagccctaagactaggctatataaggcaaaaggaaaactcgaggaactcaccaccatttcgttacttaggtctcaaggttccaaccaatctgcctttttcttttctatttttcagagtcttgttttttttttttaaatatatataggattttaaattttacttatgggaagaatagggaaaagtacatctactttattttccagaaatggtgttattgccttatattttaaggtaattagtctgcctataattttcggcatgaaatctgctgtggcagtctgaataatgtctccccaaatacaggcatattttaatccctgtgaaccagctgtgaatgttactgtatatggaaaaagggactttgcagaagtgattaagttaaggaagttgatgtggggagattatcccggattgtttgggtgggcccaattaatcacagtgtccttagaagagggacccagggggagccatttagaggagaagccgatgtgatgactgaaacagattggactgatgcattttaaagatggagtaaggagccataagccaaggaatatgggcagccactgtaaattgaaaaaggcaaggaaacaaattatctcctcaaagcctccatatggaaccagctctgcctactgtcactgctttagctcagtgaaactgatttcagacttccaactccagatctgtaagaaagtaaactggtgttcttttaaaccaccacatttacggtaatgctttacaatatccataggaaattaatacatctgctttgtatagatagcaaatatgtacagcaggagatgcagatcctagtgatgaacatgcatattctgaacttctcttattcatcatactttctaatttggagtatttaattccaaatactccaaattagaaagtatgatgaataagagcatatagaggagtcgtgtgacttaagtgttatttaaggaagcttgagttgcaacaatgtgtaagatgaattgggtggatggagattggaatcagagaggctaaaaaggaggctattatcatccatctcagagagacaaggacttatcaaaagaggatagaagttggactgaagatttagagatgggtaccagggacatttcaagaaaaaagaaaaaaacaaggctttgaagactaactaatgatcagagagatgaagagtatgaagtcaatgatgacgcaaaagcatgaataagtaacgtgttcattaagcaagaaataagagggtaaaaacgttttctgttaggttttcacctgtcaaaaatgactgaacaagttaaagtgattgtattcttttaaaggtgaaaagtcaatcagtgctttttagagaatgttaattccaaatctctgactttagaaaggctggtttgtcatatcctcctagtccttgaggaccaaaatatgtccaggtgcttgattgccatgtcttaaacaagcagccctcttattcactggcagtaagagagatgtttattagcatccttttgagttgttgatgaatttacttattggctgacctctcctttgttacagtctgaaattttatatttaaacttttaaaggatataaagctctctatttgcaaaacaaccatcaggtgtttttcttctatttaaagctgaagttcttaaaccaaaaataccattctgaatcccaaatgtgtcttctatcaaacatcctcaaggttcttaaaatgatgtaaaaatacatctttttgtttttgagccaactctggactcaatgtcctccgagacaacctttagaagtataaaggtggagtcaggctgcttttacaacttggttgattctatttattgaacatttgctgtgtgaatgttcccctgaccttgggtatcattatctatctgtgatagataacctatatcacagatagatagatctatctgtgacagataacctatatcacagatagatctatctgtgacctcggggatcatcatctgttaaagctttcattcattataaagggatcattgagggactagtgtggggctcccacggggattttcagctcacggagatcctttatttatgggtctcaatatggcattgtttttgttttacatttccttctgagacagagagaactcacataaagcctaaatctggctcttgcaggaagttttggctctgtaaagcagagcttccattttgaatgaggttatctttatgaagcacagtattatggttgaactctttttcattcttaaatccataaatcaaaaattcccctgttctactttattacaatagatgttttcatcagcttctactgagttggatattttcagaattctaactttgttgcaagccttccattgtcttcagtgcttctcaaacatgaaaatgcctaggaattgttgggggatcttgttcagtgcagtctctgattcagcaggtctgaggtgagacctgagagtgtgcatttctaacaggctcccaggtggtgtgctgctgctggtccctgaaccatattcaataacaagggtgtttggctcatccttactctgtaaatatcaacttaggctacatcttaatttggtgccaatagtatttcgtaagtttcacaattggattgagctagatcagaaattaatagttaaaccattgcttttttatttcaggaattagcaaaaataagatgaaaaacatctgtttagaaaatggaaaatgcttgaaaaagtctaacactaatggtttgagttttagttgagattgacttctatcatttccttttaaaaaaagttaattcttttttaaatttcaatagcttttgggatacaagtggttattggttacatggatgaattgtatagcatgaactccgagattttagtgcacccatcacctaagtactgtacattgtacccaatatgtagctttttaatctctcttgtccccgaccccaccttctgtgagtctccatagtccgttatattcactctgtgtgcctttgcatacctgtaccatttccttttatggttttcttttagatacatgcagtaggtcaaggaatataggctaaaaaattttaattatttattttaagggtttaaaattttgtgtttcctaaaatacagaaattataatctgaaatactataaaaatcagaatttaacaaaacaagatacagtgttttattagaattacaagcatactgcataggtttgagtttacactatttactgaaaatgacatttttgtagtaacactcaattatagaattttctgattttcaacagttactgctgcattatctgatccatttgttgactgccagttgatactggaactactgactaagcaaaaataaaatcctaatatgggttcaagtattaaggataattaagtatgtatcagaatctttggcagtggttgcatcagaaatttattattaaatactcatgccagttattactctagatagaagactgactttttaaattaatgttttattatggtaaaatatgtataacataaaccttacaattttaaccattattatatgtataattcagtgactttatatatgttcacaatgttgtgcagccatcaccactatttccagactgtttcatcattccaaacagaaactttgtacccattgaacaataaatcaccattatctccaccccctacccaagtccctggaaacctctattctactttctgacattatgaatttgcctgttccagattcctcatataaatggaatcattcaatatttgtcgttttgtgtctggcttattttacttagcatatttgcaacattcatccatgttgtaacatgtatcagaatttcttttagaggctcaataatattccattgtatgtatatatcccattttatttatccattcatttgttgatggacgtttgagttatttctaccttttggttgttgtgaataatgcaactgttctgaacattggtacacaagtatctatttgaatccctagtttcaatgattttgggtatatacctaaaagtggagttactggatcatgtggtaattctatgtttatctttctgaggaactgtgaaactgttttcctcaacagctgtgccatttttcattcccaccaacaatgcacgaggggtccagtttctctgtatccttaccatgaatggtttttgtttattttgttttgtgtgctctgaataaaactatatgaaaaaggttagagatgggggaaaaggtattgtaagcagtaagaaagtaagcagtgatatattaggcttagttatgaagtttgcattttggcatgacactccaatgatctagcttctgattgtagggttctatacctaaactagatttagttagttgaatcttttggagaattcccttcctcagttttttgcttctagcttcattttctagtatgtttcacaattaactgccttcccttatgctttcagaaattctctaaacatcttcctagtgaatcttccacttgtaccacagcatttgaagaactccttgaatacctgttgccttcccgccccctgcatcttggttactgcttcccatctgtcttcctttgatagcaaggtagaccattttgttagcccacttctttaggccaggaactgtctctgtttccataatagctctgggctggtggaatagaaggtacacaaaacagattggtactcaagtcatggctagagtaggcctaggccaagctagagagtgggttatgtttctatttggagtgaccaaacagtggctttggatggactttggggtcagggttgagttttttgggaaaattgtccaggatggaagaaggataaagataaagagttcggttggtgtggagatgggattgggctgggcttagggaagtgaaggaggacaggtcagccacacacagaagcctgcacaacagcttccattgtgttctggactcagaactaggaatattcactataacagtgtgactgacttgaatttcattagaggaatattaaaagcagatgtaaaaaaagacctgtgaaggctctagatcagaatcaactgtaacttggctcataataagccaagttatttcgttattttcttatgtcccatgcctggctagcctaaacccaactaacccagggcaaggacatggctgaaaacaaggaccccagcactggctatacttcttaaggctctattcaaaccaagacacatctcttcctgtcattttaaagcacatgccctttttagcagagggtcagtaaatttcatgctgtcttagaaaatgcactatattcttggagaatgtactttgagctggtgtgttggcttcataagatttgatttttaaatactaaatgcttaaaaatacatgttttacttcttttgtttgagatgaggcttttagggagtaatagacaccacaataaaagctagcatggtttgcattttcaataaaaaggaatttgcgtgaagtgctgctttttctcaagaagcacttgcgtacagcattgcttagcaacacacaaatcagctctgacaccttattcatctttaatattcaggttcaaatcaagcctttccagagatgggacagattgcgtctttcaaaccaagcaagtgaaagttgtcactttgtaattttcatctttaagttggcagcagcatcagaattttcattttataacttcttttgaaattggaatttttttcaactagcctcttatgtccttctcctctgttctcactttgttttttgttcctaaagactcttaaaaggtctttcctgtatttttggtatcaaatttaaattccttaggatgacatgcaaggcccatctctcatagcctctgcttcagccaaattaaacaattcatgttcataaacatgctgttttctttgatatcactatttttccagcccacattgttttctttgcttggcaatactcttagctgggtaagtcctgctcatctttccagatacttctggaatgttggggaacttctttttgattccatcagattgagtaaggggcctcttttcctgaggtcctgtgcaaatcctgatcatagggtttataatatcggacttcatttgtttgcttttctcatcctaaactagaaatcccttcttgagagacagggattcagtctttcatccttatatcctgtcctacctgtgtgtttcatttatctgaatttcttactatttatgacagagctgaatcttctctttttttaaaatcatgatttttattcttttcaacctatctctctctctctgtgtatatatgtatatacagagagagatatcgaaagatatagatatctatatatatatttttttatactttaagttctagagtacatgtgcacaacgtgcaggcttgggaggctccatccgtgttcccataaatgacatggtcttattcttttttatggctgcatagtattccatggtgtatatgtaccacattttctctatccaatctatcattgatgacatttaggttgattccttgtctttgctattgtgaatagtgctacatgaacatttgcgtgtatgtgtctttatggtagaatgatttatattcctcaagatatatactcagtaatgggattgctgggacgaatggtaattctgtgtctcactctttgaggaattgccacactgctttccacaatggttgaactaatttacactcccaccaacagtgtataagtgttcctttctctctgcaacttcaccagcatctgttattttttaactttttgataatagccattcttactggtgtgtggtggtatctcattatggttttgatttgcatttctctaatgatcagcgttttaacctgaattttatgtgatatgtgaaatctttgtgagaaagtattactcaatcctgttgctttaaaaaatatctatgttcttactggtggcgtctccttgatgatgcaattatttcactagatgttgatattttttatgacgaaccacagtgtttttagtttaattctattctgtacagtgtgttataggatagaaataaagtgattttatggaatagtttatcttataggaaatgtatgaaggtgatcccaccaataaaaataaaatcctcagaatgtcattttgcttacatattttaaattatcttcatataactttgaaaacagttgtgattttgccttaatgaatgaaagaaagtttatacatgaacttcaaacacattttcttttctaaggacaatctaattgaggatataagccttgcttttagattctaagagtaggtttttaaagttatgtgtgagggcctttcatggtaccacccaaaagtaggtatgcaatacttttttgggtaatatctccatttaactcaagttctttcatgtacagttttgagtccagttattctctctgtttttataaataggcatatcaaattgctatttgagaaattgaaggtttcaaatttatatttaaaagacaaatgggctcataatctttattgctgtggaatttgttctaagcatctgaggacttcagcagtcaactatatagacaaatattggaggatgacatttgtgtttaatatagaatcttattttggctttttgaaagtgacttcattgttctttattctaagatatcataatctttctagtctgatttgtaaatgcttatttgctaaatcttttcctttataagacatcatacctttgagatgagagtagattgttttaaagataactttttcttgtcgttttgttttgttttgttttttatacagaaaacaagcatcgttgtgggtccaaggagacattttccgatccaaactgaaaaatcgaccatccagtgaaggaagtattaataaaattctttctggcctagatgatatgtctattggtggaaatctttcaaaaacacaaaacatggaacgatttggagaggtaagttttccctaggagattctatcttcttaaaactgatgttctgcatttgtttctcagttggacctatataacatagcagtgtcttttctctggatgccacgagtaccaagtttttagaagtagagccatccgtctatatagcaagaagcagaggaaagaaaccaattgcccttaaaaaaaaaaaagctataatttaaggagtaaattataaaggaggctactctggtaaggggtaatatttatagaaaggaaacagaaaagcaaactttctatttgaaaattaaaataaatatcaagaagaaaaattttaatgtgacaattgaggaaataatacataccacaagtggtgctttgaaagcctcaaattcatgctgatttctaaagtaagtgccaacttgaaaacatgattagggcacttttttaaaaaaaaattaaggctctactgtaaacaaaccactgtaaatagttgatatatattgtctgattaatattcataactacctggtgagttaggtaatactatctctattttataggaaggaaattgcatatcagagatgttctaacctcagtgtcaaacatggttcaatccatgtctgtctgagtccaagcttgtgtttttttatatcacaccctgttacctctgaataaaaatagaagtgatttactaagaattaggattatgagcatttttggaactagaaacaacgttgaaacaccatttgtttggttccactattgtagagacaagaaactggggtcccagaaaatttgtgatttgtgtaaagttccagggttgtttagtagtggggccactttgacaactgggcattcaattcctagtttaggtctttctaccacgttatacctgaggtgaagctaagtatctggtttatacttttatatctttaaaggagaaaaaaagaaaagaaaaaaaggacctgttcaaaatagtggaacaagctaggcagcgtgatgtgtgcctgtgtggtcccagttacttgggagactgaggtgggaggatgtttgagcccagtggtcgaagctgtagtgagctatgatggcgtcactgcactctatcctgggcgacagagcaagcacccgtctaaaaaagtaaaaaagaaaaaaagagaaagaaagaatatagaagcaacaagtgtagatttacattctattagacagtgacccattagacccggacaagggccttaaaccaaatactgtggctcaagcttagcccacaaggagcccagaatggaaggaacacatcatagctctcttaggttaatgactggcatcccaaacagatttctttttagcaagaaagatagccagagtgcttggagattgggagcatgaattttctttcagggacaaaggatggagaccgttggaagaaatgatttttaagcccagtgctctgttctccaggatggctgctgatgaggtgactaagtttacccattcgagtcatctgtcctgatgaaatgtacaccttatccaaggtcatgttgatgttagagcctttgttgacttttctttgtctctgtgttccagtttcacctattaagagcaaataaaaagaaagggtctgaactaagattttaacatgataatatagctaagcaagaatacctttttcttgctctagtcagcatttcctccccaggttgagtacaagtaaatagggctttgagttatgaactctgaaaagacaaacataaagttaatcccgttatctgagaaacatatttaccttgcaggaacatagtactttctatatcataatcttgattaagttaacatctggtagttagaacgttttattctcatactcttttaatccccaatttgttgaatttaagaaacttaacatttatgtatcactgtgagggtaaggaatgcaatatgattggaattttaaataagacagttttaaatataagtgtatataagtctactcccccgtcttagtccatttgggctgctgtaacaaaacactacaggctaggcagcttataaacaacagaaatttatttctcacagttctgcaggttgggaaattcaagatcaaggcatcaacagatttggtgtctggtgagggcctgcctagtggttcatagacagcaccttctgcatcttcacatggcaaaaagggcaaacaaactcttaatgccatcaccttgtggggttgggatttcaacatatgaattttgggggctacaaatattcagaccatagcatcccccatcattattttagttttagccattgaaatgctattgtttctgaaattcaagagcagaaatgaaagaattcagagatgccagagaatgatggtatggtgaatattttacacagcatcatgtatgggccctaggactactttattagctagttaatggctttgtgcaagtaactcttacaagcacttttctttccatgcttatctggtgccagctctggaatatcacatgaatatggaaaattcgcttactcaaaattggtcttaacagagttaatgatgtctttattattcttataaattgcacatgggaaaatagattgagaatgctgtaagaatttaatgtgtttcaagttgcatgtgggtaaaagtctatggaatttctggatttacttagtttgtatatatagaaagtgcaaaaaggcagtattcctcttgagattgacttttaaaaaaaagattaaaagcagagattctaaattattattttctttctaggcctacagtaattttcttgtgattagttactaggaagctctgtattaccagatttggagaattcgaatagagttttttaggccgggcatggtggcttacgcctgtaatcctggcactctgggaggctgaggcagatggatcacttgaggtcaggagtttgagaccaggctggccagcataacgaaaccccatctctactaaaaatagagaaaaaattagccaggtgtgatggcacatgcctgtagtcccagcttcttgggaggctgaggcatgagaatcacttgaacccgagaggcggaggttgcagagctgagatcatgccactgcactccagcctgggcaacagagtgagactcggtctcaaaaacaaaacaaaacgaaacaaaacaaaacaaaacaaaacaaaacaaaaaacaaaaatacagttttttagtgcttaggatgtaggtgaaaggaaaacaaccagaatgttgcaggtcatagtgatggactaagttgtggttttactgaatgttctttgccaacttagagttatgagaaataaaatagaggcttcacctttattgagcctggacttcagtgctgggctgggcactatgaaatatacacagcccatcctgtgggtctaggttaggctccctgctccctgctcctgccttgcactatacttttcccccacagtcctcatgcctccttccctgctcggtgatactctctaggaaggcagagacttttatttgtcttcatcatgattctgtttttggcaaaaggccttaataagtattatgtgaatggatgaagaaggcttatagtttcagagaaaaaaaaaggacagagacatgaaattggtaataatctaagctacacaagtgcattatgtgctcaaatacaaaatagtactagcaataagtgctcactttaacatttaggggcctatgggtccattatggcttggagttattttaaaagatagaatttaaagtactttatttaaagtgcaaatattaaatcaggatcttagcatgaagttactgtatgccagtaactgttttaggcacttgacattaatgaactctattaatccttacagtagccatatgaaataggcactgttattaggcccatttacaggagacatacctgaggtagaggtcaaaccatctggccaagatcttgggtacatggtgaggtggtcatttgaacttctgtgctctggctccaaagtttgtgccctcagccaccctcccgggaggcctctcactatactctgctaactctctatgaggtcttcattgtggctttagtaaattatgtacagtaattttgagcaaaactgtaaccattccttactaataaacttcttctggaattacaacggtttttacattttgtctttctactctagggctatagtccaatattagcataccaatcagtagatgctcttgacttagtgatattaattagatacaggtgctgctaatattcagccaagttcatacaaattgacaatcaagtagacaagaatgtagtgttttaattacatctttgagacattgtgatttataaaatccatcaagtactcataagcagggtacatcttagaaaaatctatgaagtaaaaattaaatctctaatgtcctgctttttaagcacctttctttcccccattatgacagtgaagaccagttctaatctgaatgccattgggatccaccagaggttattaagcaggggagtgacagcacacagaatcatggtgctgagagatcactctggctatggtgtcatatagggctgagggtggaaggccagggagttggtgatggggaggtccaggttttaaaggacccaaccagtggcagtgaatggggcagccagaagagagatgtgggcagctctgataaattcaaactttttattgatcagaagcagcttattataaagatgacatctttgcctttccccagcacttacatctcataggttcaacatctgagagctgaaaagaactctagagatgacccagccacctttcctagccaatttattaaaatctgctaaaaattccattctcatctttatcttccagttcttggacttctatttttactcatttctatttaaactgtctatttatgtcatttttctattaggactcttccatctttattccctagtgtgctatattctatctcatagatcttttcttaatgagactttccacagcctttcctatagcttactgtgccacgattttgtttaggttttggtcagcaattactttatctagctgaaatctgtggacacgattgtgcatagagaaaacaactggtggaataaaatatttattcttcatgttgttgtttgttctttcactaggtcatcactcatgttttttttttttaattgtacttcttttggtacaatattttagtttactaagtgatattactaaaatatcattttcttgccttcatgtagggcagcccagtatccaaaaggaagagagttgctgcttaatcctccaaagggcagtggggcatctgagagcagacccctttcctgtgggggacaaagataggagggtcttccctggactaggtagggttcttcattgttgccagcatcagccaagtggttttgtttcttttcagcagattccagggaatctgcctctcctggactagcttaggacaagagagagtctgctctggcattttgtagggagatgggctggagcctaagggcagaatggaggcccaggttgggttctcctcatttgtcacttgtgaatgtgttctttagtcatcatgaagaatgaatctggtataaggaaggaggcctaacagcacctgatgagaaaagtcttcaaacactcccctggctaccaactcatgagattgatttgtgccacacaatatctgcatttgctaataaacattttcctcccacaggctcttatgacctggtacatcttatcggatcaatcccctaataaatataaggcttattatatttatgtctgtgtgtcttattcagtattccaggaggccaaagtccttttccatatagctttttagtttcttaattctgtaatttaatgtaaatatgttttgaataatgttactatttttcttgagtttgaaggctatttattaatcactgagaattttatagtttatatgttctatctctcatagtcctaaaaatgcccacactttgtacaatggccacagagaaaaaataaaagaagattagtttagacaaaaatagtacggtttacattttagtagattttttcagacctatattgcctgtctggatctttcctccttcttccctctccccaagtctgaactccgatgtggtttcccgtaccctaatccagtccatcatctctcatcagaccactgtatagccgcttaaatgtgtccctctcccgagtcttgacctccaattcattctcacagtgatcaatgggaggaaatatatgcaatatatgcaaatgaggggggtcgtgtgggtgtaaagaactcttacaaatcaccaaaatactatgtgcacaaataaaacaatatgggaaccctcctggctggtaaacataaaaaaattctacttccctagaaatggaagagacacaaatttaaatgatgagatgctatttatgcctatcaaatgtattaaaaatgtatgcagtattgacaaacgtttagggaatacaaagctcttaaacattgctagttggaatttacaatggtacagccttttggagggcaatttgatcatatgtggaagatgactttaaaaggaattccacttctatgaatttgtcttaaggcaataataagtcttcataaaccatgtatatataagagtatgtttgttgaggctgtttatagtgatgaaagacagagaacagcctaacctaggctatcggttaaataataaaattaggcatatctagacaatggaattttatggagccataaaacgacagagatttaaaaaaatttgccctgaaaaacttccactatatgttttttaagttaaaaaagttacaaagcagcatatgtatataatacaacctctttttgtaaggaagaagtaggttgggggttttatatagcacagggaaaattctggaagactgtgccagaatgttaatgtgtgttgcttttgatggtaaatatataggtggttttaatattttttcctgtttacctatactttattactaatgacaaacatatggtaaacatatctccatatatatggtaaatgcatatatatttaaatacataaaaatatatcataaatatatctgcatctctctctctctctctctctctctctctatatatatatatatatatatatatatattttttttttttttttttttttgagacagtctctatggcccaagctggagtgcagtggtgcgatctaggctcactgcaacctctgcctcccgggttcaagtgattcttgtgcctcagtctgccaagtagctgggattacaggcacgcaccaccacattcagctaatttttatatttttagtagagatggggtttcaccatgtgggccaggctggtcttgaactcctggcctcatgtcatccacctgccttggcctcccaaagtgctgggattacaggtgtgagccaccgtgcctagccagataccttttttttttttttttgagaaaaaacacctctgccctcgtggtcgtcaccaccgcagccacccgagaggagctggggaagaacagtggcccgcgaggctcatcacagacaatgcggtggctcctgtgagggtgtttaagtaaacttgaggggaggaagtaaaagtatgttaaatctgggtagttaagtgcatggctgtgtattgtagtatttttgttcttttctgattttgagatgtatcataatttacagaaatatttgacctttaagattcacaatagaatgagagaaaaatacatgcaaagtaattataatttaaaatgtactgttatttaattttctgtttaactgtatatcttttaaaatgcttttattcttttcaagcaatatatgatcacagcttaaaaaatatcaacaagcgttgaattctagcaacaaaaaatatcagtctcctttctcacctttctgtatctctggacccacttccaaagggggaaacctctaggaaaattatactattatttttagtgccatatttctattataaatactttgcttatgttgctgttttttaattgatcaattttggacatttttgtattgcctcctggttgttgtagacaggatgcagctcttctagctcactgtcaccaccacttcccaatataactatattcgttaaatcaaataatgtgcacattattactatgtaaacattgttcacggttgagcttagtagtacactatgactgttttcttttttgacgctctctttgtgtgtcctagacttaattgcctttttaaatttgcatagttttctatgcatttaggaaaagataatgctttaaaaagttgtgccaaacaattttaaattttttcaaaatttcaacacagcaaaattccattctaattccattcttttcctgaagacatttctcccttctaacttggactggttgttcttagccctgctgtgtgtgtgtgtgtgtgtgtgtatgtgtgtgtgtgtgtgggtatgtgtgtgtgtgtgaagtcctaggatcagaactatatagcctgattctataactcttcttcatattcttcagttagatccctaattttcttggatctcatgttatctttccttttttcctgaagagcatatcctgtaatagttttctcagaaagattgtatgggaggtaaatttttatatctgttttacctttatacttacctgaaaggttgaattttagaattacaggttgagaatcattttatatttagaattttgaaggtgtttctagtgggaaacataaagatcctcctagttggaggaacaaataagctttcctggtacaaaagcacccagttgacaatgaaactgattgtggcaaggattctgtcaggtcctcctagaagctttcttagccattctcatgaggacctatgtgttttttggcctcacctcatattcaggaaactctggctctgtgctaagtaactgctaacatcccagcacgttgagtcgttactgcagcctagtgaagctaagctcaccttctcaggtgcaccatcccactggcaagcctagctgtcagaccttcctgatttctgttcttgcaggcttcctttgatggtaataagttcctcccccattggggttgtatggatagaactgaatggtaaaactgatttctggagattttttagaagtgcaacttgagactctaagagaatcctctgtcatgaagactccatgatcctgtgactgttgagctggtattcttgcacaggacgacctttcctgggatcttgggctgcgtcacttgcacccattctttaagggattgcctctaggaagcttttgtccttattctttctttcccactggccttgtgctttgcatttctttatttcttttttaaactcagagatgtgatggtgaggtttgatctttttactgtggaacccaacataggtggccgggattgaggaggtattgcgatgagaaatgactcaaatgtgacttgatggaagtacatttttcatcaaacaagagttctagttttaaataggggaggggactattacggctgggagggattttagcaaatccaagcactttgatttttcagttgaggaaaaaaggcaaaatacagtcttcactggtgcaatgacagtgtgctatggcatatattttagaaagaacattgcatcttgggacaagaaatctaattttgaagtcacacaaaggtcattaagagcttatgggagcttgggcaatattcctaacttccatgagtatgtccttttttcatcgataataagggtaccagtgcctccccctgcatcagggctattgaagagactagcatttgaagagactagcatggtacttctatttttcaaactttaaagagttatttcagaaggtaagatctagtgaacatggtcctttaaatccttctgaaaagggcttgtgtgcttttactagtgttacatgattactgtgttaataacttactgtataaatatcctaaagtatttttatcttgtatttttgtaaacaggttatggaatttgcagtgatgggtcctggtagtatctaaaaacatatttgtactgcatctgtgggcccttctgtatctaggctatattccaacgtatgattgtgtctgcaggagagtctcctctgttgctgtccagtgtaacaaacagctccttgtatattctaccacatctattcccatgcttcattgatttggaatttgacttgttgcctgttgaactggcaaatagttgagtgttcttttgtgtaaactttgacaatgctgattcacagtacctttagtgacttaatctatattaagataatctgtataaaatgtatctatatatgtagtctgttaagaaacctatataaagccaaattttgacctttctatggaacgtgtatttttttccaggataacttagaagatgatgatgtggaaatgaaaaatggtataacccagggagacaaactacgtgccttaaaaagtcagagacagccacgtacctcaccatcctgtgcatttaggtagatctgttttaaacacttcaatttatagtgtgcttccctttgtgaatagaacatttcatcttctctttaatctgtaatcttctgttttgaattttgttctacaaatactaagtttactattttgtgttgtttattgattattttatcactgttgggagtagctaaagtttagaagtttattgaaagcaactgctgccatctcagtctctggaattctaccttaagctgcaaagcagttatctctgggactctgtttcaaattctgtttggatttctccccttctgctgtgaatgagtttcttgtcctgtgttggatcctcacaggtgtgctgaggctgttgtattgactcatagtgtatataaaagtattgtatgccagtctctggcaatctaagctagttcctcagctttaccttctatttttgaaaattgaataagcaattcttacctgtgcctgtaaagttataagccatcttgactttgaagtctcaaactactcaccagaatcaatgatgggacttgacttctgatcacatttgaaacctgctgatagctcagattgggtttaaaaaaaggggaatcaaaaggtgcaaacgtttgtaaatatcatcattttttaaaattacaatatactgggtggcaaggccccagtccacaaattaatataatggtaagcagcaacatttttttgacttataaataagagatacacatagcagaaggatgttttgccggtatggtaaacaccaaacagattcacagggaatttagttttcatgtgtaatctgggagaaactataacactgtagtcagattgggtctttactgagttcctgatctaaggaataaaggttcatattgctcaaagatgaggttatcattttctgcagtattatgagaaaaggggatagcaagcctggttctgggtagtctaatatccatttgcaaggtttctcccttttgctaatttaatatttttactggtttgataccatttgatgtgccttgtggtctttgtgaaaacgtgtgccctggtgatatgtgagcatctgtctttgatttccgcaggtcagatgatacaaaaggacatccaagagcagtgtcccagcctttcaggtactgccaatgaggttgaatgtctagtagcttgtaaatatatgcttccttttagccatgtttcccaagcctcaaacacgaaaatcaactgtacacagctttttgctttttaaattgcttcctttctcttccatattgtttatgccttatttttaatgctcaccatgaaaaggatttttttttttttgctggcatgcccacaggactgtgtggtggtggtagagacatcaatgtattttgtgctcttagcacattgtggaggggggtctctaagaaactacaggtgctctgcatttctccttttgatctagtgatagatctagcttaaattgttttcatttttattggtcctctttctattttttcccaatcagcatgcatttgttcccctcctttattttctagtcttattttcttctctaccttccttttcaagaggaaacactagttttgttctgtggaaaaatgtcccctgaaacctccgggagtggtaccacgatctggtgtggcactcagtgagagcagcagagatgtttggccaagagtgttgatgaaataggggaaagaagctcttcacctgctggttcttattcattcttaggtttaggactgtttagtgagggcagttcaaagagggcttaagcttctggagcttctggagaagcttgaattgcttctttgtagaactttttccatttttattttggaggcaaaacatgagcttaagctgctgtttggtgggtggataatgaagaaaagagtctacaagtaaataagcttttctctagcagagaggaaaacagagttcagctatattaaatgatttatctaggatcaaacagatttggtattaagattatgactgggccctggctctccagatttgagtcagtttttcctttttgtccacttggcaaatatttattgagcacctgctcagaatccagcattgtgctagccactgggaattgaaatgagagagaagtctttgccctcaaggagcttacatcaggtaacggagatagacaaatatcagatgacgcaatatggtataagagctatgatttactatgagaatatatgatgaaacatatattgcttgggaactcagagaaggcttgcttgatgaggtaacagctgattggaccattaaaggctaagtgtgatagaagtgggtcaaatggacatggaagataagaggtagaggatgggaaggagatgagaaaatgccatggcagggaaatagtctgtgcaaactggacaaacgtgtggacgctacccattcagggaactcaaggcattcttatgtagctggaatagagatgtccaatgggaaagtgtggaaagaaggacctgtccagattttggaggggctgcatatgccaagccaaagagtttctataggcttgtgggcacagaggaaagatgaaatggtttaaacagtgaagtgacatgattcactgaaggctattcacaatttgaattgtttaggaataagattaaaagatgccacttgtagtcaaggataagaaataaagatggcctcgcctagggtagtttgcagggtgaaaagaagaggatggatttgacatataagaagtggaatctaaggttgtgctgaggaatgaataccagtggcaaagaagggcagtggcccaggaagacaggatcatggctaagagcaggactttgactcctgggtttgaatcccaggtctgctgttcactaactgagtgactggatgaggaacttttcctctgtgtttttgtttcctcacttgtaaagtaaggacagcaatattagctacttcgtagggttgttgtaaggacaagctgagctgacatctttaaggttcttagaacagtgcctggcagttagtgctgtgtcagtggtggctgccgctgctgtcatcactattaggacctgtcatgatatctttaagattgattaatttatcttgtcctagttagttgctgaatgtttaagataagactactttattgtgacactttgccatttttctccgcaaagattaagttcatccctgcaaggatctgcagttactttgaagacatcaaaaatggcactgtccccttcagcaacggccaagaggatcaacagaacttctttgtcttcgggtgccactgtaagaaggtaatttttctctccctcttctaaggtgctggtttgaggtaaaggaagcttgcagcaggcgatgagtttagctgcagttttgtcagaggaggggacaagggagaagaggagaaaccacggaagaccctgtgatgttctggggcttccgttcctgtcttgggaaggcaggagacaaggttgtggagggaatggtgcaaagcgtgctcttcttctagagagtgagcagctggcttagtgtgatccagaaaatggagttcagttgtatatacaaatgatattgtcatttctcagctgacacgtataggcaagggagaactaaccaaaatgggtagggatgtttgatgtagtcatgtgattgaatatgtacttaagtctgcttttaatgctccccttacatggcccttttcctttacttcccaccccagggtaaataaaactctgtgatgttctatttcaagatctgtagtcaaagtgttttagccagtttcttgggtcctagttaactgcttttgacaaagcaacttgatatgtataactcaaggctacatattatcataacaccaagggtgatgaggaagccatcctgacatcattcacattgatcagattcatcttcatcatgttcccctaatgtcatgagtatgtgttttagaaacgtgagctctgtgtgattgtacattgttgtctgttttttccctcctcacttgtgttttccattcagcttttccataaactcccggctagccagttctctagggaacttgaatgctgcaacagatgatccagagaacaaaaagacctcctcatcctctaaggcaggcttcacagccagcccgtttaccaacctcttgaatggcagctcccagccaactaccagaaattaccctgagctcaacaataatcagtacaacagaagcagcaacagcaacgggggcaacctgaacagccccccaggcccccacagcgccaagacagaggagcacaccaccatcctccgaccctcctacaccgggctttcttcttcttcagcgagattcctgagccgttctatccctgtaagtgcgcagacaccacctcctggtcctcagaaccctgaatgcaacttctgtgccttgccttcccagccgaggctgccaccaaagaaatttaatagtgccaaggaagccttctgagcgatgccttccctctgtgctgtgaaactgtctatgcactacattctgctagctcctcttcaagtaaacgccaagtcacaactgggttttcttccttccttctttttcttcttacccccaactcctttttaagtagtttctcttaaaagggaaatagctttcattcttttgattatgggcattgttgacttcagttacttttcagttatgtttccaatcactctgaatatctggtgctaagccaggagctgattcatacagtggatagcatttgctgggggtgcgctggtttggggaattatggctttttccgcatcatatatcagtgaattaattttggagtattgaaacgtggaaggtgctgagtgaacagtatcttcctagaactaagcattaggcccttgaatatttcacctcctgcaaggaactgacccagaataaaataagtggcaagtggaagatatttctaagaagggcttataggtaggtacctgggatgcaaggtggggagcaagcagagtatcaggaaggtgtttaaaagtagccagcactcttctagagaaaggtgggaagacctccaaacacatcttaccaatgagatctctatttaggttaccaagctctctttaacaatcaacaatacctggtaaggtaaactctgttggtaaactcctattatgaattactttaataacctgttttgattgcctctaggggtattgagatctataggaatgtgagtttcgacttgagaggaacaaggacaaataggaaggagaaatcaatcctatgtattaaggaaatatgaagcatggtacatatacatacagtgttgcaacactgatcgtactcagggcatgaacaagccctgggtgtcttggaaggctctggcctggtgtcgcttcacacttgctattcttgaaacatttcctcagccgtcatctagggagtgcctgcttctgtagagaagaggggaggaggaaaggtgctggtggcagtgtgctgcgtatggcccactcagcaaaacaggagccccatggttcattcttaatgatatctactttctttagttgacagtttagaaaccatgaggatgggccaggctcagtggctcatgcctataatcccaggactttgggaggccaaggctggtggatcacctgaggtcaggagttcgagaccagcctggccaacatggtgaaaccccgtctctacaaaaaatacaaaattagctgggcgtggtggcgcgcacctgtaatcccagctaccataaggcaggagaatcccttagaacctgggaggtggaagctgcagtgagccaagatcgtgccacggcactccagctgggtgacagagccactctcaaaaaaaaaaaaaaaaaaaaaaaagaaaccatgaggatgaggatgttttctaacatgagaatgcagtgtgtgtgtgtgtgtgtgtgtgtgtgtgtgtgtgtgttcatgtgtggttgcattagattcattaccactcctgtccctacctgagacctcttttaaaacttttaccctctctgtccactctcaacccattccctaagaggagcctggcatatctgatgttccctgtcctattttacaggcatgagccaccatgcttggccttggcattagtttagattcttttacagattagggtcccaggaaattgccagcccatctaccccttaatctgattctgatcccatgatcccactataaaaattgggtgtataggtatcataaaaacttaaatccatgtaactaaggattagatgtaaaaagataatatatttacattttcctaactatatttataaatcatatactttccagcaggcattgagttcagtcatcattttcacataccgattgtggatcagcctcttcttttggatcagaatgcagatctttccattttcagaaaaagtgctagagatatatagataatcatacagtcatgtgctgcctaatgatgttttggtcaataacagaccatgtatacaatggtggtcccataagactataatggagctgaaaaattcctattgcctagtgacgtcgtagccctcgtagggttataactgcagtactcatgtgttgtggtgatgctggtgtaaacagacctactgtgctgcagccatataaaaatctagcaatacaattatgtacagtgcataatatttgataataaatacctgttactggcctatgtatatactatactgtactttatatcgttattttagagtatacaccttctccttattaaaacaaaagttaactgtaagcctcaggcaggtccttcaggaggtattccagaagaaggcattgttgttataagaaatgacagctccatgtgttactgctcctgaagaccttccagtgggacaagatgtggaggtggaagacagtgatattgattatcctgacctggtgtaggcccaggctaatgtgtgtgtttgtgtcttcattttaaacaaaaaatttagaaagtaaatactaaagatatttaaaataaaaaaaataggataaggatgtaaaggaagaaaatacttggtacagttacacatacaatgcttattttaagtgttaatttcaagtgattgggagttgataaagacattaaaaaatagtaaactaagtattattacaaaagagtcaaaagttaaaacaattaagtttataaaataaaaatgttacagtaagctaaggttaattgattattcatgaaagaaaaatttttaatatagatttagtataacctaagtgtacagcatttataaagtctacagtagtgttcagtaatgtcctaggccttcatgttcactcaccactcacccactgactcacccagagtaacttcccttcctgcaagctctatccatggtgagtgccctttacaggtgtacaatttttaagtcttttataccatatttttattgtctattttctatgtttaggtatgtttagacacacatacttaccactgtgttatagttgcctgcaatattcagtagagtaacatgctgtacaggtttgcagcctagaagcaataggttataccatttagctcaggtgtgtagcaggctctaccatctaggtttgtataagtgcactctatcgtgcacacagcaatgaaattgcctaaggatgcattctcagaatgtatctttgtcattaagtgatgcatgactatgtaaataccttgcagattacatacgtaaaggtattgtgtaatccacatttatagctgaatgccagtagcattggtagcttgacaagaataatgttctacttttttgttttcctctttgctggtagaaccatgggggcaattctttagacaattgttaatctcccctaatgatgtttacataacttgatttgggtctcgttccgtattttgttatttcttttcacttctcctcctcctcgtccctcttctggctagaatagagtgatttttaaataattcaatttaagtaatagtctgtgtgggcagttgctgccacttcccttctcctccctcctaaatttatcatcttattgtaaagaaaagcatttataaatagaattatcaacacaacattttcctccctctcaccctccctggaagtaagaagcagcaggtctttgtagcagaccttcccccctttaactttgcttagaaaacctcctgtgagagggaaagctccaagtcctacttctgctgacttgtggtcaaaaagctaaattatgatgaaaattcccactttgtgtggaataagataggagattatgagttatttttgtttatggtccagtgcagcttgtctaattatactgggtttattgtcgaaataagatcatacttctagttctagtactactgaagatgtgagattaggagccttgaagaactaggaaaatcactcaataaaaatgttttaaaattcttaggtaggaaaatgaagtctgcatggcaatatcctcccagaacctttaagaaagacccagaaactcttaggggatgggggttatgggtatttagagggaatctaatattttaaaagctacaattagcatctcttttgaaagctgcaattgctcactcactttttgcagcagttcagcccccagaaaaatgtaaaaatgatttccttattctgtcattaaatcgtttaacacagaaaacaagaacaaatgttaaggattccttatggttgtgacagaatgctgaggaacagtcagattttatttttattaatttgtcctcttttgctagtcttgcagtttctactgccctgtgcaatgcacacacacaaggttacatttttgttgacccacttactgtaaaaaatgagtttcactccctgacactcagaggagttttcaaatgcttaagaaatgagggacatgtgattatggtgtaggtggggtggaagtattttattaaattgaaattacttgtggtatctgtcttgaatatttgctatgctttatttttatgacacttaatcactggattactagtcatctacattgaccttacctgacccccaactctgagttagttcatgttgcttctcccataagcctctctacatcccaccttggtctaaatcagaatactctttttcactcagaatttgcataatccactagactatatgctttgtgagggcagggatggtgcctctggtttttatagttatgtgccctgtgcatggcatatattaggcactcattaagtatttgttgattggataaaatgatggatggttaaatgaatgaatgctctgtagctttaataataaaactatacaaataagtgaaacttattatagcctgtaataagctttgttatgcactcttctatcttaatcttcaaacatttgcagggatattctcatagtgaaggttgtaggtaatgtcagtggtgccattgtctcttggaatttttcctttcttctccattcagttgcttcctcatccctgttgtgtttgagtctttgatgatcttcctaacttgtctctttccacctttaattcttactttaaagtagggttggcaaactttttctgtaaagggccagatagtaaagatttttagctttgtgtcccaactattcaactcaatacataaacgaaaagtgtggctaatattaaataaaactttattaacaaaaataggtggtgggttgcatttggatagtgagctgcagtttgccaacccctgctttaaagcattgccagataagagatatagatttcaacatcttatttccctgttcagaaatgaccagtggtcccttagtgctagaacataaatactgactttctttgttgagctttcaggccctctgtactgcatttctgtagtattgtatctttgcaccagcatttaccttgcttattctcttgttttcttctcccacagtgttcatgcctactgctagtctttaggaagccctttcttggaagccccctgctctccttaccaatttctcatctttaaataaagacatatattacctcccatgtcttctgtgaagctctccccagtaagtggaatccaccctataattaatactttattttatcatgtatgctattatatacatgaacatctatatttgtttacatattgtctgtgtatgtaagaattgtctccaaatttaaacttcttttgcagacatttcaaaaagttcttttatagttcatggtttctaacacagtaccggtcacaggagggaattaaaaattaaaatactcatttggttgaaagttgaaagcaaaatggaaatgaaatattgtgtgcttcctactttccctcagcattcttatatgatagttgaagttggcttaaatgtagttctcttttctagtgttagtagcatttttatactcagttggttaatgctgctctttggttatgaagactctgtggatgttttccacctcaaatttgacaaacgtaagaacaatcttggtagcctatgaataggttaagttcttctgtgttctaacatcaggcagaatacgtatgtgttttaaggaattattggtccttaaagtaggacctggaatgagatcaaaatattagaatctagctttataaaataaccagtttgatgaaaatctgagtgattggcagtgcactaaagcatggttcatttgtactttgggataatgttagtgctgacagtgataagctacttactgattgtttgaatatccattcccagtaaagtgctgatactttccagtggtatgtagtagtgtttcccgatatcaacttgttgtcttttccctctgcctgttctccattttaaaaattggtcatcttgtcctgattttaaataggacatttttattcgtctgcttttgtcgctattaagaaatacctgaggctgggtaattcataaagaaaaatggtttatttggctcacaattctgtgggctgtacgagcatggcaccgacaacctgcttggctttgcgtgagtcctcaggaagcttacaatcatggtggaaggcaaaaggggatcttgtgtatcacatggcaagagggaacaagagaaagggaggatgtgcgaggctcttttaaaccaccagatctcatgtgaactcatagagtgggaactcactgattactgggaggacagcacaaagccattcatgaaggatccaccgccatgacccaagtacctcccactagccccacctccaacactggagtcacatttcaacaggacatttggaggggataaaacatccaaactatatcaatattcatttattaattcatattaatattgttaaatattaactaggtgttaatatttattacagttaaaggtactagctttctatcctcttgttgtatatttatgttgctgtggtttttcatccttcctctttgttgtggcattgctttagatttgatgtaagttttcagctaagggatactaactacatatcaagaacatgagctcaatctcagtattgaaccacatctttggccttcattcaacattgcgattttttttcccttcccaaggggacctgagaatgctacttgacaaagcatcaaattgttatgaggtcagcatggttcggatgatgcctttaaatatgcatataaactgtttatatgtttgcagtatttgtagatatatgtaactataatttaagtttccagtgttaaatagtagtttatgttaattttctgtataaagcctgtcagctgtttttgactgtacatttgaaaagacttgaaaacataaaacttgctttaagtgataaggttgatcagaaatatataataggtaaggattaatttatattttcaatgtattagagttatgaatcaccctggttgttcagcttaattttatactttcttatgtagtgtcaataatactactaggtcaatagaaaagagtcttattttaatcttgcgtcttatttttttggctaggagtaaaagaaagcaagtgctttttatatacctataaaagctggctaggtgcaatggctcacactataatcctagcactttaggaggctaaggcgagaggatcacttgaggtcaggagtttgagaccagcctaggcaatacagagagaacccgtatcttaaaaactgaaattaaatgaaatggaaacttatccaattaataaagctatagctaatatttatgtaagtgtctagcttgagcctagtatttttttggtagagcaaggtgagacaaatacatacaagccattgtcctccactagattaaaaacttcatgcaggcatcttctggtagaattgatttgctctcatttttctggtcctttctatttttgcactgctgccagaatccacttaaaataccagtttcctaatgtaagcctttgtttaacagcttctgtggttgaagaataagaccaaatattataagatttttcctctttttcctgaaattctgtagtttcaccataatatagctatatacagattcattattatttatcttgcctggcatcagtgtgtactttcaatcttagggctgcttttttagttatggaaaattctcagccatcattcttctttttttttttgtagagagagtgtcttgctatgttgcccaggttggtctcgaattcctggcctcaagtgatcctcctgctttggcctcccaaattgctgggattacaggcttgagccaccacacccggctccactatctttttggatattgctttactgcctttccccttatttcccttattttctccttttgcaatagccccacaatttttttttttaatagaaggagtctcactctgttacccaggctagagtgcaatctcagctcactgcaacctccacctcccaggttctccacctcccaggttcaagtgaatctcctgcctcagctttctgagtagctgggactacaggtgtgcaccatcacgcctggctaatttttgtatttttagtagagatggggttttgccatgttggccaggatggtctcaaactccttacctcaggtgatctgcctgccttggcctcccaaagtgctgggattacaggcataagccactgcatccagccaatagcccccaaacttatattggagactttcaatctgtcctcaatatatcttaccttctgttttatatttttcagttcctaagctctagctgtattctgattgaattcctcctattattttcaattcgtgaattttctttaatgtgtccattctggagtatatcccccaatccactgacctttgatttcaggggctatatctttcttttccagcatttctaatttgatccttatgatagccatctgttataatttgggcccgcctgtttttgttttatggcttcttattctttttatatgtgtgtgtatatatatagatatatatatatatttttttcacttgaaggatctcaggtgataagccattttgatattgctttgctatttgcatttcatcctgtgagagtttgccttgtggttgcatacttcgtcagttctcataatgttcatttgccttgtgtgttagggaatttggttggtaggttcagatgggatgggagtgttggtgtgtttctctcctctttctctctctgtttttccctcctcgtctgctggccttcttgttggctctgcccgatcatctaggcctttcagtctagaaacagaccttaatgacccaggcttccatctcttggtgagctcctcccaggctttcttctcaggcagggatgtggctccatctcagccctggcccgagggcaatggtcccaatttctctcagcctccttccccatgtgggagagcctgactccacccctgatttcaggccaggggctttcgacctatgtacccacatgaatggaacacccagccacttctgcaggcttccagctgtgtagccagagtcccaccactgtcttgattgtttctgggtcacaaagatgttgatcttgcttttaatttctgctgtgccctttctttcttcttcatctttaaaaaatatttaatgcatgcatccagagggtagtttggagtgtaccatctcgacatgaagtaggtccagtctctgcagcttgctgttcagtgcctttttcagctttccccaaccagctttccaaactcatatccctccactcctgagcatgaaccttctgcttctgccaggcagtttcttatgtccttgaacgtgcatggctcctcctacctctgtgcttttcttacatgctatgtccccaacttggtctcccttcctccctccctttgcttctcacctcctttccatcaggagttgggctaagtctaacctcctcctctgtgaagccttccttaatctcaccagaccatagcaatcatgatgttttttgaagtcattctgtttgtattggttattggccttcctcatccctcttttgtgttgagagtcacctatcttgtggatgtgggccttgaatccccactgaattccttgattgaggttagaaaatgtcttttatttttgttatctccaaagcatctggcattgagctatgcttacctgtttgattgtgggtatactcagtccatacttgcatcttttctaatactgtgtaggtcatttgtttcttccaaaaatttgaattttactgtgtgtgcacatgtgtgtcagatctttaacttagaaaggcatatttttattgcaccttcctcttacacacacatacacatacatgtggatgtgcatgcatgtgcaaacaagcacagacaccacgtgcacattgcttgtaaaatcattggatttgcccgtaacagaaacctttggtaaatgacgcaggctctccttgatagtgaatgtctaaacaactcaaaggttgatatatgtgggagagaactgtttttatcagtttagaagtagatatttttctctcttgggcagactgttgtgagtccttcagccttctgttatgaaaaagcagtagactgtaagagaaaatcatgaagtctcaatttgaaagtgagcaaaataaggttgacccattctatctcattttcccttatttactctttaagtacacattacttactctctggtagctcctgaatctttatggttaagaagggaaaggctgtgttcccatttcctattaggaacctcgtttccatgctctcctgtcttttgaaaacatcatccaaggatactcatatcgttttgtcctcatcactgttatcacctcccttcatccctggaagacttttgcttctactttttagctgcctgggcactgccaacattctggacaactgtaacatttttctaatcattatcatcatccactgtttcttgaataccttctatgtgcctggcatggtattaggtactttatatccattatcttatttatttaacctgctatttacagatggggaaatcaagactcagaatggcaataacttgcccaaggtgtcacagtgatcttattttaaactttcttaacctcagttatctttatttttgttcacttgaaaattcattgaataaaccttcttattgcttagcacattgcttctgacatcttgaatcctgccagcctcctttaaacatttccccctcctcctaactctgctccatgacctctttctgaccctgcctgtttccccagccatctcagttcacctctttccttctacagcctgcatagtcatttttgcttcctttttccaacattctcactgctacttggacattctgtaaccacttgattaccagcctccaaaattagatcaattcaaccatctgttgtatctgttcctcatctctctcctgtgagcactgttggagaaaatcctataactttgccaattggctccatctcaaatgtgtttctaatttacccggcccttcagtgctcctaattagttgttttatccctttttggctccttttctcttccccacctggctgttccaaaactttttaacatttttcaccaacacaaccccttcctgatctccagagccagctgaccctgctttgagatctgctaagaacatagaatttatcagaagtaatttcttctaacttccctcttctctgtctcaaagtttatctgcatctggactcatccatttcttccttcccttttaattccaaagaaactctactgttttccaatgataactctacctacctgtactgttctttccagaatctttcatgaagttgccctaaccacttccttctccttttgtatcttcagcctcttaccctccgtttgcaggtctcctcaactgcaaatgtgcacatccaagttggtaggctggtgggggctggggaggagtcttcccttggccctgtcttcctctcacagtttctcctttatggccacacttggggaaagagaagcctgcacttccccctcccttgtctctttgatactcctccgctctacagctgggaggtggcccctcattctggtgaaagtctctcccgcagattactgccgacttcttcaaggccagatctgatgggctcctgttagtccttctactcctaagcctgccccttaatgattgtccttacattggctccttctctttgggtaacctcctgagcattggacctacactcccagcttcctctgggtgttacctgggatagagagaatacaggttccttccattgccagctcctctttggtttcctagccgaataatctcatctttattcatccagtcatccaagctagacatttggagtcagctttgacactacttctgcctgcctttcccttgtcacaccagtcactaagtcctatcaagtctccctctaaaatgcctctgtccttccattcttaccactgctgccttaattggggtcttcatgaactatcgcatagccctttctgtcttcctgtctcttacctttaatctttcctctatactgttgccagtgttaaatttctgagacacagagctaatcaaatccttctcatgtttggctttgttcagtggctgcactctgcctactgggtcaagtctggctcccctggcttggcattcagggttcttccctgtcgggctgtgtgcctccctgccagcctcctctccagcagctctacctggcacgacctgccttaagcctgaaccctagcacttgcagtccactctgctttcccttgtttctctgcttgattttgtatttcttgacctggctcgatagttatctttttgataagcatttgtgacccatctaaacagaatggctcttcctttctcgactctcctaggagcgctgacactctcatattatagtcagttatacatgattctctctctcctctgctttcctttaagcttctcagaaacatctcttgtttcctgaggttccacagtacagtataagtgcctaataaatacttattgaactaaaagtcagataatgtatctgggttcgtgaatgttaaagtgtttaggagcctgggtctcattgttagcatatgaagcactaacagaaaacaaacaagtttccagctttagctttaatatacggtaatctgggagttgtgtattttttttctagaaatgtggctttactaaaataagagaaaataaattttaactgagtttgcatcaatataattttggtgttcagatgaactgaaaacactcatgtaatggttggctgagtcaagctgggtgtcaacaatctgtcatctaacaattgagctctttgtgattgttgaaaagcatatattaaatttctccagaaaaaagaatctattaaaaatcatgtaggaaggtgaaagactattttatatagcattataatgagcccaaattggctttttaagtcttgaagtccctgaaatgcacagagaacactatggaaaaatgcacacacacctttcgaacctgattttaacacaaaccttcatccttttatcttaatatgatgccaataaaaccatacccagctacatttcatctagtgttattggaggaaatatgtatcatattaacagaggcaaattctttcagtattgtacatgttgggtacaatatacactacttgggtgacaggtgcactaaagtcacagacttcaccactatacaattcatccatgtagccaaaaaccacttgtacctcaaaacctattgaaataaaaaataaaaaatactttcagtattgtgaaaccacagttatggaaataagtatcaatgcacacattttatgtgttaatttgtgagcaatacaaaaactggaaactctattacaaaggcttaaagagacataggagtacagaggcagttatgggtgtatttatttttccccagtgttgtatttgttcattaaaacttaaaacactatagttatgtatataaaataccatgttgccaagcatgtattttttcctttaatttcaatcacattaaaacaaaccatttttattttaggttctttttgcctctgtggttagaacttaaaccagggataactagtacactattgtttattccttaaaggactggggaaaatgtaggaaagaaaatgtcagtgtggcaaaaaagtccatgaacattttgaatcaggattttgaccttagtaggatgctaacattccaggccattggatcctttggttcaagttatttgaacattaagacatcgttacattcatttgctgtcaaggaccttaatctttcattattctttataatttgctgtttttgatagctaacatgttttatttattaaccatctgtacaatatttatatctgtaattattagacatgttcctgccatgattaggtaactgggctgtttaaaaaagaaacacctccagaatagctaaaattttaaagttactacctacatctgccaaaacagattagtagcagatttccagaacagaacaaattgtcttgatctccttacctaacactttgttttatgtcaaatcttactgctttcagggaacaagacttcttgatggaagcttatattttgacataaaaattttgggggctgcaaatgtaaggcaattttatccttatttttcaggttgaatattgctacattattaattttatggtattcatacaataagaataccacatattcataataaacttgatctggtcctaactcactataactctgttgagcttactaattaaatgagcttgaatattatatttgagaaattaaaatctcttgttatataaacaagggctaacttctaaaataatatttgtacttcaggtataaaaattattttcactttataaccatcttcactgtcattgttataatttattttgtatttcagattcattaattcattattgtaacaactaaaaacattggccaatcagaattaaaactttaatcaactcataatacttaagcatggatgttcttataatgaaaatttcttttaaatttagaatattcctgaaaattctttgaattcaggcctgatgaaaatcattcaaaaatgtatttatcttttaatgcaacaaatattttttaataattttttttattcactcagaatcatatcttgcctaaggtcattatttgtctatgttagggtgatagagaatgttggattgaatatgtagtgatcacaaggcaaatgctcgctgtcttgagacattaaactatggtagctaagggtttgagctttagagtcagactgctagggttcaaattccagctccaccaattcttaattacatgaattggggctaattactgctttgtgcctcagtttcctcatctgtaaagtgggttgtctgaaacatttaatgcgtgaatatgtataagatgtttagaactgtccttagcatataggaagtactcaaatatctagttcagaataattgatgtgtcaagtaatatatctaatttgttaagaagttcagctagttgtatttaatctatttttgaatacgaaaatcaatagcaataatattgttcatggaattcaaaatgcaaatgcaattttactataaaatgtaattttactataaaaattaaaaatgccagtaactggctatagtcttttctgggatattagtaattttacaatacatggacatttggaaaacattgtatatagttggtagtcctacctgtgactacaaaaaaagcatgaagttatgctttgttacgatgtgtattaggtcccaccaggcactcatctggcttatctatctaacctgtctaagatttgaaatggagagtacttgtgtttttccttgaggtttcctcaactgtggctgagtacaaatgacccagagagaccgtcagcacaaccccgtaggataaccatgtgatacctgaagtttaaatattcctgtcatccaacactgttgctccctgaatagaaaggtctcacagtgttagttatgcttttgttaagtgaatagatcttggagacttgaacaattctcttctccccttagtgcatttctttctttctttttttttttttttgagacggagttttgctgtgtcacccaggctggagtgcaatggagtgatctgagctcgctgcagtttccgcctcccgggttcaagtgattctcctgcctcaacctcccgagtagctgggattacaggaatgtgccaccatgccctgctaatcttttgtagttttagtggtgatggagtttcgccatgttggccaggctggccttgaactcctaacctcagatgatccacccgcctcggcctcccaaagtgctgggattacaggtgtgagccactgtggcccccttagtgcatttgtattaagatttttattttagattgaaaatgaaaggaagttaatttgttacaaaatactgatgtcagaataatttgctgaaccctttttactgatctttcatttcacttttctttataccatataaagaaaccatggaacatgttttgttttgaggactttggtattgtatttttatcctctagtgcttaatagatacaacttatgttcagtaattatttgttgaatgaattgaactggtgggacagaaggtcaattcgttggccaaatggtgtcatcatttgtttgcagaggcctgcagggccagttaggcaacataagagagcaaactagggggttggaaaaggaaatagtggggcttgtggtgagctgtatctgagcctagattaaacaccagccagagtttttgagctctgtggaagtaaaggctttggatagaagactaatgaatatattctccatatgaataatagaaatctttaaaatgttctagactatttctgttttccagttcactgggtactgtgattcactaaataaatacgtaaataaatgaatatatatatgtgtgtgtttatatatataaatatatgcacacacacatatttgcccctctatattgatgtacatatgaaatactttaccctataaaaaagttggtttaacaaaggtcgcttgtctaatgtttatttgctacatctctgtttattgataattgatggagcttgcaaaaacaactttgttctaagttatatgcagtttgaagaatttctgatttctgttagtgataacatgcacaactttactaatcggaacaaaagtaaaagttaaatattctcaagaaagcactagctgagctacacacacacacatacacgcacaacatacctttgtggcattcttatagctgggggacttaactggctctgccctctgactgcttgccagacttagaagaaaccgagaaaaagcaggtagaaaaatgtttatgctctaattgcgagtgtggtagctggcgtccctcaagtggaatgtatatgggcttcaaggcttttgaccaacttcactggactttcttagggtcttacctcttttattcgcactgtgggttcaggtatatttatagtatagtgctctgattcttgatcatctcacacctattttgaagtattagcatgaaccacatacaagaaagtcaatagccaaaccttttccattcttcctacagctcttgaaactggcagccttgagaaccacccatttcccttactacctctcacctaagcctttcctggtgcacgatgttaactttacactatgtatattactatttaatgtcgacaccgctgtcttttcatttcacatctgttatgacattgtggctttcgccctttgcggtcagggaccataactctttgacatactgtgttaacagggacttactcaggaacagccatttggctgttcatggggtgtaaaattcactgcagttttgaagctgagaaaagatagcttgaatccttttgtaagttctttggaaaatggacagattcttttttactgataacctatatcatcaccaaaatggacctgtcttataattgactagacctgttaatgaaatgttacagactaatttgagaaataattattgggtgggagaaaagggcatttactagaaaatcaagtaaactttgttatcctcaggtatttaattggaagaattgagcaaaaaatttgttaatgtttagattgatttatgttcctttttctaatcactgtttcctgctaaaaaaaataactgtttggcaaactttctgtaactctctatcttttcctggtttatgtctgttgtcccaggcattctgattacatatcccaatcacaatccttttatatgttagtatctaatgtgatgtggaagaatttgtatggtttacttgaaaattgcctattgtttattaaattccgacagcaagactcttctgcataaatgtttttgggtcttaagatcagatttcaagctggtagtacttcatttccccttaagggaaaggatgtgtaagatatttataaattcaagcatgcttaaggaatttatttaaatggctgctaattctactgcattagaagcatgccattgatatgtactgaattaaatttaaggatatatcatctcaaagtatattctagtaatctttaattagttaaaagtatcttttaatattgttaagtaaaactcattaattgtagaaatgcttagagatgagtttaggctacctaccgatttttaaattaaaacttaattttttaatcactataaataaattagtaaaccttttaaaatataaagttttcttacaatcactttgcataattgaatatctcattcttacctagctaatgctttgtgtctcctgtctttttgtttctgttttggcttagtttatttcattgatctctaagctgtcttgtgtggaagggagaagctgcatgacttgctagaagttttacatgtgatggaatttaacctcagtttatgtctctccctgcacagtcccttcagtctgaatatgttcattactaaggccttgccactccagtgaaagctgttcttctcttagacacaatttcttcatctggacgagcagtggagagggaaagcaacttcttgctggaagaatatctctgccttcttaccttaaattaaaaagagcactaagataacaccttcaagagacttgaaaacagaaaactggttaatgactactataaatgcactgaaactatgtttatggagatttccatacttttaaagacagttttaatgttgaatttggtactttgaagggttatttttaatgtattttggtaatacatttattattatatttacatgtacagtgttacattatatatgtattgtgaactttaaaagactattttgataaatttataaatatataaaattatgtaaaaactacactatattttgatttagattttcctgctgtttgctaccaaaaatttgtattttaaatctgtttagttttagtatggttttgtctctaatgaataaataattccttcttattaagaagaagtaagggagaaagtttttagaaagtgatttttatgctcgcactataaatatggcaggtcagttcattcttttgggaagtcagtttagttacactgagtttatccaagtttatctctaccaagagtataatggcatgggatggcttatttaggacaattccctttcccattgtttttgttgctgagccaatttgagttagttttgcatcctggggggctttaaaatacagcatgcagtgaaagatcagaattcactgaatatttcttctgagagcatggtttcatggtttttctctatgaaatgactcaatattccaaatgtttttttttccttcctcctttcaaaagagttcttaacccaattaggatatcctgctttgggtatgaggttgttgttgcctgtaatcacacatggtttgacatcagttttaaatcaatggagagaaaaaactgaaaaagatgctgctaagtagttctctgtattaaaggagatatttttaaaacagggtacaaccccctgctgcacacgctagcatatctggaacctactatgaaaatgaaaggacccttataggtactcacagccctttcatgtaagtatgatctgatatttaggtcttcagaagcctgtaggtttcatttctatgaggaatcgaggagcgttacatcctgatatccttccaggctgcttaagaatggactgcttcgacactgaaagtgctagttaaatggattcatatgaagtgctttactcccaaccattgagttatttataatgtatttattaggggagggtaccttgagtctattatatatgcttcatcaaaacatcttgttcatgttttatgtttttaaaaaaggcatttgaatgaatgtttgactcaggtttgttaaattaaccttcagtaactgcagtaccaaaaattacactcaactgatgaaaaaaacgaattgtatgatttaggaatcaaaaactaaaataagtggaattatgtatcttttctaaagttaaaaaagtaaaatattttattatgagttattataaaaattggttaattgtataggaagatgacagtatttttttcaagttatcataaaaagtaattcagatgacatttgagaagtaggggaaagggaatcatgttgacagttttagttctgtgaacactaatttgtgtgaagctattaaaatgattgtaaagttgactactgtaaatttcccataattatgtgtgtatatgtgtcatatgtatgtacatgtatatgtctaaaaattactttacacatgtgcctacatagacacaccaagaagtggatgtatataatatagaaagtatatagcaaagtaattttactctgataataaaaattgtttgacatgtattttgttatgaatagtttatcttccaaaagatattttgctctattttaaagtgtagaagaatacactgctaataaataataaaagttttattcaatttacttattttttggtgtttataatttgaatttttgagttatcaatgtactgaagtctctttataattttatttttggttcagtgtggtcagtgccttgagtgtttcaagatctctattctggattttagtttagcttttattgactttctaggttgtggccattgcctgaaatacatgacagtgagctcacagaaaccttatactttgaatttcacaaaaatcatataatgttaggttcttgcttgctttccctttattttttttactgtcaataaaatactgatcctgatcagtgttttgggtcctgcttagtcatttatgactactgatgactattgtgtgattgatcaccagttccttttgaaaaagaatgccatttttcctaaatgagaaattatagaaatcagttagaagaaacctcacacctgttggatctatgccctgaaaagtcagtttgggaggaagaagctacactatttattggagatattttatatagtaaactggatctctttgggttatgatgtttctgaggtttttttttccttaaattttttttttttttttttttagaatgcaaaggaaagtttgtgggtgagaaggtagttttacatttggaattgggatctgcaaatagctgtcctaacaacactgcatgaaacaattggggtaccaaggttttcataggaccacatcttaaagaaggagatttcttatgaattaatgaacctgtttcacagggcagaaggaaatctttttttgtacagattgggtttttatgaaaaagaaagtaaaaaaaacaaatcaattagctggtttcagcagatttctcacctattgagtttacctgtttcttttttatccttagatgtaaaatgatttataaatctcaaaacacacctgggaaaactatctatgtgattcaaatatagcaggaacatgaatttaccaactatacacaaatgtattttgaaaattgtttttacttctatgctttcttcagtgacatgttaaaccattaatatgttgagtctaattaaaccagttgttagtatataagctgaacaggactccgtgggcttcatgtcatataagaagtctgtactcgttccaaaagtcataaggcagagtcccctttgcaacacttagcaaagcaagaatttggtcactgtatgtctcctcagaagattaattagggacaattccaattacagaagtatataatttacagcagaaaactcctttatttacacataggttgcatagggttgacaactatggcatataatggaaagtagaaaataattgtattaagttattttgagctgaattgaaatgttaatatattcccacccagttccctctctatggattgaattatgataatcatatcaagaaggagaaaaatagcttttctcaagaattttaaacttttctttgctaagtacaagtagaaacttacattaaaagactagttttaatgcgaaatgtatttggaacaggttttaagtggacaaacataaattagctgaacttctcactctgcatgcctcgttttaacctgcacgccaccaaaatcaaagtaaatcacatcaccacttgcggtgtctgctttggtttgaatcaagttgaccatgcatttttgagaagttgtactccaagtgaagaatggggcatggtaataactgtagaaatgactctacctgcaaatatttacattaaaacttaagatttgggggtagtaatctatcaaatatgtagtcatccctccatatccatgggggattagttccaggacctctgcggataccaaaatcagaggatgttcatgtcccttatacataacggtgtggtgtttgcataaaacctatgcacatcctcctgtatactttaaatcatctctagattacttataatatctaatacaatgtaataccatgtaaatcgttattatattgtttaaggaataatgacaaaaaacgtctgtacatgttcagtac

SEQ ID NO: 12277 - DNA, 113966 bp, Human
  misc_feature (1)...(113966): n = A,T,C or G
gtttattaactaaaatttggctccttttaaatcatgaaattagagtgtttgaagaagcattaaagctcatctagttcaatcctccatctgattatatagtgtcctactaaataccaggttatacataattagtatagtgatagagtactcacagccatatatgtctagagcagctcattccatgaattccttccaaaattcactgaaaagaaaactgtttgttattgcttcaccaagggaataaagaaggctgtggtccaaaaataagatcaccatcatctccactgcataatttataggatttagagtcaggctgtgaggaagacagttcaggaaaagacataactgcaggagtacaactatttcttctgatttttgatacccctctcttccatttccaccaaaacgagaatttatttcaatgacagcaaatgttcatatagggagaatagttgtacagtatagagaagccctaaagtgtgtcatttatctagtgtctaattataagtggcttgggcgaaaccccatagctactaaaaatacaaaattagccaggcatggtggcgtgcacctgtaatcccagctacttgggaggctgaggcaggagaattgcttgaacccaggaggcagaggttgcagtgagccaagatggcgccactgcactccagcctgggcgatagagcgagactccgtctcaaaaaattaaaaatgaaaacatacacagggtcgggcgcggtggctcacgcctgtaatcccagcactttgggaagccgaggtgggcggatcaccagaggtcagaagtttgagacaaacctggccaacatagtgaaaccctgtctctactaaaaatacaaaaaattaactgggcattgcggcgggtgcctgtaatcccagctactcgggaggccaaggcaagagaatctcttgaacctgggaggtggacgttgcagtgagtcaagatggtgccactgcactccagcctgggcgacagagcgagactcagtctcaacacacacacacacagacacacatacacacaatacacatgtgattggggttgtggagaagcattgaccatctgtaagcccctagagggtgggggctataggttatttgcgttttttacaagcaggaccatgtcaggcatataatggatgcccatacatgtttgaatcaatatgtagcctaatacagtgatattggcaagacgggtttagaaacattgttttggttcaagatagagttactgcttcttctacttcttaggtagggctagaaatcgaatggagaattactttctgttcatgtatgggcaagcgattcattgccagccctgtcaaagacacatagagttttttttctcattgcacacaggatttgggtgattaggaaagtggagcgagtctactaataaaccgttgtaatagcacgcaaagcaaaaataaattcagcgtattcgtcccatgccaatttaggagcatatttctcaaattatgtttacgtaggttttccctagagtgagtggttcccaatcttgttttgtcggtatttgccatcagttgtcattaattcattgttattaatgggaagtgctctttgatccgtcggaaccttgctcagtataggccccaaatgttcctttaagcctcggggaaaacgactttggctggtcggtgcccaaagccacacccactaagaggccttaggaaacctggggctttcctggcggcgacctagctgtggcaaccacgcggcgcgtcgggatcccatgggtcgcgcttgttttccccgtgggaggcgcgtccccctcctccgcccggccggccggccgctggaccagctgcctttctggccgggacgccgggcccctttccgcacgcggcgcgccccgagttcatttgcatagggacgcgcgcggcgccggcgagagggagggcgggcgcggccgggaagacggcgcgcgcgcgccctgacagctcggccctgctcgctcactcgctcgtccccggcttccgagcacagcatggcggtcaaggtgactccaactctctgctgctgcttttattgcataagagacattccgagcgccctgcctgcagccccccactgcttcccattttattcattgtctaggtcttagatagcttgtcctggggctccggcttgctgcggggagagctgtgcggggcttggaccggaggaggggatgcccggctgggggaggggaaggaggagggattgtgagttgaaggggcttgtacggtaacacgggtcagtgaaggaagagtaatgtcctgtcctaggtgcatgggattgtgagtccggagttggagggcatcagaaagggtgtgggaggaagtggcaagtaaagctggggatacctagggtatcagtgaattgcggtgggggagggagtaagtattgagtaatttggggcctcaataaggccgagggcagtggttggcttttgcgttgcagattgcagggtatcgaaagtatttgtatttgtggcagctctcatattttaggttggatggggagagggacgcggagataattacatgttgggtttgctttttatggagaaaggctgctaggccaagtgattaatttgggtgatttaactttcctgttgatctactcttgttagcttcttgatttgaaggtgggtggttactactgtgttgctagtagatgtggaataaagtaaaagatcctcattgccttccctttccagtccagaggaagcactgtccgatagctttgctgtatcttaggctattcgcacctgtttttctgccctctagtcacagttatccagtttgacagttcttatcagcaattagggcttttagtttgttttaaactaaatgataaaagataggagcattgattgttagccatgtgacctctaatctgaagagattgtgtggtctctagtgaagcattaactggcttttttttcttttttgcttacaggtgcagacaactaagcgaggggatcctcatgagttaagaaacatatttctacaggtaaattggcttgcatagtgtgcctttcattgcaaaaacaaaaaacgtacatgtccttagtcctattcatgccttaactttgaggaatgttcagttttcatgtattctttcaaacatgaccggacaatatagcttatacttctcttaataaggtttgatttaaggccttcttttaattaagggtcgataaaaggttttcctcaagttactgcttttttttttacatgacttaagatatatattttgaaaaaaaatttccagcttaagcacagagaccaagataaaatttcaaaatgtattggcattcttgtatagttaataggtatgatgactaaaattctcttccttgaaagttgcatgtttacaaagttttcctacttatgagctatcctccatgtaatttgttacagagataagaatattatagctattcttaatttgtgtgtcttacttacattgtatccttaagcctttggggattttaccccaaaatgttacctcttaagattcttgcaatggtctaccttaacttctaagcttttagaatcagtgacttggctgtagacttaaaaagaaaagaaaaaagaaaaaaaaaaggttggcttagttttttgttttgctttcttttcttaaatttcaaaagtttcctatgcaggaaattgtacttaagaagtagatgtaggccgggcgcggtggctcacgcctgtaattccagtattttgggaggccgaggcgggtggaccatgaggtcaggagatcgagaccatcctggctaacacggtgaaaccccgtctctactaaaaatacaaaaaattagccgggcgtggtggtgggcgcctgtagtcccagctactcgggaggctgaggcaggagaatggcgttaacccgggaagcggagcttgcagtgagtcgagatcgtgccactgcactccagcctggggacagagagacactgtctcaaaaaaaaaaaaaaagtagatgtaaagggaggcaagctaaggtgtttcaccaaatattgcatttctctctgaaatcttttgagaactttctattctggacctgggttcttatgaagacactttgaccttgggcaggtccctgctgtgtattattttcctctgtgaaatgagaggtgatctccaaggttccttcccattccaaaagtctatgagtctattttaggaacagattctaacatatgctgatgagcctggaatagatgacatttttatttgagatatgtggtttgcttaagctattgttgggtaagacgctgcgtagttgagcatacatatgtgtagtttatgaaaaataatttgtgaaaatgggaatcttaaaggtcataatatctgataagggaagtatttttttccagaacagaagtaattataataacagaaatggtccatttatgacttgaaacctttattccttgcaggcattcttgaaaatagccaaaaatatatcggtattcaccataccatgtgattatagtcaattgttttgtgaagagttcatgtgatatagttaattttatgttctagactaagtagatgcggaagaaatgagttgaaatgctgcatgatgtagtgaaaagaatactgcctaggtatctgagtactgcctaggaatacggagttaattcccagccctgcatttatctggttcttgtacccttaggctaatcatctggccttcctgagtttcagcttctcatgtgggactcagtgggacataaaggaatgggaattgaggtctttctagctttaaaaattctatgggaaaaaaatatactgtgattctgtatggatttgttttttgtttttgagtgggggtagaggtgggttggaggtatgaggagaatggcgaggactgtccctagctctttgacaacttttttttttttttgagatggagtctcgctctgtcgcccaggctggaatgcactggcgtgatcttggctcactgcaacttctgcctccggggttcaagcaattctcttgcctccgagtagctgggattacaggcatgtgccaccacacccggctaattttttgtatttttagtagagacagggtttcaccatgttagccaggatggtcttgatctcctgacctcgtgatctgtgtgcctcagcctcccaaagtgctgggattacaggcgtgagccaccatgcctggccgattctttgacaacttttaaatcttagcttttcatttactgttttgcatatcgtcattatctttttacacattattttgatgatgcctttatttttatgttgaaaatttgtggaattcataactgcttatttagcactaagtatgaaacattgacacaagcattattgatagataagagagtgatagaatgtaaatactcaccttcagaaaggcctaacgcagcaagaaagataacaatataggctgagtgcagtagctcacacctgtaatctcagcactttgggaggctgaggctagaggatcacttgagcccaggagttcaagaccaacctgagcaatatagtgagacctcgtctctgcaaaaaattttaaaaattagccacacctggtggcatccatctgtggtcccagctactcaggtggctgaggtaggaggattgcttgatcctaggaggcagaggttgcagtaagccaagatcataccactgcactccagcctggcaacagagcaagaccttgttacacacacacacacacacacacagacacacacgatacagtattgctagttggatcaatttgaggatagttaccaagtaaaagatttttattcctggcttgaatacttcaaactatagttatttgaagctttgcagtactgtttagaaacagttttatgaaacagttttatagatgcatatagttgattaatattttagctataatagaagacaaaaatacatgctaaccgtgtatttctttagcacttaacatatttacccaacaaatatttacaaaggattatttgctgtgtaccatgcacttttattcaatacaatactgttcagtagcagacaccaagtcgaatatcaagagagacaacagagccaagacctaaatgctgatggacatgtgattggactagctgctctctcaggcccatgccatctctcatggtttgtggttgagggaatcaagaatagtgaaggcaaatgcatagcctgtggtagagcaatcagattggcttcttacatcatagtggctgtgtaataatattgacaatggctaacatttattgatcatttagagtgtgcttgagattggcctagtgctttaaggatattaatgttagttttcataacaactttatgaagcaggtttaatatccttgttacatagatgaggttaaattaatgtcagactatgtggtagagccagattcaaatcaaattccagagcccatacccttaacccttacataatactactggtaggatattgaaatggggtgacttttgaaagacagaggtatatcaggggataatggcagagtgttaagaagttaaaaaaaaatctggttacttaggtgatgaaatttaaaaagtttctttacactgtaactgtctagaatagttagccaaggaatttggatttgaaacagtagggagccactgtgggtttctgagtaggcaaattgaagtggtgaattctggcagctttttgtgtatgttggataaagtatgaagagattggaagtagcttaggtgataagctgagaggctactgaagtaatacttttgagaattaatgacctagagtggttgatggctggggaaatgaaaagcaaggacaataccagcgatgtaagggaagaatctatcgaatttggtattaaatatggaagtaagggaagaagtagaagtgaacctgtcagttttaggataggtgttaattgataaggcatctatttggataatattttttggggggatggggttagtttggttgctaaacaaatgtatctcactaagttaaagttggatttggacagatacaaatttgtgcaggtggtagatgaattccttgtatataaagcaaggcagaggatcaggggctgatttataagtgatatctccaattgaagtaggaaggaggaggaggggaaatagggagaatggtcccatgaaagtttaaagtaggagtttcacaagaaggatataattaaaggttaaaatgtagattattctgttattagtatgatttagtttggggaggattttggggtcacttgagtttagaattatctgagctacttaaagactataaagagatgtaattttaaattttagagtacagttgaaaactctttgtaaaatgtagatctgtggcattaactgtttaagttcacaaatagtcaataaaaattcctactttcaaataagaatattttgttaaacttttgagccatgggtcaaaagtcatttgtaaaacaataaaatggccgggtgtggtggctcacacctgtaatcccagcaatttgggaggctgaggcgggtggatcacttgaggtcaggagtttgagaccagcctgggcaacatggtgaaaccctgtctctataaaaaatataaaaaattagccagatgtggtagcgcacgcctgtaatctcagctactagggaagctgaggcaggagaatcgcttgaacccgggaagcgggggttgcagtgagccgagattgtgccactgcacttcagcctgggcgacagagcgagactcactgtctcaaaaaaaataataattaaaaaaatatatatatatttttatttgaaagtactggtatatcagctgggtgcggcagctcatacctgtaatcccagtgctttgcgaggctgaggtgggaggatcacttgaggccaggagttcaagaccagcctgggcaacaaagcgagattccatggctacaagtatatgtatatagatttagctgggtgcggtggtacatgcctgtggtcctagctgctctggaagctgagatgggaggatcacttgagcccagaagttcgaggttacaatgagttatcattataccactgcactccagcatgggtgacagaacaagactttgtctccaaaaaaaaaaaaaaaaaggaaaaaagaaaagaaagtggcaactgacttatttatgtatctatgtttagtgaaattgtatgagaattggtgtgggagttcataagaagggctttataagagtaaagcattattattttgaatatagggaaataggttcatttttcctgtggtgttcattgcttctcaagttttgatgagctatgtttctattagttaaaaaacatcaacaacaacagtatgcactaagattctgcctttttctgcccacctccactctgccaagttcatgaaattggagtacaacaaatgaattcttatgtgttaggctgtgctgtaattttacaactggtttaagctaagattttaccattaccacccttacaactgtcatttcttgatttatcccttttttcttttaacctctctcacccacacactgtcattgattcaatttagctacatcagcagtgtacagtagcaaaaggagacaatagaagcagtgaagaagaaggtgaggtgggacagcaggaacataagtctgacaaatttctaaatgaagagttaattttgtctgtcccttgtggcaaagtagatttatcaaaaacatttaaatgaattattttttaatctctctctctttttagttaataggcttcttttgtttgctggtgtgttgtatagtaaaggcaatatatgttaagactgcaactatatttgccagatcaaaaatttactgaaatgtagacctcaaatattattttaattttgttcttttttcattatcaccaatgtaacaatgaagatcgtatcccatacaaaattatgaaaatgtgcttttttcctgtcttattttaggttagagaataaagaggagaagatactgttaatgtaaagcaaagggcgattcctccttagggtttttacaataacatttatttttaatagaaagatatgttcttttattcaaatagtttatgtattttatttacttatttttgacagtagcctggagctgagaagggaataaagcagggcttttagcaggagacccttactctttgttgaaatatacattagggctgtgtttccaaaagtgtggaaggtataccacaatattagagtaacaataagattatcaagtattaaagggtgatacagtatttgtggaaacaaagactctgaaaagcaagctggcaatggtttaaaataaaaagaaaatatcatttgaacaaacaatggtattttcttttggattatttatcccagagaaataaaaatatttgtaaaaatataagaatatagggcaagatgtggtggctcatgcctgtaatcccagcactttgggaggccaaggtgggcggatcacaaggtcaggagattgagaccatcctggctaacatggtgaaaccctgtctctacaaaaaatacaaaaaaattagccgggcatggtggcgggtgcctgtagtcccagctactcgggaggctgaggcaggagaatggcgtgaacctgggaggctgaggttgcagtgagccgagatcgcgccactgcactccagcctgggcgacagagcgaaactctgtctcaaaacaaaaaaaaaagaatatatatgtacaaggttaactgcagcactgaatttttcctcaaaaaagaaaaaaaaaaaaaacagcctaggcaacgtggcaaaaccccatctctacaaaaaatacaaaaacctagctgggtgtggtggtggcatgagcctatagtcccagttacttgggaggctgaggtgggaggatcacctaagcctaggaggttgaggctgcagtgagccatgtgcaccactgcactccagcctgagtgacagagtgagactctgtctcaaaaaaaaaaaaaaaaaaagctattatattaaagaggagtggtagaagacttatggaataactatactatgaaagttatgcagatactaaaaagaatgagttaggcctagaccaccaatttagagaaattttgcaatgtactattaagtgagaaagatgcaaataagtatatatagcatgattctgatttgtaaaacaaagtcatttcatgtatgtttacatataatatgtttgtgtatgatttaatgagcactgagaaagttatgaaaggataaatactaggttgttaacttgagggaagaataaagaggaaaataaaaatagtctcaatgtatatgtattaagctttgagcaagtgagtaatttaaaaagtaagaatttagcaattcagagcctgaagctacaagaggatttcccagcataatttggattgaataaacccagtatgagacacacagaaaaggatctatagttttattaaccatgctattataattgagggttttcaccagttcctcagaaatatggaaattgaagatgataacctatttatttatttatttatttatttattgagacagagttttactgtgttacccagactggagtgcagtggcatgatcttggctcactgcaacctccgcctcccgggttcaagcaattctcatgcctcagcttcctgagtagctgggattacaggcacatgcctagctaatttttgtgtttttagtagagacagggtttcaccatcttggtcaggctggtctcgaactcctgacctcaggtgatccacctgcctcagcctcccaaagtgttgggattacaggcatgagccaccatgcccagccttttctaaatactttagaaagtatttaacataaactatatagagttctcattaaaaaaaaaaagaacagtattaggcattaaaggcagactagcaggatagtgagactttgtccttgaatcaagcagaaggattgaaaaataataaaaagataagaaaattagtgttattaaatgccatgtgatgttctactaccaatcaatacactttttttttttttttgagacggagtctctgggctcactgcaagctccgcctcccaggttcacgccattctcctgcctcagcctcccgagtagctgggactacaggcgcccgccaccacgcccagctaattttttgtatttttagtagagacagggtttcaccgtgttagccaggatggtctcagtctcctgactttgtgatccaccctcctcggcctcccaaagtgctgggattataggcgtgagccaccgcacctggccgatcaatacacttttaattgcctactttgtaccaggctaagcactgtactaggttctacctttatagagataagatagagctgtttagtgagggtagggacaatacaaaggacctcagtgaaggtagaacctcacattcttttttttttttggtgggggacagagttttgctcttgttgcccaggctggagtgcaatggcgcagtctcagctcactgcaaccactgcatcccaggttcaagcaattctcctgcctcagcctcctgagtagctgggattacagatgtgcaccaccacacctggctaaattttttttgtatttttagtagagatgggggtatcatcatgttggccaggctggtctcgaactcctgacctcaggtgatgtacctgcctcggcctcccaaagtgctgggattacagatgagagccaccatccgtgcccagcctagaacctaacattctaggggcgaggtggacaattaaaaaagcccacagagcagaccacgaggtcaggagttcgagaccagcctggacaacaaggtgaaaccccgtctctactaaaaatacaaaaattagccaggcgtggtggcgggcgcctgtaatcccagctacttgggaggctgaggtgggagaattgcttgaacccaggaggcagaggttgcagtgagccgagatcgtgtcattgcactccagcctgggcgacagaggaagactcagtctcggggggaaaaaaaaaaaagcccacagattggctgggcacactggctcattcctgtaatcccacctctttgggaggctgaagcaggaggatcacttgaggccactagtttgagaccagcctggccaaaaaagtgagattctgtctctacaaaaaaaaaaaaaaagataaaaaagaaaagaaattagccaggcatggtggcctgtgcttgtagtcctagctactaggaaggctgaggaaggaagatcatgtgagcccaggagtctgaggttacagtgagctagggtcatgctactgcactccagcctgggtgatagagtaagaccctgtctcttaaaacaaaacaaaaaacaaaacaaacaaaaaaaagcttactacagattgtgacacgtccaaggaagtaaacagaataatgagaagggccatcattttttaaatcatttttcaagagagtggtcagtgaagggcccttaggaggcaatattaagagctgagaactaaaagggaatgagggtgaagtggtggagggaattccaaagggctcacacgtacaaagcttagatatagaaaagggtttgatgtgttcaacaaacagaaaggccagtgtgcctgaagcattggtaattaagtatgggggtaaatggcctcccaaagtactgggattacaggcgtgagccactacgcctggccgattctttcaatttaatgtcctcctgtctatagagttcctagaacatcttgagctggatgaaactccttttcatccagagggcagcagagtgtacctggagcctacatgggatttgtagtctaacctgggtttgaatcctcatttgaaaccttttgagctcaggtgtttacttttggagcctgttttctcatctgtctaagaagggataatgacacctagcacatagggatgttctaaagattaaataaaataacatgtaaactatgcagaaccaaataaagcttagttccttgtctctttccttctcttctaagttgagattaggatgttttgtttgtttcttgaataagatctgagtcccttgtcttctccagatgactatgctggacctagtcaagagactaagatgttaatatgtatttatgattatgtacatataatcagttaattacttacattcttgagacatccatctgaagttattgacaaataccgatttctctcaagtctatgaggttctaagatgttgtatagtcacagtctaaggctgggagacccgagagaccatggaagatgtttgcagagttttcttctgaaacttcattcgctcagtctggacgtgtaaaagaataacggtccagccataggctctgaaatcccaagacacagacttgaaaaaatacatattttttttttgtgcgtaactttcttttttaaaatcaccacctccctgttctgtgcagatttctcttacttagtactgtggaaatttctgaaagcatcttccactgaaaccattgctatggccagcgttgggtttctagaactggaagaaacacacattttgaaaatattagtcagtactatttcagtcttcagtgacaggaattttggttaaacatgcgtaggcttagaatgtactggctctagccatgagtggatcaggagcttaactgctgtcaccagggatcatgcacctttcatctcttagttttggtttctgttgtgctagcttcattctcaaacaggctttgccatgtggagcatccccagattaaaatcctacccattcagcagagaaaaggtactgtttctccaatttctaggttaagtctaggaattattgtcctccctaataccccaagaaaacccatgtactagaaggaggcagtgttctcattggccagatctggttcacatgctcacctctggaactgttcagttgagtcagccccatttgaatgacctgtgtaaattgagggtgagggaggtgtgtatgttcaagaaaaattagcatgcagttaccagaaggggggaaggaaagctaggcacattaaaaccaagaactgtttatgtatagcatataagggattggaaaacctggaagcctaggggtgactcagggaggctgggagacagagatggcaagagattctgtgcctccaagtcaacactgctgtatttggtagctttctagaacattccagtgcagctgtcatactatctgcaaaaataccttaagtgaaatgacaaaaaataaccaaaattaggacccctgaagaagaaatgtatcctcacctcattttttcttcagaaaaattttttctctcagtcttctttctagtctttttcttatggtggtcttcctctccccatcttcttttctgtccttaccctacccctcccatcccatggctcattattttcagcagatctgttcaacacagattgctattgattgtcctacaaagagccaggtactgtgcaaggtgctagaggtatgaggatgaataaggtatccctgtttttaaaggactcatagcctagagctgcttaaattacacatccctacattaatacttttttaaaaaaatagaacattctgtataaagctgaaggcttgaagtccttcctgagctctaccccaaaagccaatacttctgaaggcttgaagtccttcctgagctctaccccaaaagccaataattccctgccacctaagaggtaaccactgttcttggtcgtgtttctttctgatctttccccatacatttacacagaaaatatggggttttggccgggcgcgatggcctgtaatcctagcactttgggaggccgaggcggctggatcacctgaggttaggagttcaagaccagcctggcccacatggtgaaaccccatctctactaaaatacaaaaattagccaggcatgatggcggatgcctgtaatctcaactgctcgggaggctgagatgggagaatcgcttgaacctgggagatggtggttgcagtgagctgagatcacaccactccactccagcctgggtggctgagtgagactccgtctcaacaacaacaacaacaacaacaaaaaaagaaaatatggggttttgtggttttaaaaaacataaataataatagctaatgcttactgtgtcactgttatgtatcaggcactattttaagtattttatataaatcatcatatttaatcctcagaacaactctataaggtaggaacgattagtattcccattttacagatgaggaaactaagccccagaaaggttaagtagcttgttcaaggatatacagtaaacggaggagctttgctttatatattttaatacaattcgccttttttacttaatattatttggagatacaggtatgttagtgtgtaaagaattgtttcattatttttctgtagccctttaaataactttgttatgaaaaatttcaaacatatacaaatctagagaaaatagaataatgatggataccatggatgactagagggagaaaggaaggaggggaacagggtggaaaaactattgggaactatgcaaactctctggctgatgggatcatttgtaccccaaacctcagcatcacacagtattcccttgtaacaaacccacacatgtaccctcttaatctaaaatatgaattgaggctcatgcctgtaatcccagcactttcgaaggctgaggtgggtggctcacttgaggtcaggagttcgaggccagcctggccaacatggtaaaaccccgcctctactaaaaatacaaaaattagcgtggtggtgcatgcctgtaatcccagctactagggagactgaggcaggagaatcacttgaacctgggaggtggaggttgcagtgagccaaggtcacgccactgcactccagcctgggtgacagagggagactccatctcaaaaaaataaaatatgatttgaaattattttttaaaaagtttgttgtaattctaactgaattaataaactttaaaattcatacaaaaaaagagaaaatggtataatgaatcaccatatatctgtcattccagtgtcaccaattatcatggctaaccttgcttcatctgtattacagccacagtggcttattttgaagcagttctcagacatcatcttgcagtatccataaatagttcagtatgtagctcctaaagataaacactctgaaaaactaaccaaatcataacaccattatcacacctaaaaaaagtcttatcatcaatttcttttgagtgtcgaagttctctgattgtttcatatatttttaagtagctttgttaaaaagcaggatccaagctagattcatacattgcatttggttgatctgtttcttagatcttttaatactttctgcaccctgctatgttaaaggtccttatttctctttggtaaaaatcttggtatttaatcaaggcttatcaacattaaggcattccatccccctaggagcagcaccttgattgtcaaagcgacatgatttgcccaagcttatacatatatatgcttcttgtatgttcccatggttacttagactaagagactaaagtatttatttaaggaatgatgcaaattaattattcaacttaatctgccttgggaagcattctagttccagttattgggttctttgggtcattattttatttccaaggtttttggttattttgagtggaaaattgttttggtagatcttctttattatggtagcttcaattgatttcattgattaataagggtctttacctccctgctgtgttagaaattgcatcattcagtagctgacagtagggcttactatagtggacagtgaaaatatattaaaacaacaacaaaaataagcacatagtattcatggaagcaatctgagttaggaagacagagcactgaataatatttttttagcaaaatcagtaaaaggttttgtttctagtatatccaaaatatgcaactgaaagtgctaatcaaaattagatttatacaactgcttttccctaatgctcatgtagttgatttgagtaacattggaaaaattttacattactaattaaaatccttgtttttaaaaattaatatggcttaataaagttgttaaaaaatcaaactggccatatgtatttaaaataatttttttcttataaagtattatttatgatagaatgctcttttattctaattgaactaacataataaggcaaattacacattgtactgtttaacagggtttgtgtgtcagatctgctgtggtctttgctccttatgtagagtgcttgtgtagtgaaagggcatgcattcctgactaaatttggcttctgttggaagtaagagccataatagtgaaggacagtaagagaactagcttcatatactcagtacttgccttagtacatattgtcctcttttattgttcaaataattcatttttctatgtgggaaatgctctatgagatatctgtagttactaaacttcatgatattgtcatttgaattactgaaattgaaaggatgttaagatctgaaaatgtcagttcatctcagttggaacaaagtaatggaggaacagtttgttttgactcatattacagccacatgttggttagacagagataaagctgcctagaccagtcaggaccgatctcgtggtaagcccaggaatactggaagccaacccagggaaactctggcttggagagagatgaaaggttagaacaataatttcttcatgtttgggcaaaagcagaagaattcactaagcaaggagggaaatagagatcctatgcttttctgtttctaagcattttacagtaactatttcaagttatattttacaattttgaagtactttggtgttcaaggtgtcatttttgcctcacaataggacagcaatttttctgcaaacccttgttaaagaagagactccaagaatctgcatgttttgcccaaaaattcttgagttaatggcacaggagtttagaacccaagttttctgacccagttttagtgtccgtcgtgccatcatctctgagctacttgacagcaggcactatgtcttgttgatctctgcatccccagtaccaggcaccaggcatagtgcctggtacacagtttcaaaatgaatgcaaaataacctgaaagatttgatctcagcagatttttggcttaaaaagcagtgtttctagatatattgccttagttttgatgtgcatacttcaaaaatccttaatcttgatacaccatataattttttaaaagtaaccagttttctagtcacaacacatcagaatttttctttatagtctctggaatatcttttagagatataaaacatcaaaggatctgtttatgaacttaaactatttaaacaagtaatttgtatcatttagagtgtttgggctttatgctcattcaaatcattgaattttaagttaacctttttttcttagtggaaatttagggttgtgtgtcagtctttgtaatgtgtagttaatataataatataggttgcatacatcctttttttttttttttttcctgggatggagtcttcttctggtcgcccaggctggagtgcagtgagtggcacgatctcggcttactgcaacctccgcctcctgggttcaagtgattctcctgcctccgcctctcgagtagctgggattgaaggcacccaccatcaggcctggctaatttttgtatttttagtagagatggggtttcgctatgttggccaggctggtctcaaactcctgagctcgtgatccacccgcctcggcctcccaaagtgctgggattacaggtgtgagccaccgtgcccagccggttgcatacatcctaaaggtcacttaaggttaaatttggtaaattgcaaaggagttattgctatccagtttattccagtcagttgaagccttggtatgttgatctgttggcttggtaggcaaaacatttttaaatggcatgatcttctcatttggagctagagatagttcagtgtaattatgatacacatctgtatgtgaaaccctgccatcttttatagacaataattttgattaaatgtatgaggattctaatctcatgagatctattttatttcttaagctttagaatgttaaggctttcctgagcacatgctaactatactcaatgtaaatttaaatatttctggaaatgtcaaagctgtatgttcttttacatttcaaatacttgagttgggcttggaaaaagtttaatcaagaaaatggaccagctatttcagatacatttcagatactgtcagctactttatgtcaatgtcttccatgtgtccttgacttcttgccccagagggatatacaactgcttaagagatatctttgaaatggcaaatgataaactctaaagttacttggagtatagacatacttgggtaatttcatctaaagtcattttagttcatcctttgaaaacacaggaacaaaatgaaaattatattatgaaactattaaattgcttgctatactaagtgtgtatgtgtgtgtgggggggcaacctagtgggacccccatctttacaaaaaaataaaaactgaaaaacttagctgagcatggtggcacgtacctgtggtcccagctactcaggaggctgaggtgggaggatcacttgagtccccccccccccaaaaaaaaaaaacccaaacccctgatttaaatatatcaccaatttttgaggtaccagcttttctttgttagcataatacctaaaatattttagcatttttgactgactgtgggtagatagattctagtttcagatctaaactccctctttggttgtgttgttcaggcaacaggcttacagacattgccaagtaattgtctctaatttaatgagttaattagttaactgtctcctgtagaagtcaagtactgacttcttatggatgggagaaaacttatgcttttttcctctaagctatacactctatctttcagttaaaattaagttaaaatagagtaggagagctggagaaaacactggcaaaatacctcagggtaagtggttctttggcatcatttataaccccagatactggcaaagcctgtttcagtacatgtcaactaaagcatttgttttctttgttagccgctgtgtcctttgtggtttgtgctaaggctgctctatttcctgatagttttaaagtcaagaatgttgacatcttggcgattccatatatacagtatactttaaaaatttttaaatgttagattcaaaaggcccatgtgcaggtttcttttttttttttttttttttttgagacagagtcttgcgctcgcccaggctgtggtgcagtggcgcaatcttggctcactgcaagctccgccgcccgggttaacaccattctcttgcctcagcctcccgagtagcggggactacaggcgcccgccaccacacccagctaattttttgtatttttagtagagacggggtttcaccatgttagccaggatggtctcgatctcctgacctcgtgatccacccgtctccgcctcccaaagtgctgagattacaggtgtgagccaccgcgcccggcccccatgtgcaggtttcttacaaaggtatgttgtgtgatgctgaggtttggacttctgttgatcctgtcatccagatagtgaacatggtaccaaacaggaattttttcaccccttgccctttctctctctccccgctctaatagtccccagtatctattgttcctgtctttatgtccatgtgtacctgtaacaggtagagggtcttgactgcaagttgtccaggttcttggcattttgaacagagttggacaaaacgcccagcaaagcaaggaaagaatgaagcaatgaaagaacgaaagcaggaatttattgaaaatgaaagtacactccatagtgtgggagccaatgagcagcggattaagggcctggatacagaaacttctcgcgtccaaatacttcctagaggttccccattggccacttggtgcttacctcatgtaaatgaagtggtggcccgcaattggtctgattggttgcggaaagcaacctatcagaggctgaagtgaagttataaaggtcacactcccgtacaaacatctgattggttgcagaaagcaaccaatcagaggctaagggaaagttacaacgttgtatttctatgcaaaggaagagtctgcctgcagtcggtctgattgcgaacagccaatttcccatctgccgtggagaaaagggggtttgcgaagggagtagcctcaggtccttttgttacttaggtgtggaaagttagggttttcctttcaatttagttctaggaagttggtgtgaaatggcctccagaccctgttctcctgcctcatacccaatatttaattcccacttttaaaagagaacatgtgatatttgattttctgtttctgcattaattctgcttaggataatggcctccagctgcatccacattgttgcaaaggacatgattccagtcttttttatggctgcatagtattctatgaagtagatgccatacagaacgcttgtattgtgtgtttgtgttttttatttagtggttgtagtcctggaggtcaaattcagatattagagaatagacacctctgtggcaaaaagaacaattgttgccaaattttcttaatacaaaatctctgaaatgttttcatgtgctcccccctcttttatcatctgttaatgaaacaaagaagcaacacaagcagttgtgaagagcgagaacaaagatcaccataatcccatttctagtattttcttttttctttttttaaatttgagatggagttctgctcttgtcacccaggctggagtgcattggtgcaatctcggctcactgcaacctctgcctcccgggttcaagaggttctcttgtctcagcatcccgagtagctgggattacaggcacctgccaccacgcccaactaattattattatttttttgagacagaattttactcttgtttcccaggctggagtgtaatggtgcgatctcggctcaccgcaacctccgcctcccgggttcaagcgactctcctgcctcagccttccgagtagctgggattataggcatgcgccaccacacccgtctaattttgtatttttagtagagatggggtttctccatgttggtcaggctggtctcgaactcccggacctcaggtgatccccctacctcagcctcccaaagtgctgggattacaggcttgagccaccgcgcctggccaggattcgagcatttttatgattatatataatgtatacttgtgtgtatgtacctatatattgctaaatttcttttcaaaaggactgaattcgacaaaagcaagatgtataggacggtataaatagtatgctatcatttatataaaaagaaatggtaagaatttcatatatacacacatatatttggatgtatatatattaacattatatatataatttacttgtttatggataaaacatctctagaaggatacataagaaatcgattgcctctggggtgggtaattgagtgattgggaacagaagtaggaggaagactttccactgtatattctttggtaccttctgaattttgaatggtatgaatgtaatactattaaaataataaaaaaccattagcaataggtaaaagtacccactgtcttctttttcatgcccactgtgttggttcaggcctcaagctgtttcacctgtatcttttatttatttatttttttgagatggagtcttgctctgtcgcacaggctggagtgcagtggtgctatcttgggtcactgcaacctccgcctcccaggttcaagcaattctcttgcctcagcctcaccagtagttgggtctacaggtgcgtgccaccacacctagctaattttttgtatttttagtagagatggggtttcaccgtgttagccaggatggcctcgatctcctgacctcgtgatctgcctgcctcagcctcccaaagtgctgggattacaggtgtgagccactgcatccggccctcccctgtatctttgtaatagccacttaccagtctccctgttcgaagttagttcttctctccttcactcaccttttatgttgccatcaaggatagcacagatcaggtatgtctctcctttcttcttaaacttttagtagtatcccacagctcgcagaataaagttcagactcttctgtttagcattcaaagtcttctaccatttggtttcaaactgccttttctactacatgtattagtatacgctctctttattaccatttctctctccaactaagccttctcccagaaaagaaaaaaaaagggggggtattttttgtttcaactttgttcacattagatttttgtgtttttgttttgttttgtttttgtttttagcttgaaatacccattctctccacttgcaattgaaattggatttaacttttaaggtccattccaagtgttgcctttctccctccattccctggccccatcccaccagtcctaagaatgaatcactcctttttggttcccatagtatatttctcataccattgtttgcaacccatattctagttactggtggatggaactggtaacaggaactagtaattgactagtaactaacttgtcagtctccttacattctgtttttagacttccttgtatccatccttctttccagttgcagcggtcttcctcatattgtgcctttcctcactcctgcctattcttaactctagtggttttgtgatcttggtggaacatgtccaattatctcgtacatattaagaatgaggaagaaaagcaattgacaggaattgatggaatctacttactattagtgtaaataccttacagtttgctttttctttatcctatgtttatatacttattgttttgaaacttattgttttctttatcctgtgtttatatatttattgttttgaaatttcaaagattattttgtcttcattgtgtaagtgtgtgaaatatctagaggcctgggaggacaataaacttgtctagggactcacaaagggttagtggtagagccaaggtttaaacccaaaaccccttcaagaatggcttttatagtcatgtatagagaacatgactttattttggggtgatatttcttgaatgcttttggtagcaccaattagttaaaaaaaaagtccatattgggctacgtcttttacttttgttctatagcacaagtcatcaagcaacccctgggctactttttttttttttttttttttttgagacagggtcttgctctgtctcccaagctggagtgcagtggtgcaatcttggctcattgcaacctccgcctcccaggttcaagtgattctcccacctctcaaatgctttgaatgctaaacagaagagtctgaactttattctgcaagccatggaacaatactaaaagttttagaagaaaggagagacataatctgatctgtgctattcctgatggcaacatggaaggtgagtggaggagagaggaactaacttgggacagggaaactaggaagtcgctattacaaagatacaggtgagggcccggcacggtggctcacacctgtaatcccggcactttgggaggccgaggcaggtggatcacgaggtcaggagatcaagaccatcctggcctaacacggtgaaacccgtctctactaaaaatacaaattcaagtgattctcccattcctctcagtctcccaggtagatgtgactaaaggcgcatgccaccatgcttggataatttttgtatttttagtagagatggcatttcaccatgttgttcaggctggcctcgaactcttgacttcaagtgatctggccgccttggcatcccaaagtgttgggattacaggcgtgagccactgcgcccggccactgggttacttcttatgcaggctgatatagcacttgtggtggtagtctctgtggctttttttgtttgttttttgttcttttggacagggtcttgctctgtcactcagactggagtgtggtggcacaatcatggctcactgtagtctcgacctcccaagttccagtgatcctccctcctcagcatcctgcatagctgggagtacaggtgtgcaccaccatgcccagctacttttctaattttttgtagagacctggtctctccatgttgcccaggctggaactcctgagctcaagggatcctcctgccttggcctcccaaagtactgggattacaggtgtgagccactgtgcctggcctaactcttttcttattgaaagaacaggtggctttgtttagtcagatccacaaatggagatgtttgcaacacttgactagaaagcaaaccaacaatcatttgccctgattcttcttccctgtcttgtttcctagaagcaaccacttgtaactcttttagctatttcatttggtatttcccttcacatttctatattgatatttctagacatttttgactttctgtaatagtagctgaggtcttagcttccttgtactacttcctctcacattcctgtcagtatatttataattttatttttttttgaaacagggtcttgctctgttgcccaggctggagtacagtggcatgatcactgctcactgcaacctccacctcctaggctcaagcaatcctcccagctcagcctcctgagtagttaggactataggcacgtgacatcatgcccagctaatttgtgtatttttgtagagatggggttttgccatgttgcccaggctggtcttgaactcctgggctcaagcagttgcccgccttggcctccccaagtgctggaattacaggtgtgagccactgcacctgtcctatttataatttttattaaattaatatttgatgtctatattattatgactataaatactgtttattttgagccaagtcatggattatgatattttctatttttgtacaattaaagtaatttctcatagttaaaaattaccaaacttttgatttgcctagttatttgtgtacctattaccaattcattcatttgccaaatatttactgagtgcctactataagccaggcatcattcttggtgtttgggatatattagtaaacaaattagacaaagattctttcccttgtgacacattctaattgggagatagacaataaacataagaagtagaatataaagtatgttagaaagaggtgctgagggaaaaaaaagcaggactgttgaggagcatgatgcccttaattcatgattctttatatgtgacctggtttttctctctgaaaacttgtagaattttcacttcatttggatgttctgcaatttaacgatgatgggccaggccctagtgtagatgttcgctttaatttttcatgcttgacattttgtgagcccttgtattcttcagttctgatcttactgctttgttggttgactgaagtaacaatcaatctgatgcaactcaaggagaagggctttggttgttcatgtttggtcatcccatagtatataaagcccttaaattaatgagtttctttgatacaggtattattattattttatttaaaaaaattattgatgtaaaaaattactgatgtcaaagaatattttaatttatttcctatttctggctactggaacttggaatgatgagaggtcttgtttgttattcttttctcattcatttcacttctaaggtttggcagattacatgtctccctggtgctcttgtagacaggaagcctctgggagtcactttcaggtcctggctgccctttcacttttcttagtcttttcatatcttttatcttaccaatatatgtatttttaattgagataaaattcacataatgtaaaattcaccattttaacgtatacaattcagtgttttttaaaaaagtatatttaccatgttgtatgatgttaccactatctaattccagaacattttcatcatccccaaagagaaatctgataaccagtaagcagttaactcccattccccctctcctttcagctcctggcaaccaatattctgctttctgattctatggtcttgcctattgtggacatgccacttaatagtatcacataatatatggcctttagtgtctgtcttctttcacttatcataatgttttcaaggttcctacatgttgtgcatgtattagtactataaaatgtttttaaatcaggctctgaatatttgatttttcggtatccagagaaaaattctgcatttattatctttattttgattttaatactggcctttaatttaccttttcacaaaccatttattggatataaaatgatattggataatttttcagtatgcattatttatttatttttttagtatgccagtactgaggttgatggagagcgttacatgaccccagaagactttgttcagcgctatcttggactgtataatgatccaaatagtaacccaaagatcgtgcagctcttggcaggagtagctgatcaaaccaaggatgggtaagtatcttcatgcattttctgaaaactaatgttctggaatatattgttaaaaatttaaaaaaccagctgggcacagtggctcatgcctgtaatcccagcgctttggaaggctgaggcgggcggatcacctgaggtcgggagtttgagaccagcctgaccaacatggagaaaccctgtctctactaaaaatacaaaattagctgggcatggtggcccatgcctgtaatccccagctactcgggaggctgagggaggagaatcgcttgaatccgggaggtggaggttgtggtgcgccgagatcgagctgctgcacttcagcctgggcaaccagagcgaaactctgtctcaaaaaaaaaaaaaaaaaaattaaaaaacccacaaacttacctacgggtatctagaattttaatattagtaaacatgtaattagtaattaccaagttgctcattagtaattagaaaatatgtttttaaaataaatatattattattatattttggggatacataaatcattatgaaaaatgtattcaggctgggcgcggtggctcacgcctgtgatcccagcactttgggaggccaagtgggtggatcacgaggtcaggagattgagaccatcccggctaacatggtgaaaccccatctctactaaaaaaaatacaaaaattagccagacacggtgacgggcgcctgtagtcccagctacttgggagcctgagataggagaatgtcatgaacccaggaggcagagcttgcagtgcgccgagattgcgccactgcactctagcctgggcaacagagcgaggctccatctcagaaaaatgtatttaaaaaaaattttgttgtttttaaatcaaggtgtagcactgctgcatcaatattaatccaatgttaaaaaacagaggagctgcaaagagctaaggcaataaatactggcatcctatatttaaagcatcttgtagggtagctctgtgacttacgggttagtgtaatggtcttaaaaaagagattaggcgctctccctctccctctccctctccccacggtctccctctccctctctttccatggtctccctctgatgccgagccaaagctggactgtactgctgccatctcggctcactgcaacctccctgcctgattctcctgcctcagcctgcgattgcaggcgcacgccgccacacctgactggttttcgtatttttttggtggagacggggtttcgctgtgttggccgggctggtctccagctcctaaccgcgagtgatccgccagcctcggcctcccgaggtgctgggattgcagaccgagtctggttcactcagtgctcaatggtgccnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnggaatagaaaggggggaaaggtggggaaaagattgagaaatcggatggttgccgtgtctgtgtagaaagaggtagacatgggagacttttcattttgttctgtactaagaaaaattcttatcctgttgatctgtgaccttacccccaaccctgtgctctctgaaacatgtgctgtgtccactcagggttaaatggattaagggcggtgcaagatgtgctttgttaaacagatgcttgaaggcagcatgctcgttaagagtcatcaccactccctaatctcaagtacccagggacacaaacactgcggaaggccgcagggtcctctgcctaggaaaaccagagacctttgttcacttgtttatctgctgaccttccctccactattgtcctatgaccctgccaaatccccctctgcgagaaacacccaagaatgatcaattaaaaaaaaatttttttttggaaaaataattgaagctttatgttgaaaaatatgaggatgccaggcaagtattccactttataggtcaaattctgagccaataatttttaaaccacactaactggagatccatgttttgttttgttttggtctacattaaaaaaatattttatatatatgtatataatatatatattttttgagatggagccttgctctgttggccaggctggagtacagtggcatgatctcagctcactgcaacctccacctcctgggttcaagtgattctcctgcctcagtctcccaagtagctgggattacagatatgtgccaccacacctggctgatttttgtatttttaggagagacagggtttcaccatgttggccaggctgatctcgaactcctgacctcaagtgatctgcctgcctcggcctcccaaactgctgggattagaggtgtgagctaccatgcccagcctttaaaaattggtatatactagttgtataattaaactatatattttattcaaagtttataaaaatggtgttatttactgctattatcaaggatacaggcatttctttttttcgaaaaaatatttcacgggaaaagcctcattttatgttgaataatctgagcagaacgagttccaaataaccaagtatatttcttccattcattcaataggtattgagtgcctgctatgcctcaggtactgttcttggtgctggaattattaatatatcagtgaaaaagccacaaaaagataataaaaaagtgaattatggtatgttagaaagctgtaagtactatgatgaaaaataaattaggggagagtttagggagtgatatttattaatttatttctctatttatttggcaaacattaattgaacagccattgtttgtcaggcactgttgggccttacaaatacaaacataaattaaatgaggcttttggccttcaaaagaaggtaatagcttagtgagaaagaaaatgactaaacaaaggaaaaaagtaacacttctgaaatgaggtgctgtcatagctatatgagaggaatagagggaacccaagaaagcatggttaactgttttgggtggtcaggacagcatcacagaagaggtaatgcttgagtgaaatctggcaggatgagtacaagcttgttagtagttggataagtagggacgagaattccaggaaagggaacaggaacggcatgaaacattaaggggcgtgtgtgtgcgtgcgcatgtgctcacattagtgaatggcaatggaggagggttgtgttgcaagtactttgatgtggctgtggcattgctttgttgctgggggagatgtagttggagtggctgaaggcttttgactctgtcttgcaggtatttttagcctggtagtgtatgggtgtgtgaaaagacagaaataacaaggggcatcttgctagagtgtcagtttactcaactcaggggagaaaagcaatcattatttgtattaaaatcatatatggctgtattatggagtgaatgtaatagttgcatgaattagataaagacaattttggcttgttatggcagtttcagtctacatctccaagcctccagggcctaggctctttctcctacctgttgaggtgcttgtgtgacaaactttgagaaactaggcagtaagtagtctaaaaattatttccattaccacagatgtaaacagattttagaaatggtgggttggaatgggacaagactcgcatgcaatagaatcaatttaggtagctattgtaataaagtagaaagattggtgtctaagttctttgagtccaggattagtactgtattcagttttattgtcccatagaaccttgcacagtgtgtgaaatttactatgtgttcaacaaatatttgttttggaaagattttatatcatttataaatggcaggtattgggaaacttgtataccttttaggtctactctctcaaaatatatcaactgataaatcactgtggatcattcactcataggatctttcaataatgattagacaataaagcaaatgaaaattaattatacctatcataagtccttcatcagaattattaaaggtaacatatatatttagctcttttagaaattatcagagtatttattgttagtaatttggtctaagacctgatttcagaatatccatatattttcaaatgtttccttttatgaccatctgctctattctatctcagtagtgtatcttctttgaagcttcatgtggttctcctaggctgagttgcattgttaaagtaggacattttcttttcttttttttttttttgtcggagacggagtctcactctgacacccaggctggagtgcagtggtgtgatctcagctcactgcaaccactgccttccgggttcaagtgattctcctgcctcagcctcccaagtagctaggattataggtgcatgccaccatgcttggctaatttttgtgtttttagtagagatgaggtttcaccatttggccaggcttgttgtctcgaactcctgaccttgtgatctgcccgcctcggtctcccaaagagctgggattgcaggcataagccaccgcacctggcccatttttcttcttataatcatctttttaaaaagatattctctactgggcacagtggctcacacctgtaatctcagcactttgggaggctgaggcgggaggatcgcttgaggccaggagtttgagaccagcttggacaacatggtgaaaccccatctctacacaattaaagaaaaaaattagccagttgtgatggtgtgtgcctatagccttagctacttgggagagtgaggcaggaggattgtttgagcccaagtgtttgtggctgcagtgagctataactgagccactgcactccagcctgaggggcaaaatgtgagattctgtcttaacgaaaaagaaaaaagatattctcttttctcccctctattttctaccccttaacccagggcagtgatgaaatattagaatagcttacttggtacgttgtttcctgccccaaaatgtgttccttggttctatcatagttttctgatgatgagtcctatagatatgttatgtgaaatagcaacatataatattgcttataaccactcaagaccaagtctgaatgagtggagctagtatagacaagttcaagtgatttggttaagtgtgtgagaaaaattggtctaggagtggttgaaacacgctcttttgtgctctgcaatccttcccccatgttttccgggatgttaactgttcctctctcttgttccccatctcctttcccccagtagatagtaaaataagtaggagtgtttggatatgggtgcttgctgtagaaagccatgtaacatacaaaacagcattatatattataaatagcacaatcagttgtctaaaagtaaaagccattagccaagtattatttgtgggattgtggcttaaactttgaagttctggtgtataatgaaaagcaaaatgattttatgcatttaatgcagatctcagagactataattgtgtgatctaatctaaaatatttagactgttgcttacttgaaattgtaacttctagaaccatagtttctatattcagtcctagtcagaattttatctggaggttctgttctcctgtgatgtagaaaactggtgttcttttcttctactttttccccaagtgttttcctttatgttacacaggcatatagaggaaccttttatgcagaaatcttgattgttttacaaattataaaattaacattaatattttgtcattttattagttcctatttactaaattaaaaaggggcttcgtagaaaatttttaaaaaacacaccaaattcagaaaatatatttttcaaagttataaaatgaatacatgttctttctaaaaagtcagacaatggggtaatacggtaaagagtgaaagtacctccttatccccattacaaggaaaactaatagagtgtgaactaatcagtagtttcttcactcaacagttagtagcttgtggtttgcatatattctattaaagtcttgattgggcccttctagcaataaaggaatccatggcaggataaagggaaaaggagccttaaaaatattctggagccaggcatggtggttcacacctatgatcccagcactttgggaggccaaggcaggaggatctcctgaggctaggagttcaaaaccaaccggggtaacatagcaaaaccccgtctatacaaaaacatttaaaaattaaccgagcatcctggtgcttgtctgtagtcccagctactcaggaggctgagacaggaggatcacttgaacccaggagttctaggttacagtgagctctgattgcaccattgctctccagctgggagacagattgagaccttgtttcttaaaataaataaataaataaaattctggaacatgcttgctttatgttagcattgcagactatttcttgctttcagaaaaatattgttgcattataatgcagtaagtatataatgactgtgggcttaaaatagaggagagtatcagagagactgtcaagtggcctatttttctctcattcctcccaacattttattatgaaaattttcaaacattcaagaaagttgaaagaattttatagtgaacacccatatatctaccacctagactaccacagagattatattattattattattttattatttatttttatttttattattattatttttgagacagggtcccactctgttgcccaggctggaatgcagtggtgtgatcatggcttactgcagcctcgacttcctgagctcaaatgatcctccctacgtcagcctcccaaatagttgggaccacaggcgcctgcctcatgcacagctaatttttatttattttggtattttttgtagagatagggtctttctatgttgcttaggctggtcttgaacttttgggcttaagcaatcctccccctttggccttcccaagtgctgggattacaggtgtgagccactgtacctggccagattctactattaacatctgactattcttgctttttcatatatccatccatccctctatccttccatcaatccatcttttttttaatacatttcagagtaaagtgcagccattgatatagttcttaaatattttagcatgcccattatttactagtgttttttgttttgagggttttttgttgttgttgtttgttgtgagacagagtgtgtctctgttactcaggctggagtgcagtggcccgatctcggctcactgcaacctctacctcgcgggttcaagcaattctcatacttcagccacccaaatagctgggattacaggcatgtgccactatgccaggctaattttttttgtatttttagtagagatggggtttcaccatgttggccaggctggtctcaaactcctgacctcaagtgatccactgacctcaagtgatccacccgcctcagcctcccgaagtgctgggattacaggtgtgagtgaccatgcccagcctttgagtgtttttctttaaatgtaggactcgcacatagtaagaaaatgtaaatctcaaaagtgtatttgctgagctttgacaaatgtatgcacctaggtaacctcaagtgactttttttattgtgttaaaatatacataatataacatttaccattttaatcatttttaagtggacagttcagtggctttaagtgcattcacattgttaggcaaccattatcatatccaaggccaggcgcagtggctcatggctgtaatccgagcactttgggaggcctaggtgggcggatcacctgaggttaggagttcaaaatcagccatggctaacatggtggaaccccgtttttactaaaaatacaaaaattagcctggtgtggtggcacgcacctgtaatcccagctactcaggaggctgaagcaggagaattgcttgaatccaggaggtggaggcggaggttgcagtgggccgagatcatgccattgcactccagctggggcaacaagagcaaaactccgtctcaaaaaaaaaaaattgttgtatccatttgcagaacgtttttatcattccatactgaaaccccataccaattacataatgactccccattctctttccttccactccaaccagcccctgataaccagtactccacttattgctactattttagctatctcacataggtggaacaatataatatttgtccttttgtgtctgccttatttcatttagcataatgttttcaaggcacatctatattacagcatatgtcagaatttcattcctttttaaggctgaataatgtactcagttgatttattttttagagatagagtctcactctgtcacccaggctgaaatgcagtggcacaatcacagctcattgcagcctcgaacttgtgggctcaagcgatcctcttgccctggcctcctgagtagctaggactacaggcatgtgtcaccataacaggctgatttttgactaatttttaagttgttggtgcttttgtgtattttcatgatacatctgaatatatatctcgtgatatatctgaatatatctgaaggtaactgagtattgagggatggctgagtattaccccaatagcttcttataatagtggtctacttactaatgccagatactctttctggttttcaactatagctttaaaattgggaaagggttaggagatatacagtaatggaagaacaccaaattgaaggcaggagttaggagtctttaagtagactcactgatttgctgaatgtctttgaggaagatcacttaacgtttgcctttctaagggtccttctggctccaaagttgcatgaatatatgatttgtctttttgaatatgctgacagacaaaatgtagatatttagtaaattccatagactttctattttaaacaaagggctacttaattggaaacctatgtgacaagagtctcaaatccacaaggacagtgtggtctgtagatagataactgatgagccctgtttggttgcttttctgaaggagaaagactgcttgtcttcaaggggctggtgctacttgggaccggaaacctagtgttgttcacacttgcagtttatcaaaataaaccagaaaaactgagtatttatgggaaatcttgtgatttcttaatgtcaactaatgcaactaaaaaacagtactttgcatgccaaagaaaacacatctttggaccaaattcagtctgccagctgatagtttgtgacctttgctagttaaggaagaagtttttggcctcttctcataaatatagaaggttttactactgagcatgaaatttgttttaaagctacgtattctgtatttcagggtaggtgtattttttatgtcttgatgctattttgtagaaaccaatatgttatgcctttttaaagaaaacccataatcagcctatttttatttttaaaattattggtcagtctgtttttttcttcctcaaacagaaattgcatgaaaaatacactatagaaaatccttgtatcaattaacacattttgaaatatatagagtaattaacattggacaatcaaggaaagattagtttcctaggaaaatacttcattgaagaccagtctgcagatctgtatgcatatgagacacatttttataatgctgttacttggacactcattactaatgagcagcaagatggtatggaatctttgtagcaagcttgctatgaaagatctagtatatgctggctttgtaaggtcactgaaggcaatttctgtgtagttttgaccactggttaattttataaccttgagtataataggactcattaagttctagaaacccaacatatgagtttcccccactttttgttaagttttgttttgttttgttttgaaatgggtctcacttgggtctcactctgttacccaggctggagtgcagtggctattcacaggcaccagcattgcatactacagccttgaactcctgggctcaagtgatcctcatgcctcatccttttgagtagctgggactacaggttcatgacattgcacctggctcccaccttttttgttttgatttttccttttaacatttttatttaaaaaaaatttttttttaaacagggtctggctctgttacccaggctggagtacagtggcacaatcttggctcactgcaacctctgcctcctgggcttaaactgtcctcccacttcagcctcccaagtagttggtactacaggtgcacaccaccacacctggctaatttttgtattttttgtagagatggggtttcaccatattgcctaagctgctcttgaactcctgagctcaagtgatctgcctgcctcagcctcccaaagtgctggcattacaggcgtgagctactgtgccctgcctctaaaagttttattttaatttaattatttattgagacagagtctggtctgtcgcccaggctggagtgcggtagcatgatcatggcttattacagcctctacttcctgggctcaagcaatcctcccacctcagcctcctgagttgttgggattacaggtgtgtgccaccatgcccagctaattttttatttttactttttgtagaggtggagtctccctatgttgcccaggttggtcttaaactcctggactcaagcaatcctcctgcctcagcctcccaaagtgctgggattacagatgtgagccactgtgcctggccaaaatttttattagtgatgtttcaaacatgtataacacagagaataatgtaaattctatgaattcatcacctacttttaatcattaccaaaataattatttcgtttatacctccatctcttctccatcctctggattattttgaagcaaactctagatgatgtatttcatttgtaagtgtctcactgtgtatctctaaaagataatgcttaacaacaaccaaaaaaacctcctagaaacattgatttcttaatatcatcaagcatttgtattatattggtatttccatttcccggattatcttgtaaattaaaaaacttttttttttactttgtttaaattggaatccaaataaggatgtatattgtgattcattgttatatctcttaggtcttttaagattgagattccctgtgcttgcctcagcagcacatataataaaattggaatgatacagagattagcatggccccttaaaaaaaagaagaatcctcttcatagcttcattaaaaattatttttctgcagctatggaatgtttcttctgtcatttcctacagtctgcatttatgtggtggtagtgaacatgttcctttgtttgttgtgttttctgtaaattagtgaatagttctagagcagtggttctcaataggggtgattttgctcaccagggtatatttggcaatgtctggagacatttttgctggtcacaacttggggatgctattggcatctagtgggtagaggccagggatgctgctaaacatgctacaaagcacaggaaacccccacaacaaagaattatccaacttaaaatgtcaccagtactgaggttgagaaactgatccagagacttgatcagattcaggtttaattatattttgcctggttctctctcttcatgatgttaggagctattgattattgcccagtttcattgattttctaggggcttacaaaagggtgatattctaattctcctttccttccttatctgaagtacctctataaaaacaaactaccctttatcaattatttggttaccctgagctacagtttatatagtaaaggcagattaaatgcctgatgctttccctttcttcaccagccaatggcgttttatattttattccaggttgatctcctatcaagagtttttggcatttgaatctgttttatgtgctccagattccatgttcatagtggctttccagttgtttgacaagagtggaaatggagaggtgacatttggtaagggaaaaagaagattataagtgataagttaatgatgctggtccagtcttcaattgctgaatctagtaactaatatagattactgcttatttgggatctgacccataattgaatttcctaaaaggatttatgcagataatgatggctttattttttcaaagcattaaactgttgccaaagatgaagaagtgtagtaatgctgttgctttagctcattgagtcactgacactttcacattcctaaaataaatggtgtaagattttcttgttctgggccagcctgggcaaaattccttacaaggtcgattttgaacaacatgaaacaattttctcattctttaagtgatttttagatagggagttcagagcttctcttgtagcatccttggaaaattgctactatgtcattgtaacaccaagaatggaaccgaaggaggatatcaaggcaaaattagttagtgttctctgaacctgaattttagatttcagttttaggaaagaggctagaatattaaaattgccatctgacatgaatgtagaaatttatttaaatcctctagtagacacaaaatctaacacactgttgatgtttcacaggtgtatacactaggatttttatttgtaaccatatattaaagatacttttttacagaaattagtatatgtttagtaaaagtattggctaatttttcttgcaacaattttttcaataaaagccatgtagtagttcaaggaccttgagcactgcccccacctttttaaagattgccactgtttttgttgtggcaaaaaacacaagataaaattactactatcttaatgattttaaatgtacagtttagtagtattaagtatatccacaacgttgtgaaagacatctccagaaatttctcatcttgcaaaattaaacttaagcccccttttatagtgtgaattggcatggatatttgtagaaacacccttgaaaatcaggctttccctgagctatgacattaaacacttattcactattgtgtttgagttataaaatagatgtcctttagttaaacttgaaggaaaaattatcactgcaatggtcaaagtggtgagaaagtacaggtcagtcaatcagaaggatcagtagtgccttggctgtaattttggtggacacattttctagcgtgacattgattgttttcttcttccttctgcccattgactcaactatcttctgtatgagaagactttccaaaaaaatgctatgcagagttttttgttttgtttttttttgagacggagtcttgctctgtcgcccagactggattgtaatggcgtgatcttggctcacggcaacccctgcctcccgggttcaagtgattctcctgcctcagcctcccgaatagctgggattacaggcatgcgccaccatgcccagctaatttttgtattcttagtggagatggggttttaccatgttggccaggctggtctcgaacagttgacctcatgatccgtctgtctcggcctcccaaagtgctgggattacaggcctgagccaccgcgcctggcctgctatgcagagttatttagatttttgcatataaatcttggcatcctcctcctttggagcaagcttcgaccatcttgcctcctgaagaatgttgactttcctcagaaacacctagattctgtagtttaaggcacaaaccctccatcatctcattcagcattaaccatgcactactagcaatgctgcattttccattttcagtaggtatcacacatgctcacatatctcacaaatgtgatgcagaaatgcttggaaaataactggattcagatgtctgagttagtgacagtgccctgtgcttatatcctgtgtgcattaagaattagatctcacaatcaaattctaatttttgtccctctaccttgatatcatggttctttgtgtctcctccatttaattacttttcccagtttcgattattataaaattagtaactcaagccacttcatccaacagactgtcaagaccaacttaacaataagacacatgccattgttgataaatagattaaaatgagtgtaggaagtagctaagtttatatatgccttatttaatgtaaatgaaagcttgtagtcattagatctcaactttagttttttttttttggaggtggagcctcactctgtcacccaggctggagtgcagtggcgtgatcttggctcactgcaacctctgcctcctgggttcaagcgattcttctgcttcagcttcccgagtacctgggattacaggcacctgtcaccacgcctcgctaatttttgtatttttagtagagacggggcttcgcccatgttggtcaggctggccagtctcaaactcctgacctcaggtaatctgcccacctcggcctcccaaagtgctgagattacaggcgtgagccactgcacccagccaactttagctttttataggtcttctgtttttctttcaaactatgatttatgaattagaatttttagaaatatagttaggattaaacacaaaccagttttagtttttacggtaccaggtataaactgaagaacatatgagccctcaagaatcttgctttcattcttttcctccataatctagagacaggaatattattatggaataagaaaaagatgaagccaggtgcagtggcgcatacctgtagtctcaactcccaaaggagtgatttcagctcctcgggaggctgaaatgggaggatctcttgagcccagagtttgaggccagcttgcacaacatagtgatacccagtctctaaaaaatttaaaacattttttaaaagctgtaccctgtttctgttctggattccctggctagctggttggctcttttgatggtgctcacctatttcctaaggactttgaccatttcaccttctgtccctgccttcctagttttaaggatccactttgagacaaattttcttaagtagaatgagagaaatgataaaagaaagtttcctttcatatttttaagagggaaaatattgaaactgttgtagcaaatgccatttaacaagatttctaggcactgcttatttcaagccatattcaagactacagaatttatgcataaggaagtaattaacttggagtttatttttataggattttggatctggggtaaaggtcagttttcatgtttgtaaccacttaataaaatgaattgtgcttatgtatttataggcacatgtttaggtaaaaggaaattttagatccattctaaatagagttaaatccttttcaccaaatggccttctgttttctagtttggagctatttatagttttctcttgtgcacatgagagaaagttggaagacaatattagctgcaatgtgtaaggaagtggagaaaacctgttatgctatcagcatctcttgtagactatgatgataatgttatctgtgtacttgtatatattctcatttatgctttttttagatatgattttatacacatcaaattatatacttaaactgtgtgcatctttgcaagtatttatataagtagtaatattgaacatttacttgagtgtttatataaggttttttgttgttaaagatacctctgctctggggagaggacttagattgaggccttggaaatccatttcagaacgtgaaaactcaggaaagggttctggagtttttttaagagtgaataaaatattagttaattgtttcctctttgatgtttctttaataaaacttctaatgcatgccgtggataattacttaatggtttgtatatctgttactgtcaggtggcatgagccttgtagaggctattgcatgactggtgtgtgctagctacagtgtaagtttgccttggtctcaccattgtccacaagtgtactggagatcctgttcagtactattagattcaggtaacctagataagcagttatactacattgtgttgtcagtagctgccatgcatttaaaatccaaattgaaaaaaaggccgggagcagtgactcatgtctgtaatcccagcagtttgggaggctgaggtgggcagactgcttgagcccaggagttcaagaccagcacgggtgacatggtgaaaccccatctctactaaaaacacaaaaattagccgggtgtggtggcacatgcctgtagtcccagctactcgggaggctgaggtaggaggattacttgagcctgggaggtggaggttgcaatgagttgagattgtgccattacactctagcctgggtaaccggagtgaaaccctgtctcaaatgaaaaaaaggcctattgccttactaaagatttaatcctttttttttttttttttaaggggccaggcgcagtggctcacgcctgtaatcccagcactttgggaggccaaggcaggaggatcacaaggtcaggagtttgagaccagcctggccaacagggtgaaaccctgtctctactaaaaatacaaaaattagccgggcgtggtgggcacctgtaatcccagttacttgggaggctgaggcaggagaatagcttgaaaccagaaggtggaggttgcagtgagctgagattgcgccactgcactccagcctgggtgaaagagtgcaactccgtctccaaaaaaaaaaacaaacaagaaaaaaccacaacaaactgttgtctgttaactaacaaaatgagtatgaaacatgttatatgttctgagttctctattaacatcaacattgtgttccaaatttggtgtttgcctaggaatggacactcttcaaagtaaacttttccaaggacacatcctcaccctctgactgaagaaacctcaaaaagcagagattcctttaaatgtagtactatgtttgaccattaatacatatagcaaataaaaatgtgttccatttgtgcctctgaaataggctgtttttccctgaaggagagaataaattgggatgggttaggcacaaccactgttattattttaaagagccaggagatggaagtgtagttatgaaaaatgtaccctttctcactggaaacaaagctatagacatgcaataatatgaagttctatggtggccaggtgcagtggctcacgcctgtaatcccagcactttgggaggccgaggcgggaggatcacctgaggtcaggagttcaagaccagcctggctgggccgggtgcagtggctcatgcctgtaatcccagcactttgggaggccgaggcgggtggatcacaagatcaggagtttgagaccagcctggccaatatggaccagcctggccaatatggtgaaaccccatctctactaaaaatacaaacaaattagccgggcatggtggtgcatgcctgtaatcccagctacttgggaggctgaggcagaagaattgcttgaacccaggaggtggaggttgcagtgagccaagatcaggccactgcactgcagcctgggcgacagagcaagactccatctcaaaaaaaaaaaaaaaaaaaaaaaacaaagaccagcctggccaacatggtgaaaccctgtctctagcaaaaatacaaaaattagccgggcgtggtggcatgtgcctgtaatctcagctacttgggaggctgaggcaggagaattgcttgaatctgggaggcagaggctatagtgagccaagatcatgccactgcattccagcctgggtgacacagtaagactccatacccccacccccaaaaaaagggaattctatggcggccaggcatggtggctcttgcctataatcccagtactttgggaggccgaggcaggaggatcacttgaggccaagagttcaagaccagcctgggcaacatggtgaaaccctgtctttactaaaaatacaaaaaaattagccagttatggtggtatgcacctgtaatcccagctacttgggaggctgaggtgggataatctcttgaacctgggaggcagaggttgcagtgagccaagatcacgccactgggccgggcacggtggctcacgcctgtaatctcagcactttgggaggccgaggcgggcggatcacgaggtcaggagatcgagaccatcctggctaatacggtgaaaccctgtctctactaaaaatacaaaaaaattagctgggcatggtggcggatgcctgtagtcccagctacttgggaggctcacgaatggcgtgaacccgggaggctgaggtcagtgagctgagattgtgccactgcaccactccagcctgggcaacagagcaaaactccgtctcaaaaaaaaaaaaaaaaaaaagatcacaccactgacttcagcctgcgtgacaaagactttcataaaaagaaatgaaaattctatgataataaatatatagcttaatttggtaagaagtagagcttcacctgagtattcaaattaaatcaggaagattttttgatttttttttttcttggtgttgctttcggatattgcagagaagttttttgttttttgcttttttttttagtactcaaggctattagagtagcttaagagttcaaggtgaaagaaaaggtggagtgttattagtttttatgctgtttgatgatagactgttgaagtgtctagcttcaataataatagtatgtatgtatgtatgtatgtatttatttattaattttgagacacggtcttgctgtgtcgcccagggtggagtgcagtggtgtgatctcggctcactgcaacctccacctcctgggttctagtgatccttctgcctcagcttccctagtagctggactacaggcatgtgccaccacgcccaactaattttttctatttttagtagagacagggttttaccatgttggccaggctggtctcaaacttctaacctcaggtgatccacctgccttggcctcccaaagtgctgggattataggcgtgagccaccacgcccaaccgatagtctttaaatatgaactcatctttcctgagaaatggacctttacatatatttgacagcaggactactctattgactgtgcagtagtcccttctagaggtaggtaaagggctaatagaaatactttctctcagagaaacaggaggtcattcaggaaactaatgaccatctgagaggagaacccagaagtctgggactgagtctacatgccatgttggttgggacttcctctacaagttcctgttgttggtctttttgttgttgttgtttgttttcctttgttttcttttttggcttcccagttgttcctcctctttcctcccaatttttccttcactgaaaaactcttcacttctacaagtctcaccattgtttttgttcagctatgtacaaggatattcaccattcatggtgggagtcctaaaaacctctctgacttcactttaagaactgtgcaggtgaaattcagctactgaggaacttttccccctgacaataagaatgtttggtctcaagcctataagttggttgtagtggctcctgctgggctggaatccttggaataaggatgtcgttgggctgatggtaggtgggctgtgtcacagggctgatggcttgtatacctacaggaggagttctctggccacaccgttggtacagcagctccttccaggctcattcatggaacaggcatggtggcagtcttggagaagagtgccagccccggtcagaggtaattttgtactgcagaaaggtgaacaagaccagtaggaagtgcccataagaaccaggggagggatgagggtggatgagatggggagacacagtatgggtttctggggaaattaaaacctctgttaagacatatttacataatatatatgatttaatgtgtatttcatctagtccaatcatcataagtgactgatacagctaaactgactaatgttacacatctgtgaacatttttacttaatcacagttgtcaccgttaacctgctctcctgacaaatcattgtgctcctctcctttgagcaaagagaacataatgacaggctacttttgtatttagccccagttcccttttcaatggaagtataaaccatccctttcataagcccatgctctgcaggaagtgaaaaagttgtcttttgttttctatatgtcagaaaactaatggattcctggttctcttagctatgccaacctagtataaaatactatatcgtgattttgctgccaataagatgtgactgtcatttccctttcttccaggccagaactatgctacagaaatagcattcttaaacatggcaaaaaaaagatccttgtttgccactggaaagatgggattctctctgggggtgggtggaacttgctatacagtttcagttagatgtatttggtatatttgagactattggtgttccctttcatgtcacgcaggacctgataaagctgggtaacataaaaacaccagctgtttgagttattacctcatacaagcataagctctccagttctggagcttttatataattttatttatcacattctgataaaagtaaagtggcaatttatgaattggacttgaaaacaatagttctactaattatttctgtgtatctgaatcagtctcaggcacttggtagtagaaacaatgataacagaagagaagtagaatacatctccagaagtgccaaagtaggtttgtaatcttattagttctagtaattatagtagtccatgatgtgtcttaaaaaaaccctaaaagtatcagagtaaataaaccacagcatataataatgatcataacaaaaccatatataaagctgtcaagtgaccactttgggagaagtagaaaatgtccaaatactcatggaaaatgacacttctgtatttggggagatcactatgactaatttagaccatcattttaattgtttcagagacattctaagatcttatttagagatggctaagaagtttatgaaataggatatctaaagtttttattacagagatattttccagatgtaaattatacattataaatttagttcataaatatcctttttgtgataatagaaacttttttttcgagacagagccttgctctgtcacccaggctggagtgcagtggcgcaatcttggctcactgcaacctccgcctcccgagttcaagcaattctcctgcctcagcctcctgagtagatgggattacaggcatgtgccaccatgcctggcttatttttgtatttttagtagagacggagtttcactatggggaccaggttggtctctgactcctgacctcgtgatctgcctgccttggcctcccaaagtgctaggattacaggtgtgagccactgtgcccagccaaaaaaatttttatagataattgaattttcttagcttgaacgcttttgcattttggactttattttacatagtttcatatttgagattctgatattttcttattatataaaagggattcaatttcattctaccattatataagaattatctaggtagtaatatatacatttattatcaaataattatattttaactcttgaaataacctttaaaaggttaccatgaaataactattccctttaataattgtaatgttacttaattaaatatagtaatttgttctaatttgctttccatttttaattttttttaacttgaagatgaaacacttctttttgttagaccttaaaagtaagaaattaattaatttgggactagaaacagctaattaattaagttagatcctaaaaatctttaataatctgctacaatatttgtagccctaaatattttctgctatctttattattttaattgttttgtaaactttaacatattttacaacttcgaagtttcacatagatttaaggatcatcttttgtgttggttagaaaccaggatcccacaaattgctattgggttaattctttgctttttaaatttgtatttatgtaaggtgaaaacgcttgacctattgaaaactttgaagtatttgtccctacttagggaagaaatgaatcctgcattccatttcaaagaaaagatgagaatcccatctccccagtgacatccaatgccttcttccaactttgctgattgctgcaatctattcagagctattatattgactctagactggtagaacgtccagttcagaattcttacattcccctatcccagtagtaatgcttttattaagaaaaagtgtatgtatataaaactaaagggaatccattaaaccatttacaatatgagatcagtatcttatttaaagaatttgcagaaattagagaaaacagcatagttggagattataaaactttaaatgtgtatttactaattctctagtataactgatagctatcgatggcaaaactctttcactaataaaattggctgaaatttgaaaataattttgttcttaagacatcagttaaacaggcttcctgctttcttaactttgttcatgattttttttttttggcatgagcttctaaattagtttatccagtctatgcttgttaaagtaccagtcatttgtgaattgacttttatagtaagtatagaactctgtaagaatgtaaataacgttgttagtgcatgaagacaagctgccagagggttttggttgtatgttacacagtgtgactagttcctatctaaaaattagtgtactgtatttagctctttatttaaaagtgaaacactaatttaacttatcttaaaatattttaatagttcagactaataatcatggattttatggggattttgaagctttgtgtcaagaccatatttttaacaatatcagaagcttttaataaggtgcttgctgctgagctaatgatatgcttttgatagtttttcttatacctatcttcaatagacatattcaggctagtgtgaatgtaataatcaagcctcaatcaaaccatacttagtatgacaaatattgcattatactgtaatttaggtattcatgcttctgataaagggtttaattcgactccttgagaaactgggaaaacactattgattttatacgggatgtaaaatagcagccatttatgatgtaagatagaaatcactttctaattaaaattaaataaagagaaattaagaatctcatggccttatatgcaatggtacatattcttaagtgtaaaattatattttttgtatcagttgtgttcctgcgcatggtttctgggcacacaaaaaaattgcagttattttaatagaagcagatgatattgacttttaaaacttctcttaatttttttctgtaggaacattgcagtggtttaaactacttattccagatataattgatttatttttgttttcccttttaagaaaatgtcaaagaaatttttggacagactattattcatcatcatatcccttttaactgggattgtgaatttatccgactgcattttgggcataaccggaagaagcatcttaactacacagaattcacgcagtttctccaggtgagcttagttttcataacaggtatcaatatatactattcttctgtgtccttcgctttgtatttattaagtttattacaaaaatagaagttctccatggtatttcactcctattttttaaatttccccctcgccagagacaacttctttaaactcttaatagctgtttctttcagtgtttacttccatttatttaaatagtaaagcacttctactttttttctacttttaaatactttttaattgtatcctaactatagaagattagaagctagttctttcacgactgggcgcagtggctcacgcctgtaatcccagcactttgggaggccgaggcgggcagatcacgaggtcaggagatccagaccatcctggctaacatggtgaaaccccatctctactaaaattagccgggtgtggtggcgggcgcctgtagtcctagctacttgggaggctgaggcaggagaatggtgtgaacctgggaggcggagcttgcagtgagctgggatcacaccactgcactccagccttggcgacagagtgagactccatctcaaaaaaaaaaaaaaaaaagctagttctttcacctctctcctctccctctttatcacagacttggacttctgtcccctttcccccaatataattatgtcatgattctgcttagatcagtaatcctatgagttattataattttgtaaatactattggtggctgaagttattatatatttttttgagacagagtctggctctgttgctcaggctggagtgcagtggtgtgatcctggctcactgtaacctccacctcttggttcaagcaattctcatgtctcagccactcaactagctgggattacaggagtgtgccaccacacctggctaatttttgtattcttagtagaggtggggttttgccatgttggccaggctggtctgaactcctggcctcaagtgatctgcctgccttgaccacccaaagtgctgggattacaggagtgaaccactgcacctggcctaaagttattgttcttagagtttctagttttcatttgtttagttttctgtgtactaatactaagtcattctcaaaccttggcccaattattaagatctctttttaatgtgtttaaaacacattaggtattctattaatttcatcttcttggagctctccaggagctttcttttttaaaaaaatttgaggtaaaatttacataaaattaatcatttaaaagtgcacaatttaggccaggtgtggtagctcacgcctgtaatcccagcactttgggaggctgaggtgggcagatcacttgagatcaggactttaagaccagcctggccaacatggcgaaaccttgtctccactaaaaatacaaaaattagccaggcgaggtggtgagtgccataatcccagctactggagaggctgaggcaggagaatcacttgaacccaggaggtggaggttgcagtgagctgagattgcatcgctgcactccagcctgggtgacagagcgagactccatctaaaaaattaaaaataaataaaagtgcacaattgagtggcatttagtacgttcacagtgtcttatatctagttccaaaacatttttatcatcccaaaaagaaaccgtgttccattaagcagtcactttctatttctgctttcccctgagctctggcaacttccagcctactttctgtctctatggatttacctattatggatatttaatataaatggaattgtacaatatgaacttttcttttttttgagacagaatttcgctcttgttatccaggctggtgtgcaatggcgtgatctcagctcactgcaacctccacctcctggattcaagcgattctcctgcctcagcctcctgagtagctgggattacaggtgtgcgccactatgcctggctaattttttgtatttttagtagagacagggtttcaccatgttggccaggctagtctcgaactcctgacctcaggtgatccacccacctcagcatcccaaagtgccggcattataggtgtgagccaccacgcctggccaaacaatatgaacttttgcatctgtttttttttttttccacttagcataatgtttttaagaattatccatgtcatagcatgtatcagtgctttattccttttttgtggctgaatactattccattgtataatatagtataaatatgttatattttgtctatccattcatcagctgatggacctttgagttgttcccaccttatggttattgtgaatagtgctgctatgaacatatgtatacaaatatttgtttgaatacctgttttcagttcttttggctatatacataggagtgtaatttctgggtcatatggtaattctgtttaactttttgagaaaccacctgactgttttccacagcagctgcaccattttcctgttgtttcctcacctgcttcagggccagaagccagactgtgtaagctcactgcataggagtcattctgtgatcacccttcacttttaccttggagaatccatttgctgttctgttacgttgaacctcctgtttgctgcattttatctcttcttttattgcggtttacctatttttggtagaatacttcctgcaatggcttcttgaggaaagtggaataaaatttttttgagacttttcatatgtaaaaacctcttgttccggctgagggcagtggctcacacctgtaatcctagcactttgggaggccaaggtggggagatcacttgagtccaggagttcgagaccagcctgggcaacatggcaaaatgccatctttacaaaaaatacaaaaactagccaggtgtggtggcacacgactatagtcccagctactcaggaggtgaggtgggagaatcacttgagcccagggaggtagaagctgcagtaaaccatgatcccaccactgcactccagcgtgggtgaccgagtgagccctgtctcaaaaaacaaacagtctgggtgttttggctcacgcctgtaatcccagcactttggggggccaaggcgggctgatcacttgaggtcaggagttcaagatcagcctggccaacatggtgaaaccctgtctctactaaaagtgcaaaaattagccaggtgtggtggcaggcacctgtaatcccagctacttgggaggctgaggcaggagaatctcttgagcctgggaggcagaagttgcagtaagccaaggacaggccactgcactccagcctgggcgacagagcgagactccatctcaaaacaaactaacaaacaaacaaacaaatccctcttgttccaccattatgctaagatagtttggctggttattgaattctagtaggagtttattttccttataattttgaaagcattgctcttttgttttctagtttccagtgttgccacagtgccattctcattcttaatttaatcttgaaactttttccactctgactcgggagtgttttaatattttttcttttctttggtgtttatgaaatttcacgatggtattccttggtgtgagtttatttttattcattggtctgggctcttcattcattgggcttttctaatctggaaacttacgtccttcaattcttgaaaattttattacttttcttattctattttcttagtttctaggactattaaatgttacatttatgaccttttagtcttcttttctctcctattttccttctgagccttctattttctatttctgctgtatttctaattttcaggaactctttttggttttctgaatattccttttaaaaaatagcatactgttcttgtttcatggatgcactcttttctttcacttcttcaaagatattgaagacaggtttctttgttgtttttttaaagttttcttcttgcatagtgtctgctttctccacatttatttatttatttttactctttgtttgggtctctgtttttctttttctcttttttttttgagtcagggtcttaccttgtcccccaggctggagtgcagtgacaggatcatggctcactgtagccttgacttccccaggttccagggatcctttcacctcggcctcctgaatagctggtactacaggcgtgtgccaccatgcctgcctaattttttgtattttttgtagagatggggttttgccatgttgcctaggctaggtcttttatttcggattagggaatcagggaaaaattgtctagtctccaatctggaatattagatctggcttttgatgttttggttgctgagtaataagtagttggaggtctcagtgttcaattttgcagaaggactttcagtttactaccttttttcactgtagtattctccctctcaactgtgtgtggtctatgctggttcagagatcctctgttaaactcctcagacagtagacctctagtcttctgccaaggttgggaaagggtggaggccttatttggagtaaggcaggggtaactaactgcttcttaaacagatatccagctaagccccttgttttcagctccaccttcaccatcacttccagaggtaccaatgcagctaacaattgaatcttttgggggtcctgtcatgtacattggcttcctttttggctttttctgcttagtttttttgagtccattaagtcagttgtcatttgcttttctgctttctgatcttaaaaatatagttgccatcttctccttttctgttgtctttgtccttgcgtttctgttttgttttgttttgttcttttattgttattttagtggagagtggcattttggaagacggtggagttaaatgtacaagttcactctcatccagtcacactgtttctgaagctctgctaattttcatctcataattagatgaaatgcattttcaagggcataggatctttcccttcagcataactgcctttctttatctttcctttagttctcctatccacctacctacctacctacctttttaacccaagatttatttattttaccttttataagcccacagtattgtttttcttcattaggatgagcacagatttgaaactatgggctttaggtgtgggtatttggaggtgccagtgtttgttctaactcttttccctgttagtgcttatctaactcaccttataaaattctcaaacttgaaaagttgaaaatatatgcatttgagagctgacttttttaaaaaaggaaatgtctgcctgattagtgtttaagattcttccaaagattactttctctctttctctcactgttttccttgcatttacagagtctattttacaatatctattgtaccctgatgttttaattatactgtataaactgagagccgcatatatgtaacttctttttttctgtgtttaacttctcatttttaagtcattaattttattttttaaaatcttttttattttggaagacttcaaatatactcaaaagtagagagaatagtgtaatgaacctcctggacctataaccagcttcaataattaccacttcttggccaatcttttttatctataccctccaccctgcctcctgcaggatcatttggaagccagatgcacatactctatgattttttcatctgtgatccttcaaatacgtatctttaaaagacaaataagagtcctttaactgttgaccttatagaaaacagacaatctattctactaacactactccttcagtgagcattctgcttcatcttgaaggtaaaggtccacatcttctttagtactgagtgttattaataaggctaaattgtacccatggctaccatttgatatttctgggtgattaagacatatagggaagacaaagacataagaaagagatagaaaagaggtagaaggaaagaaaaagatatataagacagggagtgaacctgtgtctacttttgatgctatttaggaatatctttgccatggggaccaatttcaaatccatgtaatgatgtagatggattgaaaattcccacttcatttgaagggtgaagtggttggagctgaggtcatgggaaaatggagtgagttatcacaagtccataggaaaatataattaaataaaaatgatgagacttctataaaaactacttttaatgtcatgaaaagttaaagcaacattaatttgtagtctttgataagtaaatgtgaatgaaaattatgtaatctttaaataatatgtatatacttagatatgactattatttacagagttgcaaagagtgtgacggtggcatccaatagcagcaccattgttatgtttgctaacaggttttttgcatttagtcatggatccccacaacagaaatgctctgattttgacttttgtatagtacacaggggattgctggaacattttgttgtttttgtggatatcacttattacaaagtttggttgcccaatagttcaaaagttcagagatattctggactgtcttacagtttatgagtaacagtgcccagagccagtgatagctgaacactacttttgcagtttgttattcctgactttcattttagaatgactgaatattgcacttaccagttggtagagtttctcactgagtttatttgaaaaatttgtttgaaaaaatggtctctaattcatttatagaatgacagagagagagactttgattgcaacatttaaaattgaaaaactgaaaatgaatctaaactcttaattcatgaagtactctttgatgacaggtaagccttcaagcaggagagataaattactgtatattttaaaggctgaaatgaagcaccaaaaacattattctctgttttcagtaatgaaaacttgtcaagtaaaatctaagggttattttttcctacctttcctttattgatgtgctctcattcattctttttcctgaggagtaatatgtagtacatttttaagaaagctcatgctttttgaaagaaattaaaagttttgttgcaaattcagatctgtgcattgtttgttttgtagtaagtacatgtgtgggaaggatatctgtccttccttcctttccaaaccatgtacttggaatgtgtttaaccagcttaatgccctatttctaatttcctcacaggagctgcaattggaacatgcaagacaagcctttgcactcaaagacaaaagcaaaagtggcatgatttctggtctggatttcagtgacatcatggttaccattagatctcacatgcttactccttttgtggaggagaacttagtttcagtaagtaaaaagcaagttctttaactttctatttcctcaaaccttttgatccattgagtcctggattgcctccagggactcatatgactctcaactattcaaatttcatgcttggttggtagaaagtaaacaggtttgtgtgtgtgtgtgtgtgtgtgtgcatgtgtgtgtgtgtacgtgaatgtatgtatgtgtgtgtgtaatggaggtagaggtgatggtgagttatcttttcccggatcatagttttattcagagccaccatcttgctgtcatctatttccaaattgtttatttccatttacagagtccagttcaagggaaacaagagtttatagacaagggtgagcaattactttttccagtgggcagtaactctcccagacactactgccttcatcttggcctctttccacaccaccgggctcccaaggtcttgctataaagatggctccttcctttgttgccttcagggtgctgtctgccggagggatcatcactggcttctgcagtgttttaataaccatgcccatggcagaaggtatggaggaaatatgtggccatcagcctctgtggctcactcctctctctgccccttcacctgtacattcagtctgtatgcaccagacatagttttttgttctgtcaaactgctaatctctataaagtaatcatctggaccaatagcaaactcatgtcatccacttcctcacatagagtggtgaaactttcctcacttacccgttttcttgtctatgcgttgtacttatgtataagtttttgattactgcttgttttgaatggagggaagccaatgagtgcctttgttgtttcagctgaagatcattatccctgatttagactggggtagaaagatcaacttctgttctttttcttcagtgaatctgaacatggaccatgtcactttctcctacacgtttcacctccttgacaccatcccccactcccctgccctcacctcataccccaaccaaaaaaatgaaagaaggaaggaaagaaagggataaagggagagagaaagagagaaagggagggaaggagagagaagggaagagaaccctagagggaggggctcagtaccttagtgggaagggactcatttaatcttttccaactaggttagatagacctactataatagcctcaattttttgaggctcaattttttatagtttaccaaaagtcaattctaatcctcagaggagtatatgaaaatttgagtccagctttttgggttgctggtatccaaattcaggctaacacaaatataaactgtatttaggttaaggcatgtgtgtgaggggtggtggggtgggatatatttgctcatcattacctacactatttgtaatagacctttatgattaaaattgttacattgatatttacataagcatttctttgcatttttaaaggagaatgttttcaatcatatgggttcctctgacttctggcttggaaatgaggcttttgcaaactatgcaaaatattctcttttgagtttatgtccaagtggtgagcagagaacaaattacgtcttcatcctgcagaggtaatgaaggccacgttgcccgccatctcaggcatgagggagcctcttttgcactattccattgaagacataactcaatagtgaataaattctctccagattttctacattttttggagtttttgataattgtacccttcatgatccgaatttagagtttagcacagactgttaagtattttaattataacagtggccttaaaaattaggaaaagttgatgtaataaaattgtcttaaaatttaaagtcatcagttggtttttgtgtatgtgtgtgaaggaaaaaaacaaggttaaaaagtgttccatagattgtacagtgattttgtttatccaggactagcaagagtttcacagttgagggtcttgaagatcctgtttaaataactattgttttgatctgtgataattatatttgttgtttttgaccttataggtagatgaaccatgaagtccaacttccagatgttactttcttccttaaaacctaaattacatagacttccctgagggcatgcagtgcactgtttcagtgtgatactttccttgtatttatgtactggttgttaacatcattttaacagtgaagactcctttggatcctctttgagaaaagtacagtgtccataaacgtgtttttgtttttgtttgttttttaaactttttgtgttgtcattttctaggcagctggaggaagtatctcacaccaggttagcttctcctacttcaatgcatttaactcgttactgaataacatggagcttgttcgtaagatatatagcactctagctggcacaaggaaagatgttgaagtcacaaagggtaagattttaaaatatacataaataagaatctcagcattttcacttttcttcactgaggcatgatgttgatctaagcttaccactctaaagccagatctagaaagtatgttaccatgtgtatgtatgctttacttgggctccaaaaatccaggtggatttaatgtgatactgaggtcaggaatggaaaagtggctttgacagttttgaaaagaaccttgacccaatctgtcaaacaggtcagtggcagtgtggcagcagcttgtttgtactaggaaggagttgccacagaaagatgagcaagcctactccttttggtgagtggtattaggatgttttgaatgactggagaacacccactttttttgtattataactctggagaacaaagtgaataagcaagataagaggagattctaaagagattgttttattcttgaagttaattcatctgttttgctgttttatcatcttaacattttatcttttaccagccttcagaaatgcatattcttgtatagttgaacttaaatatttaaattcaattttagattttaaaaatgatactaaaatgcctatagctttcaggttatattatagttggtgaaggtagaactttgttatatattaagaatcattcaagattttaactttttttttctctgttccagaggaatttgcccagagtgccatacgctatggacaagtcacaccactagaaattgatattctatatcagcttgcagacttatataatgcttcagggtaagtatttcaataattcttcatgatatttattatagagtagttctaaaatgtgaagcagtggtgtccttttagttcattctaacatgagttttttccatgtatttgaatagtttatattcagaatataaattccaagaaagacaagcagatgtaacaaaggagaggaaagaaacacaggaagacagacagagggagaagaagatggagggaggggaaaggagagaacaagggagagaagaaagaaagggaaggaaaggggagggaagagaaggcgggagtgaggtgagataggaataaggggttgagatgcatgagagagtgaaatgggagaagaaagcaatctgacagagaagagaagggttgtgatagggttcataaagtgggaaagaggctgggcccagtggctcacgcctgtaatcccagcactttgggaggccaaggtgggtagatcatctgaggtcaaaagtttgagaccagcctggcctgtgaccagtcggagactgaagtgaaggctccctgtgtccagaccctgtgtttctttcttctcctctgttacatctgcttgtctttttctcttggaatttatattctaaactattcaaatagactgttcttctgcctcatttccccctgagagacgtgatcttcataaatctttatgggaggcagagggaccaatagtctttcttctgtaactacttcatgctgattggggcacagtccctacctattggggaccatggaactctagcactgctctgtctagtggagatagggtgacttcttgatggccagggcaggcatcatcatctggaactggaagccctgctgcatgatcatttgaagcttaatcgtctctaggtgagaagaaataatctggtaaaaagatgaacaaacatggtccaaaaagtcaatgcaagtataattattaacaatgggctggccaagggaaggagccatgaagcccagcttggtgcccttgaccaggagccctatgatgtggacagctgttgttatattttagaagtcctgtcagctaattttcgagtggcatccctactaatcctgattggttgatataaaaacaacattcttataggaaaagacataagccatctttttgagcagttaggagatccagtctccttctattttgtacagtgactgctgccaaggagtctgtttgattttgtaaggtgacaatactttgggcagtgtcttccaagctgtctggaagatccttggatgagcattggtaataggatagggaagttggaagcctgctaactcctattgctattcctgcagttattcctagccctaccaaaaggggtatgagttggatggctcatttgtgcttggtagttgcagttagaggtataatgagagactggttattgggagctatgttgattttaagggggtaaatatacaagtgtacagcttccaatccagttggctgataaacataagtacaactagttccacacaggagaaaggatctttgttttttaagacaaaaattgttgtctatggtgaacatatgggttagtttgttgttttcattttcccaagtgattaaggtccctgctaaggtggccctggttaaaggctggaaaggaccttgggaagtatcctgagttgccccagcagcatttttccagtggaggtagttgcacttagtgtccaccagcaaccacctagaggtattttcatactggggaaccaaaagacaactagatgtctcaggattagtatggtttttcccaagggaaaatatgaacacagctactgggcctatcttggcagtacttagactgtgtatcctttaaagtgccttgaactaggaatggtttccttgaaaccatacaggtttaccaaatgatgcagtctgggcaactgcatagcttacatgatcatgtgaagggttaatctctagggtgtagctcttaagccaattaattagagctcctttatataacatcacacacacaacacttgtagacaggggaagatctagctgttgttacgtttttctttccctttaatttttttttttttttgagacagagtcttgctctgttgcccaggctggagtacagtggcatgatctcagcccactgcaacctccgcctcctgggttcaagcgattcttgtgcctcagcctcccgagtagctgggactacaggtgcgtaccactatgcctgcctaatttttgtatttttagtagcgacagccatgttggccaggctggtctcaaacttttgacctcagatgatctacccaccttggcctcccaaagtgctgggattacaggcgtgagccactgggcccagcctctttcccactttatgaaccctatcacaacttccacagaccatctatgacgtgcttagattttctgacttgtcctgtatttccctgtttcctaagtaattaagcattctactttaggacaagaatttgccatacaagattctttctcatataaaatttcttttcttcataaccttccttatcataaatacatcttcatagctataactttctttatatctctctttcctactaaagtaatttctgatgcctccaaaagtcaaaaaggtcaggtaatgtgatgcaaaactgagcagagccttagattttgagagggacctgtctgcctacagttcttggggttccatgaggaaaacaggggtttctcctaaaatggggtctgtggcaccttctgtttttcccaaggagtcccaggctcccttaggtcctttcatgggcatcaagagtggcaagaagatagaccagggaaatagtccagtcaactgagaagaaaaacaaaactgttgtaaagatggataaactgaggcacaacgcagtttaaaaattcacgttcacatagagctaggctacgcagctcgctgctcagtcactgatgcacttgtgtggtagctcatggtgtacttcaccaacaggtttcctgccccctcagagcttacaacctgggtttcatttcctgctctacagctatataatttaacagttttcctctcaatgtgttggattctaaccctatatatctcacattttattaatattactgaatcttaaagggagccatgatgtctttaatcctcagaaatattaaacaacctggctgggtgtggtggctcacacctgtaatcccagcactttaggaggccaaggtgggcggatcatgaggtcaggagttcgaggccagtgtggccaacatagtgaaaccccgtctctactaaaaatacaaaaaattagccaggtgtggtggtgtgcatctgtaatcccagttactctggaggctgaggcaggagaattgcttgaacccgggaggtggaggttgcagtgagctgagattgtgccattgcattccagcctgggcaacattatgagattccatttcaagaaaaaaaaaatataaagcaacctgtaaacaaaggagtacatgaggttaaacagtattcaaatttctttatgctttaaaacattgagagagtatattgagaaacacacctaagaaactgcagtcaatctactgtgaacaaaaatttagagaatatctcttcaaaataagctatctagtggtatttatacatattcttacatatatcagcagtgttttacatgcttgtaacgttaaacataattgaaaagtgtcaagattatagggcttatacatttctgtgggcttgaaaatgatgcaatatagattatttgtttctataaagtagtcagtaaaatgtacaaacttctaaacggagtaataactaacaagagagttcatactgaaggtagtaatactaggaacaaaagagggctcaacactgccttcaggagagaaagggtccagattggtatattttctaaaggcttcctccagcctgccataaaacacggctagattttcctccttgccctgtgcaacctcccttactttatcataatttactgccttagttattccctttttcattcctccaaggagagccttaagaaatttggcccagttgttcattcccatgggggtgttatagtcccagttaggatcagtagcggagactgtgtctgggcctgggcaattaccctgagggttttgggcaaataaattgtctgcttctcggcaagtggcctcaaagattcattccttttccaacggggtgcaacaagttgctggaatgaattgaacgtctctctatgagagatgaaaggctaaggtcaaagcttggaacctatctgcaaattttctggggttctctgaatagcttcctagctttttctttacattgttgtatgttatttatggagaaggggacctacactcagaccagcccctcggctcctgctgcttccctaagggatagcagggctatagaggtagttgaatagagtgttcccctctgaatgtgaggggacttagcagggcccttggttttagctcttgggtttgagcctcagaaacacttggcaaggggttatatgggggtggttgccattgcccctgagagacaggtggcccttgcaaaaaggaggtcatccacaatatccggttctgccttagaacctgcccttttgggggcaggttctgggagttttgcagatggttgggttttgatatagggccatgaaggcctgcacatatgggatttctgaccatttacactgccttttgcaaaataggtctaattgcaggatggtgttgtaattaagacttccattgactccccattattcctggctgtctagctaattttggggccatacaatattatggttaaaaaaaatcagatgttttctccttagattgtcagggtcaaattgattccagtggttgagaatgcagccaagtggggaatcaggtggaatggatggagagttgcccatagaggtctggaagaaagaagagaacctagcttatttggtgactcaaattttacctggggcatccccctggaaaaactctgggccttgattggggtcctcaggggtgtccccctttagggccccatcttagtctgtcagatgtctctgaccttagatgggtgatggtaccactttgggaaggttctctccaccactgatgacccactgtgagctttccttttgtccctggatgaaggccttgtcttctagcatccatataatttgataaggccatggtttcctgttccactggagtgatagccatgaactttaataataggaactagaggttggatggatttcttttgtcatgtggattacaggtaatctcaaggggggaaaggtagattttgggcatgaaaaatgaaataatagtgttggctattccactcaggccctcgacaagagagggaatgtttaaaaatccaccaccatgacagtggaccctgtgtaagggcaggccattctataaaaataatctggtgatgacaaaagaaacaagatgtagaatgtattctaaagattgtgggccccaaaagtcctcagcaagttgaatagattgagtaggataagggaagtcaaaacatctaagagatatcctttgccattacaagctaactctttaggagaatttgacataagaaaagagggcttaagttgactgaaacatctgtgagtttgttctggaagagctgccactgccaatttcgtcacatgtagggattagggactttaactaggaaagatagaaaagagtacttccccattctgggcagggcagctatccccattcacttcttggccttcaggtaacaccagagagtggctctggctagttgccctcaattaccaaggatctactaggaaacagcctctgaaagactgaaaaaaagaaaaggactcaggtccctcacccaaaccaggcaatggtggtcaggtgcttccacatggatacctttcagtctcccgggagagtggacctggccagagacctgcagttgccttcatgcttagatgctgtctgtggagggtcccgtgttggaaaagggaaagagagcagaaagggttcccctctgtggagtgtagggagctctgcatggagatagctctagcctgtgccctcaaatgaaggctcaatagagaggaaaagaaaaagagcaaaagcaaagcaaagaaaaataaatccccaaatttgggcttacctcctggctgacttgccaagatatgttaccagtggagggtcttgactacaagttgtccagtttcttggcatattgaacaaagaattggacaaaacgcacaaacaaagcaatagaagacaaaagcatagatgtattgaagcaaaagtatactccacagatcaggagcaggcttgagcaagcagctcaagagccctagttgcaaatcttccggggtttaagtacccattagaggtttcctatcggttacaccctatataaatgaagacttggcccacaaccaatcggaggctgaagtgaaggctcagcccgtgatcaattggaggctgaagtgaaggctcagcctacaaccaatcagaggctgaagttacatcctacgcaaatgaagacttggcccatgaccaatcagaggctgaagtgaaggctgcctgtctccagaccctattctcctgcctaaaaatgggtcaaaactcaaagggttggaaagaacatatcgttggaaaaaaaaaaaaagtctccctcatacccttgttcctttccttcgaggcaaccagtatttatcagatttatgtgtatccttcccagatactttgcgcctgtcctttagataggtatccttggggacacatttagtgggtagggacagtcaatctctatacttttgcttctggcaataattatttgattttaatatctatcactggagtcttaccaaattcatgcactccacattatttctctggagtcttttgctttttgttgatgaaaacagagttaaaaggtttttatttcactaaaatgatctgtgtaaatagggaagtaatgattttaaactatagttcactgttttttgtttttttttttgagaaaagatgattttggcgtgaggagtttgtcagtgtctaacaattctttcctatatttttcctgaaggcgcttgactttggcagatattgagagaatagccccattggctgagggggccttaccttacaacctggcagaacttcagagacaggtatgagtaatctcataaatatgatcaccttaaaaaaatgctgaactagtagactaaataggagctgacagcttctgaatgctgtaaaaattaaaaattactttccagagaaagactttacttagcttaaagattacctttatagaactactgttacccccacttttatagaatatatatatattttttgagatggagtctggctgtgttgcccaggctggagtgcaatggcgtgatctcggcttactgcaacctctgccttctgggttcaagagattctcctgcctcagcctccccgagtaattgggattacaggcgtgcaccaccacaactggctaatttttgtatttttagtagagacaaggttttgccatgttgggcaggctggtcttgaactcgtgacctcaggtgatccacctgcctcggcctcccaaagtgctgggattacaggcatgagccaccacacccagcctatagaatatttttatgagataactagatttatatttgtgttttgttttttgttttgttcagataaggaaaataagagttcaaacatacatgggtttgaccccgttccccttagaattagcattcttttcatttgcctcgtcacatttaaagattagtgttaggtttactttgtatcattaaactgatatttatagggtttctaaaattaaaaaacttccctcaaattaaataaatcattcactgggattgtgccttacagattacagccaggaaaaaaaaagtaattagtgaaaccagaaagaaaaccctgactgttaattacatttttgataaatattacttttggtttttataaatgttaagaatgattaaaacagtagcttctgagtcctataaaattaatacaatcccatttctgattttacaaatactatcttggtaagaaaaagaaaatccatgaaattaccttgaagagtggaatggaacagtttttaataaatctcgttttaagttgaaacttctacttctatagcacttaggaagtttcagtggtagcagatgatcacattgcttttgtgtgtgggtaagggttaggagggccagtcattgtcctcctggtactttcctgctctaatagacatggaacctgtgttcctcataattctctaggagagtgtgatgccatactaggcaaggcgacgtggggagggcatggataaagaagacaggatacagagagagagagagagagagacagttactaaatgtgcatgctatagaaagaggctatgtctgctctttcttcattgctgccacattggtgagtagccagggttggcttgctgttattgttcaccttcaccaaatgtgttaatgaaacatcaagatatgtttaagtgtagttcgctttgggaagacttggttaggaaacctttcttctacttgagctccatggaatgatgattctgcctgtgaaactaattagaatttacagttctactttacataaggaacaagaacattttgtagtcaggttgaagtaaattgaaaatggaaaagaaaccattatatctgcattttgtattaatactttaactgtttgcttgatgtgtaataaagcttcctacagattaaaatatgttgtaactcattgcaatttagcttcttttgtatcagaaaaactcttttatctgctgccatcaaagtttatttccaggctgggtacagtggcttatgcctgtaatgccagcaatttgggagcctgaggcaggcagattgcttgagcccagaagttccagaccagcctgggcaacatggcaaaaccccatctctacaaaaaaaaaatgcaaaaaattagccaggcgtgatggcgtgtgcctgtagtcctagctacttgggaggctgaggagggagaatcacctgagcccaggaagttgaggttgcagtgagcgtgactgtgctactacactccagcttgggcaacagagtgagactctgtcttaaaaaaaaaaagaaaaaagtttatttccattaggaggtctcagatcctttaaaaatagatggatttatttcaattcagtgattttaaaaaaataaaattttataaaattatgtttaataaaaggaaagaatgtgaaaaatttttaataaaattaagagacattgaaatatttaaagagctcttactgaatttaattttattttttgtagcctatacatctgtgaaaatttgctcttgaattttgaaaaattgcatttcaaaagaagatattttgcagtgttgcatgtgtctattgatatagctctccctggaggtttccttaatatttgtaattggggaatatttcatttagcttattaaaaacattgaatttaaaagtctcaactcatttctcctcctcagtttttctgctgcttacttttctattcacccacctctcttgcccctagcaattttcctagaggccatatctgaagcttgttttgcaatctttggcaccctgagtctgcatccttcacatttcttcatccttaggaaagtgatgtaattttgctactgctgtgaattctttttaagacagattcaagatgatttgcctgtcttcagtggcagcgctgatgcttttatgctgggatgggtggcctcaagggtcttgtcagatatttaggaaatgggcagtgataaaaaccaccattttcttcttccctgggtctctgattggtatccagagtgatggggagtgctttctctgcctttccttaaccagtgagatagtacagggatctagaatttctggagagctggtagaagtcttaggtattcttacattgtccccaaaggaagaacctcagagtctcaggacaattttttttttttttgtggagacagggtctcactctgtcagccaggcacaatcactgttcactgcagtcctgacctccccggctcaggtgatccttccacctcagcctcctgaatagctgggactgtaggcatacaccaccatgctcagctaatttgttttcagtagagacagggttaagccatgtttcccaggctggtctcaaactcctaagcttacattaatccactgatcttggcctcccaaagtgctgggattacagtgtgtgtgagccactgcactcagctaaaatgtttgatgtttcctctcacatagaagatagtctttctactgaggattaggtacagagaaataaaaattaaggtcttaagtgtatattttcctgtacattattataggaacaaaatctgagaaaatagaactcaacagaaataataaataattattagaattttatagaaacagatttgtgaaggttaaggattcagattaatgtccactaatggccattgtgaaatctgatctttactgtccttgagatttgatacaagtttatttgggactcagttttccctttaataaagtgagtatcttcatgtatttctgagaagccttcaagctcctgcattctgtagaatggtatgtatcaatggattttattttcagaattctaaatttatcctcctttttcctttgtaacatttaaaattttataaggaatacaggctggactcaagtagaataatatgaaaatatgcttaagttcttatagcaaccaaagtaatggaataaactttcttcaattttcagccttgaaaaaacattcctcagttaacatatttcaggtttatgaggcattgtaaggcagccatatagactacaatcctagtgactcagtttttaacattctttagttcacagaatttcagtaatgctaaccttaactattcccatgttacttccagaagatatcttgatttgattctcttgtaatttttcctatattgccaaattagaagtacataattacttacatttattatgcagagtattcccttatatgaatctattagaaacctaaatataaaataggaagaaggatatatgtcttgttatctcaccttatgaaagttgttatgaaaacacttgtttatgatggagaatctgtgagtccagaactagaagttatgagggagagagtagttaagagcctggccactgattatgtaacatcctctcattctgtttcctcatttattaaatagggacagtatgccaggcacagtggcttgtgcctgtaattccagcactttgagaggccaaggcgggcaggttgttttgagcccaggagtttgagaccagcctgggcaatatgatgaaaccctgtctctaaaaaaacatacaaaaaattagccaggcatggtagtatgcacctgtagtctcagctatttgggagacagaggtgggaggattgcttgagcccaggaatttgaggctgcagtcagctgtgatcacactactgcactccagcctgagtgacagagtgagaccctgtctcaaataaataaataaatagggatagcagtatgcatctttataggattgttatgggaattacatgagtaataatacacttacattaagcctgacacctgctaagcatgcaataaatgttaactgctattattgtgcttattactgttatcaaatatgagaagcccatataagcaaactccaagatgggctgaaacatatatgtgacacaactgcttaatctaccctcatctacttccattaggtagaaggggatgggaagtgaggaaaaagtattaatatatctttgtattttttaagtgcctgaaatgttttatattttaattttttgatgctggctgaaattttaccaggcctgtttttaaaaatttttaattaatgatggatattcaacaaggaaaaaaaatcactaccccataccatacacaaaagtcttttcctgttcctaaatgtgaaagattaaagaggataacacaagatattctatttatgatctggagataggcagagattttgtgaatagtacagaacaccagtcataaagaaaaagattaataagttaaacttcattagatttaagaacttttatcaaaatataccactaagagtgtgaaaagacaagttacacaataggcagagatatttgcaataatttaaataatagaggatctgtatccagaatatatagtataataaacttgtgcaaatttataagcaaaaggcaggcaatgcaatagaaaaattggctaaatacctgaacagaaacctcacaaaagaggatatccaaatggtaaggaaaaataatagaaaagtttaatatcattagtacaagaaaacacacattaaaactgcaatgggatgctattttatactatccagattgatcaaaattatactctgacaatggcaagtgttgttcaagaggtgaaggaatggaaattgctagcatcacaactttggcaactatttgtcagtaccactgcagttgaagaaacacataccccgtgacctgttggttcctctcctgggtgtagtccctaacaaaaatgtttacacatgtgtgttaagagatatgtacaagaaagtttaggccgggcgtggtggctcacacctgtaatcccagcactttgggaagctgaggtgggtggatcacttgaggtcaggagtctaacatgatgaatccccatctctacaaaaaatacaaaaaatttagccaggcatagtggtgcacacctatagtcccagctgctcgagaggctgaggcacgagaattgcttgaacccaggaggtagaggttgcagtgagccaggaatgcgccactgcactttagcctgggcaacagagggagacgctgtctcaaaaaaaaaaaaaaaaaaaaaaaaaaaaagaatgtttatagctgcgttatttgcagttgcaaaaatattggaatctaaatactcaccaacagtagaacggataaatatgttgtgctattaagatgacnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnagcctcccaagcagctgggactacaggcgcccgccactgcgcccggctaattttttgtatttttagtagagacggggtttcaccgttttagccggcatggtctcgatctcctgacctcgtgatccgcctgcctcggcctcccaaagtgctgggattacaggcgtgagccaccgcgcccggcctctttttctttactgtatattacataattacttttttcaactgtatgggataaatgatctgtgatagacctgcttgggtatatatgtacttactttaaaaaagttttgtttctatgggaaattatattaaagctataggccactcactaaaaaaactatggaatataagctggattgtgttctgtcaaaacatcattagaattattaagaattattattttaacttttaagtttgggggtacatgtgaaggtttgttacataggtaaacgtgtcatggggtttttttgtacatattattccatcacccaggtattaagcccagtacccgatagttatcttttctgctcctctcctttctcctccagtcctccctcaagtagaccccagtgtccgttgtttccttctttgtgttcataataagctcttatcacttagctcccacttataagtgagaacatacggtatttggctttctgttcctgtgttagtttgctaaggatggtggcctccagctccatccatgtccctgcaaaagacaggatctcattcttttttatggctgcatattagaattacttttatctttattttgtgtatagcgttccttagacataggactttgttttctttgtgtaatttgcatttctgtggaccttctttgaattttggattcatgagcacatataggaagacattactgtccatttaggaattcctttttttggaacattttacctctttcacctgtgatattttaccacaaatggaagtctgttctcaaaaagaaagttaggtttatttattagtctattattagctattatttattagtcatttaactcatttaaatttaactcatttaaattattagatttgaagacttaactatagtctttaacacaacttaactccctttttgctgagagaaaaatatgtattgtttagcattcaggggaaaattatatatatattaatatatataatatataataagtattatatattatatattattatgtatataacataattatatacttatataattatataatatatattatatataatatattatatataatataaatacatatataataatatatataattatatattatgtattatatataattataattctatattatgtattatatattatgtaaatatataatgtatacattatatatattagtatatattatatacatatataatatgtattatatattatatattaatatataatacgtattatacatatataatacgtattatatatcatatattttatatttatatataatatgtattatatattatatatatattttatgtatatatatatttttccttcatctccttctcctatactgtcatggctttaggttttaatcttactttttaaggccaagaatattgaattcaaatcccagactattgaagtcatagatgtagtttgcagacagaaaaattttgttttgttttctctagccttattttgccattccagtcatacatttttgtttttatagaatctagccttttttcccccttccaatgcttgatataaaaactttagctatttctcccttttattctacccattaatagtgtgtcatttgaaagaggtagttctccctattgagttggcagtgtggtttgggcaggtttgacttgttaactgacataatcttgccttatctaatgcatcatcactgctcactgcagcctcaacctcccaggctcaagtgatccttccacttcagcctctcaagtagctgggaccacaggcatgtactaccatgcctggctaacttttgtatttgttgtagagatggagttttaccatgttgcccaggctggtcttgaactcttgggctcaagtgatcttgcctgcctcagcctcccaaagtgctgggattactgctatgagccacctcactagacctaattctcacttacaaaatgagatacgtataacaaaaaaatgaagagaacatctctttaaatgaggtctcaacttatttcctatcatacacatatgcttagggagtaggttaaaaatcatttaagattctcaactcttgttttgaaaaacacttaattaaccttgttaaatatcaaactttacgaccataatcataaccttaagggaaagagcgtcttttcctttggcccatttgctcacggcaggcaatcttcttagtgctgagtgttttccttcagcctaaatgctaaaaattcaggacacagtcattaatagggatgacagcggtagcatttcatttatgaatattcatgaagtgaaatccatagcattaattacattaatttacatacctgaatacaagtgagccataagtgataactaagccttaaaaaaatgttgctaaccatatattgtatgttttcttttaaatgttatttaataagggtgaaggtgacatttctgtcaaaaggcatttgggtatttatagttagaaatgtttttagcaaagaattaaagcacagtataatccttcagttttcataggattttgtagggcttataaacattctttaaaggaagaaagtatacagaaaaatatatgcagttgaatacaggagaaaccttttatatgaataagggtattagtggttacttgatgcttatttaggatcataggctttttattctgtgagttttaattcaacatattcttttgaaaggatacatgattgaaaataattcataatctatgagaatgaaatttattttcatccagttttgtgattgagaaactctaagtgggggaaataacattctacatacatttttttttttttttttttttttgaggcagagtcttgctctgtcactcaggctggagtgcagtgatgtgatctcagctcacagcaacctccacctccaggtccaagtgatgctcccacttcagcctcccaagtagctgggattataggcacctgccactatacctgactaatttttgtatttttagtagagagagggtttcaccatgttggccaagctggtcttgaactcctgaactcaagtgatccgcccaccttggcctcccaaaatgctcagattacaggtatgagccactgtgctggcccagtgcatttttaaagaagttaaaaacgtatgccaatgtgtttagtaggtagcataatagctatattgattttaaaatgtgagctaaaatgcctgtctttgtttggactcctattacaaattaccataggtggtttagatagcaaacatttatttctcatagttctagaggctagaaagtacaagatcaaggtgctggccgattcagttactggtgagggccctattcctagtctgtagacagcaggctgcttgttatatccttgttataagagggagagatagagggaggtcgtctttcttgtgtcttttcttataatggcactaatcctatcatgagggctccattttcatgacctaattaccacccaaagttgctaccttcacatcacatacaatcacattgggcagtagggtctcaacacatgaattttggggagtcacaagcagtgaatctgtagcaatgccataacttgaattccttcaaagtatatgagattaaatatcatcattgccttgaaaggacagattgtgtatatgttttcaactgttgtctttgaaacaaagtatcagaattaactggttaatcaacattttagaaactcattgaagcatattcagttaattatactgaagcatattcaatatagtgggccctccatctgcttgagtttcatgtccttggattcagccaactgtggatggaaaatatttgggaaaaaacaaacaataaaaaataacactacaacaataaaaaaatacaaaatttaaaaatacagtataacaactatttacatcttatttaccttatattaggtattagaagtaatgtagagatgatttaaagaatacaagaggatgtgcataggttatgtgaaaatactacactattttagataagggacatgagcatccatggattttggtatttgaaagtagtatcaggaatatttttgtgccaggtgaggtggcttatgcctgtaatcccagcactttgggaggttgaggtgggagaatagcttgagctcaagagtttgagaccagcctgggcaacataaacagaccccatctctacaaaaaatttaaaaattagctgggcatggtggcatgcacctgtagtcctagctacttcggaggctgagtcgttgggatggcctgaacctgggaatttgaggctgcggtgagccatgtttgtgccactgcattccagcctaggcatcagagtgaaaccctgtctccaaaaaaaaaaaaaaaaaaaaggaatatttttgcattaattaataagtgaaatataaaattacttagaaatatttatctcattctataatttctatttttgtatatactttaaaatacatcttatgtgtaattttataatgtatattaagtttatgtatatataattaagacgttggcaaatatgtgaactttttatttagtttattctgtcatttcatactgtttacatagtatagaaggtcttttcatagtgaaaatattaaagaacaagactgacacactagtatagacaagttatcttagatcctttctttatgctgtgggatacctgtgaaataacatctggtggaatttttctcttttttattattatagatttttatgttagaactgtggcagtagtcattagagatggtagattatgatcaatattctctgatttaagaatcaagttaatttttatacactttagaaagctttttaaattttaagttagttaaagaaggaaaaaaattttataactgaaatgcttgtttacctgaaagattcacttctgtaaactgatagtgtattcccccaacagtagcagataaatgaggcattaataggcttgtaaaaattggggtaagtgggaagctactgtgtatttggcctaacatggtttttaaatgctgacaatagagttatctatttttaaatacattgctttcatttttggctgcatgaatatcctattttcttcttttagaaaagatattactgcattaacaatatcacttttaggttttgttttttcttgtcttaaaatagtcaaattgtagctttttcacttgctgtgtgcgctttcaagatttttttttacccgttttcttctctgcagcagtctcctgggttaggcaggcctatctggctccagattgccgagtctgcttacagattcactctgggctcagttgctggaggtgagtgacatgtctgtgtgctgtttgaggcttgtgttaatgtaatattatctcaccagactgaggcagatcagcaaaggtgcagttcattgttcccatgggtcacgacttcagggctttctgaagtgttctttatttttacctatgatcaggagacttgtcgtagcaatggctatgaccatctggctccagtctgtcttcaggacagaacctctgtaatgatgtgaaagtctgggatgcagtgctgcactcaccttaattatactggctaaggccagtatgaaaaaatggaaaatgagactgtgtttatgggacaggttaagaaattgagattcgctattatccttagcaaactaacgcaggaacagaaaaccaaataccacatgttctcatttataagtgggaactaaataggagcttattatgaacacaaagaaggaaacaacagacactggggtctacttgtgggggagggtggcaggaaggaggggagcagaaaaaatgactgttggatgctgggattaatacctgggcgatgaaatatgtacaacaaacgcccgtgacacgtgtttacctatgtgacaaaccttcatatataccccacacctaaaataaaactaaaaaaaaaaagaaagaaattgagatttgggatatgaatcccagaacctcgtgaaataaaagagcctctcaaagtgacccagttttgcttttctgcttgtatgttttcctttcccttatcgcttgcttaacaatatctggacttgatgtttatttgcaaaaatgaacctcccttccctccctgttcacagccaaaatttgagagactgtttttgcttaaatactctacttagaaaatgtgtacaatctgaagttgctttgttgagaagaagctagcaggtgtgattaaaatgcttacgattttttaagataagcctgaactcaaaagacttttttttttcttttcactctcagttttagaagttgcaaaccaggttttggctttcagcagtcaaaatgtgtaatactctcgttcatgtaaataaattttcattccctgagaaattctaaagcatagccatattttcttttaaaccaaattctatacatagggataggataatgttgaagtgtgtttctaatattatggttgtaactatgattaatttaccaagatgctttattaaactaaattttaaaatcgtagccacctagtgtacggatatagtcattttaagaagtaactggcataatatttaagcatttaatggaaaatataaataaatgttatacataatagtttaatgttgttactatagaaaactgagtgttgattatctaatttgggaagtgactcgataatccactctgtagtttatgaacctacgatatcaaagagcattcttgacagttgttttctgaagcagctgtatttatggatttcagtgcttgctatagcctgctatccctaaggtgtttgtgagggaaagaaaaataataaactctcttttgtgagaatacatgttgtgttttattttctcatcctttaagataagatttgtcatccttatggactctccatttaattgtgttcttttttaagcctaaaaattgttctgtttgtagctgtgggagccactgcagtgtatcctatagatctggtgaagacccgaatgcaaaaccagcgtggctctggctctgttgttggggagctaatgtacaaaaacagctttgactgttttaagaaagtcttgcgttatgagggcttctttggactctacaggggtgagtaagcaaatcccagctgctgaagttagtgatttgatctcaccagcagcagattttaactcactaattatggaagccaatatgtagtatgcctagccagactaggtctgtttctctctttttattttctctttgctcatttccctttttgcattctttctggtgattagcaatattaatctgcaaataaggtcttcatttcttcttcttgtggtttatatttcttggtgtccaaattatgtgtttgtcccaacatgggtctatgtcaccatgctcctacaaaccaaggcacatatctgcaggtggaatacaaggatgatagttaagaaatatagagctgcttttctcaaagaattaaagaggagaaatacatctctttcctgtgaaaaagaatccaggttaccactcaaagatgagtttaccctccatatatttatttcaactgaaataaatatcaaatgtttttgtctctttcagggaccatttataaattttttccaatgagccatctgaaggtttaaaaaaaaaaaaaaaaaaggaaaaccctttggttccaagtctaattcttgcttctttcccccacttagctcagaggtgtacagtcaaaacagagagattttctttcgcagggaatgttagcagccactctagactgagcacagtgcagttggcatcagaggcagcactgcgccccatgcagaattttccccaccccccgttgtctttgtaggaacttgtctctttggagagagaatgactttcatgtatgtgttttcacattagaatatagggtttcctttgggagggagattaattttttaatctctttgggcgccacttgggattctatgaaaatactctctacatgctcaagtccatgccatttatgtaatttactgtacttgtttgtttgcacatacaagctcattaatccctagcctattctgagctctgttgaactatttggcttagaaatcttcctaagaaagactgggcccgaacaaagctttatgctcatggacaggaggaaaaaaacaccgctggttagcattatatacaggtattcaagcaaaaaatataactccgataaactcataattgaagtagagggtcacaaggatgttcatttttagcattatatatagaataataggagagagttatcccgaaatcaaactaggctcaagtaccctgctcttgagaatgaatgtgatgagttttcctcaaatattcagaattgtagtctctttgaattccacctgtacagcatgtaccctgtggaaaggcgtacaatatccagaatgcagacctttccatgtgaatgcttgttttaactgattaaaccctgcatatccagattttatttaatggggaatcaaggttgagtggcattaaggttgtttttttccttgatatctccaatatttctttgttgaataatgacctttctcctctttggtatacttttaaattgcaaagaaaatgtcccctattaaaaggaacctagatatttactgcatagtttagccttctcaatggatagatgcttacagaagatttcatttgagagagatgtcatgtttattaaatggatgcaatatagcaagtaggggaggggattgttggttttattcaggatgtaagctcataaaagcagttctttaaatgagagacttttgtattagggagaagattgtaggagtcctgtatgtgagcactatgattattgagattgtcatatattgcttgcaactggtccattattctgtcagatgattgacaaaattgttgacagattagctaaatttcttcgcaggcaacaatgataaaatgacacaaatcagtactttattaaattccatgagccttattgaggcgagttgtaaaacaaatatgcatgctgacatggttgtatgggagttagattaaaagtaatagagcctgataatcacgagggttagaaagttaatactgccatctgctgatttgttcttttaaatcagtctgctacgcatgaaaggtgtgtgaggctttgtgtgtatcattgataattcagcctgactgacagtagcctatatgtatgattacttgtggctctcaacttatggaactcagcagtatcctcaaagcaggcttaagatcagcagtcagcaagcaggcaaacacatatataactcccctttggctggatgatttaaaggatataaaatgtttattgttagcatctttaaaaaatgtatgcaaaaaagtatgctaacaatttggataagctgtgtgctttagaaagctgagcccaacagatgttgaattgtttatttttttcttttccagtttacaaccagcctggggaatttaactttctaaggattatgatttcctttgttttgaggggattcttttaaaatgtcttaagcttgacatatattagtcaataagaatacaacaggcatatgtttttgcttataggagatactcgttaaacaatacttaaaactgcatttttctttgcagttttggcttccttttaaataaatgaatattgaatgctgtgtttctctgaagagaagattatgggagttagtattctataataacgaagccactgtatgccattatgtaggtagcaaaatctggggtatgcttaacagcatgcttttcagagcttttccaagtgtacagtatctgtgtatgtttatatgttgttggttgtaataagggagggaatttggttacattgttattggcagtgttcccagaatagagaagacgcatggctccgtttcttcttcatggactttttgggaagtgttggataactaggctttaaagtaagcatgcttaagaagaggatttatagcctcaagaaaacgtgacattatactgcatttgtaaataattattacatatgtatacagagttttaaggataatctttttcccattttaatgaaaactctgcaatgtttgatgggtaaataatatgggggaaactctttgttgctgggcttgtgtattcatgtctggtacagctatattgctgatgattctgtccctttacctaggtctgataccacaacttataggggttgctccagaaaaggccattaaactgactgtaagtttatctctaactgaatttatgtcatttgtttagattaccattaagccaaaaagctaaaatcaaggctaggcgtggtagctcatgcctataatctcagcattttgggtggtgggaggatcacttgagaccagttctaaaccagcataagcatagtaagaactcagctctaccaaaacaacaacaacaacaacaaaattaaaaattagccaagtgtggtgatttatgccaggaggctgatgtgggaggattgcttgagtccaggaatttgaggctgtagtgagctatgatcatgccactgcactccagcctgagcaacagagtgagaccctgtctcaaaaacaaaactaaaattgatgctgctgacactggcacactgtcgcagaatttgtacaactttaattttacatgtaagcatttgataattttaaattttatcataagacaaatattttgctgacttggaaaagcaacagtatgccagaagagaaatggttgggaattttggttaactgatgttgtctttctaattaggttaatgattttgttcgggacaaatttaccagaagagatggctctgttccacttccagcagaagttcttgctggaggctgtgtaagtattactgttaggcgcttcttgtgacaaatacattccgttgacctttttgcacagatataatagatatcttagtggcatttctcttgaactcaagggattctaagcaggttttctcaataatcatatggaataagttttaaattttattgtaaaagctaacgggttttgagtgtagaaaagaggtagcattttccgccagttagaatggtgatcattaaaaagtcaggaaacaacagatgctggagaggatgtggagaaataggaaccattttacactgttggtgggagtgtgaattagttcaaccattgtggaagacagtgtggcaattcctcaaggatctagaactagaaataccatttgacccagcaatcccattactgagtatatacccaaaggattataaatcattctactataaagacacatgcacacatatgtttattgtggcactattcacaatagcaaagacttggaaccaacccaaatgcccatcagtgacagactggattaagaaaatttggcacatatacaccatggaataatatgcagccataaaaaaggatgagttcctgtcctttgcagggacatggatgaagctgcaaaccatcattctcagcaaactgtcacaaggacagaaaaccaaacaccacatgttctcactcataggtgggaattgaacaatgagaacacctggacacagggcagggagcatcacacactggggcctgtcatggggttgggggttgggggttgggggagagatagcagtaggagaaatacctaatgtaaatgatgagttgatgggtgcagcaaaccaacatggcacatgtatacctatgtatcaaacctgcacattgtgcacatgtaccctaaaacttaaagtataataacaaaaaaagaggtggcattttcatcagctctatctctttgatgctcctaaagcattaccttccagacttttttaaaagttctaattcctatgccttttaagaaatagagtacagaaaatatagtagtggatagagttaccattcatatatgttaactggaactttaaaacaagtgtgagatggctgattaattgggcccttatatcttaggtataggactgagtaagccattgtttaataataatttttcttctttagaggccagagggtatggcaaacaataataacggtaactacatttcagctattgacagaaattctgaaccaagagactcagatatttacttagcgcacaaaggtttctgtctttaaagtgtaagcatgacatgattattggcaaacaataataacggtaactacatttcagctattgacagaaattctgaaccaagagactcagatatttacttagcgcacaaaggtttctgtctttaaagtgtaagcatgaccaattcttaaatctatttgcagctcaactaatttcatttgtggtatttgtttcatatttgataacacatggttcgtttcagacttgtttagtccattttgttcttggaaacattaataacttccagttgaattggctgacagtcttggctaaaacttcctcagttgcttgtgaaacctgaagtgatgaggtcagtgaccttggcaacatttaattcagagacactgcctcgggggtcagagagagagagaggttgctccaggttctctttgatatgtgtcagtgtggcacatacctgagtcctctgcagagttgctttggaagaggtggactgctgtgtgggtgtgtgtgtgcctgtatgcatgccccagcacattctcaggaaggaaatctctttggctacatttcttttttaatgaagagttaacagtggacatagaataaaacttttgcttaggtggatcaccaaaaatgaagtttctcttcttcctttattccaattagattctgtaattggttcttatctagagagcgaacctttgccaatcataaatattctttttcttggtcattttaagtttctgtttggttaagaagctttctaactcatttttatcacagcacatgcatacctttgccagaaatataagtcatgctctttctgttccatgtagctaattatttgtttccatttgcaatatccaggtttttggtcatgaagctgacctgtttccatgtctgacatgtgacctaagtggttaaaccaaaataagatgtttagttcctttgttcttcctagctaccgaccctgtttataggtttgaactttaggaatttctattgaagtctgggttgccttgagggttgtgctgacactctaaatctcttccttaatcatgactcatttctggaggctttgatggattgtctagtgggaaattgacagcatgaaaaatagtcaggttggactctaggcagaatgataaggttgtctgcagttcttcaccacaaacgttttctgcttcccccttgctctaaatctcttctttcagggaagaagaaaaaagtgcaattattgagtttctactgacaaattcagttatgctatgctataaatgattgttaaaacataattcactgtttctccccaaagtctataaatttcaacagagaataaagtcttaaaaagaatgagtctctctttatagaatatcaggctgtatgggacataggatactccatttcctaaatgatacctggcaaacagccaccagattaacactgtgaagagtggctgtctgtgagcctgaccctgagtcttcatcatcctgagtagtggtggtgatacgatgtacggtgtccttatggcttttggctgagtgctgtcagtgccactagtgagaagaatgctgctgttcttccaaaaattacccaattttaaagatgcacctaatgcattaacctattgcaggttaattaggaagaaatggctcaaattgagttctaggctttttttcccagaggaaggattagctaggacctaggccttgagttccctatagatgagagggaaattttattgccatggaaatgacaatattcccttttaggaaaaatggtgtgtgttgactagatcatgaagtgacctagaagtgaaaatctctagtccttgggcattatatattttgttgttgttgtatgttttgttttattatctggtttgtttttgttttcgtttttgttttgagatggagttttgctcttgttatccaggctggaatgcaatggcacgatctcggcccaccgcagcctccacctcccaggttaatgcgattctcctgcctcagcctccctagtagctgagattacaggcatgtgccactgcacccggctaattttgtatttttagtagagctggggtttctccatgttaggctggtctcgaactcccgacctcaggtgatccaccggcctcggcctcccaaagtgctgggattacgggcgtgagccaccacacccggtctttatgatctgtttttaaaggcatgtgatttttgtttttttgtttgtttgtttttcttcttttttgagacaggatctcagtctgttgcccaggctggagtggcgtggtgcgatctcagctcactgcagccttgacaactcctgggctcaagggctcctcccatctctcagcctccccagtagctgggactacaggtgcatgccaccatcctctgctaatttttgtattttttgtagagatggggtttcatcatgttgcccaggctggtctcgaattcctgggctcaagcaacccacctgccttggcctcctagttttgggattacaggtgtgagtcaccaggctggccaaggcctgtgatttttgatacatgcaaaagaatacaaacaatataattacagaataataaaatgagcatccatgcttctagcacccaacttaactaaaacgttactactattgttgatgatgattattgcttttgatgtagcttgaatcagctaatgaggaatagatacctttcttactgggctgaacattttatagggattatctcattattgttcccaactagagttgaaaaaactaaaaccttagtgaaatccaaattttgacttagtaaatatcaaaattgtggttcaaaccacttctatctccaaatccatattctttcacacttgatataggttttcatttgttctttcatatattcacttactcattgaatacctgatatctttcatgcaaattttaaaaataccacctttaggccgggggcggtggctcacgcctgtaatcccagtactttgggaggccgaagcaagtggatcacctgaggtcaggagttcgagaccagcctggccaacatagtgaaaccccgtctctactgaaaatacaaaaaaattagccaggtgaagtggcgcgttcctacagtcccagctacttgggaggctgaggtaggagaatcgcttgaacccaggaggtggaggttgcagtgagctgtgatcgtgccactgcactccagcttgggcaacagagtgagactctgtctcaaaaaaaaaaacaaaaaacaaaacaaaacaaaaaaacagaaaaaataacagctttattgagatatacttaacgtaccatacaactcccccatttaatgtgtataattcagtgttttgttgtgaaaccatcaccacaatcaattttagaacatttttatcaacacagaaagaaatgcagtaccttttagctatcacttctcaatcttcccatcccatccgtaagatctaggcaactgtattgcccaggcaggagtgcagtggtgcgatcaaggctcacagcaaccttgaactgccggctcaggcaatcctcccacctcagcttcatgagtagctaggactgcaggtgtgtgccaccaccctcagctaatttttaagtttttcatagagacagggtcttacttggccaggctggccttgagctcctggcctcaagcaatccttctgcctcctcctcccaaagtactagagttacagatacgagccactgcacttggcctctaggcaactattaatatactttctgtttttacaaattcaccaattctgaatattttatataaatggaggctgggcgtggtggctcatgcttataattccagcactttgggaggctgaggtgtgtggatcacttgaggtcaggagtttgagaccagcctggccaacatggtgtgaaaccccatctttataaaaaatgcaaaaattagccaggcgtggtggcaggtgcttttaatcctggctacttgggaggctgaggcaggagaatcacttgagcctgggaggcggaggttgcaatgagcagagattgtgcccactgcactccagcctgggcaacagagagagactctgtctcaaaataaataaataaataaataaggaatcatgatatgtggccttttgtaagcatgacattgtgcctaacttttttcacttagcgtgttttcaaggttcatctgtgttgtagcatgtatcagtacttaattcatttttattgctgaatatatggatatactacagtttgttcattcattagttgataaacatttgagttgtttctaccttttgacttatgaataatgctgctatgaatattggtatataaggttttgcatggacatgttttcatttctcttgggtatatacgtatgagtggaattggtgtgtcatatgacaactgtaattagcattttcaggactgccagactgtttttcaaagtggctacatccttttgcatccctactagtagtgtgaagcttctgatttctctacatctttgctagtatgtgtgtgcgcgcgtgtgtgtgtgtgtgtgtgtgtatttttttaaataatggtagcgtctcactatgttgcccaagctgagagtgcagtgactgttcacaggtgtgaacatcacatgctacagcctcgaactcctggcctcaagtgatcttcctgccccatcctcctgagtagctgggactacaggcatgtgccatcatgcacagctactttccacatctttgataacacttcttattgtctttttactatagccatcttactgagtgaaaagtgataccttattgtggcctaatgactgacaatgttgagcatctttttgtgtgcatattgaccacttgtatatcttctttgaaaaaatgtctattcagaatttttgcctatttttaaattggattgttttttggttacagagttctttgtatattctagatatgagtcccttttcagatattttttattttcttgatgatgtcttttgaagaattgggctttaatgaagttcgtttaatctattttttcttttgttgtttgtgcttttggtgttatatctaagaagtcattaatccaagatcatgaaagatgtatgccttttttttctggtatatagaaattgactttatatgtatgcctccttttttcttttcagagttttatagttttagcttttacatctaggtcttttccgatttttaagcctaagttttttaggttttttttttttgccttgaacagagagagatattactaaatgtcagttttgttttagttttgattgctaatgttttggtgtatttccttctaatgttttcatatacatgtgtacatgctcttatgcatagacatatgtgtgcacatgtgtacacacacacacacacacactttttaaaaccagatggaagttttgttgactctgacttcctgattggaaatgcaagcaactctcacttactacaggaaagagggagtcacagtggaatgtcttattttagaagtagtatataacctttgggaatagtagtataaacagattgtgcattttcagatttttatttttatttttattttttcgagacagagtctcgcactgtcgcccaggctggagtgcagtagcgtgatcttggctcactgcaagctccgcttcccgggttcacgccattctcctgcctcagcctcccgagtagttgggactacaggcacccgccaccaggcctggctaattttttgtatttttagtagagacggggtttcaccgtgttagccaggatggtctcgatcttctgacctcgtgatccacccgcttcagcctcccaaagtgctgggattacaggtgtgagccacagtgcctggcccattttcagatttttaaatctcattgtgaacattaaccaaacttgtgttttgtatctatatcaaaatcttctcaaacaaacttactcattcagaatttatgataacttggatgtgctatcccaacatgttttttgtttatttgtttgtagtatctataaattgaactctaggttaaattgcctgaccttggctaggtgtggtggctcatgactgtaacctccacactttggaaggctgaggtgggaagatggcttgagcctaggagttcaaggccagcttgtgcaacatagtgggaccccccatctctacaaataataataattttttaaaattgcttgacccttttttaggtggagatggggtaagattgtatgtgtgtgtatacagttgctcagtaaatatctcttatgaatgttgagtgttgtatgagtattaaatatgtaacagtaggttttaaataatttttcctgttattctcataggtaaaccattcttatcagaccatatgtttatttttctattagaaaatttctgtctttctgtacacacacacacacacacacacacacacacacacacacagatccagatattcctcgacttacaatgaggttacattgtaataaacctatcatgagttggaaatttttaggtcaacagtgcacttaatacacctaaccttctgaatgtcatagcttagcctatcctacctaaaacatgctcagaacacttatgttagcctataattgggcaaaatcataaaacacaaagcctgttttataatacagtattggatatctcatgtaatttattgaatactgtactgaaagtgaaaaacaggctgtatgagtacttgaagtattgtttctactgaatgcatattgcttttgcaccattgtaaagtcaaaaaaccataagttgtatcattgttaagttggggaccacctgtatatatgtgtttatatataatatttatatgtacaaatgtatgtttattcgaagacacaaatataattgaatgtttgattatgatatctattgtgggcaaaaatagtaccttaatgtcaacctagaattttcaaagtacattattatgcattattgtcaccctctataaaataggtagatgagaaacagaagtccaaaaaggctaactctcttaccccaatttacacagctaatatatgctggaggtttcatgtgaacccaagtattctgatttttttagaccaagtccttttattctatgatgtccttttgggggaatcaaatcattgattgtgtcaaaataaatctagatgaccctattcaactttatagtgactttcttgcctctttccttccttcctttaataagtgtatgaatatgacatatttacatatttggttttttaggtataattaacatttttaaaaggaacagattttagatattcagctcaatgagttttgacagttgtatacacccatgtaatcaccacctaagataatgaacatttcaccccagaaaagtcgttcatgcgtctttccattcagtcccttctcccttaccccatgcaaccacacttctgatttctgtctgaagttttgttgttcttggatttcatgtaaatggagtgcacgagatgcattctttcatggctggcttcttttgtttaacatgttttcagagagtcatccttgtgtgggtatcaggtttgtgtttgttttaaattttgctgagtagtatttcatcgtacgaatttaccacaatttgtttatccatttttctcttgatggatgtttgggtttttgtctgttacaaataaggttgctgtaaacattcttgtacaaatctttttgtcaaccaatattttcatttttcttgggtatctaagaatagaatagagtcgatgtatattcaatttaaaataaactgccagttagttcttagaagtggatggatcattttatagtctcctaagcagtgtacaagtattccagttgttccacatcttcactaatgtttgatatctgtagtgtttttgatagtaatcattgtaggtatgtgaaatagtatcttattgtggtttaaatttgcattcttctgattcctaaagatgttgattatcttttcatgtgtttattggctattcgtatatgtgtgtgtgtgtgtgtgtgtgtgtgtgaagtatctgttcaagtcttttgcgtacattttattaggtttcatattttttactaattgtaaaagttgtttatacatcatggatacagccctttgtcaaacagatgtgttgtggatatttttttgccagtttgtgacttgtttattacttttattaatgatgtttatagtagtttttaaagaaaaagtaattatgtagttttttggatagatccagaaacttaagggagaataaatttaaatatcttttcaaattaacaaagcagaatattaaaaaatctaaatggactaacctttaggtactttctaatggtctctttggtaagtacctgttcttttttaattgttaaactcgaatcagagattagtgataaacttacctagctgactgcattacctctttcagagagtatatactcctgagtggatggaagtcatgaaactcaaaacttattactcagcaaagtgctaatgttgcaggtgaattttcacaaccctatgcgaacacactttctggagaacacgttctttccctttgtgtcttgctttcagtctgcatagtgctctcaaatgagttagtagtgcacaagacctcggtgaggcagagagcatggttgtgggaatggaatggttatgccgaatgcaaaatctatgacgatctaggtcagtagtcttccaaacctagaatctttcaactctcccatgctttttctcagcttaagcatgtgtctacacacaccacatacacacaccctcccttcatatcggtaaagcaaaaagcccacatgttaggcggagcatttactaatcctgggggccaagatctgtaactagccagctccttatgatgaagaattctatgtcttcctcagcaagccaagcttgtatatctctaaagagtagtttggaaacagctcttccacctctcatccccaggaattagtgtagtccaactttatgcctacatacttatgtgaacacatatagatatgcatacaagttgaaaatccttatatatttatgtcaaaagtggcttatgataggtacacagggattttcattcttgctgtcttagttcattttggctgctattaaaaaataccttcgatggagtaatttataaacaacagaaatttattgctcacaattctggaggctggaagttcaagatcaaggtaccagcagattcagtgtctggtgagggagggcttgctctctgcttccaagatggcaccttgctgctgtgtgcttgcatgtaccttgctgctgtgtgcttgcatgtaccttgctgctgtgtgcttgcatggtaggagagacaaggcagctcccttcaacctcatttataagggcactaatcccattcactagggcagaaccatcatgacttaatcacctcccaaaaggccctacttcttaatactataatgttggatattagttccaacatatgcattgtggggaaacaccaatattcggatcatagcacttcccttaccctagttaggagtatatgtagtgttaatttgtaacaccctcgcatatatcatcactcagcaatgagcacattgcatttatttcttttaaactatcactatcctattttagaaagaaccatagcatttcctattgctttacaaaaatatgaacggttggtggtgtgcaaggctgagtcactgtctgttcctgttcctcttgagtcagtcctagtgacagctagttctgtgacttttactgtttatctggttattttatacgcacatactgtgttcatctggagttgatgtgaccttaaataaattgaagttagattttcatcagtctcgataagggaagactttataatgagttgcttagattggatattttgtggttggagggaaatcatttcaatctataggagacaacagatcaaagaaggaaataaacaaaggacttggcacaagcagggcccagcctccaacctctttgtgaaccttgccccaggggtaggattgagagggcagaaggttgaataggcctaatcctgtatacagcccctcggcctttggcactgtggaggcatggtgacatctcaaaattacatccttttccccgctaacttttgctgtcagctttagttgattttctcattaaaaaattcatatgatataagattaaatggaagttttttattctttccatttctgttatatatgggtaaccctcattcaaaatgagatttgttcccttttatgtatcttttaaactcagttctagaacaaagaaatgacaacagaatactgaaaaatagaaagcatctaagtctgttttagtattaatgtttgtatctcttttaaaaaataggcgggaaatttaagcaattagagaattagaagctaattttggtgatttcatgagtgaaaaaaattcagcaaaggtatgatatagagtggtatgttatctaatgtaagcattagtaacagaagcagcaagatgccaaatttagcaatgtccatttacatttatatagctgtgtatcattgtgatttaatttaaaattttatatatcttagtgtcgattatttcaggtcactagctatatttgattaggttttttgatgttcatatataataagctttttaaaaaaccttgggtccacagtaactaacgccaaccagtttaaaaaatatatttgccaaattaccaaatttaccatgaagaagaatatgcgagagaagacttagtctataaagaagccattgtttctaagaccaggtctgtttcttgttgttgttgcgtagttaatacattcatatgttttgaaatttaaaaggtacaatagagtatgctatgaaaattatttctcccagctattcagtttctctttccaggaggcaatcaatgttttaatctttaagccacttgggttttgagaaacttaggtaaattttgacatatttatgatcaaatgtgtgcctaatattttatgttctgtttttgtcatttggcgtgattttattatcaaatcatattgcccaattaatagcatagaattgtatctacttagctgttttattgggaatttgaatttcttcctgttcaattttgctgctattaaaaatagcaaacattagcatatttgtagaaatacaggtactattttttattgaaaagttactgtatttatgaaattctctatattaaagattatatttactgcaagcagtgcttttcccctttggaaagctgttattaatgatatcatttataatcaatagagtcttagaagaaatatggtatttctctgtatttgtttcgcagagaggaaacacccagttcaagagtttgataacatcatagtccctcattctgagttgcttgatttattaccagtataattgaactaatctcagattttactcccccttccctatccccagtttaatatgtaggatagagagagtggtcaacctcagaatccgaaaaagaacagtgcatatttgccatgtgtgtttccctttaagcattataaacatccagagttttagacaaattattacgttggtacaaaagtaactgcggtttttgcagtctttatctttgctaaaattattcagcgtttctggaaagtatttgccttatgttcctaggcctatcatgaggttttaaaaatgtatactaattactaaaaaaaaaaaaattttaagagataggggtcttgctccattgcccaggctggccttgaactcctgggctcaagtaatcctcctgcctcagtcttgtgagcagctgggactacaggcatgtgtcattgcacttggcttgtatgttaatttttaaaacatatacaaatcattaattgtcagaagttttcctccttcaaacataggcatgaaacaaacttacagatgtgtgccttgctatagtgtcattgattatttgcactcttacttgctagattatatgtgtttataaatgcacatcaattgagttttgtggttatgtcctgtgcgttgttgggatttggtatgtgtgctaggtaactaatcttcaaagcatacaacaattaaggtgtatgtatttttaaaatgtagtcccagctgggtgcagtggctcacgcctgtaatcttagcattttggaaggccaaggcgagtggatcgcttgagcctagcagttcgagatcagcctgggcaacatggtaagacccccatctctacaaaaaatacaaaaattagctgggcgtggtggtgcacgcttgtagtcccagctactcgggaagctgaggtgggaggatcacctgaacctggggaggttgaggttgcagtgagctgttcctgccactgcactccagcctgggtgacagagtgaggccctgtctcaaacaaacaaacacaaacaaaatgtagtcagttatttctttttattgtaccatttttgtaaagtttcagtagaaagcctattacttgtatacttcaaaaaatttgaagcattgttaaaggagtataaatctcaatcaattatttctaaaagagagaaggaagaggaggaggcagctgtggggtgggggtgggggacacggattggagtactcctgcccagcaggatgttataatttactaatgattacaaacatgaaagaccttagtatttatttaaacataatgtccacatttaacacttggcacccagggactgacactgtctggtagtggcaaatttgggggaattagaataaaaatttgtggttctattcatttttaaatctgctttagttaaaacataaagcagatatgcaaccattatttaagatagtctttgcaaccattatttaaacaagagatttcagggaagtagtaaactttttcaattgatttggtctttaatactagctacaggagcaattacttggattatcattttaacataatttttcatgcagcaatccttttgaaagtattgtttgcttagattgaaacattaaagtgcttccttctgcctgcagtacaacagattcaaagagagagaaaggcaggcaaatcaacatgtaaaattgggtcagtacatcgttgggggacctgtgtgccagtggtctggattgtgtcgagttgaggagttagaggaaaccatgagagagagatagcaaattgctgcacctccctgctcgaaggacaaagaggggattaaggccctggggaatccaggacaataagctgtccatgaagagggaaggaatttagtatcagtgctggcaattttgaatattgaaaggagttaaggagtcaggattggaataggggtagttgggggatttatagtcccaaggcaattaggaaaatgggctgagccatgttcctgccccttggaagcgggtctgggagggctttgggttttagataagtgagcaggaatgtgggcaaaggttgagcactgaagtgccattgaaagctgcatgtgaatttttaggtgttctatacctgtggaattacagtgccccagatttcatatttcacatgtgattatatacaatgattataatgatatgaatatcattatgaatattatatgagtatggttatgattacataatataaacagctacagttgaagatgtacaaatgggatttttcatttcatgaaaggagatatatattttatttatttttatatatccatagtcacacacatttttttctttcttacagaaaccaaaaaaaagaagttggtagaagttttgttaaacgttttttttttttctctactagttaacagatttcagatgcaaatatactctcattatccaaattcaaatctctgtcactcaccacaggaatatagaatgtggctttgatcttgagggtgttgtactcatggtaactagatgttccatttctcagctttgccttgaagagtttttctggttttgtcttgaaatgatactgaaatttatctttctaaattcttcccttttgtgtgggtgtagccatgtacctgtatcagagttttgcttaggataatacattttagaattggaactggaggagacttttccccttctgacttaaggcaccaaagtagttttaattgctctacaatccaaggaagcagaagcaagtgggtctgctgccaagaacgcttaccacaaagaggaaaaaaataattgtagctctgaattttagctctggcttgtaaaatatgacagtcttttactatctctttttctttcattgagtaccttgctgccacatctggctccgcttttttttccaaatgggtttattttgttattttgaatatggctggggtgatcctggaaagactggtctgagaaacaatcttgacatttcagctagaaacaaacccagaggtagattgatctgagacagagtttgggaccatccctctgaacctctccagggttggcctaagtgtcaaactgtcattcccccctgaggaaggaagtttcacctccttcttttcaagatagcaagatgtggaggctttgctggattttccttttttacgctgccagtcgggctctgatgtggaatctgcctgtctcttctcccttgcctacaggctggaggctctcaggtcatttttaccaacccattggagatagtgaagattcgtctgcaagtagctggagagatcaccacgggacccagagtcagcgccctgaatgtgctccgggacttgggaatttttggtctgtataaggtgggtaggtttaggttataatgtactcaataaaatatgaaagaatgtggaaaccagacttcttccctccaagttgaaaagcaatcttgtccagcagggtagtctgtggagcagaaaatcaaacaaaaagaaaagaatcaggacacttgtatgagaggcagtgggatacacatgcagcctctcctgttgtcatcaggcttttatgaaactgccagcaaggaggccagcaccgcagacctgctggcctcaggctcacagcctttcatttgctggggggcttgggaaaactttccctggtgctctctttgggttggtttagggcttcaaaatagtcttatgtttattttcggtctgattatctctattgttatcttcccagtgggagcttttgtcttaataatttgaccacagtaaaacagtagtagagtttggtaggattcaggtctttaagaagttaagtggtaggatttgtcaataatgaattccattaaaaaaaaaaaaaacaaaccaacaacagagtgtactgtactttaacaaaatgccagtcaaaagattccttccctgcgggtatacttactcccatcattacagatcagatgtaatggagcagaagctattatttttcttaaacaaggaagaatatttctttccattcctttgcctggtataaggggaatacgtaaatttagccaccatagccaagtgtgtttccacagcatctgatatagatccatcactgcagaaatgtgtaaatttgtttcggtaactgcaaattagaaattagaaattctctagattggaatcacacagctacagggttctctggagaccagcaaacaatgatgcctgtctcaagagagtttcgtacacatttttgcttcctcctccccactcccaatttccatcctttttgaattccctttgagagatgaatttattaatattgcttctctctgtattatcctttagcgagtccttggattttttttttttcaatgtttgagtttgtctttttttaaaaaagccagggctgggagcactggctcacacttgtactctcagcactttgggaggccaaggcagggggattgcttgagcccaggagttcaagaccagccagggcaaaatagcaagaccttgtgtctaccttaaaaaaaaaaaagaaagaaaaaattagccggcacagtggtgcacacctatcatcccagctactcaggaggctgaggtgggaggatcacttgagctcagacggtcaaggctacagcaagctgtgatcctgccactatgctccagcctgggcaacatagtgagaccctgtctcagaaaaaaaaaaaaattaaaaagaataaaacagagtcattaaaaaaacaagcgccaaggtggagtgtttgcctagctaggtagtggaatggtgtgggcttctgacaaagctgagggaggtgttctttgagacctcagtcattgggacaagctgcccctgggtaatgattttctactcctgtggaaacctgccgctaaaatattttgtctgctatttaggacatggggaatgaggagagaagatttgggtttcttttccccctgctctagagtagttacttttccttcaccactgcctatagctttttacctggcactgcggggactctcagctgatgtaaaaacttaagagggtagatcttgtgtgtttttaccatagtaagagattaattaattttaaaaactctgaatctatataagaaatgccagaaagttcttagttttcagaatactatcattacccagttattaactctaggactgcaggattcaccatgctttcacaagctttgagatatgcagatttccctattccccacttatctcccgcctcccccatttcccttgcacatcagttctaatgctgtttaagggacacctcaggcttgtcactgagggacacctcaagcttgtcactgacaaatgtcacatggatcccatttgggcattcacactcagtttcacactgttttgcactatttcctcactgtgtgacagggtgccaaagcgtgtttcctccgagacattcccttctctgcaatctattttcctgtttatgctcattgcaaactacttctggctgatgaaaatggacacgtgggaggtttaaatcttcttgcagctggagccatggcaggtaactacaaatttttttttaactgaaagaattctcccattatttaaaaagtacagaatctctatgtactttccccctttatttctggaagtattattgtttgtacctgacttagtttaaatatcactttttctcctttgtgggatgtgctgtaattctgatgagagttaattacatttgcataatgtggataaacagcttaatgcagcttagcaactcagagccaaattagatctgcccatctaaattgggctttcatcattaacatgtttcttagtttcctgtgcccctgaaaccttgagtacagccaagctaagcattaaggtgggaaagtttttcctcaaatcagttgcttagctgtatctcatgctcatgcacagatctagcatgctcttactttctctcttctgtatattggaatctacatgatttggccgaaaattgagcttttgtcgtgaagctgtccctcttcttcctaccattgccctcattagaccaaagtaagcagtacccctcagcaaaccaccttgaactcaatttttgtattttttctaatcgttaacactttgtcattagccaggtgtagtggtgcgtgcctgtagtcccagccagctacccgggaggctgaggtgggaggatcacctgagcctgggaggtcaaggctgcggtgagccgagatgacaccactgtactccagcctgggtgacagagtgagagcttgtctcaaaaaaaaaaaaatttgtcttttattaatagttatttgcataattgttatcctctgtactaggctaatagcttcttgagggcaagagtttcattctcttcatccttgcctttcctacgtggccagtgtaatagtaataggtgctcaataaatgtcaataacatgaatgaaaaccttcatgtcgtctaagataccaaattaggcacagaagagatttcatttgaaagaggagccttgtaagagcagggaggtactaagatgcttccttctgacctcataggtacagcctgactcttgagttaggaaggagctgacttggaatagaaggagagaaccaggtgtccttggctgcaccaacactctgaaaagacaaaggaaggaaggggtgcatgtttgctctctatacaaccagtaatgaaccattacagagctcagtgtggctctgaccagccaggcttatgttcactgtgtggctcttccttgctgggctcattctctactggaggctactggctaaacatcagggcaacctgagcagctcccggagtgtnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntgagctctgtaatggttcattactggttgtatagagagcaaacatgcaccccttccttcctttgtcttttcggagtgttggtgcagccaaggacacctggttctctcctccttttccaaatcagctccttcctaactcaagagtcaggctgaggcgagcttggtggctcattcctgtaatcccagcactttgggaggccaaggcgggcagatcacgaggtcaggagatcgagaccatcctggctaacacggtgaaaccccgtctctactaaaaatacaaaaaattagccgggcgtggtggcgggcttctgtagtcccagctactggggaggctgaggcaggagaatggcatgaacctgggaggcggcttgcagtgagccgagattgtgccactgcactccagcctgggcgacagagtgagactgtctcaaaaaaaaaagagagtcaggctgtaaatgtgaggtctcaaactcctgacctcaggtgatcctcccatcttggccttccaaagtgctgggattacaagcgtgaaccaccacacttggcccagtctcctacttttaaatgggggcagcatttgccttccaggcttttccttgtgctttccaatcaacaatgaaaaacagccagagaagaagagtctaattgtggacaggtgtttgcaagtggttgaaccaagtaaatatttccatggaactgtcagcaccgacttcttccccatagacatttgatgtcagttttcagaatgagattattttttctaatttttaccagtcaagctttgctagcaggaactgagaacattcagaagtctgcctccaaaggcaggaagtttacctagtttcatctgaatagggtgcaaggccatgccaaggggaagtatttgcattattccctagcagaacctcgtacaaggctgccaactccatccgcctagtgaggatacagtgatattcaggccaaattgaatttcttcccccggggaagattattttgctcctttgctctctgttttgttttataagtaaaaggtgtggttgtgaaatccatcttttgtgtcctgctgctgatcaatctcaacatgaccccagggagctcgggcacaggggcctttccctgaccagctcccctgttgtttcttaactggctgcctggccacctcttgctccagttgtaatgacttttgtcatgtaagcatgtctgaaaggagtcacagtcaactctcaaggtagcccttcaaacaagcgagtgattataagtattgatattcacttcccacactacgacaagaatcagcaaaaacagtagtttggtgtcagatacatttagtgactcactaagatgacattatcatttttttatacataaaaatacttgtatcttatttaagaaaaaaaggaggtaaaataattgaaactgaaagggaacgcttgggaattgtcttattaatattgctactttttttttctctctcacagttatttgggatcatgcaatgtagagtgattttttttttaattcaggaaaaaataataataattttcccctgatcacactgcaacagctaataggcttctatgcccttttcccattaatggccagacatctatgtaaagagttttgagttccgctcaagtggttgaagttgcaggctctatagtagatgttagcagtattcctatcttttataaggtactctagataaattaaatgtggttttctcctgaaaggtgtcccagctgcatctctggtgacccctgctgatgtcatcaagacaagactgcaggtggctgcccgcgctggccagacgacatacagtggtgtcatcgactgtttcaggaagattctccgggaagaagggccctcagcattttggaaagggactgcaggtaggcaggggctggagccatacagaatggctggctggctctagcgtcctcccctgtgactcagtggctgtctttaccacatttgtcctggtttcaagtctcccctgcccctgcttctctttttcagctcgagtgtttcgatcctctccccagtttggtgttaccttggtcacttatgaacttctccagcggtggttttacattgattttggaggcctgtaagtcagctgctcaactcctttacaaagaaatcactaagtccaaaacaaatgtttgttctgtctacaaaagcattgttgcaactcttagaaaactgataagacagaacctttaagaccaatgcatttaaaacagtgagcttaagaagcatttgtgttaagcaagtaaaacttgacagagtgacatcgtacataatattaagcagctatttgggggattttagggaagcagcaaatttttttaaaaaagacaggatatcctctgttgcccaggctggagtgcagtggcatgttcttggctcaccgtagcctcaacctcccgggctcaagcgatcctcccacctcagcctcctgagtagctgggaccacagaggcatgccaccacacccagctaatttttgtacttttttatagagatgggatctcactgtgttgcccaggctggtctcgaactccaccagccttggcctcccaaagtgctgggattacagacatgagctaccgtgcctagccaggaggcagcagattaaaatgctgtgtaaataattgtcttttttcacataagcaaatactgaacttcatggcgttctcattatgtggattttattatatggccctttcacagaagtaatgtaaatgtataccagtaacacttttgtgcattttctttcaaagtcccaagcccttttgcatctctgatatttcattattcaccacaatttattattagttaggtgcagatgttcttgaagctaatttactggaaaaaccaataggtttgaagagagattttgcccatggatataatcactagtgagctgtaggccagaaattgggcttctaaaagcttaccacttgaagcttgcactgagaagaagaattacaagttgaattttctgggtggggaagttgtacccaaagcaagcaattattagcttttcagcagaagaccaagtaccattcctgagtcctcacatcagaaacctgtgaactcctctgtgcccaaaggccatatagggaatcagctgctgaaccaagtggagggacctatgcaaaaaaagtgagaacagcagtcttacagttgcattgtagaaatgtgaggcttcaggcttttccatgcttctttcatcttctgtaaaagaactaaagctatttctctctctctcttttttttttttttttttttttagacggagtcttgctctgtcgcccaggctggagtgcagtggtacgatctcggctcactgcaacctccacctcccaggttcaagtgattctcctgcctcagcctcctgagaagctgggactaagggcgcccaccaccgcgcctggctaattttttttttttttaatatttttagtagagacggggtttcaccgtgttagccaggatagccttgatctcctgacctcatgatccgcctgcctcggcctcccaaagttctgggattacaggcgtgagccaccatgcccggcctatctctctttaaataatttaattgataatctttatgagtctactacataaaaagttaacttctaaagttatgtcaaaagaaaaatatatactttaaaaattactttcatatgtgctaagtgcagaaaatttggaaaaccataaagcataaaagaaaaaaaccagcctgggtgtggtggctcacacctcccagtgctctgggaggccaaggcagaaggattccttagaccagaagttcgaaaccagctttggcaacatagcaagaccccatctttacaagaagaaaaaagaaaaaaatcatccataatcttactacccagagagtcttcatatttgagtgtcttttcttctgacttttttcctatggatttgtttatatatgtatgcaagcattggaaataaggccatttctcttgtaaatcaaatatgtagataagttgctgtcaaagcagctataaatcatgactgtggtttctagtcatgcagcacagatgccatggaaatggttgagagaaacattcttctttgtggcacatgggtcagaccgaaaatgtccagctgtaagctgcgctcatccaccttgagcatgctaaccattggctttttttctgtcaacagcaaacccgctggttcagaaccaacacctaagtcacgcattgcagaccttcctcctgccaaccctgatcacatcggtggatacagactcgccacagccacgtttgcaggcatcgaaaacaaatttggcctttatctcccgaaatttaagtctcctagtgttgctgtggttcagccaaaggcagcagtggcagccactcagtgatgagacaactgttgagtgtggcaaaatggcgccttgaagaaagaggcctaggagagcagccctgtaatgtatccagtcagctgcatggtactgactgagctgaggagtcaaactcttctttctatatgacatatacatatacttgtttataaaataatcatttgcccagggaaaaaaccacaacgctgtttcaagctttagtcttatgtgttgaaatgtttttgtaagccttggcatgaattagtgttctagactctgctttgcacagcttgcacttacagtgattgtacatattgtacatctttgtacagagacatcttggcacctcatcccaacaaatcacatttgtagaaatgtaatgcggttctgagtggcttgaaatgtacagaatgttttgaaagtgttttattaagaatcacacaaaaataaatgtattaaaattaaattcattctcttattggtgacttatggaaataaagcatcaatattggatgtatttaattcctagtttgttttccattctggaataaaaaggtatttgctgataaaaggcataacgagacatagtgctgctaccactgaataagtgatactttggaaagatgcatgccagtggatgccagaggaccaggctaatgacttgtgtgtgctgatgtgtttccatttgtatttaatgtgtgtagaccctcctctgttcatcaatcaaaaagcatttcctaggcagctcctcgcctgtcagtgtgcatatggaaacagggacatctccatcattactggcttagttttgctttcctttgacacagtaaggcaaaggccaagctttcaaaagagtaaaggatactttcacaatttcccttcatatggatatgattccagtcaaaaataaaatgcacaccaaaatgtatacatgtagttggatttttctttgtaaatatactgataatactttttgttctgattgactactgattgcaaataactcatgatcgggttcgccctttcttccacctttatagaaaacagaaaaattagttttagaaagggctagcgcagagtgaagggagggaagaagaaagagaagaaaagctctatatggtgatttagtggggtctaggttcttactttggaatccaaatgcaaactgttctaaaagtcactcatcaagggcgtgattactaatttggatctaaacatagatcttgacagccacatctacactttgatatggatgtgatttgatgtgcagtatcagaatttatttaccttaccaaagtgctctgggaagacattattgctactgccagtaagctgggatatgagaatgtatgcaaatattttcaagaggcgagcctggagacagaccaagttacttagtatcctgcacagtgctcctcgattgatggctgacagccctgtgactgcaactgtaggctccctggaggccctccaggaacaaaagaattagctttgaaagcaagttattttcaaatgtattagattggtctcatgggagtggaacaaataataatacagttgttttgctactaccacttgttagaaatatataagtagtccatggatatgtgattacaaaagaatcctatgtatgtatctagagtgagatgggaaagtgtcccgcttaccctccttctacctccaccacttcctggcccagaggtaatcactgctaacaggttacagcatgaatatgtagtctgtttttcataactctatagaaatatatgtacatatttatattttagaaacaggattatgttatgtgtgtgttattctgtgtcttgcttttgttcacttaatgtgttttggatatctttccatgtcagtttataaagttttatttttaatggctgcatagtatttcattgtatgggttataatacttttcataaatcttcccttattgatatttattcatttttttcactactgcaaacaatgctgtagtgaatggcagacatctttgtacacatatctttagtgcatgtgaatttcattaggatagatatttggaattgcaattgaaaacttttaagacaagctttatgtttttatacatattgccacattgttcttcaaaaagagttattaatttactttcctttgacagcatatgagaatgcctatttctttgcaacctcagcaaagagggatattatcagtcttttacattttcagcaaatcatgatagctgatcatggttattttatttttctaattactagtgagattgaatgtcttttcatatttactggtcatttgtatattttcttattgtggaatatggacaaagtacatgaaacatatgtatgcatgtccacaacagatatgtacacacatacatatatattttttaacatatcataatgtgcataccatatgaccaccgggtcaagaaatagaacatctccagtacctcaaaagctccatatatgtccctccctaacacaaccctctgtccactttaacatcatccc

SEQ ID NO: 12278 - DNA, 47115 bp, Human
  misc_feature (1)...(47115): n = A,T,C or G
tcaatgaggggctaagcaactttgtggggtgctgtctctagtgctgatgaaccacatgccctagtaacaacctcagccttccaaggcctggcctctgttcttttaggccctgaaaatgccaaaagattccattcactgatggaaatcattaccaagtcctataaaagccaacgtgtaaaatacatgcagcaaaactgatgaattcaagtgtatgtgtttgtgtgtggtctagaaccttaattgaattcatgagaagccttaattgtgagctgtgttgtaggctgtgtgccaggcacttaggttaaaatggtaaacaatcaaatgtggtctacaccctcaaaaggcctgcagtttactgggagagaaaaacattgacccagtaattatgcaaatcattagaaacctagattcaaaagaaaagaaaaaagtatatagaaacctagattcaaatgttagaatcaagatgtacaaggaggtgtgagaggccgggcgcggtggctcacgcttgtaatcccagcactttgggaggccgaggcgggcggatcacgaggtcaggagattgagaccattctggctaacacggtgaaaccccgtctctactaaaaatacaaaaaaattagccgggcgtgatggtgggcgcctgtagtcccagctactcgggaggctgaggcaggagaatggcgtgaacccgggaggcggagcttgcagtgagccgagattgcgccactgcactcccgcctgggccacaaagcaagactccgtctcaaaaaaaaaaaaaaaaaaaaaaaaaaaaaggcggtgtgagactgtggaactactgtaattggatttgatttcaggtctgtctcaattctaacataaactctcctgcactctgggcaagtccttcccttcctctggatgttagtatcctcttctgtaaaaatggtgtcataccatttgcttctgaggaaatctctcctatttgttggaattcagccaaggcaacatcaccttcatgatgccttccctggctctccaggctgttccgggggcttctgctctggtcttctcgccacctgggtgtacctgtctcagcacatctcacgttgcaagttttctaagcaagaagtaaacgcatcaagacttttatccctgtatccccagtgcattgtggtgtctggctcgtgtttgttgaacggatggatggatggatggcaagtacaattgtggtgcaggttgtgctaatatcattatgaaacctgaagggacaatttgctggctgattgtctcagctggagtcatgggacgtgatgagcattattatataggttttgaagcctgaagatttctagttctgattatttgtgatgctttcttgggcggatgggcctctttccgcttgtttgtagctgcatgcgtaattacactaccttacagggctgtggaattttgaaaactgcaaaatgttatttacagtcaactgaactcagcaggaaccttatctctcggtggaggatggaggatagaagcaggggaagacaattccacggaaacggtggtgggttgagctgggcctttccagggagatgcaaaggtatgggagtcagaaaacattggttagtaaccaatcccagtttaagctctgaacctcagttcttctgtttccaaaacggaaataataacttgagatttgcgtaagagtatgacgttcaaatgtgctaatggataggacggaaggattaggagtggtacccgggggccactgcctcgtgcaacgccccagccctagatcaaatccggggcgtggtcccactgtgctcccgaccccagcctcggcaggaagcgccggctacgggggaagccaacccggagacacagacggaagtgggtgaccggagctctagcagcagccgcgatgggcgcagccgtgagcctatggagagcggaggtgttcccgcttccaccaatggaaagccggtctaggcgggcctttgcaaattgccctagtaacggccgcatggtaactcaggcgccgggcgcactgtcctagctgctggttttccacgctggttttagctcccggcgtctgcaaaatgaagattgaggaggtgaagagcactacgaagacgcagcgcatcgcctcccacagccacgtgaaagggctggggctggacgagagcggcttggccaagcaggcggcctcagggcttgtgggccaggagaacgcgcgagaggtgtggccagtggaccagggagttgggggctgcaagcagggctgctgcggcgagagagctgctgaagtcggtggctcggggcgggatgcgcgcgccaggggtctcccgccattatttcctcagggaagtgaaaatgggccaggggctcggggaggggcgccgccctggagctgggtgaggggccgccccaggatacctagtgacgatccactgggggcagttgacggtttgccaactcatggacaagtgctgatataaacccacacaaccccgtccccttaattcgtaccaggctctattcgcgacactgggatacagcgggaattaagataggagcttacattttagtgtagtgagagacgataaacgtgtacaccaataaataaaaataattatcttatcttggtggggttagttactgcagggctttgtcggccacggtcaggaaattggattttattgtgaatgcagtggcaggctatgggacggtttaaagtagggaattgactaaactttaaaagctcattttggttcccaggatccgggaactgagggagagaagtgggaattatggagaagagcaatctggtttatccacccctccaagcatcctttttgaccattccaattaaatctcctttttctaagtgctggtgatgccaagtactttcacatacatattattttttggcaggtgaaaatattgagttggggagagggcacttcacgtatatgcttgacactcgttttagtaacggtaaacctggggtttgcacccacgtgtatttctgactcccaaatcagtgctctatgatgatacagccaccnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnccattgcgctccagcccgggtgacagcgagactccatctgaaagagaaaagaaaagtagcatctgaagaatatcttctaggttctattaagggcagtgtgctttggtaactgaagtggaaatgggatggatatagcatacccacacacattgcttacatcatttttttttttttttgagagggagtctcgctctgtcgcccaggctggagtgcagtggcgccatctcggttcactgcaagctccgcctcctgggttcacgccattcttctgcctcagcctcccgagtagcaggtggattacatggtcgggagattgagaccatcccggctaacatggtgaaaccccttctctactaaaaatacaagaaattagctaggcatggtggcaggcgcctgtagtccttacatattttttgaggggctgccataagtgtgggaccaaggtacttcacagtccatgaggaatagaggtagaagagataagatgtattcacaagactctggcacagtgtggtcactgcccagagagaagagcaccttttagatagtcacgtattcagttattaaatcagtgtagcaaaccttatattatgtaatcctgagatatagatgctcagctagtgtaactttctcagtgttccccccttatagtcaaatattctaaaatatatgaagttccatagcccatttatggaatatgtgtgtgtatatatacacacatgtgtactgcaaatggttaataaaattcagagatttataatgtatttaaaatatactaacagatgataaagtaatttaaccttgaggattcaaaacatattcaatggatctaatagtgccataggtttaacttcacattcagtatttacagtgttcactgatggccagctagtactctatgtcattgattcttaccccttaataggttactctgggaatttgatgaaagctatggatcctttctctggaaaaaatgtatatatgaacataaacacagttttgttcccaacttcaagaggtatttgggcccctggcgtctatccctgtaccctgggccaaaaatcagtgttcccacttgtactcatactgtgcattcttcacacagtagtagctagcaccatcttttaaaaacaaatcatagcatgacacatagtcttcaagaccttttcagtggctttgtattatttatgtagaataaaatccaaactttaccacacactgtaagttcctgttctgcgttctggccgctgtctacctcttcaacctcatcttcctggtctttttcgctatactttggtcactgcaacctttctgtcccttggatatgccaagcttgtttctgctttggattttctgaattcgctgttttctttgcctggaacgctgactcctgctcctcccagaggttcacatatcaaattaaatgtcatcagaaagacactccaggatcactttctagccactcgttctctctcatcatccctttttcttcatagtagtgatgaagattatgtgtgcaatgtttgtatgtttgtatccctccctaaaacatgagctccacaagtacaaggcttttctgccttgccttcgttaccctcggcacctagaacagtgactgcagtgcactggcactcagtgttagttggatgagtgtgtgacttgtgtaggccagggactgagatttttccccttgtgaaacattttaatattgatttattatttctttccattgtggtgtgtaggcatgtggcgtcatagtagaattaatcaaaagcaagaaaatggctggaagagctgtcttgttggcaggacctcctggaactggcaaggtactcattttctctcattttttaaatctacccaggagaatgatcctagtgtctaagccaaattgaattcatgtcttaactagtctttgtttagctaaatgggttatatgtatgtttttaaaattaatatgcaataatacaattgggtatctaaaatccctgcttctaaaattcaaattatcctggcctacctccagagaagaaagaatgaagtccttgaaggggtctcattgtctctagaatttgtcctttttctctttcaagtctcctttgctgtggaaatacatttctgttggcctagggcttcataaagatcttctgagtgacatcttacttgaggggacaaaaaaatgagtcaagcattcttccaaatgctagctttacgcatcgctattgtggctgtgtgggagatgaaaaaaaggaaaacaagaattagagacatgatttttatcttcaaggggcttacagtctctccagggcagaaagaaaggaaatcatgacagcacaggaggactcagtatgagtgctcagctttgaggtattgactaatattaaatgcagctggaatttaaggaggcagcactgtgggctggtacagctggaagggttgagacttgacattttcccttcagagctgggagaggatttggctttgcagggaagataagggcctttcaggcagaggacaccgtgtggcttcttgggattcgtgaggggactggccagatacttgaaactcaccagagttcccaatttgagcttgcttattcttcaaaagggccgcttgatgtgggcaagtaggagcttggggttgtgtgtgaaaagaaatgggctttaaattccagctctagtattgacttgctatgagacctgaggcaggtcccttaacttttctaagcaaaagcatactctacctatttcaagcaattattaaactgatcgattgtaagataatgacttgcattataattttgaaatgattactgattgtgtatcttatattggtatcttacaagaggaagaagtgctatatttgtgaacagttttttctcttcctatataaaagcaaattgtgaacagttttttaaactgtaaagtgccatacagatgtgagcttcagttacctctctccaggcaacattagcttgtccagtgcatttaccatttatttgcttgctattccttatatcttagaccttctctttccctccatttttcttcttcctaaagtaaataatttagaaatttcttctagaagtttgttggtgggaaagtctctcacgtttgcattcattatgttgcccttgttttgaaaaagagctatgttggctatataattcagttgacagatattttcttcagtactgtttcacagtacttctctctcaatgttatttgctcctttggcttctgttgtttttgagaagtctaattttgagggttttgagtcttctttctgcatgtttttgagatatttttgggtttggtgtttcactattatatgtcagagtggattaatttttgtttatcatgcttaatgctaattgtgcttcttgaatctgagtattatgtctctgctcaattctggaaaattgtcagccttaggagaatcgcttgaacctgggaggcagaggtatcagtgagccaagatcatgccattgcactctagcctgggtgacagagcaagactacgtctcaaaaaaaaaaaaaacaaaaaaactgtcagcgttaatctcttcagctattgcctttccccattctctttgttctttccttctggaactccactgagatgaggttaagattgcagtggttttcaacctggggcagttttgcccttgcaggggactttgacaacgtctggagacatttttggttctcacgacttggttgggggtgctactggcatctagtgggtggaggccagggatgctactaaacatcctgtagtgcacagagcagtttccataataaggaattatctggccacaaacgtcatggagtcaagctgagaaaccctgggctagagcttctcgttttgtcctctttgtcttttagcctctcatatttgttatctttttgactctgctaaattatgggtaatttcttttagatctttgttccagtctaattgtctcttaagctatgattaagtgactgattaatccaatctattgaatatttttttccttttcattttgaaaagtttggaacctacaaaaaacttgaaagaatagtgtgatgagcccctctataccctatacctagatagccagttataaatattttgtgacatttgctttttctctagtttatttctgaaccacttgacagtaagttgtaaggatgtcttcctacatgaccacggtgccatcatcagacccaccttgctaatgctattatattcccccaatttttgtcaattaaaaattaaattaattaatttttaaaaaatgagcagcagagccagggagagaatggtgtctcaggaaccaagaaaggagaacctttaaagaaaggagtaggtaaccatatccactgtggtagagaaatcacaaagatgagggagcctggcagctcatcatatgattccatgagcagttaacaaatgtgctttcaaagacaacgaagttaaattgttttaatgaaaagaaaatataggtgatagaaatcagaaaacatctttccaagttgtttcagtttttggctttttaaaaaacaccagaatatcaaaatgcaatcaaagattacacactgcataaattgttacaagttataatgtctttttttttttttttttgagatgaagtctcgctctcttgcccagggtggagtacagtggcgtgatcttggctcactgcaatctctgcctcccaggttcaaacgattctcctgcctcagcctcctgggtagctgggattacaggtgcctggctaatttttgtatttttagtggagatggggtttcatcatgttggtcaggctggtctcgaactcctgactttaggtgatccacctgccttggcttcccaaagtgctgggattacaggcgtgagccactgtgcctggcccccagatgtattttgttatggcccaccttttttactcatgtgtggcccttcaagagtcctcttttatgttttttttttaattgtaatgtttttgtttgtttgtttgttttttgagacagtttcagtctgtcgcccaggctggagtgcagtggtctgttacccaggctggagtgcagtgatctcggctcactgcagtctctacctcttgggttcaggtggtcctcccacctcagcctcctgagtagctgggactacaggtgcacaccaccacgctttggctaatttttgtagttttcgtagagatggggtatcgccattttgcccaggctggtcttgaactcctgggctcaagcaatccacctgcctcggcctcccaaagtgctgggattgcaggcttgagccaccgtgcccagtcccggttttattcaggggtttctatcttaagtgctataccttgctgagctttcctgtatctacagtctctgaactttcaaggcaaatagtttactgctctgaatgttattatttattcaattctaggtgttttgtaagaggagaggttttcagtggacccagtgtgccatattgctagaagcatatgtctttcattttttttggtgatattgtattgctttcctcccaggaaatatgagaagtgctcagcactgtggtattaccttataagtttgtccactcccttccaatgtgtatgaaggaatttggtgacttctgcttaatggtttgctgcagggtcccaaagtttaggcaacttacctgggtgacaggcagaaatactgcttattttagagatgcaaatgcatggttcatatgcatttccactcttgaggacctcacactgttaataatgggtttgggttttagaagaaggagatattcagatgagattgaaaaatagagatttcttcaaccttcttttggcaacaacctcttttttgtgccacttgtcactcacatggggtgagtacaaaaaaaaatggctttggagattggggtttgcatcctggtgctgctgcttgcggttttaccttgggtgtgttggtaacttttgagtttgtttcttaatctataaaatacaaattagatgatcaaggtcataggctagttggggagattcgatgaggtctatgcagcactctgtagtaggtgtaggaatagtagccatatcatatactttccctctggaagtctttaaatggaggaaacgagacacacatgaagctttttttttttaaccaagtatttatcatattttaatggaagtatgttcatctcttctgtattagttaaagggagggagagtgccattgaattggatgtggtcactgtctttgaagttcaaaactgagggtagggaattggggctggcagagatacaaggaagagaaagaggagtaactgggaaggggtggtcctgtccagcctgtggccccacggggagtctgctgttagagtgctgctcctctcattgtgccctttcatgttccagagatttttttcctttgctcttagaagaataccagttttcaaggtgtcagccttgagctcacaagtgcagatgcctaatgaggcaggcaacggggatgagggaagtggctgggtgcactgtggcgtgtctgccttgagccccaggtgctcggccttgctgaaggtcaccatgagactgcaggccaaacagaaccaggctgtgagcaacgagtttgccacttgtgatctagcatggcactttagtactttcatttgacagatgaggaaatcgggcacctgagatttgctgagtgcccaaggtcacactgaaaattagtggcagaaccagcactaatctttctgttcctggctagtgcattttatactgtgctatacactgattctctaccagattttactacctcaaaactatcaccaaaagggcatagaaaagaaaatctgagaggaaccttgactgttaattttaagacaccgtctcagtttcactttgttcttcagtaacaagcttgttttcagtcttagcccatatacctggggagctggccttactcgtgctcctgtttcagagttgaggaaagatgaaaatggcatttagaggccatggcattgcccagttctgtaccaactttaaagcatttgcttgccatacttgacatttgaccgtacacctgtgaagtctggttctgtttagcatttgccagctgtaattatcttgtcaaaaatcaatttgtagtttaccacagggcgtgtttaagtgtaacttgttaagaccaactcatagcttcaaaatcctacttgaggtatccttcttcactctttgtgggctacataacataaaatgaacaatccattcattcattccttcattatttctgatgggttgtagattggtgttttcctgtatttgtaaaaagagaaagcaggtatctcaaagatccagtggtgtattcggagcaattaggtcagagccatatattgatattgagagaacaattttggatgactgtaaagttggcccttcctatctgtgggttccacgtatgtggattctgccaaccacaaatcaaaaatactcaggaaaaaaacaataaaaaataaaaatacaataacaaaaataatacatacttaaaaatacaatataataactatttacatagcatttatattaggtattgtatgtaatctagagatgatttaaagtaacaggaggatgtgcataggttatatgcaaataccctgccattttataccaggacttgaacatccatggattttggtatccctgtggatactgaagagtagactcttctaattatgataacatgatctttggagtcctgctgccagagattaaatctgcgctgccattttctagattatggtacttacgttgcattacttaatgtctctcagtttctcatgtgtaaaatggggagaatactagtgtctatttcataggctggttgtgaggatcatgtgaggcatttggagttgggcctgcactgggtaagtctgagtgaatgataacttgtaattatagggaagataagagatgccatttatgatttaaattgactgtccacaaaagtcatcaaacatttattgtgtgaaacatgctaaatggtaggactagatgttcagctgttcctagttcctggtggttctgtagcatgtgtttctgaactgtcatgttttcaggactgtgaactgtgtttccgttgctttcttttgtagacagctctggctctggctattgctcaggagctgggtagtaaggtccccttctgcccaatggtggggagtgaagtttactcaactgagatcaagaagacagaggtgctgatggagaacttccgcagggccattggtaagtagtgtcacatttgtgggaggagttggtctcacttcctgaagcctgtgcaccgaagcctctttgtggtgaagatgcctttatgactggtattcgtggcactgctgtttttcttttggcacttagtagtgcattatttttcaaataaaacaaaaccccagtttttctcattgaagtgcgttagcaattggagcaactatggaccctagctgtgagcctgcgcttcttcatgcaataaatagatgtgtctaaaagtgtttttttaatgagtcatattttcctggaagtcttattttgccattagagatgactatccactgaaaaggttttggactcaagccagaatctttgtgtgccatgtggccagaatgcccctggtcctggatggcgagccagaagagttgtggcctgtcatagagtgaggagactgaggagtggggactggcagagcttagaggcttatggcgcctaacccttagggcctcaggctatcatagtgagtgcctgtgatgagccaggccttccctcctctgaggggagattatcaatctacatttcgcatttgaagaagcagtctcagaaggttaaataacttgctagggacccagttagtaagtggcagaagtagtttgatccgacatctttctcatttctagagccgttgctgtgaagattggctgtgagaagaaaatggcttctctttcgaatttttgctttttgctagctaggacttctggggcagttttttggccccatttctgctggcacagcactgggcaagtcctagtttccctcagatctgcttatagaaatagcttatttcttttaactgttacataaaagtccagttattaagccatttctgttttttgaacatttagatttattctcagcttttactcttaaaaacaaggctactaggaatatccttttatgtgtctttgtgcacatgtgcgagtatgtttctaggatttgcctgctgagtcgtgggttatgaacactagtcagagtgcctgtaccagtttccaggctctttcattgtcaaaccaaagtaagtattcttaagaaggaaatttaccagaaaacttcaaggaaatgatgaaacttaaaagactgatgaaaaagttcagtttcggagtaagatcaggtagggccatggttaaagcttttgattttacattgaacaaaaggagaagcagttagaaagtgctggtatccctgggctctggttttgcttttaccagacccctccggctgggttgggagtggatagtaaggagggtgagggcagagaggagtctgagcaggacaaaatagtggcttggaccagggtggtggcagtggaagtgcaaagtggttggattctgggtgtgtttgcatggtagcgctgacaggatttcctaaagggttagatgtggggctgaaagaaagagaggagtcgaggaaaattcccaggtttggccatttttggagatggggaagaatgggagggagcaggttgggtgtttactcagcgtctcctggggatacagtggtcagtgcttatctttgtagacacagttcctggcacatagtgggtgctcaggaaagttcttctgagtgagtgagagaagtgggtagactttgaagcagttagaaaacagaagccttttttttttttttttgagagagagtctctgtcgccaggctggagtgcagtggcgtgatctcagctcactgcaacctcagcctcctgggttcaagcgattctcgtgcctcagcctcctgaatagctggaattacaggcatgcatcaccacacccagctaatttttgtatttttagtagagatggggtttcaccatgttgtccaggatggtcttgatttcctgacctcatgattcacctgcctcggcctcccagagtgctggggttacaggcatgagccaccgtgcctggctcatgccctgtaatcccagaagtctttagctaaaaaatatgaaaacagaagtctttagctaaaaaatatgtctgggctatagacatatgttgtttggtttatgaagtattttttataaatttggagctagttgtcaatatttagcaatagggaagtgtcataaagtgctcatttctgcctccttgaagcagctttccttcccacagcaggcggagctgagcgggtacttctgaccaggtccccataagcattgaagtttgtgactgtttttctaaaccagagagattatgaactgtgtccagaggctaaattttgtgttacttggaatatatttatttttattttataattttaacacttcctcagtgccacgatttgaatatttttaaaactgcaaagtatttctgactggaaatatattatttttaccatgaaatattggattttttggtgcttattttaattattttattttgttttagtgccatggtctcactctgttgcccaggctggcctttaactcctgggctcaagtgattcttccacctcagcctcccaagtagctggggctataggtgcacaccatcatgcctgggtttggtgcctattttatttaagttatctatttttaaaacatttttctctttttaaattttttttagagacagggtcttactctgttgtccaggctaaagtgcagtggtgtaacaatagctcgctgcaggctcaactccttgggctcaagagatcctcctgccccagcctcccaagtagctaggactgcaggtgtgcatcaccacacccagctaattttttaaaaactgtatgtaggccgagtgcggtggctcatgcctgtaatcccagcactttgggaggccgaggccggtggatcacctgaggtcaggagttcgagaccaggctggccaacatggtgaaaccccgtctctactaaaaatacaaaaaattagcggggcatggtggcatacgcctgtaatcccagctacttgggaggctgaggcaggagaattgcttgaacccgggaggtggaggttacagtgagtggcgattatgccattgcacttcagccctgggtaacagagagactctgtctcaaaaaaaaaaaaaaaaataaaaaaaaaaaatttccagagaggccaggcctggtggctcatggtggtgcctgtaatctcagcactttaggaggcaaaggcaggcagattgtttgagcccaggagttcgagaccagcctggggaacatggtgaaactgtgtctctacaaaaaatacaaaaattagctgggtgtggtgacgtgtgcctgtagtcccagctactcggaagcctggggtgggaggatcacctgagtaagtcgaggctgcagtgagctgaaatcacaccactgcacttcaacacaggcaacagtgagaccctgtctcaaaaacaaaatcgggaggctgagacatgagaatcgcttgagcccaggtagttggtggttgtagtgaggtgacattgcgccactgcattccagcttgggctacagagtgagacaccatctcaaaaaaaaaattgtttttgtagagatggggtctcactatgttgcccaggtggtctcgaactcctggcctcaagtaatccttttgccttggccccacagagtgctgagattataggagtgagccactacacccatcccagtgccagttttaaacagaggtattacaaacttatagagaaggatgtaaaacattaattaattatgaagtaaaggcttataccgtcaccaccgaaggaacagagcacggccagcacctcagacatgtgtccctccctggtcacaaccccttcctctcctaggtgggacccacaatgtgccataattgtgtgggaatggtttatgtgatcatcataaccttgtacaccccatgtgtgtatctttaaaccatggggcttaattttgccctttttaaagtttatctaaatcatactttatgtgttccttgtgtcttgcttctttagctcagcgtctatatctgtaaggttcagcccatgtgattacatgcagtgtactttgtggatttttacgttgtatttggaatagcagtggaaatgactcgcaggactcctttaaggtttaaaatcttctgagtattttttttttaaacatgtgcccatggttttatttaactcataataaagatgagatgaacagtaagatgttacaactagttcaaatgtctgagtactttttttttttttaattgagacaaggtgtcacactgtcgcccatgctggagtacgtggcatgatcttggctcactgcaatctgtttcctgggctgaaatgatctacctaccttggcctgccaaagtcctgggattacaggcgtgaaccaccgtgtctggtccctgagtattttttttaaatgttctatttacttaaaaaatgtttttctgatattgataaaatctgtgaaaactggctttcacatggatgtatgtgtttgcattgcttaaaggtaacttgaatgctttaaaattcagaaaaatagagataagttccttggcatctgttttgtaatttgccatttttgaggggaggggacagtagtaccattcttttgatggcagcgaggtgaaaagaaaatttcttgatcctaccagagaataaaaaggcaggccattgactatcttcaaaaaggaaccctgcccatcttcctctgcctttgaattctgtgaagttgggagagggggtggggaggaagcaataagccgaccagaaataaaaagcagggagtctgtgctatttccttgatgtgatgaaggtccctgtcagggatatagaaacctgagccagcagatgaaacctgtgtcatttgtgttgtcgttgccagagatagcgccagctcagcccctttcctggctaacagccggtttcattgtccgtcacccacgtcccctgccagcttgtcagcacagagcaacttctaaacaaatgtgggggctagtgagagacgggaatgtctttcttcccctccttgaggaatttcatgccacattcatctagcagtaaatataagtaagcattccatttgaaggaatttatcgctgtgggatataaaaggtttgattttaaaaaatcaaagttcactttaaaagtacaggattttcccagtttaccacaatgttctgatatattcgtgttgtttggagaatttttgtctaagattaatgttcaggaactaagaatttggtaaagcacaaatgaaatgggtcctctcttttggggctattccaaaacttccatttataggctatcagatagaatgaaggtagagtaaaacttttccttaactttaatatctgagagtctttgtcctgactgggtttctggggtagagaaggcaaacagcccaatgataagataatgaccacatttaaaagtgagaagttacagagcgtacctgacactataggtagtgtttcttagtgccattggaatatttccatatcagaacggaggtagcttaatggtgagaacaccaaatccttatcaagccaccctgccatcagaactagtttatgtctccacatttgtgagttgaatagtttttcatttattctttagataactggatctcaactgtgtctgcactttggaatcatggggggaatattaaactaatagtgatggcaggggcccatcccctaggatttggaagcaagtagtctgggtacagccagggcgtgattcattataggggcccctcaggtggacctaaaggttgagaaccatgaccataggctccagcggagatttagagcagtatttcgtaaacttaggccatcagtggtcttacttcaccgggtcccactggtattatttacttaaaatttttttttaaagtagacttggtaattttatgcatatgtacagaaaagtgtgcagaacataaatgcatagcttggtggattattgtaaagtaaaaacccgtgaaaccagcagctaatcaaaaaagggaatgttgccagaactccaaggtacccttgatgtccactcccagttgccatccttccttccccaagttaatggtagtcttgatttctaacagtacagttcagttatgcctggcttttagtgctgaggttgagggtgtttcggtgatacaggctataacattacatggctgactccttagagttctcaggccattaccatatagaacatgtaaatgtatctgcaggttcgtttcttgggtattattagtagatgatgtgcctaatgacaaccccttcactcttagtgacttcattcattcatccattcactctacctgcctatgtgctgtgccctcagctcaggtgtgggcaatctgcagaggggtaggcaaggtctgcaagttatggcattgccgtgggctgctgctgtgccagtggaaacacaggtcaccatggggacaatttggaggatgaggaagaagaatgtgtgaaggggggggggatacgttttaaactgagtctgctaggaggagttgcctaagctaaaaagagtggttcaggaagcagaaccgttatatgcaaaagcatgtaatgaacatagagatcacgttctaaaagttaatttaacaatgattcttggataatgaacaaacgtttattaaagagctaatgtggatgatgtttagaattcagagagaaatttacctttatttgcaatattctaatgtaaggtgctttggaaattggttttgttgttatggccttagaaaaactgtagagcagctgggaatggtagctcacacctgtaatcccagcactttgggaggccaaggtgggtggatcacctgaggtcaggagttcaagaccagtctggccaacatggtgaaacctatctctactaaaagtacaaaaaaaccccaaaaattagccagatgtggtggtgcacgcctgtaatcccagctacttgggaggctgaggcaggagaatcacttgaacctgggaggcggagcttgctgtgagccaagttcgcaccattgcattccagcctgggtgacagaatgagattctatctcaaaaaaaaaaaaaaaaaaaaagaaaaagggaaagaaagaaagaaagaaaattgtagagcaacacattgcaaataatgcatgacaactgggtatttcttcttggagtatgcagtgagagccagaggcccataacacctggcagttttgagtgtcacccactgttgacatagatacctaattattttagtatgttctgctcaggtttcatagtgtcagagggtgtgtaatgagttattccactggttttaagatttcctttgagagtcagaaattcaggaaacaaggctacaggagttttgatagccactgttctggtggaatagaatagtgtgggttcagagactggattaaaggctaaaggtannnnnnnnnnnnnnnnnnnnnnnnnnnnnnnnnnnnnnnnnnnnnnnnnnnnnnnnnnnnnnnnnnnnnnnnnnnnnnnattttaagaattataacttgtctatctagttctggatttgaacctagaaagttcccttaaaaagttgcatttctaggccgggtgtggtggctcacacctataacccagcactttgggaggccgaggagggtagatcatgaggtcaggagatcaagaccatcctggctaacatggtgaaaccctgtccctaccaaaaatacaaaaaaattagccgggcgtggtggcgggcgcctgtagtcccagctactcgggaggctggaggctgaggcaggagaatggagtgaaccggggaggcagaggttgcagtgagtcgagatcgcgccactgcactccagcctgggcaacagagcgagactctatctcaaaaaaaaaaaaaaaaaaagttgcatttctaatagtgcctctaatttacattgatatgtttgtattgcctttttacccatcatgacaccctggaatgtacattattaaggttgatttggcagttctggtgacatggaagttttgggctctcagtgtgagagaaaagattctgcttctcaccatggcccctctgccacctcttccagggctgcgaataaaggagaccaaggaagtttatgaaggtgaagtcacagagctaactccgtgtgagacagagaatcccatgggaggatatggcaaaaccattagccatgtgatcataggactcaaaacagccaaaggaaccaaacagttgaaagtgagtacatgtatgtggcctcttttcccttgactctcccagcactgtgtggctttgggcaggtggtgtaacctctctgcatcccagttttcctgacctgtgcactgcaggtattgatttctcacagaattggttgaggatattgtgtgtataaagcggtacctagcatagggcttgcacataggaggactcaaggaagatagctcttttcttacttactcctaggaaactctgcatgttaaaatgtgagctgtgtggttaagtcaagaaactgcctctgccatcccatgtcccatattatgaccatgcatcaaataccctgggctgggtctgaacctgggcattaatttttccagttatcagtgcccatgctcatagaaagaaacagcattgagtaatcaaataagagttgtataaagatgatggatgggcttcccaggggccacatgcagaatcctgactgcagttgcttgtgtcaggaacctgtggtcgcttcagtggctggttctgtttagtacagggctttgtggagaggccagaatggtgacactggatagcgctcaaagacagtcctcagccacctgtcctgtaagtctttaggatggaggcagtagagtttctaggggaagagcatgagttttggagtctaagtccttaaggaatccctggctttgttacttacaactgtgtggcattaatctctgagtagtagtttctttatttgttgaatgggaataataattgcctgtctttcagggttatggctttgggtgtggcacctagttacctaatgaatgatagctgttaatgttatcgtgagagccttcacttggagaaatggagcagtctggattttaggctttgccttattattattaataaatattatcattatagctctcatttattgtatgtgtcaggccttggactaagtgcttcaacaaacatttattgtcattcataactttatatgtgtatatgtttgcgtgtgtgtatgtgtgtatagttttcctcatgttaacagatgaaggctcataaagaggttacatggttatcctgggatcatccagccagtcatgtggcagagctgaccctctgagtcctaaccgttgtactgtctgcccaccagcttgctgtgtgacctttggaagtcagttgagctctctgggactcagttttctcatctataaactgcaggagattgaccatataatttctccatttttattctgttctacgattttatggttctttgattctctgaggttgtttcttggtcactgctttatggagatcgtaaaaatgtcacttcttcaaagggccatttttctttttcctaacagggtttccatctcaggaacttgcctctgcaaatatctcttttatacctacccctcgtcacttccattctgaattaattagatttctcagtagcatctgccacctttccagtaattacatcttcagtcaattcatttgggaaattaaccgatataaaaatgcttgaggcaaaaaagaagtatattctccaatgtaggacagataaaataaggcgtacagtttaaatttcagctatttgtaacactgctttgtacagtttctttacaaaaataatgtagaggagaagatgaaatttttcttccaaaatgaatacttttaggtatttttagaatatgtacaagatatttggatagaaggtgctcaaatacttggtggatattcaagtctgaaggagtcttctgagttctagcaacgagaatgccattagtactcatgaccccttcctgccaggccttacctgggggcctcacccacttttgtccttaggcgcacagactcacagcagttctgccagggtctgccgtccccacccagctaaggagaggcagaaccctgggtttgctgctgtggtggtagttttttaaaagctttattcagatagcattttaaataaaactcacccattttaagtatacaattccaggaattttaatttattttcacagttgtacaatcaccacaatcttaatttcagaacattttcatcgccccaaaaagaatcctcctactcatttacagtcattccccattccaactatagccctcggcaactactaatctactttcggttgccttcttttggacatttcatataaatggaacatacagtgtatgtctttttttgtatctggcttctttcaccaagtcctgggttttcactttttaattttgtttgggcaaagcccaagttttttttccaccatagctacattgtataacatagatctccatgaagacctcgagaaacttgtgtttaactatagaatccttacaaaggcagctgtcctagaatattaatcactgagggtcaccagaatctggagaaaagcaacagttccgcaaatctgcttatttcctttcctggagatataagcaggcagacccaagggcacaaacactgggatgtgagtcaaaaggcttgggaaagattctcatttatgtttttctttgaattactgtatacatctgtgattgcacctgggtgctgttgtatagatgaggaaacttagaactgagaaccttatccaaaatcaaaggccctgcaagatgccagctttgagattggtaagcaggtgctggcaggtacttcagttgtggaaagttccaccccacctgaggtgaggcaaatgaaggagtgaagtagggatgatgatttcaagaggggtgatagggcctgtggtcctgtggacagtgggggctgggcccacccgtctcacggcagccaggaccatccttataaaagcgctgctgccagtttacagcctttggaatcaagggaaagaggagagtacgtgtcccctgtgtccctctcatgctcgttacatagggatgcaggtatgctggcccccctattttctccctggtgtgcttagtcccccagccagtctgttgtgtggtacttatgcattcacactcctgcaggtcccagtattcatgcaaacgcaaaacaggctttctccatgcacctgctagctacctcagatcccttacggaaaggtaccttacatggtgtcagaaggaaatggaatatgtattacacttctgatttacatttttttttttagctggaccccagcatttttgaaagtttgcagaaagagcgagtagaagctggagatgtgatttacattgaagccaacagtggggccgtgaaggtaatgccttccttgggacacagcattgtccctgatttgtttgccatgagaagacctaagtgacaagggagttgctttcttcagagggtgtggggtgtgtggggaggggctggtgtctgttatgaggctgatggaaggtcaactagtggccctttatgtataataaagtttgccttccctttatcttcattctttaaccttctcgcgattaaaacagatagtctgttagaaaaaatactaaaacctgttcagagggggaggacagggtgagaaaccaaaacaactttagtcactttcaaattgaaatgtgcagtgtatttaatcttccttttatctctttggtattttcttcccaagatatatgcatgtgggaaggaacgctgcattcgttggcattcttttctatctgattttcagggtcctgtacagtgttcctcactgtttaatggatgggcataatacttcatatcatacaataaatcatccacctacaaaagagtctgagcagctcctctgcctccagttaatctactggatttggcctttatcaggaattgcatacagttaaaagaaagaagggaaaaaggattttgggagaaagtatcaggtgtttttcaacccagtttttggagcccagcgatgagcagatagctcccttctcttggcagcaggggagtggggcatatttggagtttgtcaagtaggctgtcaggcctgcagtgggaactgagacctttatctcacttagccctgtgccatttggggacttggcagtgaaaacttaccaggcactcatgtttctctctttttgcagaggcagggcaggtgtgatacctatgccacagaattcgaccttgaagctgaagagtatgtccccttgccaaaaggggatgtgcacaaaaagaaagaaatcatccaagatgtgaccttgcatgacttggatgtggctaatgcgcggccccaggtactgcctcgatgcctgggtgatctggcacattagcccttttgtatgtgtgtggagatctgggaatgaattgtcagagtcttgctgcctttcttgaggtagacggtccttttctatctgtaatgttcagcaattaacatcgacatgagctacgagggactcctttgttcccattcaaatgctctagtcacagatgatttcatgtgtattgtttcttatcccagccaagcctctggccctgagctagccagcttcctccatggcttcactccagcagtgggctcacgcctgggattttctgggtgttaatggcaggagggcaggagtgttctatgagccctttacaggatttcagaaagcctaacaaagctctttgtttccccctgcttagcaaaagccacagtgttttagctttgagctggtactgttgtctgcttctcatacagatggatacttatgccttggctagtaaagtgcaggaaaggatgttatcactatatgacatttctaggaaatagtgaatagtcactattagggaatagtttgttttctgacttgaaatttgatccgtgggtgttttgttccttggagctttggtcaagagattactgaagactcatcttggaccaacaggtccccttggttggtgaaatggccatccccaaactgacctcctgggagcccttgacctgagaagagtgctgggctgggagtcagaagtcaggaactgtgttgctccatcactgaccagcttggttaatttgtcactttgggtctctgggttttctgtggtttggggttcggttttgagttccctcctacttggcaaggcagttttgaggaccagacaggaaacatttgctgcctttagctattcagcatttagtgagcccttctgtgtctcagggcctggtaaccaacaggtgatcactaaatgctgaataaatgaccaaacaccagcctcttcctcttgctgactgcactgttaggagcccgcaggaggatgcaggtgagtggtgaacctgttatggagtcagccatgatcagctccaagttaagtaaggactaggctgatgcaagcctgtggtcaaatctagtgagaggaggcacagcaatataatcatggtatatttatacttgctctttatacttactcttatagtccatgtgtccccaaaggcacaggaacatttggaggaagtcctgagtccggttagggtcagatgcgccctagagggcatttgacgtgaactttaatgactgggaacttctaggaaggagaatggcattcctggcagatggaatagactcaaaagcattgagtcataaaaaagcttgggggtgtccagggcagggctggtagtcttgtgtggctaatcaaggaacaaggggttggaaaaagatagggctggaaaaggaggctgggcaggccccacggagcttatacttgccatgaaaggattttgtttgattcttacaggttaggggaacctctaaaaattcctctgtgtttagaagctcctcaggctttgaggaggggtctccatacctcaggatcccatgttgagttgatgagtgggatgcagggggatgaggcttctgtagtcaccttagaaagcagcactgactctaagtcttctcttatgcaggggggacaagatatcctgtccatgatgggccagctaatgaagccaaagaagacagaaatcacaggtaggagaaccagtgtgccctgtgagcaaggggcagggcggagggccccacattctgagatgctcttgcggctctgtgagcacagtcgccctgaggaaatgcctcagaacagttctttcttcctcatagcttagagcttgactctagcctaagtttctggcggcatttaggcagccatatagcacactgtgtgctatctgccccactgcagtcacaatttctggcccctatgaggccccagaaatagggatttgtgtcgcccagctctgctggagcacaggctctggagccttggggctgtcagccccctccctagtagagcacagggcagctccacagaccagctccacatactgccctgcccagtttgtgggcacttcccagagctccacaggggacactgctgctgctcccctgtgaacctttatttaacctgctgctcttcccagctttcctgttgctgttttttttctaattccacctacagtttcgtcaccttaagatgttagttaaacattaaagcaaatattgtctttaaagtttaagccagggcagcaatctgagacctttctgttcgagttgtcagaagcagtttctttcttttcacacggttttcggtgtgcatcctctttggacaatccccgcctcttgcctttggtggaagacgctgcctcagatcttccagttttctatttgtgagctgctccctcctgatgataacacaggagctggtttggaaaatgagcactgagaccttagctgggttatgtaacttttgagagactcatccctctaggagctctgagattgggcctttcttcagagcctttcattcctcaaaggtttctgctcaggattctaaaagcacccacttccttagtccaggcacttgattgaaagttaattaacctaagcattgttgtatgggaccaaaagaaagggtcatttactgagtatagaacaggtaaatttgcatgtgaaaactcatttcacccagggctcccaaactccaatgtctcccagatcagacagagctagattgggtatgtgggaagtgataaggcatggtagggagtgtgacagcagtgagcgtgtgctgtgaagggattcccatgcagaacacctgtgcaacctttttacatttaaccaaacccatcttttgggggaggctgccaattttgtgaccttttaggtgtgattatcactgtgttcagatgacgacactgaaacctggagtggggacacaccctgtctgggatcacatagctagtaggaaaactaggctcctagcatgggtttggattgaattcaggtggaggagaaaaggcgatagtctcccccagccctgtgctgaccttgcctgcccatccttgcatctcctagacaaacttcgaggggagattaataaggtggtgaacaagtacatcgaccagggcattgctgagctggtcccgggtgtgctgtttgttgatgaggtccacatgctggacattgagtgcttcacctacctgcaccgcgccctggagtcttctatcgctcccatcgtcatctttgcatccaaccgaggcaactgtgtcatcaggtaggatggctgcctgccagccacaaggcttttttaacttccatctgggctcatttgttcctcaggatctctccaaaccccatgaggtgggacagggatgaggggaggtcatgttgtttttgagggaaaatgtgccaagtggcttgcctctggcctcatttccctagtcaccaaaggcagcagctgtcctgtcactcatgaggagggtctcccacgtgatcttttgggtgtgatactacaatttggtcgttcaattggagtgtacaaaggtgagatcagacagggctagcctttgatgacattatacacatgaacgtcttcagtcttcatctgcgctctgagaggtaggcattattggcgtcatttttcaaataaggaaactggaatcataacttgtccctcatcgtaaagacaggataagaacccagctccttctgataacaaaaccagcattttctttcttttttttttttgggacagagtctcactgtgtcgcccaggctggagtgcagtggcgcgatctcggctcactgcaagctccacctcccgggttcacaccattctcctgcctcagcctcccgagtagctgggactacagttgcccaccaccacgcctggctaatttttttgtatttttagtagagacagggtttcaccgtgttagccaggatggtcttgatctcctgacctcgtgatctgcccgcctcagcctcccaaagtgctgggattacaggcatgaaccaccacgcccggccccagcattttctttctatcccagacctctgaaccacactggtgtctttccatcctcccgctccactccttcccatccctttggcctgcctttgggaagggcagatgttgacccctggaagacaagtgttcatacggtgctcatcctgccaagattggcccaaagctgggccaggaactttcctgcggttgctttttctcctaagcactctccacgctcgtggtcctggagaacaccccatcttcccatctctcaagcccagtgtcagtattcccagtacctggtagttttattgctcttttggttttctgtgatcttgtttaaacattagtgcctggtctctgcagtgctgggggcacaaaggtgggtgatgaggggcctgttttcaagcctgcaatagagtagtgtggggacaaagtccctgaggctgcatgctcagggcagtggaggcagtgggagttagaaagacaccctgtggcccatgagtatctcaggacacagctggagccaaactgagtttgaaataaaaactgctgatttgcctaactcagctctgaatgatggtgggccctatctaagattttagtttgcttttaatagagaagctttattattaagactgtccaagctgggcacagtggtatgcacctgtagtgtactctctgggaggctgaggcgggaagattgcttgaggctaggagtttaaggttgtagtgtgcaatgattgcacctgtgaatagctatcgcactcccacctggacaacagtgagacctcatctctaaaaataattaaaaaaaaacaaaacatgcaaactctggtgttgctggctctgggtaagccccacaatgggggttctgtagtgctgtgagcactgcagtatagcaacagcccttccccctcaggcggtttctttcacttgcaattaggaatcgaatgcgtgattcaagtccatgtggcagcatcttgtagctactctgaatccccgtccgtgatgctctctagacaagaccactgtcataagtgcttcctaagtcttggagagaaagtgtgtgccagatccagcatggctacttgggcagcttctggagacagatgcatgtgggccttatggctggtatgcctggcatgcctgtggctgtctggacttgcttagccttggctaggccaggctgaagcctgacagtgcagttggtgaaagggctcagccttggacagatggtgccccctgctggggagctctgctaataggcttccctccctccacagtagggaacccagcccagcccatacctgcagagcctggcatctctcgtctcagaagtaaggtctctcagtcccatcccactcaggactaaggtgcacagaaaggtggccttgatctcagaacctgctcagtggagacaaagctctggtcagcctgagacccgggagatttggccccagccccatctgggctgatttgatcaagggctgctagaggttgtggagactccttgctagactgtagttactcaagtggaaggaagacactcagaacatggatttttaggcaggtcggctcaggtaacgcagattcggttgtttgctttggaagagaattttggcactatgttctagtaggaaatttgttgtagtggtgataataatgtcaacatggtaatgaaaaaagtaatagccaacaataatagccatctgatatgcttcccacagactccacccctagaggggaactacagggcttccttaccccccagaaccacatctgatctctagagctccgaaggaaagagagggggaagggaggtgactaactgagggcttcctgtgtgtcagaaactatacagagcactctacatgggccatctcatgtcctcccaggacaccctgacaaccctgtgagcagttgaggttatctccagactcaaatgggaggttacctgcccaggccataggctagaaagtgttgccactggaacctgagcccagaggaacgtctgggtccaaactccatgctctcactgctctcccacaccgcttcccagtggaccctgggctgtgagcggggatggagctttgacggggtgctgcctggaggtggcagtggggaactgttggatgctgacaacagattgccgtgaaaatgcagcctcctaggagtgttctttcccaggtagtgtacgctccctctcggcttcttgccgctcacccctccctgtgtaaatgacccttgtggattgagcctcagaagtgagcccactctctgatggccattgtgttttatggagcatgcatttcagcacaagcctggttcccacatggaaaaattacaggcattggagtcacgtggaagctcatgacccaggcgagttccttgacctctctgaatcttaccatcctcatcaggaaatgggaatatcagcaccttttttgcagaattatgtgaagagtagaaaaagtgagtgcaaagttatcacccaggccagccctagagtattgccctcttggaagctgatttcatgcccctgcctggtctgctctgtgggacatggcttggcctcagggatctctgagaacccagcaaggcatgaagcctcttcatagcccctcctgaccttgacaagcagcccccaagtcctttaggtcacctctccctgtggacagctgatgtgggagccgttctagaagaagcacctgtccctggtcctcttgatgctccaggctccttctgggaagggtccatccatggatgacagggaggcaaagctctgttgccttcttgcctggctcctccctaacttgccaccataagaagtccctttccttccaggctcaggatcctgaactgttagatgagagcccagcactgatcccagcttgaaaactgggagattttctcttcatattgaggtatagctccctgggattaggagttcttgtaggagtttctcactgaaagtcactttgttgcaccaaaacatcaagacttaagaaacagtatggactctgctcagtgtaaccctgtggcagatagtgttccaaaaaaaaaaaaaaccaactttatggagacataattcatataaaatacagtttttttttgtgatttctagtgtattcacagagttgtgcaaccatcaccacggtcaattttagaacattttcatcaccccaaaaagaaactatacccatcaatagtcatcgtccccttctgcacccttacccccatccactggcaaccattaatcaattttgtctctatagatttgctttttctggaaattttgtataaatagcaccatataatctggtcttttgtgactggcttctttcacttagcatgatgctgtagcatgcatagtacttatttctttttccagctgaatagtattctattatatggaatatttaatagtgtatcttatttaaccattcattagttgatggacattgggttgttgggttattatgaataatggtgctctgaacatttgtgtacaactttttttttctttctttctttttctttttcttttttaaagtagagatggggtctcactttgttgaccaggctggtcttgaactcctgggctccaaggatcctcctgcctcagcctcccaaactgctaggattactgtgagctaccacacctggcctatgtacaacatttttaagtggacatggtttttatttctttcggttatgtacctaggagtggaattgctgggtccagtggtaactgtttaacctttcaaggaactgccagctgttttccaaagccagctgcatcatttgacattcctaccagcaatggacgaaggtcccaatttctccacattcttgccaacacttgtctgtctttttgattatagatattctagtgggtaatgaagtaatatctcattgtggttttgatttgcattgccttaacgactaaggatgttgagcgtcttttcatgtgcttattggccatttgtatattgtctttggagaaatgtttattcacatcctttgcccattttttattcaggttctttgtctttctgttgtcgaattgtaagagttctttatatattctggatactagatctttatcatttatatatgatttataaatatcctattctttggattgtcttttcagtttcttgatagtgtcttttgacacacagaagttttaaatttcagtgaagtccaatttatgttttttcttttgttgtttgtgtttctggtttcgtatctaagaacccattgcctaatctaaaatcacaaatgtttatgcttgtgttttctcctaagagttttatagtttcggcttttatatataggtttatgatccatttgtagttaattttcatgtagggcataagtaaggggttggtccaacttcattattttgcatgtgaatatccagttgtcccagaaccatttgttgaaaagactgttctttttttattgaattgttttggcagcctcatcagaaaatcaaatggctgtctttttagcactcttactgtgtgtccactgagccaaggttaagtggatattaggtgagttacccatcacattacccagagaggtgtttttactgtgctttctgtcagcagaaaagctttgtgttatccgtgtccctgtagttacaggattacataaagcagcatttatgtagtgattcttaaccaggggcaaatttgttccgctggggacatgtagcaatgtctggagacatttttacttaacatgactcagaagtgctgctggcatctagtgggtagaggccaaggatgctgctgaacatcctggagtgcataggacagcccttcaaaaagagttaatttggtccaaaacatccacagtgtcacagttattgtaagaggaaagtagtcacaaatgagtcagccatgttgcacatgtggtggtatatctataggatacttttccagaagtatatttgtcttgcttttatagatacgctgtattggattccaaggagatttgggtctgtggcttcatagctccaaactgtctatctggaggaagctcactaatggccgagtttggacaattgctgaatggtaaaatgttaaaattaatagtagactgaggccaaagccagaaatgaacttctaagatgcaagaataaatctgcagattgaccaaaatgtaattattatccagcttcttattagcagttttataacattaccattatggctgccttgttaaactgtgatcctccccaccccccgttcccccagctcctgctgaggtcagcacatggcctagcaccgctgctggcacatgagggctccactcagccagcccactcagcagcatcactgactagaaccgtctcccactaatatggtttctagaagaaactttctacttcagattcatagcttggacaaatctcagaaatgtttggtctttaattcctgaaaaatgcttagcagtcctcagcagccttttcttttgtttttctcctcaaattcctttttaccacttggtagccttttaatagactttaaaaactataagaaatgttattaatgcatttctataaattctgttcttgtgaagtttgatttgggagtactttatttttctctaaccttttcttctttaaactttttatgtttgttgtgatttatcatgggtggtgtagaattttggatatttttgtccttgggatattttaatgtggcaaaattgagatcttaggatttcctcaaaattaccaaaagaattctcaaataagacttaaaaaacacttatggcctaaatagaattaaaaaactaaaaattaaatgtagttttaaaaggttattttgcttaatgtgaaggttccaggcacaccaaatactgagatttgaatcatgatagaatttcatctttataattcttcttaattttaaaaagacattcgttgctggaaaaagataagttttctctaaagttaacttaatacttgtatttcctattagtttgtttccatatttactttgaagattttaatttttttttgttttgagacggagtctcactctgtcacccaggctggagtgcagtgacacgatctcggtacactgcaagctccgcctcccgggttcacgccattctcctgcctcagcctcccaagtagctgggactacaggcgcccgccaccacgcccggctaattttttgtatttttagtagagacggggtttcaccgtggtctcaatctcctgacctcgtgatctgcccgccttggcctcccaaagtgctgggattacaggcgtgagccactgcgcccggctgattttaatttttttacattagatttaacaattcattaatgtagcattttattctctttttgaattgtttttattgtggtaaaatgtgtgtaacataaaatttgccattttaaccatttttaagcatacaattcattggcattaatgacattcacagggtggcatgaccatcgccactatttctaaaaccatcaccactatttccaaaactttttcatcacctcaaaaacagaaactctgtaaccattaagcatgaagtcccaacccttcctcccctcagatcctggtaacgtctcatttatttctgtgttttttttttttttttttttgagatagggtctcactctgtcacccaggctggagtgcagtggcatagtcttggctcactgcaacctcttcctcctgggctcaagcgattctcatgccttagcttccggagtagctgggattacaggcatacaccaccaggcctggctaatttctgtctctatgaatttgcctactatagatatttcctataaagaaaccagaaaatatttgttcttttgtcggtgacttatttcactttgcatgttttcagggttcatcctgtgctagcatgtattttgtttgcattttatttttgcagtcataaatatgcatttttatacctcaactggatagaatttaaacaggtagattttatttttactaaagttaaatttttagcatgcttacttgtttttgaaaccaaatattcagatactaacaaatccagttgacatgactaattctttgttatattgattacttataaccatagactgtacaatcctgcacaagtttaagaatgccagaagtgtagcctttctgctgttaggacccccagaggccaaggcagaagcctacagcacttgggccctccaaacactagctgaaggctggccccatgtgccaccagtggctgcgcagggcacctcagggtctggtgggttggcaaggttcctccctggggtgttattcctatggcttggctaagggttcaagagaaaaataggcaaaagatgggattggacccttctcaaaaagaagtaaaataatatatataagggaatacattcaaatgcctcattagtaatcaaagaaatgcaaacttaaggtgttacctttccctctttttctaaactgttgaaatagcaaaatatttcagaatgagaatactcggtagtgctatgatcctgtgagattagataactcatgtgtagctgtataaattaggatagttattcattcaagtagctattcagggttctgtcaagcactacaacagttgctaaggaaatgcttatggctgtatgcatcaaattatcaaaatatcaataaaaataatagcaacaattggaaactacctaaatgctcaacaatttgggttaagtaaaatatttaatggattgttaagtaaatattaaacataattattaagactgttgcaagccaggtgcagtagctcacgcctgtactccaagctactcgggaggctgaggtgggaggagcccttgagcccaggagtccagggctgcagtgagctagaatcatgccactgcactccagcctgggccacagaacaagacccagtctcaaaaacaaaacaaaacaaggagactgaagcaacatgaaaaaaaacaaaaaaaacttgcatacttagtataatttgtaaaattatactatagagtataattagtatacactatatattatactatagggcataattagtatatactatatattatactatagagtataattagtatatactataatatagtatatactatatattatactatataatttgtttatatatgaatgtttggcaaatatctagatgattatttttgagtatgattttagttatttttttcctccttcccagttttgctatgatattgatgattaccaagataaataagttggtttttttttttttttctttttggaacagagtctcactctgtcacccagggtggagtgcagtggtacactctcagctcactgcaacatctgcctcacgagttcaggtgattctcatgcctcagcctcctgagtagctgggattacaggtgtgcaccaccatgcccagctaatttttgtatttttagtagagacggggtttcaacatgttggccagccgttcttgaactcctgacctcaggtgatctttgggaggcctctgcctcccaaagtgttgggatttacaggtgtgagccactgcgcctagcctgaagttgtttttatgccactggaggttagtctgtttactctggtcctggctctgattcttaggctgcctagccagctgcttgtggtgtgagtgttggatctgtatttccagtgtcgtttcttgtctaacagaggcttaggtgatgggattaattttgccccttacagaggcactgaggacatcacatcccctcacggcatccctcttgaccttctggaccgagtgatgataatccggaccatgctgtatactccacaggaaatgaaacaggtgagcctcccttcttccctcctgctctcttctctcatttgctcccagtgttcactggtggctgtgcagaaaggtatctgcggcttggatctggctgccattcaccatctcaccacttagctactggcctcgagcaagtcacattactccagagtctcagtctccccatctgaaagatggattggtctaactagacattgccccaagtgtcaacagaagctcagctccctgtcttggctgttcgcttttctgctgttccccctttgataagctttaggaaaaggatagtgaaaaaatcaacatgatgatagccattagggaggctaccagctctataaaaaggaagcaataaaatatgatttagtgatagccttttggtgaccaggccagaatatgcctgtggccttttctactcagaggacaaggccaggctcgctgttccacctgaaccaacagcaagccagctccagcagggtacagaatgtagccaccctgacctggaagaggccagtgcttgtgtcctagcagagcctgtctgctgtaaacagcatgacaagtttctcggcagctttggaggccgcccctgggcaggtctgtggctttgcaatagagtccttgagggcttctgccaagtccacagaggtgatggcgagacagcatcatacagcttagaagagcacctgaaggagggagtttgtgaaactgatcatataataagaggcttcattggaggacccttggaagcatctagctcagtggctggcacactgtgcatgccctgaagtctgcgtgagctgaatctgggttaggctgagttgggagacgacagggatgtatgagcgtgggctttatccaaagggccacagtcccagttgtccctgtaggaattgcctcttgcttggtttggagctagagcacaactatgtgccaagcataggaataccattggactaggaatttctagtcaccttcatggtatttccaggtattccatgtgatcaccatctattttattttttacatttgagtcatggagctgtaagtgcaggatgcaaagccaggcagtgccctgtagagcccaggccatcttcagtggtacataccctgaattggtgtctccgaggcagcatgtgctgtgctctttcctctgccctgcccacctttgccccaaatgttctcttctgatgggctctggcatgcagccatggttggagatgctgagcagactggggctgcagtgacgtctcgatgcgctttgcctggaccttgtcttttcaccagagcatggcatctttgttgagcatcgtgttgagcaggacatgcctggccagtttgattccatttgatccccagtaacccatgaggcagggagaactactgtcattgccattttaaaagatgaggacattgcccaggcatggtgactcacacctgtaatcccagtactttgggaggctgaggctggagggtcacttgagctcaggagtttgagaccagcctgggccacatagtgacacccctactcaccaaaacatcaaaaagttagccaggtgtggtggtgtgtgcctgtagtcccagctacttgggaggctgaggtgagaggatcgctttagcccaggaggtcgaggctgcagtgagctgtgatggtgccactgcactccagcagagtgagaccctgtctcaaaaaaagacagatgaggacactgcgacctagggtaactaattcgcccaagttcataacattagtcagtggctagcaggtaatgggactggctgtaatccaggctttctgattccggaaacccgtgttcttaatcactgtgccacccagcttccctcctgctagaaatctctcatctcattgtcattaggattcatgaggtggctttcctctggcagtttgtgagcaggacctttcccttggagcagtcagggcctctcctgggcctttcctggcacttctgctgctctcctgtggctggaggcccagcctgggcctgccagcatctcttaccgcatgcaggagtgctgtggggatgcatcaggagagtcacagatctccctttgtaaccagcattggcaaattactgaagcagttatggttcatagtagcaattgtatatgttacctaggagatggtgtcaatggccgggggcctcatcgccacgtaagggtgtcttgtcaggtgacttgcaagggtgactgccaggttgaagccaaggcattcactgaacggaggcagaagcagaaacagtcccaggcaattcttggaaaactggcccattcttactgcgggacatagcaccttactgttgggtccaaaaccccatgtgtcctgccaaaaaaggcagcccagcacagatgtgttcagggccagagacaccatttgcctactgaatgacttgagcaatttggtgcatctcaccgagccttcaccttctctgttaaatggaacatctcctccctcctttgcaagattgtcattaggatttgtgaggtattggcaataacgggccctcccatccttcccattgctgttgttattactgtattcatagctttgtgtgcttcataggtaccctctagggtcctctacgtacaacatacaacagcttcgcaatagccagcgttggaggctccaagaacgagggtcctgtggctatgtggagagtaagcagcagagccaggactgccactcagagctagttcacccttgctgccgccattcgaacccagagctcctggcccaaacagtctggaatgttctgtactgtgcttctaggacagtgacttgccaggccaactctgggctggggctgtcttggctctgtcaggagggcctctcctcaggctttctctcaggactcgtggctttgttcccgctggcccaggtgataacctcagcatttttactggagcctggggctaggtttttaaacaaactcaatgtaacttgtgtactctgcaatccaagccgacaccctcataaactatccctgcaggttattaaatgattaaagatctcatttatgaactgtccattttcgagcagcctgagacagacgctttcacgattgctctgacctgctgctctctctagtgagagagagagagcagagtgtccctgacattctggaagctgagccacagattcagtgcatctcactgaaggcgaggcacttagcttaagctgtctcctatgaccaggctccaggattcaatatttacatctccctggagtttcagaaggtcatctggggacatttttcttggcaagacctggtggtttcctcagtcccagctgtgagtgagaagccgtttttaccttgaagctgtgttcaggggggagttctgttgtgagtccctcccagctccttttcttggttgtccttgtaccatccagtaacttcagagggcccctttttgcccagctgcatttagctttggatttcagacagtgaagcccctcctgcataagctaagattgtttcagtggagctcacaccctggcagttcacccatgagcccagcagatacgtttcatgtggcctatgcagtgtttgtgaaatgtttgaacaagttgctgacatctagacatcaggacatttctttctttctttctttttttgagatggagtttctctcttgttgcccaggctggagtgcaacggcccaatctcagctcactgcaacctccgcctcccgggttcaagcaattctcctgcctcagcctcctgagtagctgggattacaggcatgtgccaccacacccacctaatttttgtctttttagtagagatggggtttcgccatgttggtcaggctggtcttaaactccagacctcaggtgatccacctgcctcggcctcccaaagtgctgggattacaggcgtgagccattgtgtcctgccaaaatcaggacgtttcgtacaaggatctgagttctgagcctgtcttgagaaaagggaagactgcagacaacaccttgcagcagtggtggccgcgggtggaggggctgcctccccagggtgtttgctggccaagcatttcaccctcacctggctcatcgcagccgctctgtcctgctggggctttccaaggcctttcccatctgtgggcagccaatgtgctgtcccccaagcccaaccgcgatcatcagagactgggctccccctgcagctcctgcccgcagggtcccagcctggagagctgacaggcgaggcttgatgtggccacctcagtaaacctctggctctcctccctcctggaaggctgaagctgggactcagtctttcccagctcctgtgcctctacactgggtgtgcttttatggctttaatttcaacaagggcttcttgatatcttgtttacgaagctgccaaagtgaaaaattcctgtattatatgcggctcgaagtcctgcagttatctcagctccacaacacacaacatcattatcctggctgccccttatcactcagtgctggtacgcctgcaggatcctggtccaccgtgttacagcatccccgccgccagcctgcctcccctccaactctaccaagatcttcaaactgcaacaagcgtcagcctcttcttgatagattagatatctcccggtgatgttatgaggcctggtaaatctttaaaagtaacttttttgatttatttaaccatcatatttatcaagcaaataaaaaatgtcccttcttgcctgagtgcttgtaggcagtagtgcccatgctggagaggaaggttagagcccttgcaggagccccgggtaggttagaagaggccccagttctctgcctggggacaggggacgggaggacatggaggcaagagtgagccacttgggaagctgcatacctccttgggcaccagccacacttgagtcagttgaatacagcacactggccgtgatgctattcatgcatactgcagggccgcacatgcctcctggagggtgccgggccggcagtgctgggcaggcgttggctccctgcccaccaacccaggtctcagtttctcttatgctgcacagtgagaaatctgagcaacattgtctttaaagcactttagaaatggggcacttgaggtcagtcaccgttgatcatgttttttatcctttaaaagatcattaaaatccgtgcccagacggaaggaatcaacatcagtgaggaggcactgaaccacctgggggagattggcaccaagaccacactgaggtgagctggtaccctgggcccgccggggcctccccagcacagccagggccctcgctggggtcattctggacaataaaggcaggtcccttcctagggcatgggactctatccatccgctcttcctggcacgatgggtgccagggcacttgagtttcaaatgcagaggatctatctgatggtttttaacaagctagagtaagggtgaagtccccatgtcctgcagcagatgctcccctctggtggagagtgctttgaccctgggccttcttgtggcagagaagatgcacagaactagagagcagggaccatgtggtagctcattagccagggccctggctcctgttctcccggtggtgttatgaggcctggtaaatctttaacttttttgatttatttaaccatcaagcaaataaaaaatgtctgggtggtggatatggagagccagggaggagcgcagacatagacagttctcctaattgttctccagcggctcaaacacaggaccggcagagcatgtcccttcacagtggcctgactcattgtaaaatcattgcttcacagtcctcagcccttccctacatcccttgagtcagttcttgctcctgaggttgaaggcagaaatgcaagctgtgaggtttggatgaaggggtactttttaaaacggcagagtcttcatgcctttggatgggcatgtacttccagctggctatgttttcatttccctgccatgttaaatatccctatctgtcggacacctgtatacatataagtttgcagtccttttccagtagcagtgacattacttcctactggaggatttgtagactgtactaaagatttggggaatagcacttatgtcttcttggtggctcctggaccctctctgatgggataatgactgcagctctctgagaagtgacaactttgtctccccttttctgtgttcgtagcagctggcacaagcccagcactgggctctgctcctggtgccagtgctgcctactgatgtggggggaaggtgctttcttcggtggccccagtttcactccagccctggcccctgtccactctaggtactcagtgcagctgctgaccccggccaacttgcttgctaaaatcaacgggaaggacagcattgagaaagagcatgtcgaagagatcagtgaacttttctatgatgccaagtcctccgccaaaatcctggctgaccagcaggataagtacatgaagtgagatggctgaggttttcagcagcaagagactccccaggtgtgcctggcctgggtccagcctgtgggcgcttgcccctgggcttggggctgccgtccccactcaggcgtgggctgcagcgctgtcagttcagtgtggaaagcatttctttttaagttatcgtaactgttcctgtggttgctttgaaagaacccttccttacctggtgtgttttctataaatcttcataggttattttgattctctctctctctctctctaagttttttaaaaataaacttttcagaacagttttagatgtacagagtcattgtgaacatacaatagggagttcccatgtatcttgtacccagtttcccttcttgttaacgtgttacatcagatagcacatttgtcaccgtgaatgaccaatactgatgcattattatactgcgttcacattttctcagttttacctaatgtcctttttctgtcccaggatcccatccaggataacccattacaactagttgtcatgtctccttagatgcctcttggctgtgacatcttcttagattttccttgttcttgatgaccctgacagttttgaggaggactgatcaggtatctgtagaacatccctcagttggggtttgtctgatgcttttctcatgagtagactgggattgtgggttatggagaggaagactagaggtgaaatgtggttctgatcacatcgtatcatgtgtggttctcatcacatgctagcaacatgactcatcgttgatggtgagcttgaccctttggctgaggtcatgtttgtcgggtcttctcactgtaaagttactctctgctgcctttccatactgaattctttggaaggaagtcactatatgcagcccacacttaagtggcaggggttatgctcacctctagagaactgagtatttaccaaaattatttgggattctgcatggaagattgtatcagaatggacttacggaagttcattgtatactttagtagatttattttgttgctcaaattgagccagctttggccagtgagagctcttgtcagttggctcgtgtgtccctatctctgaagtgtccctctgaagtgtccctatctctctggccgaatctctgcgttcgcccactaagtaagcagcaagggcaagtgcagcactgggcagtgcaccttactggaatgtgccttcccagtaggatgagagctgcgttcttgcccttgccaggcctgtccttccctgctggctccgtggtgcctgaggtggggctaagtacccggacgctgttcccagcacttgctccttgtgctagttcagactggatctccgtgctgtaatgatatgggaggcagggctgactaggatggtcatcttggtccagtgctttagttcagactaactatgagctccttgtggggcaagcagcattgtccttccattagggacagtcccctgtagtcatgtcaaggggacagtgggagggggcggagatgatgctggggattccatctagcctgagaggccccagccgtccctgctgccagagtgaatcttctccctcggcctggcccctgaggagacactggcatgcacagcagtggtggtgggacccttcatgaagtcagctgtgcatgtggcccatgccggctgccagtgtcctctgaggctgcgcttgtctttagcctccccactcgagccatgttagacaaacagaagagagatgcagcaagagcttattgcaccagggactgtgttcacactctgcgttccatgttgccttcacagtagcctgtgagactgggataggtgtgctagcccacttccaagaccacttccacagaggaggcaagtcccttggccagctagtgagagatggaaccaggatttgaaatcaggctgcttggaacctgtgttcctaactcctgggggccatactgcctccttctgtgttggcatttagcagcagctaggagctgtcaagatctgacctttgtaccagccaggtgaaggaagcggggtccggtgtggggaaggtgacccacctagaggaccagaaccaggcctctgccctggctgggcctctcacttgggctccaagcctttcatgctgtttaaggagcaagatggaagtggcgctgacagcagatctcacagccgcgggtggggacagagtcttcttcggctgcccaaggtaccaacatccagatcagccaggtgaggaggggaccgtggtcttgctcttcctaggccacagacccctggttcctgcccctcaaatatcctagc

SEQ ID NO: 12279 - DNA, 22686 bp, Human
tggggctacaggtggacaccaccacacctagctattttttaaaaaactttttgtttttaaaacaaaaactggagttttaaactccaggccaccactgcctctcacctgcaccactgtgcagtgtcctgaccatctccctacatctgttcttgcccttgcaatcatcctcaccacagaagcagagaagttacaagtgtggcaaagggcagaccggaattcaaagccaatgtggagtggggagttggatacatgagtctggatttcagggaagaggtatggatttaagatacaaatgtgggagtcactgggtatggtggctcacgcctgtaatcccagcactttgggaggccgaggagggcagatcaggagttcaagaccagcctgggcaacatggtgaaacactgtctctactaaaaatacaaaaagttagccaggcgcggtggcgggctcctgtaatcccagctccttgggaggctgaggcacaagaatcgcctgaacccgggaggcagaggttgcagtgagccgagattgtgtcactgaactccagcctgggcgagacagtgagactccatctcaaaaataaacaaataaataaaaataaaattaaaatgtggaagttgccagagtaaaaacatttaaacgctggctgaaatcaccaagggagtaagtctagaacaagaagagaaaaggacccaggactaagccctggagcacttaatattattcagagtttgggaagttgcaggcgtccagctatgttgcccaggctggtcttgaactcctggcctcaagtgatcctctcaccttggcctcccaaagtgctgggactacaagcatgagccaccatgcccagcccggatccccggtctttaagattcctctcaagcaggtgtctgctaacaccaaatgaaactcatctgccggcttcatgttttcatgcttttttcctacttaactcatcgcactggacttttgcagtctcttttttctgtgtctcctccaccgttctgggagtccccttggaacaggaacctcatcttattttgtcttcttggctcaatgcatgaacttcttggttcagtgcgtgaatcataatacctgttaaacccactctatgggccgggcgcggtggctcacgctgtaatcctagcactgtgggaggccaaggtgggcggatcatttgaggtcaggagtttgagaccagcctgaccaaaatggtgagacccccgtctctactaaaaatacaaaaaaaaaattagccgggcgtggtggcacatgtctgtagtcccagctactagggaggctgaggcaggagaatcgcttgaacccgtgaggcagaggttgtagtgagctgagattgcaccactgcactccagcctgggcaacagagcaagacccggccaaaaaaaaaaaaaaaaaaacaaaaaaacaaaaaaacccactctatgaatagtgagggtcaaagaggttagagtctggcacaggtagactagaattcccagtctgttctcttgggctccagattctcactccaccacctgaacactagtgagtcccttccgttcccaagcctcaatttccttagacagatgtaagcagttgaattgactaacaactatccaaccccaacctactgggcaagttgcctcctttggggtcaaacactatccaacttcagtttcccaacgtcataaaggagaactctaaaagttgagaatcgaaactgatgacagattgactagacggccagcctgttaaggtggccccagatattccagcctcagcccagagtcctcctgtgcccctactgcagcaagggtgtctccaagaagggggacctggagtcagcccgtcacacctggtttcctctctgctagggtccctcctcccacagagcactggagggcagctgaggaggagctaccttaaaaaaggaggtgtgtgccagggagctgggtaggagcctggctatatatctgcccagcagcggtactctcgggacagagatggcactgatgcaggaactgtatagcacaccagcctccaggctggactccttcgtggctcagtggctgcagccccaccgggagtggaaggaagaggtgctagacgctgtgcggaccgtggaggagtttctgaggcaggagcatttccaggggaagcgtgggctggaccaggatgtgcgggtgctgaaggtagtcaaggtaagactgggctcctccagcccccacgcaagacaaaacccagtatcagagtccacgtccctggggatgctggggacccctgtcctccttatccctagcccatgctgatgacatctcagaataccccatcccacctagctgtctacaccccaccgcaccactgccttgagtagaatgagtctagtaataatagctcacatttgggggctcactggactaacctcttaacatacactatctctaattcttgcactctgtgagataggtactattctttgcccagtttacagattagcaaatggaggctcagaaccaatacaatgcgaggtccttggttggatcctagtgtgaatgaaccatctgtaaaatacagtttggggacaactggcctagatatcagatagtacatatatctgatataggaaatcattgttgattttgttaggtgtaacagtagttttgtggttatcagaaggttgtcttttgtttggacacgaacactgaagtattttagggacaaagttccttggtgcctataatttactttaacgtggcttagattaagcacatgtagccaggaatttagacttgttgaatcaactagttgggtatatgagtgttagttgtatcatctatttttctatgtgttttaactttttgataataaaatgactttttttttttttagagacagggtctcgctctgtcacccaggctggagtgcagtggcacaatcaccactcactgtagcctcaatctccctgagctcaggtgatcctcagcctcctaaatagcttgggattacaggcatgcaccaccatgctcagctaatttttgtattttttgtagagatagggtttcaccaatgttgcccatgctggtctcgaactcctgggatcaagaatatgcccaccttggcctcccaaagtgctgggattacaggtgtgagccaccatgtctggccggccaataaaatgatttttgtttttgttttttttttttgagacagagtcttgctctgtcaccaggctggagtgcagtggcacgatctcagctcactgcaacctctgcctcccaggttcaagcaattcccctgcctcagcctcccaagtagctgggacgacagcgcccaccaccacgcccggctaattttttgtattttagtagagacagggtttcaccgtgttggctaggatggtctcgatctcctgacctcatgatctgccctcctcggcctcccaaagtgctgggattacagtgagccactgcactcggcctaaaatgattttttaatggaggctcagagaggtgaggtgacttgcccaaggtcacacagtgttgaagctgggatttgaacttgactcaagggacccaagcccccctcactgagattttcccccaagcccttcctccagctgtttcatgccaccgcctgtgctagctaagatcaaaattcaagagggtcggagctagaaagactttggagaatcagacagtctcaccaatgactcacttaaaaaattaagtaaaccgaggcacagagagggtgagagataccccaaggtcacacagcgagttggtggcaaaggcaagactagaattaggacccctgactcccagcccagtgctcaagttctctctctaggggcaaccaactcacagagggatctagaagccctgggcccctatccgttctttgcacctatccccagcatatgaagcctgaggccatacaatttataagtgagaaaccacaaattttgatattagacagactcttcgcttcttcctttaccagctgtgtggttttgaccttcccactcttctttctcaaacccacattcttttcatctgtgattggggcatcatcatcatctctccctcaccaagccagtggtgcaatgcaggctgaatgattcatgcacgataaatgctcagaaacagaagcatcattataattcttgccaagctttcttctgggcctgggactcaagtctgactctggcagaccctcctagaccaccccctccccaacaaacttgagaataaagtggagggaataaggaatgtctggtaagaggaggatgctacaagaataagtttattgtgtgtgtgtgtgttccaccacgcctggctaatctttgcatttttagtagagacggggttccatcatgttggccaggctggtctcgaactcctgacctcaagtgatccacccacctcggcctccccaaatgctgggattacaggtgtgaaccaccacgcccggccaagaatgagtttttacggcaggaaatgctatttacctaagcctcaaatacttcctgcacatcatagccacttttcctcttgaaaccactaaatggtagcaatccccagtgagccatgactaatgaggaataatatatcttatttagagtctaaaccctcccgttccccaccctctgaaaatctagtgagcggagctggtccacataagggaatgctcgtcttcaaatgaattgtgcttaaataggtttaaaactgaagcaaatcaggaagcctgttctggatgtgttcttttctctctgcctggatcttaccagtgggaaaggcagaaagggaagtctacgccaggcacagtggctcacgcctgtaatcccagcactttgggaggccaaggtgggaggattgcttgagcccaggaattcgagaccagcctgggcaaaatggtgagacccccgactctacaaaaatatatataaaaaattagctgggcatggcggtgcatgcctgtagttccagctactccggaggctgaggtgggaggattgcttaagcccaggaggtcgaggcttcagtgagtgaagatcgtgccattgcactccagcctgggcaacagagcaagaccctgtctcaaaaagaaagggaagtctagactggccttcggggggaatgtgtccttcattcacacacagggtgccatctccaaccctctcccagggggtggaggtgctgggtctgaatgcccatggtcccttggaagcagggcctggctcacagccttgggtcacgaggaagaaagaggcggaagaaccatcccctacttgagttctggctctttctctgactctgctgccttctggctgggagaccatggcaagctcctcactgcctcagtcttctcatctgtacattggagataattctcctagtacccacctcaatacaggaagtgaaggcgtttttttttgttttgttttgttttgtttagatggagtctcgctgtgtcgcccaggctggagtgtagtggcgagatctcagctcaccacaacctctgcctcctgggttcaagcgattctcctgccttagcttccccagtagctcggattacaggtgcacacaaccacacctggctaatttttgtatttttagtagagatgtgctttcaccatgttggccaggctgatctcgaactcctgacctcatgatccgcccaccttggcctcccaaagtgctgagattacaggcatgagccatcatgcctggctgggaagtaaagattaaaaggaataatatgtatacagggctctcatgggtgccagacacagggcgtgctcatgtcatccagcatccgtgctcatgtcacacagggcatgttatatcatccggcaacagctggaatctgattcttgtgcagtgactccaaccaccaagaaaagtagccctctgggggtctgatgcctccctagcaattccacctcccaacacagaatgagaaggagaggaggccagagagttgtggcgctttgcataccagaggcaccagggcctggagagctcatctagaatctcaaaacatcgaaaaatcccttctcgacctccttccattactaacaggaaaactgaccccccggcagcagaagagattgtctaagtcagctggataatgagaagaaagagaaatgtattgctgacttcctgtgtgccaggcaccccaccaaacgcttggcatacattatttcatctgatcctcccagtagcccagtgactcttgttccaacattactttcattttacagatgagggtctcaggagtcagaatgtttacccagctaagaaacagggaagagtcaagatctttttcaggctgctccatttcacagcctatggctcttaaatccaccaggcaaacttgctccttgctttataatgtcatgaaattattcagccccaccaccacccccagaatcctcaaacaaccctatggagtagatgctaccattcctctggagtaggccttactctgtgggtaagaagactgggtctcagaagcaatgcagtgtagtagataagaagctgggcatttggggaggccaagggggcaaatcgcttgagtccaggagttcgagaccagcctgggcgacatgccaaaacccagtcactacaaaaaatacaaaaattagccaggcatggtggcgcaggcctgtagtcctagctacttgggagactgaggtgggaggattgcttgagccaagatcatgccactgcagcccagcctgggcaacgggagtgaaaccctgtgtaaaaaaaaaaaaaagagtctgggctctgagggctgcaaactgcgagacctgagacaaatgactaatgaggagaaagacaaatgtgttgctgacttcctgtgtgccaggcaccccaccaaacccttggcatacattatttcatctgatcctcccagtagcccagtgactcatattctgccattgctttcattttagagatgaaggtcttaggagtcagaacatttacctagctaagaaacagggaagtgtcaagatctttttcaggctgccccatttctccatcccatgtctcgagatcctccagacatctcagttttctcacctgtaaagtgtgggtattagtactacccacaacccatccctcagcgggtggtgagcattcagtgagacagtgcatgtgaagtgccgcaggggttgcctggctcatggcagtgggcctcagggtgacggggctctgtgttctgcaggtgggctccttcgggaatggcacggttctcaggagcaccagagaggtggagctggtggcgtttctgagctgtttccacagcttccaggaggcagccaagcatcacaaagatgttctgaggctgatatggaaaaccatgtggcaaagccaggacctgctggacctcgggctcgaggacctgaggatggagcagagagtccccgatgctctcgtcttcaccatccagaccagggggactgcggagcccatcacggtcaccattgtgcctgcctacagagccctgggtaaggggaggggaagctcacccgactcacacacttgcccaccccaggagacttcccagtgtctcacctttactcatggccacgtgcacacacccacatttattcatttcatctgtgtcctatgcttggggctgggttattgcagtgcacaggattaactcaactctggctatcatattgctcaacttggaatacagaaattgaccaaagaattgcagagataaatacatgattgcagcctgggcgcggtggctcacgcctgtaatcccagcactttgggaggccaaggcaggtggatcatgaggtcaggagttgaagaccagcctggccaagatggtgaaataccatctctactaaaaatacaaaaaattagctgggtgtggtggtgggcgcctgtaatcccagctactcaggagggtgaggcagagaatcacttgaacccaggaggcggaggttgcagtgagtcaagatcgcgccattgcactccagcctgggcaacagagcaagactccgtctcaaaaaaacaaaaaacaaaaaaacaaacaaaaaaacatgattgcaaatggtgtaaatgctcagagaaaaagaatggggtggcctgggtaaccacagaaagggtgctcaggaagtgactttctggggaaacaacattcaggaggctctgacacccagtgaggggaaggagctaaaagtgggagtgggggtctgtcactgcattttatagaagcagatcctaagacatggatgtgaggatacgcagtttatttgggtattcctcccaggaaacaccggtagggaagtatggaactgagatgggaaaggcaagaattcaatacaacgtgcgtccatgggcaagtcaccaccctgagcttcatgtcctgggagaactcacagtcccattatggagcgaacctcttcgggatcccaagtgggacgctggcgtgcttactcaccagcttcccagccgtcactggttgggggctgctttgggagcactaactcactggcccctgttgtttgtcctcgggcagagtcctaggtgtttgaagtaaaacctacatgctgcaagcccagatcctagaggtttcatctcatgtgctaactcctatcagctgtagtggctggctgcgtggagttgctctttggagaaggtataagagacaggatctgattttagcaaggaagagagtgctgggatgtctcagtgatgtgtaccatggaactggttcctggttctccctatgagtttatatatatatatattttttgagacggagtctcgctctgtcgcccaggctggagtgcagtgccgtgatctcggctcactgcaacctccacctccagggttcaagtgattctccagcctcagcctcccgagtagctgggattacagcccgccaccatgccatgcctggctaatttttctatttttagtagagataggatttcaccatgttggccaggctgatttcaaactcctaacctcaggtgatccgcccacctcggcctcccaaagtgctgggattacaggcttaagccaccacacccggcctccctatgagtattgaaagagatacaaaacagatattaaagaaaatgagggacattgaggacatccagggaggggtctgatgcatggaaagcccaatgttggttctccagagtaagaatttcacaaaaaggacaattagacaaggcaaacctttggtttctgaagatatgaggtctcaagtgtccctggagggatacttccaatgtaaaggcaggctctccccaaaatactacttaccaccctctggcttcctcaatccccaatctcttcctttgctccttcactcctcagggccttctcttcccaactcccagccaccccctgaggtctatgtgagcctgatcaaggcctgcggtggtcctggaaatttctgcccatccttcagcgagctgcagagaaatttcgtgaaacatcggccaactaagctgaagagcctcctgcgcctggtgaaacactggtaccagcaggtgagggggctgccaggatggcaggggcaaggagagggaagagggtgaggaggaaaggcagggcctgattttcatctcaggaagctgcagccaggggaaatggaagcaggtagagagggagagaatgctagtcttttgaaatgtaaagtgaaaccgtcagtgaagaaggtggaaaaggaggagaggaggaggaagaggagaaagaaacagagaaggaaggagaaaaataggtgctctacagtatttcagtaaactagttatttttattttattttattatttttttttgagacaggatcttgctttgttgcccaggctgtagtgcggtggtgcaatcaccactcactgtagcctccacctccctggatcaagacctccctggctcaagtgatcctcccaccttagcctcctaagtaactgggactacaggcatgcacaaccatgcccagctaattttttttatttttcttttgtagagacagggtctcactatgttgaccagcctggtttcgaagtggtctcaagcgatcctcccaccttggcctcccaaagtgctgggattacaggcacgagccaccacacccaccccacatgttcttgttacccttcaattacagtctaggcctggcagatgtcagcttcgccgggtactgtggccattcgtcacagcaggttaaggactaacaaggggaaggatttctttaattccaccccaggagtcgaaaagagggcatgtgtgagtgtaaacagccctcagggacatttctcaggcagcagctcagtcagttttggaaacaaaatcttcctccgagataacggaaactccaactgcaaaacagaactcagagacaaaaatcatttattatatagaacttgcagagaagttacaagggaatcagacagcagaaggaaagatttgatccaataaaaataaaataggctgggcatgatggctcacgcctgtaatcccagcattttgggaggccgaggtgggcagatcatgagatcaggagatcgagaccatcctggctaacacagtgaaaccccatctctactaaaaatacaaaaaaatagccaggcgtggtggcgggtgcctgtagtcccagctactcgggaggctgaggcaggagaatggtgtgaacccaggaggcggagcttgcagtgagccgagatcgcgccactgtactccagcctgggcaagagagcaagactctgtctcaaaaaataaaataaaatataacagggatttaaagaaaaaacaattaccggccaaatgtggtagctcacgcctgtaatttcagcactttaggaggctgaggtaggaggatcacttgagcccaagggttcaagaccagcctgagcaacatagtgaaaccccgtctctacaaaaaatacaaaaatacaaaaattagctgggggtggtgatgggttcctgtagtctcagctgctcaggaggctgaggaggaaggatcacttgagccccggaggtgaagtaagttgagctgggtattttttttatctattcactaaggcttacatcttacagattacaggcatcctacattttatatatcatctaagttttaagaatgtaacatttcactaatattgaagaaaataagttatattaccatgagtttaaatttctaacaaaattataatgttattagttatggtttacaaaattgagtgttaaggatgaatttgcaaaaagttacaaaacaaattaattaacttataatttttttttttttgagacagagtcttgctctgtcgcccaggctggaatgcagtggcgcaatctcagctcactgcaagctccgcctcccgggttcatgccattctcctgcctcaacctcccgagtagctgggactacaggtgcccgccaccatgcacagctaattttttatatttttagtagagacggggtttcaccgtgttagccaggatggtctcgatctcctgaccttgtgatccacctgccttggcctcccaaagtgctgggattacaggcgtgagccactgagcccagccttataaatacattttaattcaaaattgaatttctaaggtcaaggataaagtttttttgttagtaagtcagtgacctataggaaaggcccaaggtttcatttatttgggagatgagaattatacaagatgattctgtgtttgtttcaaggccaaagtgttatagcttttttttttctcctctgactttgggatgggagctaatattcatatatgatggccataggaaaatatgtcagttttacttccacaaatcaaactactgaatatttgaccaaaatttttcactttctggctaaatatcaatgtatcagtgaaattctttttttttttttttttttttctgagacaagttctcactcttgcccaggctggagtgcagtggcatgatcttggttcactgcaacctcctcctcctgggttcaagcgattctcccgcctcagcctcccaagtagctgggattacaggcacctgccaccacacctggctaatttttgtatttttagtagagacggggtttcaccatgttggccaagctggtctcgaactcctggcctcaagtgatccacccgcctcggcctcccaaggtgctgggattacgggcgggaggcactgcgcccggcctcagtgagattcttaacacaggaagtgaccactgtcagttaagatgcttccttttgcaagtaagagaaaaacacaaaaaccaactcaaactggcttaaacaataaagggaattatcagcttatgtaggaaaacccctaaacagtagggggggcgggcggggggggcgggtttcaggcactggtgagggcactggctctgtttctctggaattctctcagcttctcattcctctatatgtcagcttggtcctttggcttgtttccctcttggtggcaaaatggccacaactattcctgccctcatattcacacatgggaggacttctcttctttcaaccactgaacaaaagaactaggctttactctagttgagccaacttagatcgcatgccttctcttgaagcaatcacttgcaagggggaaaggtttatgctgataggactgtgccagtcagggcccatcctggagctgcgggtgggggtcaaccccttccaaacatcatggctactatgcaatggggaaggaaagaatgtctgctagagaggcaaccccaatcttcactacagaatctcacctattaccattttttccctctatctaaggaaacctttcctttcttttaagaaacatttctcagcagctcaatacattaaaatagatttaaatgggactgcttaggctagaatgtttgtgaccgagcgcaatctgctcatacctgttcataagttcattccaggagttacatctgttgagcatatattgaagcccaatggactaactcagccctttaattctaaaatggtgaaacctatgtctagagatggaatgtgacatggccaaggtcacacagccagtaggcagcagagccaggactagaacttggatttctcagcttctggtccaacgccatccttacacagaatcttagggtctctctctctctgtcttcccatctctttcaacagtatgtgaaagccaggtcccccagagccaatctgccccctctctatgctcttgaacttctaaccatctatgcctgggaaatgggtactgaagaagacgagaatttcatgttggacgaaggcttcaccactgtgatggacctgctcctggagtatgaagtcatctgtatctactggaccaagtactacacactccacaatgcaatcattgaggattgtgtcagaaaacagctcaaaaaagagaggtactggaccactgtttgcccaccaaatcttacagaaaaaaagagagacgggctagtgtaacgtggcatagagttttatggattggctgtattaagcagtaaggctgccaccatagttgagcatcgacctcccacaccaacacagctggcatctcaagttggtggcttatcaaagtcactggggggccatggggcgggtagaagcctgttccttgtttcctaagccaccctccaccttagcttggccttcttgctctctgaagaccattcagtgctttgtaggagctagcatgggaaaatggaaagaatcttggagactcaagtttaaatcccagctcagccattttcctactgctatgagcctcaatcccttatccataagacaggagtaaactggaacctacgatataggattgatgtaagggttggagaaaatctgtgttaaggatccacaatatctagcatctggcagatgctgagtaaatgcttatattggagcatgtgctgtcagcgtcccattcatatcctctcggcctttaccgttctagggaaggttggttccacttccagctgtcagcacctgcatccctttgccagcagacccactctgagaagagccctccaccagatctggtgggagttggtggataaataccacagctccctcacccaaaagatggaaggaatctgggtctcattgcgtaactttttttttttttttttaagacagagttttgctctgtcacccagggtggagtgcagtggcgcaatctccactcattgcaacctctgcctcctgggttcgagtgattcccctccctcaggcttctgagtagctgagattacaggcgcctacaacccacacccagctgatttttgtatttttgtagagacagtgctttgccatgttggccaggctggtctcaaactcctgacctcaggtgatgcgcctgccttggcctcccaaagtactgggcttacaggcgtgagccaccgcactgggccccattccatactctttcctaaagatcgcctccagtggaccacagtagtaattacttcaatacccactctttgttgtctgccttcccttatctgtctcactgtctcactcccttatttgtgcttcctgggatcactttccaaataagccaaatccttatctggggatctgcttcaggggaagcccaacccagacaactctctgtgttagaagctctgggcctgtgtaagcaacatcacagtatttagtgttctgttatgtagtattgggtctcttttgtaaggaagaaaagccaggtctgctcatgaaaagaggatttattataaccatggccagaaaaatcgagaaagcatcaggacctgagactccctctctctctctgtcactctctctcatgaactacagcacttttcccctcagcctctgcttctctctccacacctgtccggctcccctctgcctcccaggtataagggatctccatcatccccatgtccaaaccccagagagaaccagtctgattcctggtcacgggacacagaccccatgtgttgggtcacctgccagccaacagaatgagccactttagatcagtgaccccaccccataggacagcctggcactttcaggcaggactgttttagggagcagtcagggttgggaggagccagcctggagcccaaagtccagttcattccagtagcctgtgtcacattcgattacacagatgaagtcgcagctccctcccaagccctggagtacaaagggctgggttttttttgtttgtttttgggttttgtttttttttttttaatggagtcttgctctgtcacctaggctggagttcagtggcacgatcttggctcactgcaaccaccacctcctgggttcaagctatcctcccacctcagccacccaagtaactgggactacaggcgcctgccgccatgccctaatttttgtatttttagtagagacacggtttcaccatgttggccagcctggtcttgaactcctgacctcaagtgatctgcccacctcggccccacaaaatgctgggattataggcgtgagccactgcgccccactcaaagagctggtgttaatcatggacttgcagtcaccccaagttaataagcaagcccaagatccccttcaagccaatattctttaaaatatttattcaatatttatagaaaggagagacttttgggggcagcccaacctctgctctgttgaggaggtagatgggtaagagcccccatctactggctgtaagaacttagggcaatctaggccgggcaccggtggctcatgcctgtaatcccagcactttgggaggccaaggcaggtggatcacgaggtcaggagttcaagaccagcctggccaagatggtgaaaccccatctctactaaaaatacaaaaattagctgggcgtggtggcgggtacctgtaatcccagctactcaggaggccgaggcagagaattggctgaacccgggaggtggaagttgcagtgagccgagattgcaccactgcccttcagcctgggcgacagagcgagactctgtctcaaaaaaaaaaaaaaaaaaaaaaaaaggaacttagggaggtctgtaaaaaggggacaaccacaacaataaacaataaaaataacagtccctaccttatagaattgctgtaagattaaaataggttaatctgcataggatttggccttgtgcttcaataaatgtcagtagttggtggcagtggtgtttctactatccaaagtaattcagcagctctaaccttaaacttaaacttgcaaaacctgctccgaaggtacagggccccccctgcctgaaagggcatctgttattactccagcatgcctcttggggcctcattctccccctaaattccttgcaaacacttaaggcactatcccaaagaagaagaatttttttttttttgagacagtctcactcggtcacccaggctggagggtggtggcatgatcttggctcactgcaacctccacctcctgggttcaagcaatgctcctgcctcagccttctgagtaactgggatgacaggtgcgtaccaccacacctggctaattttttgtatttttagtagagacagggtttcaccacgttggccaggctggtcttgaactcctgacctcaagtgatcctcccgcctcagcctcccaaagtgctgggattacaggcgtgagccactgtgcctggcccagataggaattcttggaaatagcattgtctccatcctgttactctcctgcggtgttttggggccctcttgaacatccccgggatgtggatatcacaattctcagtggctggacgaaataattgccgagaaggtttttttctggcttgaaggccttcaaaccattatgagcctgggcacccttttcctgtgttacaggcccatcatcctggatccggccgaccccaccctcaacgtggcagaagggtacagatgggacatcgttgctcagagggcctcccagtgcctgaaacaggactgttgctatgacaacagggagaaccccatctccagctggaacgtgaaggtaatggctcctctctgggctgtcaagggcttgaaggtcagaacgacagataaactactcagtatttactcattcagttctgtgttgatggagaacagaactttagagtcaccgtttaagggccagctgcaccacccatgggctccgtgaacttggacaaattctttggctctcagagccttgggtttcttaccttcaaattcttgttctcctttcctttctttttcccataatttactggagaatcagttctgtgttcctgatcattctttgcgtgagttgggtccagccaagtcagctcaatcagccattctgtgccagtgctgttctcagggatggggtaggggatgtgggctgggggacaacacaggcacagaaataagacatgaccacgacgctcggccaggtgcggtggttcacgcctgtaatcccagcactttgggaggccaagacaggtggatcacttgaggtcaggagttcaagaccagcccggccaacatggaaaaaacccatctctactaaaaaaatacaaaattaggcgggcgtggtggcaggtgcctataatccctgctactccggaggcagaggcaggtgaatcgcttgaacccgggagctgggggctgcagtgagctgagatcgtgccattgcactccagcctggacagcaagagggaaactctgcctcaaaaaaaaaagaaaaaaagaaaaaaaaaagacaccaccctcactctcagagaactcaccctatgttgtcaggaagcaaatccatgaaacaaacttacacaaaactgctagaattaccagagaagacaagatactctgaaaacaaacaaacaaacaaaaaatactaagtcatattattatatgatgccaaacctatagtataggcagagatcacaaaaatctattttattaacatcacactttctagtgtgcaaagctcttgtccaaggtctgtctcagttgatcctcataagcaattctgtaaagtaagaaggtcgagtgttatcactatctttattattattatcatcattactattattgccattttacagaagagaaaactgaggctcagagaggttaattaactaagggcactctgctaagaggcagcagaaccaggggctctgggggtctggaagcagaataaatgttaactgaagtcaccagagaagattcctttaaaaagttaggagttgaaatgagccctaaaggccggggggagatatagacactcagaacagaggacaaaggatgatgaggggtaaaggatgggaggctgggatgagcaagatgtgtacaggacaggagactgaactgcttggagcagaaggcagaagcagaatcagaggctccagtaaggtacatagagtataaacggggggacccgctggccaaatgaggaggcccacccatgggctggaaaatatacgcctctggatttttcctgaatataaaagccattgtaggctgggggcagtggcgcacgcctgtaatcacagcactttgaggggctgaggcgggtggatcccttgagcccaacagttcaagaccagcctaggcaacatggtgaaaccccgtctctactaaaaatacaaaacttggccaggtgcggtggctcacatctgtaatcccagcactttgggaggccgaggtgggcagatcacgaggtcaagagatcgaaaccatcctggccaacatggtaaaacctcatctctactaaaaatacaaaaattagctgggtgtggtggcatgtgcctgtagtcccagctactagggaggctgaggcaggagaatcgcttgaacctgggaggcggaggttgcagtgagccaagatcgtgccactgcactctagcctggcaacagagtgagattccatctgaaaaaaaaaaaaaaaaaaaaagaacaaaacttagccagatgtggtggcacgcacctgtggtcccagctactcaggaaactgaggcgggaggatcgcttcagcttgggaggtcaaggcgcagtgagttaagattgcaccactgcactgcagcctgaggtgacagggcaaggccctgtctcaaaaaacaaaacaaacacacacaacattgtgcaaatattttttatcttggctagtcagaaaacttggcaatgccaggcttatatttctttttctttttctttttttgttttccttttgagacagagtctccctttgttgcccaggctggagtgcagtggtgcgatctcagctcactgcaacctccacctcctgtgttcaagagattctcccacttcagccttccgagtagctgggactacaggcatacgccaccacacccggctaatttttgcattttttggtagagataggttttgccatgttggccaggctggtctcaaactcctgacctcaagtgatctgcccgccttggcctcccaaagtgctgggaatacaggcgtgagccactgcacccagccaaggcttatatttcttctggaaagaatcagctagaggcctgaccctcgccagcattttccaggtgctctccagccacctggggctctcaggccctggagtgtagcctctggaggtggtgagaacacagactctggagtctgaccaacctcacttcacatatctgccctgctccttactacctatgtgattggtgttcagtaaattacctaaccctgctcagtttcctcatcaataacatgggggtaacagtagaaccaaccaactaatagagatgctctgagaataaaatgcattaagggtatggaaggtgctcagcatacagcctggaaagtgcttaccactccctaaacatttgctgctgccgctgctgctgctactattgtaaagataaggacagatgaagggaacatttgcacatcagacaaagaagtgtggacttaacacctctccttctccctctcccttccagagggcacgagacatccacttgacagtggagcagaggggttacccagatttcaacctcatcgtgaacccttatgagcccataaggaaggttaaagagaaaatccggaggaccaggggctactctggcctgcagcgtctgtccttccaggttcctggcagtgagaggcagcttctcagcagcaggtgctccttagccaaatatgggatcttctcccacactcacatctatctgctggagaccatcccctccgagatccaggtcttcgtgaagaatcctgatggtgggagctacgcctatgccatcaaccccaacagcttcatcctgggtctgaagcagcagattgaagaccagcaggggcttcctaaaaagcagcagcagctggaattccaaggccaagtcctgcaggactggttgggtctggggatctatggcatccaagacagtgacactctcatcctctcgaagaagaaaggagaggctctgtttccagccagttagttttctctgggagacttctctgtacatttctgccatgtactccagaactcatcctgtcaatcactctgtcccattgtctactgggaaggtcccaggtcttcaccagttttacaatgagttatcccaggccagacgtggtagctcacacctgtaatcccagaactttgggaggccgaggtgggaggagcgcttgagccgaggagttcaagaccagcctgggtatcacagggagaccccgtctctacaaaataaaaaaataattcactgggtgtggttgtgcacatttgtagtctcaggcactcaagaagctgaggcagaagaatcacttgagcccaggaggctgaagctgcagtgagctgtgatcacaccgctacactcctgcccaggccacagagcaagaccctgtgtctaaaaactaaaacataaaaataagtaaatccgtttaaaaaaaggattatcccagccctgccagggggaggatgaggaggggtgtgaggactaaatatacaaataaatagtgtggtcacatgacgcacagcaacagaattcggacccacagccttctgcagcaatcaaccccaaaccatcaggacttgggcgataactggcagcatctctaactccccaccctactcccatcctgcttcctatttatgaccaacccaagaaacccaaataagctccccagaccaatcacatggttagccccacttctggtgagtgcacttccagcttccccataccaacagcctcaatcacggcatccctgaagccttcccattttcctgcctgtctttaaatctctgtcaaaagcgagagatgggtggctggttcctttgctatagcaagttgggaataaatcgcctttgttagttctcatttgggggctgtttatttccacagggcctaatgctgtcctaatggttattgcttgatcatttgagcttctcaactctaagaaatgaggactggggaaactgaggcaaaaagagacaaagaatgggagattgaggatgatgcagtgtaaaaaaaaatcacctcaactcctaaaacccatacacaaacagtacataatagtcaggaaactgtaggaaagtaatagcatctttattatcaaaggacgtcatgtgatcaggtttactccaagcaataaaaagtttccttttgcccccctgttttgcctagttttctggtgggctactctcctaccatagcatagaaaatgcacactgcaattggttatcaacagcctctggtcaatttagcaatcataatctgtgtatctcccacctctgtttgccttcagggacagaaaaagtgcctcctttccaggaggtagacaggctgttccagtccccatctttgtgtccttcataatgcccagcacagcccacattgtaggtggtgggaaaattcttgtttaaaataaaaaaaagaatgaaaaatgcaatgtcttagtccatctgggctgctaaaacaaaataccatacactggatggctcatgaacaataaccatttatttcttacagctctggaggctgggaagtccaagtcaagacactggcagatttggtgtctggtgaggacctcttcctgattcacagatggcagcttctcactaagtcttcacatggtagaagaggcaaaggtgtctctaggatcgcttctttttttttttttttttttttttgagatggagtctcgctctgtcacccaggctagagtgcattggcatgatctcagctccctgcaacctctgcctccgaggttcaagcgattctcctgcctcagcctcccgagtagctgggactacaggcacctaccactgtgcccagctaattttttttttatttttagtagagacggggtttcaccatcttggccaggctagtctcgaactcctgaccttgtgatccacctgtcttggcctcccacagtgctgggattacagttgtgagccaccatgcctggcctctggggtctcttttatgaaggcattgatccagttcatgagggctcaggacccattatgtaattgaaagattctccgtggggcctgaaagcttaagagaatgaatgacccctccctcccctccctccttgggcccggtcccaaggcgcaaggccactcgcgccagcagcatgtgtcagcaagatagcagaagcgggaagagagcgggccagaagacacctaccccctgaagaccgagagagacgtcatccgggtacaatgtagcggttacaacagactgagaaacttcctgttta

SEQ ID NO: 12280 - DNA, 12699 bp, Human
  misc_feature (1)...(12699): n = A,T,C or G
caatataaaggcaaagttattgaaggcaaagtgtccacaccaacccagattaacacatagataggaggtctcaaaggtgtgcatggtcagttgggggcagcaacacttcttcaactgggttctgtcctctggcctttttcccatgagatgatctcaatggactgaccttgactcaggcagacccctactaagcacccaaaagggaggccagggccctgggcagtctctccagcatgcctctcagcctgtgcaagaccatctaggcttctcagtgtgggtccaccttttgcccgtttcattagatattttttcacacttgtatatttaatatttctctctcgtctatattcttatcctcagtttaaaatatacttgaaacactgccatcctaaattggctgcctctcaatcctgctgtttccctggctatttccttaaatgtctcctttccttcccagaaaacttcctgaaagaaaagctggcacttgctgctttcagttcagactggccattctctcacaccagatttctagtttctgtgcccaccccaccctcagtcccactgacgttgctctactagggttgctaaagactccaggtcatcaaatccaagagttacttttcgatcttcttctgtttggctgttcacctttgttttggtgaaagaaagaatgcatgtctacacagagcatttacaggggagcagcgtcatgtgaattctaataatggaagatttctccaaggagaaatcaactcttgggcacagaatcagggataagaagttcaacctcacctatccacttgccagctggacactaggacttgacctaattaagggagttgacagtttttttggtgttttgttttgtctttacaagcagatgttatcaccccattataccaagaaggaaattgaggctcagaaaaaacttgtagattgccccaagttacacagtgggttatggtcagagctccctccatcacatagtgataatagctatgacttaataactactgtatatcaggcatgtgctaagagctttacaaggcaatacctcatataatcctctcctaaagtacagactagtttatacaccttattacaactccacttgaatgtgtaatggacatctcaaaggtgacacattcagaaatgaaatcaggatcttttccccaaaacctgctctacctacagcttttgctatctcaattgatggtgacttcatcctactaatcgctcagtacaaaaaaaaaaaaaaaaattgcagtcctccttgactcctctctttcacacctcatatacaatttctcaggaaaccctattgaaactaccttcaaaatatatccataatcttcccacttctcagaacttctactgctaccagcctggtcccagccaccatcatctctcacttagattacctagtggcctcccagcaggtctccctgcttttccctctctcgcctccctctcctcacctcccctcaccctccagtctcttctcaaagcagcaggagaaatccagctaagttctccttctcgcccattgcagcctcgagcttctgggctcaaacgatccttccgcctcggtctcccgaagtgctgagattacaggcgtgagccaccgcgcctggccttaaaatcctttttaaaggcactttgacatccattatctcatttaagtctaaaacacgaatttcgacctccgcgctgctttctggttccacctggcggcagctgcacaaagtgtttctcttcgaacgccgtcccaagtttacccggaactacttagcccagggtttcctgagtgctcctcgggccaaaagcagagcgcacaaattccagaagaaattaccaacggcgggactatttcagtgctccgagaagtatcaccagtaaccaatcagcaaaaagctctagctcacgtggtgtatattcagcctatcaagctcctgatattcatgaatgctgtcatttccgcttccgcctccttctttctcgacaagatggccacaccggcggtaccagtaagtgctcctccggccacgccaaccccagtcccggcggcggccccagcctcagttccagcgccaacgccagcaccggctgcggctccggttcccgctgcggctccagcctcatcctcagaccctgcggcagcagcggctgcaactgcggctcctggccagaccccggcctcagcgcaagctccagcgcagaccccagcgcccgctctgcctggtcctgctcttccagggcccttccccggcggccgcgtggtcaggctgcacccagtcattttggcctccattgtggacagctacgagagacgcaacgagggtgctgcccgagttatcgggaccctgttgggtgagtggtcagagaaagttaacattcttttcttcctcccacttctcatttatctcactcccctaactcattaattctttaattcctggtgtcctaccgtcctttcctcccatccccaatgacctcttaatactatatactgcatcctannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntcagtattacaggaatgtaggtgacaggaggtagagcaggaaatgaagctagcagagggcagagccctaagaagtattaaataattacaaatgtaaagtgctgtgaagggaattacctggatccctgagaagacaaaatgaaagtctaacctcatttgaagctctttggggaagctcctgagcatttcagctaacactgaataggaattaaaaatcactctggaatgagtgagttgagagataggaaataaagttgacaggacatggtgtgatcagaagtgagggattagaagaaaatatcagggatgacttctacatctttggttaagtgtgaaagaagaaagggaaggtaggggttgactaaaggtctggagtgcaaaagagatgtgggcaagtatgtcaggttaggaattatgtcattggaatatagaaggtaattgaacccataaaattggatgagatcacctaaagcaggggttggcaaactttctataaaggtccagacggtaaatattttaggctttgtgtgcagtctctatcacaactacttaattctgcctttgtagcaagaaagcagccataaaaaaattggcgtgtaaactttattcacaaaaaacatttctagatcagggcctggcctagaaaaggaacattgaataaaaagacaagagaacagagacaaaaccctaaaaacctaaaaagtcaggaagaagtagccaacaagattagaaaggtaggaagaaaactagaaggaaagttttaagatgggaagtaagtggtcaagtctgttcaacgctgatgagaggtcaaataagataaaggatatatgtgcatttggtttagggacatagtttcagtgaagggagcagaaaccatagtgagttggaattagataaacactggtagttatagacaacactgtggtttctggtggagagggaaacttttaaatcctggggtaggaggttccaatagattagaagagaatggaaaactcaacgtagtggtcttaggtcaagaaacaaatgtagtgggaataaataaataaataaataaataaataaataaataaataaaaaaaagaaatacagcctgggcaccatggctcacacttgtaatcccagcactttgggaggctgaggcaggcagatcacttgaggtcagtagttcaagaccagcctggccaacatggtgaaaccccgtctctagtaaaaatacaaaaattagctgggcgtggtgatgcgcacctgtagtctcagctactcgggaagctgaggcaggagaatcacttgaaccctggaggcagaggttgcagtgagccgagattgcaccactgcactctagcctgggcgacagcaagatttcgtctcagaaaaaaaaaaaagaaaaaaagaaatatggaagtaaaggtatcagaactagaacaaaagtttgtggtaaaagactgacttctaaggttcgcagatagatttctggatgatgataaggttaagactgaccatgggaccagatggctaaagggaggtacagatgaagctcctgacgtctcagtgtctgaaacttggccactatattagcagtctatgtaaccattaaaatattccaggtagctctgcagattaaattacagggagaaagtgtagaggctgaaaaaaaaggccgtagagtgaaggtctggaataggctagtagtggagagtaacaggcaaaaggagaccttgtaaaggaagaataaaccctatttggtgatgattagagggagaagttggcgatcacaccacagtttcagttccctggagaattctggtcccatcgatgcaccggactaaacttggagctaatgagttcagttaggtgttcattgacattgaagagatcatcaaaagcatttcaaaagtagtcagaggttgttgggagccctaggattatataacacatggacgattctctctttcacaggaactgtcgacaaacactcagtggaggtcaccaattgcttttcagtgccgcacaatgagtcagaagatgaagtgagtgggaatccaagctgtccctctgcagtttttagctgttcatttgctcggctcccctcacggtccctcccacactcataactagagctcctgtagccaaggagcttcttcccatttgtacgtacttcctgggcctcttctgtttattgggggtggcctcttgtcctttttaaccaatttttctttggacttctggcttcttagcttgctttcctgccttccctcttaggtggctgttgacatggaatttgctaagaatatgtatgaactgcataaaaaagtttctccaaatgagctcatcctgggctggtaagttggggaggtgggggctggggttaatggaaggtctcttcgtgattgccggtgtcttttgctactggactggatcttatactcttccttttggaggcaagagtattgcaagtgtattactgactgtgagcagtggctcaatgcctgtaatcccagctgggaggctgaggcaggaggatcacttgagcccagtagttcaagatcagcctgaacaaaatagtgagaccctgtctctacaaaaacattttttaaaaacttagccaggcatgatgacacacacctatagtcctagctattcaggaggctgaggctagaggatcacttgaggccaggaatttgaagttgcagtgagctatgatcatgccttgccactgcattccagcctgagtgacagagtgcgaccctgtctctaaaaaacaaaaggaaagtgtgttacctgtaggaactgtgaattcagtgggttttgctggtggttctgatcctgtggggccaggatatttcgaattaccttgtaagtgacttggaatttttcatcagcactaagtcagcctttgattttatttgacatagttttcggtgtgtgtattgctcttggcagttggtgtcactaggtgtcctaccgtagaagtgtccggtaccctgaagacacccatgccactgttgtgtttgatattgacgccacatatagacaggagtccaccactgtgttccatttcacaggtacgctacgggccatgacatcacagagcactctgtgctgatccacgagtactacagccgagaggcccccaaccccatccacctcactgtggacacaagtctccagaacggccgcatgagcatcaaagcctacgtcaggtgaccacagtcttgggctacaagggcataaaaccatgcccagatgccatccctcccccaccccaagcaaggttaattccttccatgtgtaacttgctgtgtccttaggaagcctgttcctctctctcaacagttattctaaaggtttcactctgaaacaaaatctgttcctgtaatttctaccgctgatcctagttgtactccagtttctactcattgcccttttaagtatttgagcaagctgtcaagtcatcttttgtaggacctaactattccatagttcctacagccaatcatcacatggtattcttgtcatgatccttcaccacattcattacttttctgaattacccattagtttgtcattatctctagaactcagcacagcgctcagggtaatacagattataaggatgactgtccttattttgaacacatttattaacccaggattgagtgcagttttaatgacaatgacattacagtgaacacgttgagcttgcaggtggttaaaatgccagttatgggggatgttgggaaaggccctggtggcatgctgaggaagcagctgtggtagttggaaagaccatggtcaaagggaaggcagctgttagtgcatctgtcaggctgttgattttgtgctggttctgtgtctgacactgacatagccagttaactcttacacagtacacagtaagacaaagatggtggatgccaagtctttatgagccagttggcataccactaagcactagccattgcctgacttcttaaccttcccaggtatttcagactcctcaagatccagtatatatatatataggatccagtatatacaatatatatatataagatccaactatatatatgtatatatatgtagatagagaaagatatatatagttgacatagtaaagtatagatccaggtatataattgacatagtaaaaagaatacctttagtgagatgacttatagcacccaatgtaatttggtgggcaggagttggtttcctttttcaatgctgatgaagggcgtagtccccgaaaagatttgtctctgtctcctttccatggtaggcagctgtctagacagccagctctacggggtaattgagtcctgtcctctcgtcactgacactgcaccgtgtgtgaagtaatcctctaaagggaccaggccaaatgcaaaggccccccttacagatcaagggtttggtatgtgggaaaagctaaggggagaaagtaacttttgctcccatgagacctctggggttcatttggtcccaccctttctatcagaaccttgagagccatattcctgctgtatctgctttctcagcccagaatagacatggaaaccctctcccaaggccatctgtttactttggcttctccttccgcagcactttaatgggagtccctgggaggaccatgggagtgatgttcacgcctctgacagtgaaatacgcgtactacgacactgaacgcatcggaggtgagtaacctttccatacactcgcgagaggccataggcattttcagggaagggggctgctagtctgcaacatggacggaggccttgggtggtttgaaaagggactattgatctaaggtttgtgaagactagaagtcacagtcatctcttgtataaatgggatttaaggagttatttgagaaactggtaaaggtgggaaatgatcagcaccagaggccacataccattcacatgagatcaaaaccggtgatgagcataccaggtaaaaggagttgagcctctattaggaggaagaaaagctgataagggcacagcaggaagtgtgactgagcagactgagtctaaggggagttgggaaacagagttagtaggacgttaagaccatctctttcctggtgggatgactgaattctctctcttactgcccaccactgccgctgccaccctgccaaccaacttccatagttgacctgatcatgaagacctgctttagccccaacagagtgattggactctcaagtgacttgcagcaagtaggaggggcatcagctcgcatccaggatgccctgagtacagtgttgcaatatgcagaggatgtactggtgagaggggaaagaaaaaacaaagggggaggacatagttctctatcctgggatcactgaggcatgtgctgatgaaatggtagggctcagtggttataattaactgcctcatcgagtctttgttttggtactcagtctggaaaggtgtcagctgacaatactgtgggccgcttcctgatgagcctggttaaccaagtaccgaaaatagttcccgatgactttgagaccatgctcaacagcaacatcaatgtgagtgcccttcctgagccccttcttgcctggtttcttcccccacctcagcacatacactcaaatgtgaaaagagttgggtgaggtgacctggagtaggatagagacagggcttcacctatagccccactgaagtccaggttgggaggaaggaagaggtgtgttatgcgtggttggagacttccttccttctcccatgattccattgtctcatttactgctgatactactgtgacttactgtctaaattcgtgatggaaagaaacactaaaattcagaggttaatgaaaatgcaattacttatttccctcatctgagttcacagaccccctatattccatccatgggtttcagctaaggcacccctagtctataagtgtatcagtagagataagaaagccttctcaagcatttcctttctgtcttctacctttttgacttttattcagtctctcctagctgtcatttatccacagctgtcctcatacccagtgtctaccatagagctggccaaagccagcctttttgctccctttccacccaaccccccactcattgtgtattctttgtcttccaggaccttttgatggtgacctacctggccaacctcacacagtcacagattgcactcaatgaaaaacttgtaaacctgtgaatggaccccaagcagtacacttgctggtctaggtattaaccccaggactcagaagtgaaggagaaatgggttttttgtggtcttgagtcacactgagatagtcagttgtgtgtgactctaataaacggagcctaccttttgtaaattaatttcatcttatgtgagtttattgccgggtggaagggaggaaaatgttttagatcacacagaaactaggaagtgaatattgtaggtagagaagttggttatgtgtttggcatgttactgttttaccaaactgttcttttggttttcaatatggaaaggtgtccattggcaaaacaaccttttcttgaggattcatgtgatttctacaggaaatgaaaataagaatccatggagaaaaaatagctaagaaaattggatgcttaatctgaactaaaagagtagagtgtgtagtcactatcttaaaatacattaatagtaagatggagctctttgccactttggttcggggaggcagaattaagatctgtgggttaaagattaaagaggtttccccaaaacttcagaaaattcttaggtgctatctgtaactcgaggatagagccttgagttatactgaggtctgccagtggctcaatttaagcaaagactagatggcatttcccagaggccttgtaggctagagtacttgcctgtgtaacttcagacatccatttcctctggtatcctggagttccacctcgccactgtgtgtcttagaaataagtcattattcaagaactcaggaaattatacgttggagtgaaaaggtgagtgaaggcaatggggaatcaaaaaggcctggatcctagttctgaggtatgtgtagccttaggaaagataaattataagagtcataagatatggatcataaacatacatagtccattagggtattatgaggattccatgaattaataaatgtcaggttaatcaacacttgtggagaatatcacctagcatgtagtaagcacagataagtggtagatactatgatgcctaaaggtgaatagtttgaaagtaataagcaacatgaaccccagcctggaactcagttctgagatatgtacctcaggaaatataagttatgggagtcataaagtgtggatagtaatgatagataatttcttacaggtagggaaatgtaaacagatcttatcggcaaaatgataatgacaggccaaattgttaaaggtaggttaaaagtagacagcatggtgggaaggttaatcagagtcaaaatgtttcagtgttcttacatttttgggagtagccagttaatatcaacttagtctttttaagtatgcatgataaaattccgaggttaattgctagaagtatatataatctctaaatgaatagtgatgagagatggtgggataatagggaagaaacaaaattttaaatttgagaaataagcatagaaaaggtggataaaacaaaagatggcaaaacaagtccaaatagatcagtaattacaataaatgtataagtattaaactagcccaaggaaaaattgaatattaaaacaaaccccaatcatatgctgtttacaggagacacatctaaaacaaggacataaagttgtcctgcagctgtgagtaacaatataggtgaatgttaataataatgttgaatgaaaaaagctggtgtcagaagacatgtacattatgatactccagaagttcaaaaacaagtgaaacttgtttagacatgcggttggctgtctgtatatgtgggttccacatctatggactcaaccaactacaggttgaaaatattgagggggaaaattgtgtctggactaaacctgtacagacatttttccttgtcatttttccctaaacaatacaaagtattagatggtgtttatactgtattcggtattataagtaatctagagatgacttaaaagtatatgagaaggtatgcacaggttatatccaaatacttcatattagggacttgagcatcagaggatttttatatccaaggaaggttctggaaccaatcctccacggatactaaacggtgactgtgtgtgtatatatatatgtatagtctgttctcattatctatagtagttatgttttataaagtcaccatgaacactgaatt

SEQ ID NO: 12281 - DNA, 6831 bp, Human
ctgtctctctttgcctctgcctctgtctctttctctttctgtctaaactcaggccagactacagccaggaggaggcttgaagggctcctggatccgccccccacaacctggcagccccagcctggtggcatggggctcaccctcggcacatctcaccctctgcacatctgcagatgtctttgtggcagatctttctcagggaagattgctctgtgggcaggttgtagaaagtgctgcacctccgggctgtggatggagggtgcaggggttgggggagggcgttgtcttgggccagtgttcctgggggttcgttgcctacctggcctagtcctgagaagtcttcacccactccgggccctggcctgccttccccatcctccaaagtccaggctccctcctgcccctccttgtccctgggctgcgccctccaggtcctcccagaccttcccctcttcctggccctgccccctacaaacctcactttgaagggccctggccagccacctctgtcaacaggccacgcccactcaaaagagcctgccccttccccatccattcccagcaggccacgcccagtcccccttcaactttgccccatctccttcctgtccccgccaacctaggtcaatccaataagacctcgccccttatgtctagccaggcccagcccccttttcgcaatgcccggtctctcctcgcctggcacctggctctgtcctttgcaggcctcatccccatgcacgggggcccctccttacaaggctcgtagtagtcgtagatggtgaccagggcggcctgcaggaactccgcctgcagcatcctgtgaacccgaaagcccagcaccgtgttcttctcatgggagagctggagagaacagagtcctgtctgagccggccagggccactgactggggcactgaccttgtggcactgaccacgaggccttggctgttggcattggccatgaccacggaccatgtggccttgaccacagggatcgcaactggaggagctgacctgagagggcctggctctctgcaaaacccacccaggggaccgaccttgggttctccagcccccagggtacccacacacctctggcggagggcacccggcccctctcaccttttccaggtagaggacaacagtgctgtcgctggtacttgtcttggttttgtactgaaaggcgtacctctccacatcactcgtgagctggggcagagggtggagactggagggtggctgacagtctccaaggcccgtagccctagagctccagcctttgtccaatcaaccccatgctaggggaaactgaggcccaaccagggaaaagtttggttttggccatgcagagaagtaacgatggggcattaacccagaagccttgctttgagtagacactgccctgcacccatgtgggaagtatgggaaggttgctcaggaagcaggtaggtggggtctgcattacctgtttgaggtcatcctggttggggtagaagcccgtgagcagggagacctccatgatagtcattgtggcctctcaattgttctggaacctggaagttcacagccccagtctttccccactatcctcccgcctctctctccatgctccccactgctgttgtctctggcttggaccagcgcagtagcctccttccaggtctccccatgtcccctttgccactcacaacacagagctttagcaagcagaaatctgactaccttgcctcgttgcttcaattaccaaatgccttgcctcaatcctgacacccttccacatcacctcctcccacctcagcctccatttgatcactgttagccttgttccctgtcctgccaccagacttttgcacatgctgttcactcagcctggaatcttcgtttctgcctcttcatcctgaaacacccctcatgttttccatctcagcggatacatcactccctctgggaagccttccccaacctacaccccacacaccaaatcattttttttttttttttagacagggtcacccaggctggagtgcagtggctcaatcatggctcactgtagcctcagcttcctgggctcaagtgatcctccagtctcaggctcatgagtagctgggactatagacatgcattaccacccttagctaatttttgaatttttttttttagagatgaggtcttgctgtgttgcccaggctggcctcaaactcctgggctcaagtgatcctcttggcttcccaaagtgctgggattacaggcatgagccaccgcaccaggcccagatcattctctgatttgcctctcatgactctgtaaacctctcctttgccacatgaaatcaccactgccatttcattattggttctgtgtgattatttgatgattgtgtgtgtctcctgatagactgtgggcttcgccagggcagggagaggctgccttgctcatagctgggtccctagctccaagaacagggtctggcacacagtaggtgcccaataatgtttctatctgaagcagacctgggcaagggaggtatgggacagggcaggactggggtgggggctgggatgttcggagaaaatgagaaccacggggagagcttcagggcttggagccagctctgggcatctgagtcatggagcatgtcagctgaggtagagcctgtcatatgaggacatgcagacatggaaggaggcaggtacagaatgggggacaggcatggagaggcaagcttggctggttcccactgtccactcagtacacggggaaggccgctaaggaatctagataccggaaagtgagaccctcctccctcccagttcaagatcctggtgcgctgaccttgtttccatccggagccgaaaagtctcacctccctttttattttctgcagagagaaggcagcagtttagaggctggggagcacagtaatcaagtgcacagtctctggagctagcatcttggattcaaatcctgactctgctgtgtgactttgagcaagttgcttaacttctctctgcttcagtttactcatccttaaggggggatcataatattcccaacccaacaggattgatgtgaggattaaataagttaatacaagtaaagccctcagcatggtgcctgatcagtgctttgtaactattattattattgttattattattaagagatcaagcaaaaaccaaaaccttggtgaggtttagtccctaaaattcatgggactggtgagggttgttcctcttactcccacagtgagctcccaatagtcctctctccttcttggtgccccaggctgggaactgtggaatccaactatttctctgtttttgttttttttttcttttgaaagaggttctcactctgttgcccaggctacagtgcaatggcacaatcatggttcactgcagcctccacccgggctcaaatgatcctcccgcctcaacttcctgagtagctggaaccgcaagcatgcatcaccatgcccagctaattttttgtagagatggagtttcactatgctacccaggctggtcttgaactcctgagctcaagtgatcctcctgcctcagcctcccaaagtgttggaataacaggcatgagtcactgtgcccggcccactaatatctgatcatctccagagcccctaatctggcccggcctccatcatctcctgcaggaccagtgcagtcaccttcctggtcacctggctcccaccctcaccctctagagtggtcagatcagagggagcctgtgcagacctgtgccaggtcacactcctcctccgttgggaactttctatgccccacctgactcagaacaaaagccaaagtcctcactgtggctaacaagtccctacaccatcttcccccatcacctttccaacttcttctcctaaaactctacccttactcctcctgtagccacaccaggcttaccttctagggcactgtggagagtcgcattcaggtggtacaggttgcagttgtcctcccgggactctggggacttgtgatacattgtcaggatctgccgggccaggaaagggggctgtcagagcccttccccacccactgcctttcctctgcaccccaatccttgacttcccaggtctctggccatgtggggaatttactgcaagattgcccccaccgaccccatcaattcctaggtgcagtggccagagcagtgtctggagtctagaccagctctgtgtcatagaactttctgcagtgacggaaatggtcccaattggcattgtccagtatggcagccattagccacatgtggctaccaaacacttgaaatgcggctagctcgacggagaaactgaattttgaattttgtttaattttaacccatttaaacttagatttcacagaggcttgaagaaaggtatgacttgctcagggtcacataacaaaggcagagattcagccatgactccattgtctggaacacgacaccaggccaccttttggttaacaaaagagctgtcctcccgggtatacgtcatggggctggaagatgtcatggacgtcaggctgggcatggtggctcatgcctgtaatcccagcactttgggaggccaaggcggacagattacttcaggtcaggagtttgagaccagcctggccaatgtggtgaaaccccgtctctactaaaaatacaaaaaattagctgggcatgctgctgtgcacctgtagtcccagctactcaggaagctgaggcaggagaatcacgtgaacctgggaggcagaggttgcagtcagccgagattgtgccactgcactccagcctgggtgacagagccagattccatctcaaaaaaaaaaaaaaaaagtcatggacgtcatcccagcactcagcctcccaaagtgctgggattacaggcatgaatcacactgactggcctatatttatttatttaggttataaataaataataatatgagtataatagattacttatttattttattttatttatttatttattttgagacagagtcttgctctgttgcccaggctggagtgcagtggtgcgatctcggctccctgcaagctccacctcctgggttcaggccattctcctgcctcagcctccccagcagctgggaatacaggcacatgccgccacgcctggctaattttttgtatttttagtagagacagggtttcaccgcgttagccaggatggtctggatctcctgaccttgtgatctgcctgcctcggcctcccaaagtgctgggattacaggcatgagccaccacacccggcctgaaacagagagtgtaccctgcctttatcttggacttcccagcctccagaactgtgagcaataaatttctctctctttctttctcctttctttctttctttctttttcttctttctttctttcctctttctcactttttctttctttctcctttctttctttcttcttttctctctctctctctctctctctttcttttctttcttctttctttctgacagagttttgctctggtcacccacgctagggtgcaatggctcaatcttggcctctgccttctgtgttcaagtgattctcctgtctcagcctcccatgtagctgggactacaggtgaccgccaccatgcctggttaacttttgtatttttagtagagacagggtttcaccatgttggccaggctggtctcgaactcctgaccttaggtgatcttccctcttcggcctcccaaagtgctaggattacaggcgtgagccaccatgcccagccaagccactgcaccgagtctttgtttcttgctttcttgctttcctttcttttctttcttctctttcttttccttccttcctttgagatagagtctcactctgtcatttagggtagaatgcaaggtcttgatcacgactcactgcggcttccacctcctggactcaagcaatcctcccacctcagcctcttgagtagctgtgactatagacatgtgccaccatgcccatctaatttttcaattttttgtaaagacagagtctcactctgttgccctggtgcatctcgaactcctggactcaagtgattctcctgcctgggcctctcaaaatgctgggattgcaggcatgagccaccatgctgggccaatttctgttgtttataagccacacagtctattttgttgtagcagcctaaacagactaatacagtagaatacaagacctaccgagatggtgcctctcccgttgccactggctttgatctctaggtcgtcctgggcaaggaactgaagagaacaaagaggaagatttaagggtggaggaagcagcaaagtgagggtcaagtgtagggggatgtggagcctgaacactcaccagggcctcggttttccctaacctgggacctggtgattcattttccatctctctccacgcagatggttttgcttttccctcttcagagagcatttgtggtgtctacactatcatagatcaactggaactgctcatccagcctgtgtattttttttttttttgagaccaggtctcagtctgtagcccagattggagtacagtggtgcgatcttggctcactttggtgcgctctgcctcctgggctcaagcaatcctcctgtcttagcctcccaagtagctggaactacaagtgtgtgccaccatgcctggctaatttttttttttttgtatttttttgtagtgacaagatctaactatgttccttatgctggtcttgaactcctgacctcaagtgatccacccgctttggactcccagtgttgggattacaggcgtgagctgccatgtccagtctaaggctgtcttttttttttttt

SEQ ID NO: 12282 - DNA, 7529 bp, Human
gcctgtcaacagtcagacaggccagaatcaggccctgggctggaggagtctccctgggttgatttctgtgctacagtgctgtcagcagagtggggtgggggagggggaggcgcgcttttttcatctacccggggagcaaacaccaactcctgcagcagttctgccaacaaggcagaactatgacgaaactgattaccactagcctctctgtatcagagtcaagatatggggtggatgagtccgttccccaagggtgtgctttggagccactgccacagagctaagaagcccctctgctagaacacacctgtgccctatctgcccaaccctagttcaccctgatgtcccagctcagcattaatcgtggatccttcgcgggggcccggggcccccaaaccctcctatttagggaccacaattccccaactgggggcactgtccccagatccagaggggcagtaacagtccctcttgcagatttcggatcttcatcctgccactgaaaggccacaagggggatttcatcccggtttcaccttcaggaccgtctgagcacttctcgggcgatgcagaccagtggaaggcactggctggcaccaaggcccgctcctgggagccaggccgcggcccctccaaggaccacaggtgggcagcggaagactcagagcaagagccaggggcgaagatggccctcgctgcggtcaacccggagcacgtgctggggctcaccagcctctccgcgctgaggacaaagtccgctcccgccggcttcttggcttgggcaccgggtaccgggcgtcaggggcgagacaggcaggacttgcgcgcgccccgactcgactccagaccccgacccgactccgggctcggcctcccgcgacccctgcgcgcactcaccattgtggttgacccaggtcggcttcaggagcttcattgttcggccgccgccgccgccgggctgaggcgagcgccgggtccctcagcgcgcccgggccatggagccaccgccgccgcttcctcccgcgccacccgccctccggccgccgcccgccccgcgccctcagggccgccgcgccatcgccggcccgcgcccccctccgccgccacagccgccacccgcgctcggccgccgccgccgccaccacagccgcatcccctgcgccgctcctcctcaggcggctcccgggcaacgccggaagtcacggcgcgcacctgccaaatcgccccggcgggaaaccgctccccacgcggactgggccgccccggctcctccgctggcaggggcttcgggtcgggcccgggcgcgggcgccccagaaagggcggttcgcctggacggcggacagcgagcggggcctgcagttgcaacccgggccgcccgcagaggcaggcggggcccaggtggcgtggaccgcccgtcaccagctctgcctcgccagtctgagtccgacttattaactagcttccgtcattcatcaacacgcgctattgggcatcttgcgagcgccgggctccgcgccggcgccggaatgcgatccgggcttcggactcgaacgaatgcgggggacgagccaaccctggtgggggaggctggggcggacgcgtttattagaagatcggggccgtttgcctagacatgaacatttggactcggaggagcagagggacgccccctcggccgctccggctgcactgcggagccgaggcccgcgcgagggcgcagaccgaccaaccggctagggcctgactggctagactgtgcccgctgcagaggcgcgctcccagcccagggcggggacggaagggaggaccccgagccgcgtgaaacgcaaggccctcgtgtgtgcgcagctgacaccctaggcggggctgcgtcgggggcggggacaggcgcgtcccagcccacgcagccggaacgcctgagcgctgggcgcctggtctgccggacctcagcagggggcaccgcgggccggactgtggaggggcgcacgcccggaagcggcgagggtagccatgacggcctccgtgctgcgaagtatctcgctagccctgcgcccgactagcgggtgagtgcggacgctggccggatagcggagtgcccagggcgcgtgcggggtcttcgcgactgtccgccaggactcgcctgtgctccctgctcgcctcccagtccacgaatatctcagggatgagccatctggtcgtgactcttatgcatgaaaatctgagcaccctggcgagcagcggtcctgcttaagtcctctgtggtctgaacgaaagattttgaaaaaccttccacgttgaccttgctgtcatatcaagtagttagaagtgccccgggtttgggagcattgcaattttttattttcctgtgaagtgggagagaatcagatatttatttatttatttgagacagagtctcgctctgtcgcccaggctggagtgcagtggcgcgatttcggctcactgcaacctctgcctcccgggttcaagcagttctgccccggcctcccgagtagctcggattacaggcgcccaacaccacgcccggctaatttttgtatttttagtagagacggggtttcaccatgttggccaggctggtcttgaactcctgacctcgcgatccacccgcctcggcctcccaaagtgctgggattacagacgtgagcaaccgcgcctagcctggagaagcagatatttatacatactcttgtatctttcaggcttctgggaacttggcagacgcagcttagagagactcaccagcgagcgtcattgttgtctttctgggaactcattcccatgaggtaaaactcaatcgagggcctgacctctgggggtaaaggtgtcagtctatgtgtagagaacaaagcaagaatgctggatgtgtggtttgcaaaattaacagcctacaaagtttctcagttaaatttaggccgatgcttttctgtttttccaacattttccaaaccatagattgttgtttgtaatttttaaaatttgagcagtttctcaagaagtaagtattctccttgaagggattcttgtgtgttttaaaggacacagcttaagtttctgtttctccatgacccttcctcttccctgcccattcggaggccctggagagtgtggggaagatgcaagtattaaaggtatttccatctagcactctcgactctttgtagatacttgattcagtcaatcttgatagtaaaggatttgatttttcttttttttttgagatggagtctcactgtgtcacccaggctggagtgcagtggtgtgacctcggatcactgcaaccttcgcctcctgggttaaactaattctcctgcctcagcctcccaagtagctgggattacaggcgcccactaccacgcccggctaatttttgtgtttttagtagagacggggtttcaccatgttggatgttggtcaggctggtctcgaactcctgatctcaggtgatccacccacctcagcacccaaagtgctgggattacaggcctgagccaccgcacccagtccacaaatcaattttaatagtaataagcttctaatctaacagtttggtattttcacttttgagtgtaatcccaaggcacacctgaatcccagcaataaagaggaacacttcccgattttataccctgatgcctcttgttgcttttgtacttttttttttttttttttttttttgagacagagtctcgctctgttacccaagctggagtgcagtggcgcgatcttgtcctactgcaacctccgcctcccaggctcaagtgattctcctgcctcagcttcccgagaagctgggattacaggtgcgcaccaccacacccagctaatttttgtatttttagtagagacagggtttcgccatgttgaccaggctggtctcgaactcctgaccttgggcaatctgcccgcctttgcctcccaaagtgctgggattacaggcctgagccactgcacccggctgcttttgtactatttcttgtaattgatggcacctacacagttctcacaagtactgtggggtggagtacctcctcaccacgctgagctcatgagttagtcatgcacagctccttcccccagtggagaggtcagtatggggtacttaccatcttgtctctcagtaggttcatgagaccaaagaggaaaatgtttaatatttgctttatctattagatcagaacctcttcgaaaaaagaagaaggtagatcctaaaaaagaccaagaagcaaaggagcgcttgaaaaggaagatccgaaaactggaaaaggctactcaagagctaattcctattgaagattttattacccctctaaagttcttggataaagcaaggtaaggatccttctctagggatgaagtcctcaggacaaaggagtaatatcaacttcaggtagttgtgtctgtagttcacacctgtgatagtcattggtcagtaggcttgagctgacttggccctaatgagtccttgctccttttggaagcaggagaaagcatccttgggtggtactcttgaatggctctgggtgggaaagaacctaagacatctaataatccagatgcttaagcactgctctggagttcatgttgttgctgtcatgcatgaggagtcttggctgtttctgatcccttgggcctggagtctgaagccctcgcctcatcctaacagtagaaaacccttggcctcctgttttatcatgcagatatctttggttggtatttgttgggattctactgtgtgcagggttaacagctcctgctgccgttttgtaagcagtgtgcaccatctataaaggggcaggtgttaaaagtcttctctcacccaagggagtatttgcttgggcagaggaagtgctaccagtctcctcagatcatctgttcttttgacagagagcaaatgaccttggttccaagcatcagttgcagctgcagccacattcaacattccatttcttaatttgtcccaaacttgttttatctcctaagtcctgtctgtgtctggcaatgggaatacttgtgtcagttgcagtcacagacttacatgccagtgagattggtaacccttagcttctttgcagagagcggcctcaggtggagctcacctttgaggagactgagaggagagctctgcttctgaagaagtggtccttgtacaagcagcaagagcgtaagatggagagggacaccatcagggctatgctagaagcccagcaggaagctctggaggaactgcaactggaatccccgaagctccatgctgaggccatcaagcgggatcctaacctgttcccctttgagaaggaagggccacattacacaccaccgatccctaactaccaaccccctgaaggcaggtacaatgacatcaccaaggtgtacacacaagtggagtttaagagatagacttgcaggctgctatccttaacatgctgcccctgagagtaggaatgaccagggttcaagtctgctttccacagaatcaggcatgctgttaataaatactggtttaatcaaaatgctcctttgtcttgtgttagaattttttttaaaaaatttttttttgagacagagtctcactctgttgcccaggctggagtgcagtgacgcaatctcggctcactgcaaactctgtctctctggttcaagcgattctcctgtgtcagcctcctgagtatctgggattacaagtgtgcaccaccacgcgtggctaatttttgtatttttaggagacagagttttgccatgttggccaggctggtctcgaactcctgacctcaagtgatccgcctaccttggcctcccaaagcactgggattataggcatcagccaccacgcccagccagaattaaaattaattcaccaggccaggctcagtggctcatgcctgtaatcccagcactttgggaggccaaggcaggtggatcacgaaatgaggtcaggagatcgagaccatcctagctaacagtgaaaccccatctctactaaaaatacaaaaaaaattagctgggcatggtggcgggcgcctgtagtcccagctactcaagaggctgaggcaggagaatggtgtgaacctgggaggtggagcttgcagtgagccgagatcacaccactgcactccggcctgggtgaaagagcgagactacatctcaaagaaaaataaaaagtttattcacctaagatggatggaggtgacagatgctgcccttcgccaggtaatgggaagaagataacaaagacatcaactgctgccctcaaatggggaaaaaaaaatgtgtaaaaagaagatcccaagggtatagtgaaaataccaacaggagtcagagtaacagaggagtggtgggaaaggaagttgccagctggaaaggcatgtggagaagcagggccttcctgatgggaaagaccaaggagccacctttgtgttttcagctggggttagggggaggcagaagagtgtggagcaggccaggaacatactagttaataaagatgctgtggcccccaagagggtgtgaggcctggctggggcagcggactctgtctcaagtgcttagtctagaatgtgaatgtattagtctgctcaggctgccattacaaattaccatagactgggtggcttaaacaaaataaatttattttctcacaattctgggggctagaactcctgagatcaaggtaccagcaggcttgttttctgagtctttctccttagcttgcagatggctgccttttccctcacatggtcgtcccaatctgtttcctaattttttatagacaccagttatactggaatagggcccacctaatgacctcattataactttaattatctctttaacgatgctacctccaaatacctccaaatacagtcacattctgaggtatggggttggggggagtgggagggtcgtatgggtaggacttcaccataggaactgtaggggacacaattcagcctgtcacagtacaagcccagtgtacgaatagagccattttccccagtggcttggatcacaacctcagaaaggatttttttttttttttttttttaccaccttagtgcaggtaaaccagggaaacatttcattggaataagaacttaggttgtcttcctagcgtgtggttcacttttttcccttttttaaaaattgtggtggccaggcaccgtggctcacgcctgtaatcccagcactttgggaggcctaggtgggcagatcatctgaggtcagaagttcgagaccagcctgaccaacatggtgaaaccccgtctctactaaaaatacaaaattagctaggtgtagtggcacatgcctgtaatcccagctactcgggaggctgaggaaggagaatcgcttgaatacgggaagtggaggtagtgagtcgagatcacgccactgcactccagcctgggcaagaaaagcgaaactccccatcaaaaaaaaaaaaattgtggtaaaatacacataaactttactatcttcatcatttctaactgtatggctcagtggtattga

SEQ ID NO: 12283 - DNA, 29171 bp, Human
  misc_feature (1)...(29171): n = A,T,C or G
tttgaaataaaaatctctggggctggagcctgggaataggcatttcaaacacagaccacagtgttctctggcactgaagattactaacagcctctgaagtttttctttgagattggggctttttggcctatttagaacaggttttcttaaaggttatatgaatgaattgtcaaacttatgtaactaaaagttataattcctgtctgtgatgttatctttaaattttaatgtacagtcgtcctccttattcttgggggatatgttgcaagactgacagtggatgcctgaaaccgtggatagtgccaaaccctatatacgctgtttttttctatatatgcatacatatctatactaaagtataacttataagttaggcacagtaagagatgaataatatctaataatagaacagttacaatatgctgtgataaaagatatgaatgtcatctctttctcaaaatatcttaccgtatttttttgtggttaactgaaaccgcagaaagtgaaaccaaggactactatattttaaaggaaaactatgtagtcattttatcagaaaacaatattgtttctgttgatgaaaactccattttagaaaaattagaagatacaaaagaaatagaagttttctcctaatactgtaattaagagatgaccaccagtgactatcattttgtatgtaaaaggtatgcacacacacatgtattgcataattggtattatattttatatacttttttttttttttttttttagagacagggtctctgatgcccaggctggagtgcagtggcatgatctcagctcactgcagcctccgcctcccgggttcaggtgatcctccttcctcagcctcccaagtagctgggactacaggcatgcgccaccatgccaagctaatttttgtacttttagtagaggaggggtttcaacatgttggccaaactggtcttgaactcctggcctcaagtgatcctcccgcctcggccttccaaagtgctgggattacaggcatgagccatcacacccagtctttatttcatatacattgttatatctttttttctacttagctgttatgagcacttttctgtgtagttattgtaaacattttaatgaaagcatatgtcccatcatatggatgtattataattaattaaatcagatcgctattgttaacatttagactcttcaatttttggttattttagcaatgttggtttgaatatcatggtatacctctctgattattttcttagaatacatttctaaatgatggaatcaaaaacctttcaaatacatttttaaaatctcattttcacatatcttcttactgcttttccttaccagagggaaaactaacatatctgaaagattgattgcattccaggtccattctcttatatcagtggttctcaaactttaatgcagataagaatcatttggggagcttgttaaaatttcatttttctgagtcctagaggctgctgttctgacccattggctttggagtggggcccaggaatctgcagttttaacacattcctttatgtatttgataaaggctctcttggaaccagatgttgagaaatgctttttaaataaatggccaaacagactcaaaacatttaggttacttgtcaaaagccattcatgcatctgataaccagaatttgaactcagctctttgtgacttcagagccctgttatacccatgatctcagagctttttaaacctttttaaggtttacggtgaggtgcccctaatgactgcagaaagtaaactcctactgactccactgttggtttcttagggacagctgaaagtcacatataagtacacaatgaacttctattggaacctcccatcagaaattctggtgaattctctattatgctgcataacatatactacacaaaataactttggttgtttgggtgttgcaggaccacctggcttcatgtgtggatttccacggctcttgcccagaggcgggtacactgtgttccaatgtgccacggaactcacgcagtggcactttgtggcttcatgaaggaagaggcaggccacgcaacacttcctccccaagccaaggagaagtatcacttttagaggcagaggagcggaaggcagtgggtgtgaccaaaagtgccatttgttaaaggtgaggaccctacccttagaaaagtgttgatattagtgaactgaagggagctagtatcggggtgagcctttttaatttttaaaatcctcctcaggtggaattttgtactcatattattaatctttatttcccaccttcttttttaatgtttcattccttttagcagtagcctggaattatgatgtgtccttgtgtatttcaactagtatatcctagtccgtcatttgttactaaattgagtacctgctatgtgtcaggttggtttgaggcactaggaatacaaaaacaatgattctccttgagaattaagttaatttactatcatttgttgactcaggttatacctagtctctgactctttatttttagttttagttaattttagacttacagaaaagttgtaaaaatgatacacagttcacctagcttcccctaatattaaccccttacataaccatactacattgatcaatactattaactaaactacaaactttattgaaaattcatcaattttcctactaatgtctgtttttttttttctgttcccattgtattttatcaaggatcctgcattttatttagtttttctttctccttagtctcctccaatctgaaatagttcctcagtttttcctcgtctttcatgattttgattcttcgaagagtaccagttaggtatatcgtggaatgaacttgtggtgagcgattggatttctccactacaaagttactgtctttccctttgtagttaagaattatcttgggggagatactttgagactatactgtttatcctcaaatttttgcctgttagtttagcatccactggtgaaccttgtctgcaacagttattaagtggtgtttgctgagagtgattttttttccatcgctcactttcttactagttggaatttaagaaaagagccgccccttctcttctattcatttatttgtttgatcatttttatcagtgtagactagtggatagtcactttatcctatgggttaaaatacagtgccatcattttttttttaaattactcaaatgcttctaggttgggctgttaggagcttaatctctgggtttaaatgacttgtacatgtaaatggctgtcatcatttttatcccattcctaccctgcccagggaaccactgtccctttaggatctggccagtgatcatttagaagtctcctaaaggagttgtaattgggataatgaataccaaggcctaaggaaagtggggcaatgtgtgtgtaaaaggtaaactcctaggaactctgcaggagtaaaaagagtagcaaaataatcagtctttcttctggtgttgccccagggagccccaaggcatcaggatcatgtgcctgggacaacatcaagcccactcacatgccctgtgtctgcaaaattacctgataggttcagagatgttggaatgctgattttggtgctcatagctgccgaatgaacacaccctttctccttggtgcaaatgcttagtaaatatttttagagtgatacatggtgtcctccccacccactttagtggagtaaaaatgtgtgtggttagagattctccaagaatgatacttagcacttatgtttcctttccttttgttatagcttatcttccttgccagattttaaaaactattatggaaaatctcaagcattcacaaaagtagagagaaagaaaggactctcaggtacctatcacttatattcaagacttctcagtattttatccgtcttgtttcatctgttctcccactttgggatgttgttctcatatttgacaggaaattgcagacattgagatctagaaaaagatagaaataaaccctgagtacaaagactaggctttaattctctttatatggttttccctttgcttgaaaatagcaggtagtcagaaaaagactggttgaattgagtggaggaaaaccaaatatgaaaacatgaccatttttaactaactacggggcagacttctagaaaggaaaagagtggtaaatcttgccctaaataacttctttcatgttgcctgaatttgttctcaatactgatgatgtagtcccttggcacttcaagacagccttgactgaaaaagaaaataactctgagactcctgtgagaattaagggtctctcaattacttaaatgttagtgtaaataaatccaatatgatggcactttcccaaacaccaaccaggagtcacttgccctaaaaataactttctttaaaaagtcattatgtttttctaattataaaaatattacatactcattaaaagaaaaaatggaaattacagagttagaaagtaaaaatcatctcattaatcccagagataacattatcttgggcaatattctgataacatttgaacatgaatcacattggtaattagagccaataaatacatgtgttcctggccaggcatggtggctcacgcctgtaatcccagcactttgggaggctgaggtgggcagatcatttgaggtcaggagtttgagaccagcctggccaacatggtgaaactctgtctctactaaaaataaagaaaaattagctgggtatggtggggcatgcctgtaatcccagctacttgggaggctgaggcaggagaatcgcttgaacctgggaggcggaggttgcagtgagctgagatcacaccactgcactccggccaggccgacagagggagactccgtctcaaaaaagaaaaaaaaaaaacttgttgtcctggaaatgtaccagatataacagtgtacttgggtgcatcatctcattaaattcctagagcaactttgtgagataaatatttttcatcattttatagctgggacacaacggtgagaggggttgcctccagtcacttggctggtctttcttgaaacatagatggacagacagatgacagacccttcacacttcagatgtttactcacaggagccaaggaaaccttacttctgaacttccttatgctggctctctgtacagtttttgggagagcacttagacttagaaagataggtaagaattatttttaactgggtcagatgtctcagaagcaggattagtaatgaaggcctaatacttaagtaattattaataatggctccttgcttttagaataaatgtcttacctttgaacagagtctgtaagctgcagttgagcaatattagtttatgaatatttgcagctattcttggataggtttttttgtttttgtttttttaaattacagtcatccctcagtatatggaaggaattggctccaggacccctgcatctacccaaatccatgcatgctcaagtccttttgtcagccctgaggaacccacatattggaaaagttggccctctgtatacacaggttttgcataccgggaatattgtatttttggtctgcatttggttgaaaacaatctgagtataagtggagccgtgcagttcaaacccatgttgttcaaggttcagctgtattttttaggacagttttagattcttaaccaaactgagcagaagatacagagatttcccatgtaccccgtgccttgggtaggtttttaaatctcttcccactctgtagaatgagggaggtggatgtgtggtctttaagatcttttctgatttcaacactgcagtaattttatggtcataacctccttccacttggtgattctctcttccaggggactctccctctaaaaatagctcttagaaaagccatgttcccagggctgggtgcggtggctcacacctgtaatcctagcactttgggaggccaaggtggatggatcgcttgaggccaggagttcaagaccagcctggacaacatggtgaaaccttggctctactaaaaatacaaaaattaactgggcgtagtggtgcacgcctgtaatcccagctgcttgggaggctgaggcactagaattgcttgaaccgggaggtagaggttgcagtgagctgagattgtgccacggcactctagcctgggcaatagagtgagaccctgtctcaaaaaataaaaataaaaaataaataaagataagcaatgttcccagtctgaattttctaagattaagatccttattttaaaaattgccaatcctagcatttaagcctcctacaattaagtccacaagaggttgtctgattggccccaggaacctgatgacttactgtcaccaggtgggaagagaacagacctccaggaaggcatttgatcagacagtccctaggaaacggaaggcagatgtgggagagaggtagaaggcccccaagggaacctgaatattcaagggtctgtgttgggactacccaggcaccaaggggagaaaagaggaaatatccatgtgaaggatgtggagctgagcacctgggcggagaccccacgctaccacttactagtcgtgtgggctttggcaaggtacttaaatctctccaaaccttcctttccttttcttacctgtaagatgagactagtaattcttacatcatatggttaaatgagaattacataggttaatataagtgattttaccccagtgcatggcacagagtaaatgcacacataaattgccctttttatttgttattactgctttcagcattgacttcctgtgataccttcacaggaccctgaacacaggccatattgtttaattgcttcctgggtcaaacattccccaagaactaacctcccttttcatctatagcattgtgtttagagagaaatattttctaggtttccttcaaactaacctgaaactaaatttctggagttgtatcctttagtaagtgtgaaactatcttgagagtttctgaggtggttgttgttttttacagttacttactgcctctctattcaccattaaaaaaattcactttgttttcattgtaagactgccatattataaaatgatatatgtaaaatatatgtaaatatgacaatatgtgatatacaaaaatatatacatttatataaaatatattaaaaattctaaaaatataaaatatattaaaatataaaatatattattttatattttataaaatatactattaaaaattattaaataaaataaaatttataaaataaattttataaaaataaaaattattaaaaatataaaatatattattaaaaattctaaaaagaaaagagaaaaaataaaccaccccagcgaatcccattctcctaatataattattattagctttctagactttccttaattgtatatattgttagttgtaatcatagcacagatatagggcttactttctgtttttctttttgtcatttaagatttaatcataagtgtttccatgtgattatttagcatagaaaatattttggtctccattttatttgtttgagaatatgtttgtctatggagattatctgtgccctagctttagcattttctgtgttcttctgagaacatgtttagaatttgaggagagacgtgatttgtccacacagagaggatatggtggatgttgctggcggcaaaccaggtatccttgtcaggtggcctttaccactttagtgtattttctgtggtccagggtgggccctcagctaggtggtcttaaaaacatgatttttgtcaataattaagagcatagccccctcttagaagtgaattcatattatcccatctcatgctactgaagtatgaaatcagagtggcaatttatcagctgacagtgagaaatacagtacaaaaagtggtgtttcagtgtgtctacttgttggtcaaggtgggataacactttacatattaataaattaggtcatctaagccccacaataacttttctaggtagatactatttttatccccattttacagataaggaaactgaggcttagttaaatgactggcccaaggttatgtagctgttatgtggtagagctgtagtttctgtctaagtccaaactcctgatcttaaacactgtgctgtagttttgttattcttacagatagattgttgacctcctgtttgggattctcataatgtttcttgacagactccctcctggcccccattgcaatgtgccctgtgccagtgcctctttgagaatatagcattcattccctgttgttgaggaccatgtttttctagctgtcacaggggagaagaacttttcccttttcccttattttctctttgggtcaaaatgtgcttctgtaacaaggcttcacatttttttaaatcctccttaaaactgtgccaggaaggggcaactgaggcagagaaccattagggctatgtcttaggctgtgtccagctcaggtctttgcagtctccttgtctcctttgcctatttgttctgtccaacatttggaaattgcttcccttcttgggtggcagacagcctggctgataaactagagagtgcttctgtgatgtattgatgcttggaacctctaaaacctctggttttcgaatctctaaatgctaagtggaagacctaccattacggttagtcaaggtccatcggggatgggttttcagtttgtgctggagtgaatcacttcaggatagaatttccatttgaaacaacgtgtcttttgtgattgcgttttagactgttggagcagaactactgagaaaaaccaggcattgtatcttcagttgtcatcaagttcgcaatcagattggaaaagctcaacttgaagctttcttgcctgcagtgaagcagagagatagatattattcacgtaataaaaaacatgggcttcaacctgactttccacctttcctacaaattccgattactgttgctgttgactttgtgcctgacagtggttgggtgggccaccagtaactacttcgtgggtgccattcaagagattcctaaagcaaaggagttcatggctaatttccataagaccctcattttggggaagggaaaaactctgactaatgaagcatccacgaagaaggtagaacttgacaactgcccttctgtgtctccttacctcagtaagtgttgcttttttcctttgattaagtagtatgcaaactttttatttaagtataatatgtacttgcctgtatcaaaacatctcatgtaccccataaatatatatatctcctgtgtcacaaaaactatacattcaaataaaataaatataacatgtacaagaaagtacaaaactcagaagtgtaccacttggttaagtttcagaaaatgaacatacttgtttaacaagcatgtaaattaagaaatggaatcttgctggaaccataggaactcccatgtttctttcagtcaccactccggcttcaagattctaactctacacattagatttttcctattttggaactttacaaatcggaagcatacgttatgtactcttttgtatttggcttctgttgcttaacattacttttgtgagatctgttcttatggttgcgtgcagctatggtttgtccattttcattgatgtatagtattccgtcataggaacagacccacttttattatccagccacaaaagtctagcagcacacattaatagcgtccattgatctaggctggtggctctgccccatgtgcctcctgtcctcctcctgaaactagtgggctagcctgggtatgttctcctcatggcatcagcagagcaccagagcatgagaggagaaatgcaagcacattcaagnnnnnnnnnnnnnnnnnnnnatgttttggttcaccttttatgtcttgcctctcaacttatgttaaacagtaaattagtcttaagatcagggtgccagcatggtcagggccctcttactggatattgtcctcacatgcctttccttggtgtgtgtgcgcacacacatacatgcagggggaaagggaaagagagagggagagagaaagacagagatagatagatctcatgcctcttgctctttttataagtgctttaatcccacctggcagctccacccttatgatgatctcatctaaacctagttacttcccagaggccccacagtgggcattaggaattcaacatatgaatttttggggacacagacattcagtctgtgtacccctttcctagttgagtcacagtcctgtattgtattcatattggcatgctgcttctctttagtcatggaagagtcaaagtgttattcctgattgtgtattccttcacagattatacaagctgcgatgtaaaaatgagtcagggaaatgcaaattttactggctgattattccccttgcttaaaatgctcacagtatatttaaacagtaaattcattcataaagaatagagggacagtgatgcattactgggcaagtactggactaaaggtgatgtggttggtgatgacttaaaatgggccattagtgacccaaggaggggcagatcttgagaagatgttggggtagggggagtgatagggagactgatagagagtaagtggaagcagatactaggttagggcacgtaaaaagttatgacgatgagaaggtgagccgggggactagtttatattagacctgttgcgtgaggctctttgagcgcgcaagaacagagacacagtcaggttaacgatggggattgtgaacaggccacacaggagaccatctcaacagctaccccattatctctggtagctcgatagcccagcatcagctctagtagttgtcatctgtgtaactccattccttactgtttgtttttagggcattactgactgctgtgtcttgcatgtagaccctgcaggaaggctctcgtaggccaattattctctttgggtggcttgaagaagttacttaccttgcctgctgttgagcagagcaccaaggtgccattagacacgtgagcctggtctaagcagccatggccagggtaggggatggttacatggaacaagtcatggcgactttcgcacaggaagggcctatgactgctttactcagaaggggatagctcaatttgcaagcatcttgagattttacagcctgaccagtatacgtggaatttagaaacaaacaaacaaaaaaacctgagctgttttcctcctgtggatggctttgggtttcatctgtttggattgcttccagacactgagcaaatactgtgctcgattggaaacgtctgttgtggtggcaaaatgggagagttgttgcagtgccacacatacctgttacagctgggttagggagggagactggtttctacttctttttagtgctttgcttacagggagccagggtggttccagagtttagggaaggggtgggaagagtgccttgtccaggagcttgattctgtggaatgctgttgatatttaagagattttcccctcctcctggaatttggtgaaggaaaagaggatagaccaaagttgaagttactctgtctagccctgccctttgctcttaccagagttcaccaggatattccctcttacagatggatcatagagcaagttgattacccagccacaaggaaatgcttatattatatatccaccacttgcttttgcagccagtaaccttagtgacatgatgctctggccattatcatgactaaatgagcctttaaagtaatcataataaaagctgacatttgtagtactcactgtgagctgggcagtgttctttctatgcatattagctcgtgtaaacctcaacactttttgaagtagctactgttattgtctgtgtcctatgttcattgtaggaggccagagcaagctcattttcaaaccagatctcactttggaagaggtacaggcagaaaatcccaaagtgtccagaggccggtatcgccctcaggaatgtaaagctttacagagggtcgccatcctcgttccccaccggaacagagagaaacacctgatgtacctgctggaacatctgcatcccttcctgcagaggcagcagctggattatggcatctacgtcatccaccaggtgagcgtgggggcagaccagggcctgccctcgaccctcctcttctctgccagacttggccatgtgactgtttgtctatgttgggtaaaaggaacatcagactatcatcaaaaacgagttctcttacctcatttatccttgaaaggagtagaggaaattcttgtctcagagtgtggagttatgggttcaagttctgggaaattttactgcccttaaaggaacctctggaggaagcctgttttgtgagcccttccatgttagccaatgactgccctcagatttccccggaggcttcctggccccttctgtttctttctgtgcgtgccatgcactatatgatgagattctggaattgtctgtcattatcaaccatagcaactcaatggggatctagacagaggatttgaaagaacattctgtattagtagctgtggtgctctatggctgccaccacatttctgccctgaactttgccactatttattatgtgaaacatgttatgtttgattttcactttctggattcatctatttgacttccagaagcatgatttggtaggagcacagcataactatcggctgcttttgaagagcttacctctgaggtcagtggagtggatgattaaagatacctctatttggcattaaagtttattgaaagaaaactaagacatcagtttaaacatcagtgtctaaacttttcacagttatccttggccatccaaggaggccaagaagagggataattccccctcaaattcttataaattctaagaatgtcagcaaaatcatcactactgttagaacaggtaatatttcttttagataaaactttggacaactcagaggaccagctctgcagtatagacttggtgataaactgaggctcttgaaaatcagtgtgcttatatagcacacctatgtctgtattttagtacttggaacaaaatgttactattatattgttttatagctatttttgtttttaaggttgttggtcatagttatgatttatttgattctgagttcttgctcaggacagtaacctacaaggtatagtactatttttatgaatagaaaaacatgtttgctttgggccaggcccggtggctcagcactttgggaggccaaggtgggtggatcacttgaggttaggagtttgagactagcctggccagcatagtgaaaccctgtctctactaaaaatacaaaatactctgttaaaatactaaaaaaaaaaaaaaaattagttgggtgtggtggcacatgcctgtagtcccagctacccaggaggctgaggcaggagaatcacttgaacccaggaggtggaggctgcagtgaggtaagatcacaccactgcactccagcctgggcaacagagcgagattccatctcaaattaaaaaaaaagaaaaagagaaagagaaaaatatgtctgcttcgtgttattcttatcaggaaaacattgtggtaacttctgagaaatacttgcacttttatgataaaccacttaactggaattcattctgaaggaatttgaatgaagcagccatgaaaaaattatttaatttttttattacagcttcaatcatattacaggtcaaactgtgttcttttattgcccagtgacgaatctacctccataaggccactgtgaggattagcctccaccagtagcattataacaggattctcttacagggatttctgagaaactttaaagtagcttagaaatattagcaataactttctctttctataggttgagatttcttgatcctttctggcaagctattaactaagtctcttagaagcttagtgtaaattcataacagagggtaagattgggattacctagggttgaactgtgaagcagtaatactaattgacatgactagtatataagaaaggttttgtagttttatacagaatacgtaaaggtatttgtaaaattttaagagaaaatttttttttgttaactgtggtaagaatatttaacatgagagctatactcaatacattttaagtgtacattattattgattatttgagttatttgtattttaaagctgcttttaaaaaatttttaattgtgaaacacacgacgtaaaatttaccatcttaactttttttaactttttaaaatttttgctatcttaactattattgagtgtgcagtttagtaatgttaagaatatttacatgcaatgtatctatgcataattatgcaatatattggttgcataaatatatgcagtgtatttatgaaatcaatctccagaacttaatcttgcaaaactggaactctctatcattaaacaacaactctttggatttcaaggactgtttctaagttctggaatataagtatgtgtgaagcacgaagaaaaaaatcaaatggtcttttattgtcattgcatcttctctgtcagatctttatgtcacaagtgtagtctcgtgcgtagaataattagaataataccatctcctgaatcctaactaagaggcaaacaatatgaaactttatctcaggagcttttcaagttttaattttcatatctctaggctgaaggtaaaaagtttaatcgagccaaactcttgaatgtgggctatctagaagccctcaaggaagaaaattgggactgctttatattccacgatgtggacctggtacccgagaatgactttaacctttacaagtgtgaggagcatcccaagcatctggtggttggcaggaacagcactgggtacaggtaaggtggttctgctgagggtggcttaggtcgagaagctcaactattgtgatcaagactgggtggaacaagcatccagagtgtcataagaaaatgagaaatagaaaaaatggtccataatgtatgcatcacttaaagtgcaaaacagaagttagagaatgtaatgaggaaaaagccctacaacttcagcagaggatcacaaagacaagggaaagcattggagagaaatatcatccaagcattgcaggtggtggccagtctcacccgcagcgcccctgtcggggggctttcgcaagctttcccacactgactagaatgcaagtaacttgtttgtctattcctgactccccctctaggaggcaacaggctggtgtccttagtgagacctctgttgagacatcactttccagactgtggcctctttctagaatatggggagaggtgggggagggcatgtcctctgagtagtcttctcgggagccaggacacccaggacaagttcatttctctcaaagccactgtgagaagtgccagatgccatcatctgtgtcttcattccccatcccctccacccttaagaagggtgtagctgcttttcagccttatttgattcaccagctcctattcaagcacaaccaagcgggaatagtgacacagaatgtttctctgcaaatgaaacactatattccctcatttgtgtgcacacttacctgtcagctttccccaggccctgctgttcatgggtgctcatatctgtggtgctgactgtgctggaggccataagaccagtttgaataaggcagagcacctgccctcacagggctccccgttgagtgtcagtgtggggagacaggtagctacagtggagttgcgttaattttgcatttctgcaaatacaactataagcacttggtaaggaggggagagagggacaaatgaagagaggaagaagaaggcaggagagaaagaactgtgaaactatcaaataatgctggagattccaccagtatgtactctacgtgagtgtgaagtggaaagtgagtctcttgatacctcatttgttctgggcttctgtgttgctctctcactttgggcaatttaagagaattcttaagtaacattgatgtaggtgactgttgcctcaggtactgactttaaaccccggctgtgtgtaagctgcaggacataaacacctagaacaaactatggtgggtgagagcacagtgtctttaagaaacaccttgaagggaagggtttaaagctgttccccaggtaaggtggtaccttaatcttgtggaacaacaagagcttctcagcagagttccaagacatgccagagagcacagcgcagttttggggaaaatgcaatagttcactggtattctagaaggaatgtctgcgaggagaggcaagaactgaggctaagcaggagccagattacgcaggccttctttagtctgatatggagttcgaagttgctgtggcaggggttggggagctgttgacacgttacagctggggaaggatgggagaaagcttggttcagctgattttgaatgtatcagatgaagcaagggaagaggggaaagctgaggggagagacgccacatgtctgagttagggcgggggctgtggatccagagggcaaggagagaatcccatgatttttttctttggggaaacttgatctttggatctaatcttattatctaggggttttgttttctggtttctttgagtcacttctgcattgaggaaagcagtgtatcatggctgggcaacttggttttttcaaaagcatgtcaccatctgttcacttactctgtagtaagatgtcactatttacaacacagaacacctgtaccttagacacttaccatagatgataatcttaaacttcccattgcccagatttttttaaacacctggttgcaccattcatttctaagcaatcacagaggattgcttaaggacaggttttttgctgggattctagattttatctttctattaagctgaaccataagaaggctgagctcttggacattcctgccaggaactgattttcactcatgctttggtgtcacagtcatggatttcatcagatgccgctcactctgagaaacagcatatgtatgactcttgctgtttctaacttgccattctaactggccagatgtttcttttataactaggtatcagaaagcctttgttgagtaactgacaggttttcttaatatgattcaggtaattgaatgtgtttccccttttgatcgagaggctctgagccaaatccatggccctcttttagaaattgaaaagaatcttatttgcagatcagggttctaatgtatttcccatcttaattttctattctgatttaaatgtttctagggtcctggtttatcatttatgattttctcttttttgtatgtatcatgtaagcagcctcatcttttgtggctggagagaggtatgtataagtaatgtaggtaggagttgccttcctcctggactacttgattttgctgctttgggcaaagtccctgtggcaggcaagttcatttccaggcagctgagtgtctgccccgtgctggcaactgtgtgccccagtgccacagagcttaagtcagtacatgcctcatcactgtcacaccagccccacaagtacaagcgcaagaaaggttttcaccttacacacatgcagagggaagaagttaaagtaagttgccccaagtctctcagactctgatgaagccagaaacaaatcttgtttctcactgcctatgggatcagtgatgaagctctggaccagccagtggcaaattttactggcaagaactcctttggtaccagcctccttcctacaaggattctattgttattttatgactacgttttccccacccttgggccttacagggctttaaaaataaataaaaaggttccagggccagttaaatatttatgcttttacaggtaagaagaaaagccaaaagcaaagatcaataaacacagagatagttgtcatctgacaggcacctgagaaacagttcctttttttttttttttgagacagagtctcactctgttgcccaggctggagtgcagcggtgcgatcttggctcactggaacttccacctcccgggttcaagggattctcctgactcagcctcctgagtagctgggactacaggcacgtgccaccacgcccagctaattttttgtatttttagtggagacggggtttcgcagtgttagccagggtggtctcgatctcctgacctcttgatccgtccgccttggcctcccaaagtgctgggattacaggcgtggagagacaattctttaacccttcttgctgacttgtcttcttctgcccctccccactccagctcacccctctccaggtggtcgtcgggcagcctgtgtctttctccctcctgtgctttgcctcacagagttgtggtcaccaggagatcccccatttttctgcctatttgaatccttccaggccccctccccctgatgtggcgacacctctctcctcagaaccctgataatgttcacctctcttattaggttataaactctgagggcggggctcccgcattcccgtgtttagccagccgtcttgcacatggcgatattggttttgataatctaccacatcattcccttgttctcatgctgattgcttgttggtgtcagcaggttatgcctgccttattaccgcatcctgatcaggcagctggtgttcaggcagctaagaatccctcccctctataaaatgcattctgataactatggtaatgagacactgctagtagatgtcttggtcagtgatatttaccttctaagcactttatttccttttttttgttttattataggctgcaaaaatacaatttcccagaattttaagttaggggcatataagtaaatctgcttctcttatgggttaaacagagtccccagtcttttctcagaacgtagaaagaaacaactgaactacagattagcttttgggatgccacttgtttgatggccagtgtctacatgtttattgatcactccttttggtttttctttttatctagaaaatcataaatattttatcggtcctggaacagtttgacctgaagttaaagttaaaaattctctagatattcacatctttttatttagtaacatccaagtttttaagctaccttaacttgcatttctgaattgttcaaatgttatatttaagggatacctttatttctgagatttacaaatttgtccactgataataagagtcctatataactgggaggctgggaggtgctctctaacttttacctcctgatctttctcctcttgcctctttttcttttcggtattcctagggttccacagagctgagccccttgggtctaccctttgtactcttctcaccaactagattgttggagatttctcgacctatgccttcaggtactacatgataacagcttatttccaaagccatatctgtagtcgttcctctcttgtgagcttggaccctgtatccttttgcctactggcaaagccccaggtgtatctaaaattcagcttatctaaagcatgattcactgtccttcctttcaaaacctaattcttgttctgtacagcctattttcatgaaaagcactacctagactctgtctggttggcaggccagaaacttcagagggtgttgacatgtgttgggttatccaggaaacagactctgagctggagatgcatgttgagaagtggagatttgcatacagagtgtgtgcgggagctgtctcctgccttcaaccctcccctgcaaaagtgaaagtgaaaaaaaagaaaggtatattcatcatgacacgcattcgtgctgaacccggatgcagcctcagaatccttcttaacccagtgcccttggcaactgttaccattccttggattggcacatgagatgaaatcttatcaatatctgatggtgtggttcacattgacaggtatctctataggcctctacacacaaacatcaccattaacagctgggtggcactttgctcagtgagcagaggtgagcgtttgtctagatagaggaaagaagacaagacagggaaggccaggagcattgggaggtgggtgtcaagcaggagaagcaggagtgggtgggtggaagtacatggtctcccaggtgttcctagaacgccagccctgaaatcagagacctttggtgcgaatattcttaccatttctctcatctcttttgctccaggttacgttacagtggatattttgggggtgttactgccctaagcagagagcagtttttcaaggtgaatggattctctaacaactactggggatggggaggcgaagacgatgacctcagactcaggtgaacaacagagaaaggtccccttcacggggctctgcactcagtgtggctctggagacctgcatttatatttattcctttagatgccagtccagcaggtcactaggctgcagatttgggcttgaagggtgcagggggtggagggaaggtaggatggcccacatcattctgtgccagtagcagtttacttctggcctgggggcatttggggtccagaagtgttggtggaggcctcatgtacttgtcgggaaagacttactgagacaccagtgagtgagaaaccccaaactgcaaggtgtctgctgaactgcaatttggagaccgggttgttaagagcctcatgctttctgtcagaccccttggggacacagttcccagtgtccccctgcagggagtgccagcagcctctggggagctgcacatgttgaagcaggcaaagaggtcctctcctcaagcgttaggcagccctggcagccctgcacgctgtggagactgcaggtggcctgaccccaggcctgactctgggctgttgacattaccctgggttctcttggactgctttctgctctgaggggctcaaagggaataagtctggcctccacccacagcttcttcccctcaacttggatttgggggccagatagttatagttatccctgcctcccagaaataagtaattattcaagagcttaggctggtatctttagacttgtaatcacaaggccattctgggtgtcaggaggcccccttccctcctgcttgttgcctcttggaaaagaaattcttttttttttttttttttgagacaaagtctcgctctgtcacccaggctggagtgcagtgacgtgatctcgactcaccgcaacctctgcctcccgggtttgagtgattctccagcctcagcctcccgagtagctgggactacaggcgtgtgccgccgtgtctggctaatttttttgtatttttagtaaaggccaggtttcaccatattggccaggctgatctcgaactcctgacctcaggtgatctgtctgccttggcctcccaaagtgttgggattacaggtgtgagccactgtgcctggctggaaaggaaatttctaacctggggctctgaattattagttacgtgactgtcagaaatttttttgttgcctcatcataaagaacccaggggctccatgctgctcttgttcccatgtctaggctgagagcctctggaatgtttctagcaggagggagtggattcccctgaccaggggctctacagaaatggccgtagtgatgggcaacagctcttcacagcccagcccatcagcagcctatgtggtcatggcttaggaactggacagagggtacgtgctacatttcaggacaagagtagcaaaggctagtgataaacaatccccattatcttccccaaatgtacttcactggggtgattagtagaattttgccctgatcacatatcttcagtgtcttctttcctgctacgcttcagcttcaaagtagaggggagcctccaattttgctttcatttgaaaagaccatcatggccttcagaatggtttttgactaatgtggtagataaactaagatgatttgaatatgaaagttggttgagatttactgcttatttattcgcctgtgcaacaggcactacccttctttgtacttatataatacatataatacattgcagagtacaagcatgttccatgcagattatatcatttgaatatttgaaatcaactccctatcaccattgccattttacagatgagggaactgagacctggaactgtgaactgacttactgaggttgtaaataacagagtccagatttgaacctagaattgtagctttaaaacttgtgaccataaatggccattcctttctttgttaaaagaaggcaactctaagtaaattggggatcctaacagacttgattctcctattcttcaggatgttttgaaataagtactttatcatttttttttctttttgaaaatgactaagtataaactaacacatctcctttgtaccccagtaataaatgctgaatctcattcttttttgggcttatcgcctgaagttccaccattataagaaattggaaattttagaagtttttctttttttaatactccaataatcaagctgtttgtgacactgtgtgtgtgtgtgtgtgtatgtgtgtgtgtgtgtataaattttcgcaaatgatgctttttatttgcctagtggtagataaataggatggactttaaaaaaatctctattatttttctagggttgagctccaaagaatgaaaatttcccggcccctgcctgaagtgggtaaatatacaatggtcttccacactagagacaaaggcaatgaggtgaacgcagaacggtaagtcctggcttcacctgcctagcaggctacctccctagtctgttctgtcaataaggactatgttgaattcgatcagatttgagccagttcattgtgttaaaagatttttattaagcaaattttcaaacagacacaaaaggagagaaagtggtgcactgaaccctcacgtctacagttctcaactcatggcctctcttctttccctcagtttttttcttaccccactggatttagaaatgtgtcacagatgtcatagcatttcatgtgtaactgcttcagtatgtattcttaaaatataagcaattttaaaaaaggaatcagaataccattatcatacctagaataaaattaacaatatctccttaatgtcatcaaatgtctagtcagtgttaagtacttttttatttttaaaaccagttgatcagatcagtgtctaaacaaggtccacattgcatttgaatgatctcttttaatatgtaggttccctctccctttctttatgtgttccttgatatttatttgtggaacaagccagattatttgtccaatagaattccttgcattatggatttttccaattgcatcctggtagtataacttaatatgtcctcctgacctctattttctcataaactggttgtattagtcagggttctctagagggacagaacgaacaggatagatgtatatatgaaggggagtttattaaggagtattgactcacactatcccaagatgaagtccacaataggccgcctgcaagctgaggaacgaggaagccagcccgggtcccaaaacctcaaaagtagggaagccaacagggcagccttcagtctgtggccaaaggcccgagagcccctggcaaaccactggtgtaggtccaagagtccagaagctgaagaacttggagtctgatgttcagggtcaggaagcccaggagaaagatgaaggccagaagactcagcaagttggcttctcccttcttctgcctgctttattttagcctcgctagcagttgattagatggtgcccacccacatggagggtagatctgcccctcccagtccactgactcaaatgttaatttcctttggcaacaccctcacagacacacccaggaacaatacttcacatccttcaatccaatcaagttgacactcagtattaaccatcacactgggatttctctgcatttctggagacttgaacagaatcttatttttgggcaagaattttcatttatggtgttgtgtacttcctccagtgtcacaacaggaggatgtaatgtctggttgtgtcattttgtgatgttaggattgatctgtgagtttcgatattgccagtctaatctatgcattgtgagattcctcatcagttttttacctaatgacttcagcagtcattgatgcttgatttctaaatttattatttaattaggagttgcaaaattgtaatattctaattctattgttccttctgcatttattagatttttctacaaagtactttcccttttcatgtatttgggtactctggggtatagtttttataggaaaggcagaataaagagaaaagagtcaagcactgattaaaaatttttcagactaatgacttggtgtttcctagcatccttcaggatgtagttcttgtactttttggtactcatattgtctcatctttggccaatgggatcttcttcaagctgggtcctgaatcccagtagtcctcgagagcttccctccctgtgctctgctgtgatgaaatgttctaggctcttcttgtacttttcctgccttgggaattggcctattcacaaggaatcctggcagataagccagttcttatgaggctttgattgaagaatctgtatttctttgttctgatttttccccttaaattttcaaacagtcttaaggggtttttagtgcttttgttatagtctacattttaaaacaatattaaagtgcttttagcctgatattaaacagtcctgttaaagttcatttatttttttctgaggcagggtctcgctcccaagctggagtgcagtggcgtgaccatggctcactacagcctcgatctctcaggctcaagcaatcctccaagctcagcctcccaagtagctgggaccacaggcatgtgtcaccatgcttggctaatttttttttattttttgtaaagacagggtcttcctgtgttgccaaaggctggtctcaaactcctgggctcaagcagtcctcctgcctcagcctcccaaagttctaggattacagcatgagctaccatgcctggcctaaagtttatattttaaagcattattaaatggcttttcacccttttggtagagtcaaccactccaacaaaatagctatttctattttctatgtttttctagtcattgtccataggtatgcatttttctctttatgttaaaaaaattaattattgagtagatacaaaagagtattcctaaattgtatgaaaagtatgaagattcttgatgccatgaacactgctgatatctcctacccccactttgagtgcatgacctgtgtggtcctccctaattctgtagtctcctccttcacatctcccctatccacctacccaagtaacacttctctgaatttttgtgataagtatttgtgataatgatagttatttctgctgtttcttggttttcttgttttcccatatgtttgtatccctaaacaaaagattgcttagttctgcatgtttttcaactttatgtaaatgaaatcacactgcatttattcttctctgactttatttagctgaacattatgcatctgatccccatccatattgtcatgggtaactagcatttattgtcttcactgctgaacaagtagaacctattcagttcactgcccacttgtcttcccagattccatggttctggccacactagtgacttctttaaatgcatcctgctcttttgcgtctgtgcatcttgcccagggtggtctctctgcctggagtgctttttccttcaccttcttcacttggtggatttctctctttcagcgttactgaaattttccttctccctgacacctcacccgacttcctcatgaagttaggtctcccttcattcatcctcatctacatacattctaatttttttggaggctcgtgaaagctatgtacccacctacagacaaactttccttataacataggaagattcagagatcccctgaagctcagccaaggatcagttagcaatggttggtacatatcctgtagtatctgtattccttgcacatccttctgtcctgtagactgggggctcactgagtgcagtgacacttttcatcatgggtccccgggttctcacgtggagtctgacacatgaatacatggctatcatgtctgtcaccttcaatggggaaaacaaactttgtaatggtaggaaacacaacaggtacaataatttacaaaaatatgtttgccacatttcagggcaaggcaaaatgcagtggagacatatgttaaattcttatcattcacatttgttctttttatctttaggatgaagctcttacaccaagtgtcacgagtctggagaacagatgggttgagtagttgttcttataaattagtatctgtggaacacaatcctttatatatcaacatcacagtggatttctggtttggtgcatgaccctggatcttttggtgatgtttggaagaactgattctttgtttgcaataattttggcctagagacttcaaatagtagcacacattaagaacctgttacagctcattgttgagctgaatttttcctttttgtattttcttagcagagctcctggtgatgtagagtataaaacagttgtaacaagacagctttcttagtcattttgatcatgagggttaaatattgtaatatggatacttgaaggactttatataaaaggatgactcaaaggataaaatgaacgctatttgaggactctggttgaaggagatttatttaaatttgaagtaatatattatgggataaaaggccacaggaaataagactgctgaatgtctgagagaaccagagttgttctcgtccaaggtagaaaggtacgaagatacaatactgttattcatttatcctgtacaatcatctgtgaagtggtggtgtcaggtgagaaggcgtccacaaaagaggggagaaaaggcgacgaatcaggacacagtgaacttgggaatgaagaggtagcaggagggtggagtgtcggctgcaaaggcagcagtagctgagctggttgcagctgctgatagccttcaggggaggacctgcccaggtatgccttccagtgatgcccaccagagaatacattctctattagtttttaaagagtttttgtaaaatgattttgtacaagtaggatatgaattagcagtttacaagtttacatattaactaataataaatatgtctatcaaatacctctgtagtaaaatgtgaaaaagctttgagtgttccttcgtgttttttattgttctttgaggcctacagatatgttcatttcagtatccataattctaaagagcttaaaaacagaacaaatgaaacaaagccctccactacttctgtctcccgtccttctgtccctctcttgtttgtctcatttgtgacctccttgtggaaccagctccaatcttacgataggcccgtccatgtctcactccctgggcctctccgtgaatgcattatgcttatcatgcaagccctaggggttctcaatccatcattattgtatgacacctcaacagttaaactttaacaagaatgagtgccagccaggaagtttaaataatatctaatccttcccaagcagggagagagggagtaggaagtttggtgctcctaagataaaacaggagttgtcaccacccaagtggggaaggagaatttgaaaggacaatacacttcataggcatgaaacgtttacctagggctagcttggtttagcttttaactcagcacagggagcaaaagagcaaaagtggttatttttcttttccttttttttttttttttttttttgcgcgacagggtcttgctctatcacccaggctggagtgcggaggtgcagtctcggctaactgcagcctccaccccccaggctcaagtgacaatcctccccccgtcagcctcctgaatagctgggaccacaggtgcacaccaccattcccagctatttttttgtatttttagtagagatggggtctcaccatgttgcccaggctggtcttgaactctagagctcaaaatcaatctgcctgcctggggtgcccaaagcgctggaattataggtgtgagccacagtgcccggccatgtttttttctttacttagcagagaaatactcagggttttcatgttttttgctcaaactttgtaaaggagcttcattcttgggagatttgctaatgaggctgtagtctgttgagtaaatctctccctcactgtcccttctcttttctgtagaaactttgtctagagctctctcccaatttgcttgactatgaccatattaacagacggtaattgagaggttgtaggtccctccctcatcatggttgggaagggcaatggaagagaatggtgtgtgcaaggaatttgaagatctgtatttgagaactcaatttcttactcaatggaaatggagtatagctagtaccatgcagaaactctcttgtgtttttttgacatctgcaattttttaactgttggaaaccactgaatgatgccttttatttttcttcaggtaattctttcaaccaagataatctaaaagtcccttaaatgacttgttatggaacttcttgaggtggaagatagttttttaagaccttgacactgccattgtgacactttccctgcactggggcatcaaaggctggtgacacggggcatgaggccgcctgcccactcactgctgcctccctccctgctcttgcctccccactgggcagggggtttggcttcaaaggaactggcttcctccagttcctgccctgtgcattttctcatagttgccaaagaggcctactgttttaaatattgtagagacagctatgcctactataattgctaaggattatgtgggggcaggctatttggatatcacaactacctaacacaaagagtgtgttactttgaagttttcattgattttttttcctcacctatactggcattcatttctatagtgctttgcagtttgtgatatctttacacacactttattggtgccgcttactctttttttttttttttttttttttgagacagagtctcactctgtcacccaggctggagtgcagtggcacaatctcggctcactgcaacctccacctcctgggttcaagtgattctcctgcctcagcctcccaagtagctgggactacaagcatgcctcaccatgcccggctaatttttgtgtttttagtagagacggagtttcac

SEQ ID NO: 12284 - DNA, 67156 bp, Human
cccagtttccagctgtagggccatgtattcaatggcatagtgactaaagggctgttcagagaaccctgaccaagattaatttacctaaagttggaacagaaggacatagtcaagtttaaaatcaaatgctttgtgtggtggcagaagggagtgcctttgacggtttgcaaatgcagagaggcaaggattctccaaaagttcagaaaatcgtatgagatctgagtcaggaaaggattcaagaatccaccaccacatattgaatcatataggagccgagcactttatgagtatgctttttgtttgtttttgagacaaggtcttgctgtgttgcccaggctggagtgcagtggcacaatcatggctcactgcagcctcgacctcctgggctcaggcagtcctcccacctcagcctccctagtagctgggactgcaggtgcacaccaccacacctggtaaaaacaaaaccaaacacaactatagagacatgtctctgttgcccagactagtctcaaactcctgggctcaagtgatcctcccgccacagactcccaaagtgttgagattacaggcataagccactgcgctagggcttatgtgtgtacttaatttaaccctcatcctttaaggtagatattagtacccctattttttaaaaaaattatttatttatttttaaggcagagtctcgctctgtcgcccaagctggagtgcagtggtacgatctcagctcactgcaacctccgcctcccaggttcaagcgattctctgcctcagcctcctgagttgctgggattacagtcatgcgctaccacactcagctaagtttttatatttttggtagagccggcgtttcacccatgttgaccaggctggtctgaaacttctgacctcaagtgatccggctgcctcggcctccccaagtgctgggattacaggcgcgagccaccccgcctggctagtacccctatttttgtaatgaagaagctgaggtacaaagaggttaaacaacctgctcaaaattacgaagtagaagcctgaggtggggtatggtaatttgtgattctacatttatccaccatattaagtcaactgtgttaaatcatgttgaaggaagatgatgcgctgtgatctgtaatattggtgcagttcagcattaccgtggtgcagtgtcaagttccaaaagacacaaaactgtctgatcggcctgtagcgcatcaccgcccaccagcagtacctgaagacgctttcagtcccctgctagtgccgtacggagtccgggctggtccatttacattgaaaacaaactgatcctagcatctaagtcacccagacatcttttaggcggcaagcttttcagacagtttaacacatttattcttgttttttcaaaaagagcaaacacgtggcgttacaaaggtcctccgtttcgcacgcaccggtgtcccggcagcgcgctgcgcgtcgggaggcccagtctgtcgtcccgtggggccgggggtcaggaggtcgggcaggcgggatttggggtttcgcgtgttccggaccggacacttcgccatcttaacgagctaccgcccgggttaaggggcacccagggcaggtgcccggccgggggtggggtgtccgagccgccggtgcctggacgtggacccctgcaggaagggtccgcgcgggaagcgagctctccacgagtccatgacagcaggcccgcgggggcagggagcctgcgccaggcagtctttctagatcctggcccagcctggccgctttcgcgcccgtgctccttttcggggatcctagagcgacgcgcagagcggaccaagggttcccccagcgcgttctcgccgcctggcagctcgctggccacgcccctccgcttccaccctgccaccggcccccgccgccgcaaatgtcgcgagaccttcgtccatcctcccggcgtggtcccgctgcccacggcgtccagagcgcgcacgcaagccccgggagcgcgggacagacagggcacgctgggtcggcggagctgaggctcccagctgtgggcctcgctggcccggccgcccagtctcgcgagagttgggagtaaacagccccgaatggagtgcccaggcgtgttcgccgcggaggcgccgtcatcccgggcccgccggccctgagctcccggcggcgcaggtacgtcagccgcccgcgcgcggcctccccgacccgctccgcctagcggtggcggcccgctcgctcaggtgtgccggttgcgtccgaggccccgaggcgagggctgcgggggccgggccgggtcgggggaggtgggcgcggggcctccggcgcttgtttggacacagcgtgcctgtaccgcggccctgcgggggtctgcgcgctccggcagcttgttccgttgcctggttttctttacgtgaaatgagcattcaccgagtgaaacaatacgccctgctctggcccggagcctccagacagactcaattctaggtgcgcttccggggcagtgctggcgtcaggtttaaaagacgtcgattctttgccttatctcggtctgtgcatattgcgctgctggtttttggaaatgcggggattctgttcggcgaactctcagaaccagattgccttttaaacctgtagcttcttaaaaatcttgcctcgccttggcatggttgcgctacctaagaccgttgtggatcgtcagtatttttattaagatgtttacctttcatattgggttgagcccctgagaatcttggcctatttgtctacacaaattaagttattagattctgattgacacttcgaaattacgtggagtggaatacgacctgcgttgaattctggagactcatcctttagtctgaactgtgtaggtaagccctcctaacgtcaaggtctccaattgtatgtctacgaaaaggagggcttgcagaagagaagtaattcctctcattttttttttttcaatctggagaatccgcttttattatttatacttattttttaatgtaagagcttcattgaagtagaatttacataccataaaatccacctgttttaagtgtactattcagtggtttttagtaaatttacagcagcacagccaccaccaaatccacttttagaacatttccgttaccccaagacctctgatgcccagttgtagtcaatgcccatttccaggccccgccacaggcaacctttcatctactttgtctttctagatttgcctttaatgactatttcgtatattcagatggaaacatatgatatgcggccttttgtgtcaggcttctttcacttagcatgttttcacagttcatccatgttgtagcatgaatcaggatttcattccttttatgaccaaataatattcagttgtatggctataccacattttgtttaagcatttatgcagaacacttttgacaaataaaagtttattttatgctctaatgtgtgatgcggatgacagcaaaactgttgattgagaatgggagctgggacctgacccagacacgtgtcaaacgactgcactccccaggcaccccgtataatcaagagttggtcctttctatataaaaagggaaaaatccaatgcagagcttgcggaacctttgaagcacctagggaagaagtgggagctcttctagtcaggaggttaacaagaactaggaaggctgggccgggcgcggtggctcacgcctgtaatcccacaatttgggaggccgaggcgggcggatcacaaggtcaggtgttcaagaccagcctggccaacgtggtgaaatcccgtctctactgaaaatacaaaaattagctgggcgcaatggcaggcgcctgtaatcccagctactcgggaggctgaggcaggagaatcccttgaacccaggcggcggaggttgtagtgagccaagatcacgccgctgcattccagcctgggcgacagagtgagactatgtctcaaaaaacaaaaaacaaaaaaaaacttggaagactgaaggctaaggtgaactgtacattgctgccatcagtgctgcggaattctgcttgaggaaacgctttatttatttttatttttttgagacagagtctcgctctgtcgcccaggctggagtgcagtggtggatctcggctcactgcaacttctgcctcccgggttcaagcgattctcctgcctcagcctcccgagtagccgggactgcaggtgcccgccaccacacccggctaatttttgtatttttagtagagacgggtttttaccatgttggtcaggctggtttcagactccttgacctcatgatccgcccgcgtcggcctccccaaagtgctgggattacaggcgtgagctaccgcgcccagctgaggaaaggcattttaaagtaaaataaggaagttagaagtttggaggtgccctatgtgtggccagctaatactgcatgactaaggggtaagaataaaaggagacaagagtgatgtgtgtgaaacagtaggcagtgaagacaccacagaccaaggtttctcactcttgactgtagtgatacattgggatgaattttttttctttttaatacaagaccacctgatggatggagtgtgccagaataaatggttgcatcggatgtaagaatacacccgaatacacctttgtcgaccgggcgtgatggctcacgcctgtaatcccagcactttgggaggccgaggcgggcagatcacgaggtcaggagattgagaccatcctggctaacacagtgaaaccccgtctctaaaatacaaaaaaattagccgggcgtggtggcatgcgcctgtagtcccagctacttgggaggctgaggcaggagaatcgcttgaaccccggaggcagaggttgcagtgagctgagatcgcgccattgcactccaccctggcggcagagcgagactccgtctcaaaaaaagaaaaaaaaaaaaaaaaaaaagggaagacacctttgttttaccatagtttggtctggcatgacttaattgttagcctgttaaacaatggtaatatagccaagtatgcaattagttctgaaggtggtagtttttcagccgacttttaattggactggatagtaacctttcgtggtctaaacacaattcagtctcctttggagctattttagtaaactagtttattacaaagcaaggcatagctgcataattagatgattgtcgggtgatacaagtcattttcactcacctaaattatgttctaattatttttaaagagataatttcagatgtattttagttatgcccagaattataatctttgtgatattcttttattgtgaaaattgtaagtgggagactccaagagctgcaaagaatgctagccaccagctaggccagttgcttgcgcaagtaatacatttcttctactgagtctcccttctactcaaatcccattaaatactattttctatttctataatttgaacggtgtctttttcagttagtacttgatgtcaaaaatttttaattatacgtgtattagaggtgtaatcattctcatgaaaaacccataggtacgggaataccatctttgaacgttatgcctttatatggaaagataaccaggtcttctgcataaagaatttatagaaattaaatccagttaacatttagtggatacagtaacagccctaagtaggctctctaagttaagtgatattacaaatgataataagcctttcagaatgaactagccaaaagtttaatattttcaaaggctatcttttccttaggctggcaagtagctgtagacagatctttgagaacaatttgtaggagatagatcccttttaagctctagtatatatacaaataaaattaaatctagcatatatatttgaatttttgtgccactctcttaccagaaagtatgatttattcttttttttttttttttttttgagatggcatctcgctctgtctcccaggctggagtgcagtggcttgatctcagctcactgcaacctctgtctcccaggttcaagcgattctcccacctcaacctcctgagtagctgggattacaggtgtgtgccaccacacccagctaatttttgtatttttagtagagatggggtttcaccatgttggccaggctggtcttgaactcctgacctcgggtgatctgcccgtctcggcctcccacagtgctggggttatagctgtgagccaccgagcccggcgtattctttttttgttttttttttttttttttgagaccgagtctcgctctgttgcccgggctggagtgcagtggcgtgatctcagctccctggaagctccgcctcccagattcacgccattctcatgtctcagcctcctgagtatctgggactacaggagcccaccaccacgcccagctaattttttttgtattttttagtggaaacggggtttcagtgtgttagccaggatggtctcgatctcctgacctcatgatccgcctgcctcggcctcccaaagtgccgggattacaggagtgaaccaatttatttgaaaagtttttaaaaatactaaaatatgttttatctaagtataaaagtaacatatgctccctataaacaaataaattaaagcagaaattaactatctgtaatcatacaattgaaaggtagaaccactgtaaccattttggtatgtgtctttcagtggttttttttgttgtcattgtttccatttgagacagtctctccattgcccaggctggaatgcagtggctttatctccgcccactgcaacctccacctccttggttcaagcgattctcctgcctcagcctcctgagtagctgggattacaggcatgtgtcaccatgcacagctaattttttgtatttttagtagagacagggttttgctatgttggccaggctggtcttgaactcctggcctcaagtgatccgcctgccttggcttcccaaagtgctgggattacaggaatgagccaccgcacccagctgcatttttttttttttttgctcatagacacattttaaaattgaaatgtaaaaatttggattatgtggtgcatgaactgttttacttaacatttcattagcatttccccatatttctattgtaacaaatgaccacaaacagtggcctagaacaacatgaatttactgtctcacagttctggatatcagaagtccagaatccgcctcactgagctcaagtcaaagtttcagcagggttgtctccgtctggaggctctgtggagagaatcagtttccttttgtttttcagtttctacaggccacctgcgttccttggctcctgacttcttcctcaaattatctcaacctcttgattgctttcttttttcttttttttttttgagatggagtctctctctgttgcccaggctggagtgcagtggcacagtcttggctcactgcaacctctgcctcccgggttcaagtgattctcctgcctcagccttccgggtagctaggattacaggcacccaccaccattacctagctaatttttgtattttttgtagagacggggtttcaccatgttggccaggctggtctcgaacgcctgacctcaggtgatctgcccgacttggcctcccacagtgctgggattacaggcgtgagccactgtgcccagccagcctgttgctttcatcatcacatctattactacctgttgtcatctcctgcctctctcttatagacacccttgtgatgacacctggcccacctggatcaccgaggatactgtctcagtgccttcatttagtcacagctgcaaagtccctttggcctgtatgcttttgtgtgtaaagtaacattcccaggttctaggaatgaggatgtgagcatctttgtggggaccatttttcagcctactgcaggaggagcatttgaaattgctgcgtggcgttctgtggtgtgcaccgaccataattattgagccagtctccttgtttatgcacattcagatggtctccagcttttcctgctcataatcttgcagtgtgtatctttggacataaagccttatgtgcttccagattcatacttcttggattgaatccctaggggagattttaggaaagcaggcgacctgcctctgaagagtgtggcctctggagccaggctgaccacctgagttctcagcccagctgttctacttgctggtgttgtggccccaggcaagttgcttagctactctgggtctcagttctcatctgaaagtgggggtagtaacgggttgttgggaggattaaattagttaatatttgcagactacttagaatggcacctgctacatcataaatgctcagtgagtgtttttcttattttggatttgttagacgaaaagtttttaatgttcatttttaagcgttttaatacatatgtgaaaattgccattctaaaaggttgtttttttttaatattcaccagcaacatatgagagtacttattttattggatttgttaacttaataaacataatttttattctagagggggtgcctcaggtttttctgtcaaaatgttacttgatttgtttaatgtaaatcatagaaacacaggttaatgttagcagaaatttaccatgaatcctttcaggaattctgtcaatttcctagaatgagatatgcttttagtttccctttaactagctcagtcccatctttggatgtccttctacgtaacaattgatgagtgtaaatctgtctgacgtgtgtggtctggttatgtatgcagtgatcagcactgactgaatctgaataagaggcttagaatgtgcctgtcaccacatttaaaatagcccagcctcatgcgtccttggcaggtgagggtaaataaagaacttattttttctgcctgttttggaaacaggctgaacctaacaggaaggttgcacgaacagtatgaaaccattttttctctaaagcatatgagagtaaattgcagacctgatactccattatcccccggtgttttagtgggtgtattttccaagcaaggaccttcttacataatcacagcacagttgtcaaaatcaggaaattagtcttgatacatcactaccatctgatccacgggcaggcttacttgggttttgccagttgtccctgagtgcctgttacagcagatggatccagtttggattcatgagttgcactgactctggagtctccttcaatctggggcagtagctcagtcattcttgcctttcattaccttggtgcttaggaaaattctaggccagttgattctgtagaatgtccctcaatttgggttggtctgatgtttctcatgatttgatttcaggttgtgcatctttgtcaggaacctcccagaagtgatgccggctcttctcagtgcatctgctctcgtagacctggctccgtgtgtcccattactgcttcccttggacaacttggtggagcttctccactgtaaaatgacttttccctttgaaaagagatattttgttggcagttgggcattttgacatgatgtaaatatctcattctttttcaaacttcatgtcattgtggactcctgttttcctgttttattccacgggttgggatctgttattatttatcgtgatgctcagattgtcccggattttgttagtgggggccccaccaaactggcttccatgttccttggacacttccccatcattctgtgagcctttcctcattgagtgacactgttccaaacccatcttgttcttaccgtacccagactggaactagttctttgtccaaagagcctaggttcttttagtggagagtgatatttagaaccaattgtgggcagtaggtgggctccttgctgttgggatttcactgctgccacacccttttggagatagctaggaaatgtgtgtagcacgtacacgtgcacttagatttctttctttctacatctgttagtctatgtattgaaaaccttaaattcagaccagcatttatcattttgttctgatactgaatggttcatttattttttctctttcatatttctaactttcttctctgacagtaagaaagccgcatcccattatatgtaaaatatttatttgatcaaacagttttaccttcactgctatcaccccactgcctgcctggtgccttcttcacttgccaggctctgaccccctcacctggtgcctctcccttcacataccttcctcactccgctcagactcttaagaccctgtagtgggcttctgccattctcccatgaacgcctgccttcttgtcttcagcagaattcttcaggaagggaagaagaaaaggcagagttagcactctttagaaagtgcttttcttgggctgggcgcagtggctcacacctgtaatcccagcactttgggaggctgaggcaggtgctggatcacctgaggtcaggagttcgagaccagcctggccagcatggcaaaatcctgtctctactaaaaatacaaaaattagctgggtgtggtggcgtgtgcctgtaattccagctactcaggaggctgaggcaggagaatcgcttcagctgggagttggaggttgcagtgagcagaggtcgtgccattgcactccagcctgggcagcaaagtgagactccatctaaaaagaagaaaacagtgcttttccttaggtttgtgtgtctgtatctgtgtgtgcatgctctgtctgcctgtcctgctgctgcttgtctgcttacctctcagtggtgagcccatcttgggaagtgtgcccatcgggtttgcattgtatagtgagaaccaggagggaccattcgtcacagctgaatagatgtattagaccctggaaagtgcagtctgtgcttgcaaagcgtcactgacttgtctagtgagtctgtggggacaagatctctttaggcccaggccagacacagtggctcatgcctataatcccaacactctgagaggctgaggcaggaggatatcttgagcctgggagtttgagaccagcctgggcaacaaggtgagacccccatctctacaaaaaaaaaaaaaaaaaattagctggacatagtgccgtattgtagtccgtgcaacttggtaggctgaggtaggaggatcacttgagcctcagaggttgaggctgcagtgaaccatgattgtgccactgtcctccaccctgggtgaccaagcgggaccctgtctcaaaaaaaaaaaaaataggcccaggagttcgggggttggtaataagctcagccttggggaccccagtccctctgccatcatttactggtctcttgcccccgttatggcatttttgttttccttaaaggaaatttatattttgaaaccaccttattctaggattgggaaactatagaaacctcaggatctgttgccatattttttgagccataaatcctttgaaatagtcttgatagagcctggattttagctcaccttttaggaacgcaagcaagtccacgagatccaaacacagcaagggggtgtgtccttgtccctgtcatttccagccttatcattcatccccatgggatttttacacttgaaggcaccttccttccagccactggtggcttggtgactagagcaggtgggctggagttgacaggcttggtaaggtacagtctggcggccaggctcacccgctcactagtgtggcccttttctggaaggggccagttactaagctagtggtctctgtctcttcagcttgcccaccttccttttgcaaattatttcccactgattttggtttccttctgactttcctgtgccctctgtcttttgccatctctgaaagaaaaggtactggattgcccgggattctgccctaagccgtgcccttgaccctgaggctcatccgaaattgaacatgctcagagctcagctcctgctggtgtctcccaagtcagctttcctgctgtcttccccatctcaattaggggcaagcaccactggtccagtcgggcaaccagccttggtgttgccttgaatcctcacttgtgtgcccccacatctggtggacagcccatctgtcacttctgccttcgtatctgtaatgtcatcgcctcttatcacctcccctgcccgccctggtccaagccagcatcttctctcccttggctcttgtacggaagtcctccagatgctccctgcctcagcctgtgcccccttccacaccgaagccagagcgatctggctaaaacacaagccacacgtgctcaggactgcctcatgctttctcttcccagtcagaatcaaagctgaagtcctttctgtgacctgcaggccttccctgggctgtctcccggtttcctcagatttcatctttggctttcccttgcttcccgctggcctctttgcctttctttcctcacacacacaccaggaatggtccttgccccagggccttttcacttgctttcccactgcctggatcctgtttccccagacccttggccagcttcctgcatccttcaggccttcactgaaaagaccccttctcagcagctgctgtaggtagtgctgtagcagaaacccagccctctcctgacttgtcatattccttttctttgtgttttcttatttatttattattattattattttgagatggagttttgctcttgttgcccaggctggagtgtagtggcacgatctcaactcactgcaacctctgcctcctgggttcaagtgattcttctgcctgagcctactgagtagctggagctacaggcgcctgtcgccacgcacgactaatttttttgtttttagtagaggtggggtttcaccattttggccaggatggtctcgaattcctggcctcaggtgatccacccgccttggcctcccaaagtgctgagattacaggtgtgacccatcgtgcctagctgttttctctccttcccaaatgtagtttttatcaccagctaaatactgtatgttttacttgtcttagttacggtctgtctccctgcactggaaggtaagctccgtgaggtcagagatttctatggtattttgttcattactctatccctactcctagaacagtgcctggcttttagtagtttctcactagatgagttggatgggtgaacacaggagctcagcagtctcgtcgttgggctgtgttttatctctgtgctcttcactgccattggatggaagaggtccgtatttccggctgttggctggggtgtacctgcttgaggtcctctcttcccccctcgtctttcagcctcgctagacggacacctccttgcctccctcctcaggctgggcagtgctgatccttgtgcacatctgtgtcttcctgtggttccagtgttgccacgcttgggatgctctgctcctccctccctcacgcccatctttcagtgctactgagctcagattcttccagagctgctgcagtgccccctccccagcagaagccgcctcttcacagcccggagagaactgtgtgtcagttcagcatctgtggcctggatgcctgcctctcctttcacattttcatttcctgcattttgtttagttgtccttaaatttaactagatcacacttggaaggttgtgccctgactagctaatagtccgtgtttgttctgtagtacctgatagtatcttaacttggtaagtattctaaaattgcctgatctaatgaatgagttaaggtaaaatgtcttatgataataattgccttctctgttttccacataccccacatttattattatttttaatttggggaagaactgattaccttagagagtttttttcatttatttattttttttttttgagacagagtctcgctgtcacccaggcgggactgctgcagtgtcccaatctcagctcactgcaacctctgcctcctgggttcaaacgattatcctgcctcaccctccggagtagttgggattacaggcatgcaccacaatgcccaactaatttttgtatttttttttttgggtcggttggttggtttttagtagatatggggtttcaccatgttggccaggctggtctctaactcctggcctcaagtgatccgccggcctcagcctcctaaagtggaatcacacccaggattacaggtgtgagccaccgcgcctggcctttttttcatttgaaaaccgccaaatcctttcttttcatttcttttaaaggcaagtacctgcctaagttgtaagagaacatcagccatctcttctgcatgggctgtgttaaaatttcttacctaagagtctttacctttgagtgaattattttagaacaggttgaattaaagttgatttaacccagttaggtctaagattttctcagtactattacttaattatatttgtgttatatggagcccacatgtgtcatagattctttagcttgaggcagaaaagttttaagaggcttttttgtttgtttgtttgttttttaagtggagagagagtctcactgtgtcacccaggctggaatgtagtggtgcactcttggcccactgcaaccctccaggctaaagcaatcttcctgagtagctgggactataggcgcgccaccatgcctagctaatttttaatgttttttttgtagagatgaggtttctccacgttgcccaggctggtctcaaacctctgggctcaaatgattgttccttcctttttaacaacaacaacaaaaagcctgccttgagtgagaaacgcatttaataaatatcttttaaatatatattcatttactgtgatatgagaactgttattactggcttttatcttcttcggccagtagtctttaattaagctagatacatgcttcatgtcattattttctttggtactccattgctggatgtatcaagcataaagaaactaagaagtaggggcttactcctgagcaaacttctgtcaaacctgttagggtggctttaggtgccctctgcttttctgatctttctgtttggctctttgtttttgctcttgcagttggcattgttattgttgttcttgtcgaggtggatgtaactgctttaaactttgactcatttctgatgagttccacgccccttagttgccagtgccagtgccagagatgggcttgtttttcaggatcagttgttagtacagcagtgaaagtccctctttagtaaaagtaaaaacgttttttggatattttaacccctcacggtactttatcaatgtttttctactcgtagaagcacatattgatatttccagaaaccaaaaactcagaagcaccagtttctgccagaagaatgagttttacagcttgaagtaccttttgtaatagatgacttaactccttgtccttaatgttttctttttaaaaacaagtagtgggcggacatggcggctcttgtctgtaatctcaacactttgggaggccaaggtggctggatcacctgagtttgagaccagcctggacaaaatgccgagactgcttctctatattaaaatccaaaaattagctgggtgtggtgatgcatgcctatagtcccagctactcgggaggctgaggcgggaggattgcttgagcccaggaagttgaggctgcagtgaactgtgcagagattgcgccacccactccagcctgggtgtcagagtgagacccttcctcaaaaaaaaaaaaataataataataataataaaatcctaagtagcactggaaggcctctcttgcttcatttacccatcccctaccctgctggattatttacgccccgggtatggtctgtgcaactgtttttctggttatgctacagccagcattgttctttactatcgctctgttttcattgtgaagaatggcagtttttcttacaattcagatgttttggaagatatctgtgcgcatgcttaatttaatattcaggtgacatttttctttagcagtagtttccctcacaaactgtcttctcatgtcactccagtaaagagataatctggttttataacacatttagcaggttacatttctttaagtgtgaggtttcaggtaaaataaatttcaggacagtaaacccttttatgcccttttcatagaattggtagaaaatatttcaaactatgtaatattaaagcatagtgtttcttaaagaaggtgttaaatatcactgatagggaaattactttgctgttaggtattaatgttacagcagaaagtaaggctttataccaagcttttgcctgaaaaattgatgaaatttgtgggaagtaaaagtgccaactggggaaatgctctggggattgagttgcaaatgataggaaatacagaatctgaaacagaacaaaggatcatcctgatgccttcttctctttggctgctagaatgctcaggtccagtgtgcttaatatttttggtgttattttgttgtccttagttttttccatttttctcattgattttattgttttatttttgaagatgcctaaaaaaaattttcccgtgaaagcagtgagtaataagtaaataaaaatgaaataatatgtttcatggttgtatggcacattaatttgtcttaaaaccaggatatctcttttaccctcttatttattttattattttattattttagacatagggtctcactttgttgctcaggctggactcagactcctgggctcaagtgatcttcccacctcagcctcccaagcagctgatctacaggcacctgccaccttgcctggctgacccacttgcttaaattataaatacaactaaatcatacctggctatgtcagtttgctactaatgtctgtgtgcactgttttttgtttcatagattggctcacagtggttgattgatcaaccccattggacgttggttctgtggtacaaatggagtacaggactcagtcgtcacggcctgagtgagagaagccttatttccaagatggagaagaagcggagaaagaaatgaaagcctctcttcaggctgaaccacaaaaggccatgggatttaacttttatttatgttgggcaagactgtaagatggctgattagtaatgttgcagcttttagctgaaacaaaaattcacttttaatcaagaagaaaaaagtgtgatttgaatatatgcaattttatgatcatattcgcttgtgaccatgaagcttgtcaacatctggctgcttctgctcgtggttttgctctgtgggaagaaacatctgggcgacagactggaaaagaaatcttttgaaaaggccccatgccctggctgttcccacctgactttgaaggtggaattctcatcaacagttgtggaatatggtaatgatgttgtcttaagtattaggaactcccatcctatttttttaaagcttacttaatataaaattagctattgctgaataacatgttcctcttttctacagtaaatttctttcttttttttttttttgagacagagtctcactctgtcacccaggctggagtgcagtggcatgatctcggctcactgtaacctccacctcctggattcaagcaattctcatgcctcagcctcccaagtagctgggattataggtgactgccaccgtccctggctaattttttgttttgatttgttctgttttgttttgttttgtttttgagatggagtctcactctgttgctgaggctggagtgcaatggcacgatctcggttcactgcaacttccacctcccaggttcaagcagttctcctgcctcagcctcctgagcagctgggactacaggcacccgccacaactcccagttaattttttctatttttagtagagatggggtttcaccacattggccaggctggtctcgagctcctgacctcgtgatccgcctgccttggcctcccagagtgttgggactacaggcatgaactatcgtgccaggcctttttttttttttttttttgtatttttagtagagacggggtttcagcatgttagccaggctggtcttgaactcctgacctcaagtgatcaccctccttggcctcccaaagtgctgggattacaggcatgagccaccgtgcctggccttctgtagtaaatttccaatgggttgagtgcacagcacatgaatgttaactttgcttaagtttgttttcccagtagagtaagcttatatgataaaaggaaattgacatgaattatttacctacaccttcttttctttttcttttggagacagagttttgctcttgtcgcccaggctggagtgcagtggtgccatctcagctcattgcagccttggcctcccaggcacaagtggtctcccacttcagcctcctgagtagctgggactacaggcacctgccaccgtgcccagctaatttttttatttttgttttttcttttttcttttttgagatggagattcactcttgttgcccaggctggagtgcaatggcaccatctcagctcaccgcaacctccacctcccaggttcaagcgattctcctgcctcagcctcccgagtagctgggattacaggcatgtgccaccatgcccggctaattttgtctttttagtagagactgcgtttctccatgttggtcaggctggtcttgcactcttgacctcaggtgatcctcctgcattggcctcccaaagtgttgggattacaggcatgagccactgtgcccggcctgcccagctaatttttttattttttgtttcaccatgttgcccaggctggtcttaaactcctgagctcaagcaatccatccacttcgacctcccagaatgctgggattataggcatgagccactgtgcccagcctacaccttgattctttggaacaggtgccattgtaattggtgaaggtggggagctgggaggtgcagaatgtttatgttctaaagtttgagtgaccagatgtgaagaactgagcaaatagtctcacataatccactctggaattttgttactgttttcgttttaagaaacactaactgagcattcagttctctgaatttctttttcctacttgataaaaattatatacatttctttgttgtgtattcaaacttctgtaggtatttgctttttaaaaaaatatcacgggtatctggtttcgaatgatgtattctttgtggttaggtgattcatagagatctttttttttttttttttgagacggaggcttgctctgtcaccaggcaggagtgcagtggtgcaatctctgcttactgcaatctccgcctcccaggttcaagtgattctcctgccttagcctcccaggattataggcgcccaccaccacacccagctaattttttgtatttttagtagagatggggtttcactatgttggccaggctggtctcaaactcctcacctcgtaatctgcccacgtcagcctcccaaagtgctgggattacaggcgtgagccaccgcgcccagccccatatagatcatttttcctcaaagctctgcagacagctgtctaggtacttaaactagtctttgtgttttctctcgtctgctgtgggctttaagataatttttcttttgccagattttagattagatacaatatagtatatgttataatgtatgtgcgtaaatcttatttttgtttgtggtgattggtttcagaatatattgtggctttcaatggatactttacagccaaagctagaaattcatttatttcaagtgccctgaagagcagtgaagtagacaattggagaattatacctcgaaacaatccatccagtgactaccctagtgattttgaggtgattcagataaaagaaaaacagaaagcggggctgctaacacttgaagatcatccaaacatcaaacgggtcacgccccaacgaaaagtctttcgttccctcaagtatgctgaatgtgagtattgtgactgtaggcaaatttctctctgctgtttactttgaaaatctcaaactgcagagtagttgaaaaatagtacagtgagtatccgcatccttccatctagtttgctaattgtgaacattttcctggtaggaattttttagtttagttttgtttagtgcgcagggtcggtgttgggggggcagaattattttttaaaaagagacttcgtactgttctggtagaagaaaatctgagggtttgcagtagtagatggtagtgatctttgtttctgttggaagcgattttcgccagcttcatctcaaagccttcagacttcaaggctgcggccgccttctcgtgctgaaagacgcgtccttgtgtctgcttcttccttgcatttcgcttctctcagtgtgtgttttattttttcttttcctttttatttatttatttttttgagacggagtttcgctcttgttgcccaggctggagtgcagtggcgcgatcttggctcacctcaacctccacccaggttcaagtgattctcctgccttagcctcccaagtagctgggattacaggcatgcgccaccatgcctggctaattttgtatttttagtagagacagggtttctccatattggtcaggctggtcttgaactcctgacctcaggtgatctgcctgcctcagcctcccaaagtgctgggattacaggcgtgagtcactgcacccagcccgatttttaaaggcactcttgcaaaacatgttttcctggggtttcgttttgtttttgtcaaagcctcctgaccaggaatggtcatgcatcagctgggttcgttgaagtcatcagctgtgcaggtgtgagcatggaagcaacttggcttttccttttcttctccagggcttagtctttcctacttcattacaattgggcttgtcaaaatagagtttagtctcaaatagtaaattgcatatttattaaatgatattttccaaagatatgtgttaccaaaggaaaagggttttttttccctgtttatcttaaatcaggttaacaaatttctagttctgttattatttacgatcatttctttcatcagaaggaagaagaaattaaaattttactcttctttgtctatcatattttaggcctaagagcctctgaggttttgctgcattaaacacacacacaaacacacacacacacacacacacacacacacacacgaagagaagtttaattttcatagtaaaaccaggtgtaaacttaaggcgtctgactttttcagagccttttctgctactccagatgttatgtattattctccttaaaaagcagtaacacttcaaaataatccaggaagataaaagccaatcaaacctgatacagttagccaaatgtatacattgcggtattttagttgactttattttttacttcagttatcttaaagagctctagaatgctttaggagacacggagttgcctaattttagcacaagaatcctagactctctggagatgggattcccatggacaccatctccactgcgtgtgttccgggtgcctgacacccctgtgaggggagacttgcccactgcgttcccatgccccttgaagttagctgtgaccttcagcagtaagcgtcttttccatcttgaagcctcagtttttctcattcataaaatggagatgatactccctacctcgtggggctgtcatgaagataacatgaaataatgcatatgaagaaagcttagtagagtgttcaagatgttgtaagtaaccaaatgttaacagtttctctggctgttactcgtagaaggttttgctttattttgggctgacaccattctcactctgcatcccacccatttggttctatcccatgggccataagacaaagcctatctgttttctacgtgacagtagttaaagatgtggtgaagatagctgtctttttgatatttgaagatacccatggtgtgtcccttttggcaattttttctctccaggctaatcctcagttcttgccatagttactcaggtgacttgatttcaagtcccctcatcattttaagtgttttcctttgaatgtactaatttttctaaattgtttgaaagctgtgaagccctgaactgagtataatactggaggtggagtctggcctgtgcagggtcaagcagagcaggcccattcctggtctcagtgttgctcttcagtcagcacctgcagcattgtcccatgctgttgacttaaagatcagactcagcagaggaatttcaattaagaaccgtttcagttggactgtgcaaatatttacttaccagaattgacgtgactgtatgtgtttccaggtccctgtacttaacatgggtgtaggttggtaaggctagaataaaaatgacagtgatttgctttagaaagagaactgtattggtattacagattttctcttcttaaaactgatttgaaatatgacttgttcattataacatggtctttgaaaggtaaagggaaaacccttaggccatttctgtggtactgcctttttcctccgctttttaaaaataaagagacttacagatagtaaaattcgtcctttttagagtatagtttggcaagttttggcaaaagtataccatcaaatatccaccaacaaaatcaagatatggaataattccatcaccctcagaaattccctgtctctcactcctgtgtagtccttttgtttttgaaaggtgaaattctagcagataagaatattgagaatattgagcaatatacagttgttttaagtcctgttgatatttgatggcttttgcctgcccaagaaatctagtgaaacttatagtaaaaataaaactcaatgaatgcttagggtcattttctttaacttttcccccttctggttcagtgagaacaagttgctgatgaaaatcaggtttttctttatttttattatcacaattagctttttaaaattattattatttaatttaatcagtctttctttgccttaccttggttagaaaatttcaagtagagaactatttgggagtaatatgacagctaaataacgtcctataattataattgcattgagactgtccttccagaaaaagaagataatcccactttccttcaaacagagtggcaaatggtaatcctccctgtgtttaggatagttttgcctggcgggtatcgtgtagttcgttttgctcttctgttctgatctttctctcccttgcctgtagctgaccccacagtaccctgcaatgaaacccggtggagccagaagtggcaatcatcacgtcccctgcgaagagccagcctctccctgggctctggcttctggcatgctacgggaaggcattcgagcagacggctgctgagagccatcccgcgccaggttgcccagacactgcaggcagatgtgctctggcagatgggatatacaggtgtgtgctattacccagggaaggtgcttatgggatatacaggtgtgtgctattacccagggaaggcgcggaaagtccagacatgcaggaattccatgttcgggactgcctagtgctaaagccctgcagccttccacatctaaccttcttactatttgtttagctggaggtagccaagtactcctcatctttgactcctgtgatgccaggcatctgtttctgtggctttcctaattgtcaccatttgtgtcttatttttgttaccatttctgaggttagaagggaaggctgtggagcacttctctcctattgacacatacacaaacgagcacagcgctgccggccactggcgctgaccgacaggcctgcagaagtctgtcacttcttggggaaagatggtccctgatctgggcaattccacggaaattagtttatcacttgagtttggtgtcctgaatgcagagtgactaagtaattgactatcacacctgctgatgatttgtttcagaacaggaagcagtgttaatgatcatgtcctgtgaaataaaattcagaacaataaggatttttcccttgctgattcatcatgaccaaaccttcatgttttatctaatgtgaagatttttaccttgacttctaaatgtaagccagtttcacctgctcccaggacagcgcagtttgcctcggtgtctttcgtatatccttgacttagggacccttacctctcctttgatctccttggcgccctgccctccaaaatatctgagatacttcaacttttaatacccggtggactggcatttcattaaaatgtgtgtctccccatggttttacctttttatgagaactccttgacaaaacaaattttctagtcatgagaaataattttttattccccccaaaccaaatgatttctgattttgtgtgtgcattttttaaaagtagcattgatttttatatttatctcagtttaatagattatttaacatagtattgatatgtacacagcccttttgccagaaagacattaccctctttacattggttagctgttaagtcatataggtattctgtattttttttctagatgctttctagaatttttggtcagacaggccagttgtatttcacattggtgttgatggctttggccagtatctggaatagacttactattatagaaaagtgcacactgcagtgatttttcttaggtgtgattagccgcatgtggtgttaattgttccttgcggcagagtttgctgtattataaatgagcagcattgaataaattgctgtccttattgggaataggaatggttcccccttttcccatttttgtgtcccgctccttgggtgtgtggtttgtgagtgttttgcagggcctccgagaaggtggggggtggagacctgtgataaattgccagaaggggagtatcagtaggtgccagcctggagccttgagaagcccgctaggagtggaaggggtggttctatcctgagtgctggtggcaattgaggagggtctagaaggattttctgcttatccttaaatcttatttggcggcagatgatggcattgctcctgctgtcctcttttcttagccttggctcagccagctgaccctgggagcagctgacctaacttatttgctctgagcagctttggccttccacaatatgtcattttctgtgggtcccaggaaggaatgtattttataggcaaaatccaaaatgatgatttcttcaaacataattgtgtttgctttcttttccgaataaggtgctaatgtaagagttgctgtttttgacactgggctgagcgagaagcatccccacttcaaaaatgtgaaggagagaaccaactggaccaacgagcgaacgctggacgatggtgggtctcagcagcagtgagaacgtggtcatgtgatcgactgagagtgtgtttagtgcatgattccacagtctgtccagcaattattcagacaagcccaaggtgttattgtgctttttgttgtggcagaaactgctctgaatacctcataggatgtcgggaggtagcacttcaggagagagtgggcatgcctggtgtgggggcagctccctgtcccggagagcgtggagtggctagacctggaaggggtgcttgtgccagtgacgtctaaggggatcgtagagcagcagcagaggccctcctctatccagcacttggaaatggaaggccgtggaactcatggcctggaatgttgcgtcctggcacttgctattcagtgtgttttatgggattgttttctttatggactgcagggttgggccatggcacattcgtggcaggtgtgatagccagcatgagggagtgccaaggatttgctccagatgcagaacttcacattttcagggtctttaccaataatcaggtaggtgttttgaggactcctgaaacttgaggaattcatactgaaatgtaaaaagcagaatcactggactgtacacacttgtgtaaaaggagtgcacgtcagtgacgctgagccattcatactgcagcacgcatgctcagtttactgttcctctgcctcctgggtggctccgcccttctcccaccaaccactgtgtcgacctaagttgaaccctgaagaccctgccgaggctactacttacgacgattctttgatttcccttgtttcttctctacctccaggcttccccaggcctctgtaccctgggtcggttgtctgcatgatagaacagaacaattgcagatagaataagtgtgcttgcctccctgattgggttcctaccaccttgagctgttttatttacctctgtgtcccgacacctggcattgtgttgggtaatgggagtttacaagccttgttccttcactcttcatttggaaactatagaaaagggagagggtcctagtatttgtttcttttttcgttatttattttttaaggttaatttttgaataggtaatgcatagctcagaaatgtcagaaggtaacacagtgagacccccacccctgtccccgtccagcaggttctttcctcactggcccgtgtgtcctgtgtgatgatgttcctttcttatacctcctcgtagaatttctttggtgtatatgagaaaatataagtacctggtcttttaaaaacctttaaaaacataatcttaatcattacattgcttctcttcctaccataaacttaattttatattttttaaaaaagcaacagctaaaggtgatccacaaagtaatgaagcttttgtaaggaacataggagcacttgaacatcagaagactaatactgtgaaataactgttactgctgccatttgtccttcagtctgtttaggaatgaagaaggttagatagataagttgaactattccaaaatgcttaacttaatagaagtgccttgggataagtccttttgtaggagaggggcggttgggagcttgggtgttatctaggaaggcattctttgtgtagagagctgtgcatttcacctagagagataggccacctgcagaacacagctgcctcttccttaggttcagctccaaggacttagaacttctaggtgttgtattttactctccagagcattatgcatgctcaggattcatttctggttttaagtaaaaaaaaattaagagaactacttgtaattttaaaagagccttagaaataaaaactgtcctagcactttaaaacttgattgaaacactaagcagactgttataatatttaactaggtatcttacacatcttggtttttggacgccttcaactatgccattttaaagaagatcgacgtgttaaacctcagcatcggcggcccggacttcatggatcatccgtttgttgacaaggtttgtggagtcactgcacacggggtttgggtgacagctcctgctctttcgcagcccaactttgcatcatatctagtgtgttggtggcttttcatccaggtggtgacagctttgtgagaacagatggctaatgacgtgagcttcagtgatttgcatgtcataaattgagtgggttagaggcctcagagtaggtgttgataaggagcacatggtgccttgctgatttttttttttttttttttttgagatggagttttgttcttgttggccaggctggagtacaatggcacagtcttggctcactgcaacctccgcctcccaggttcaagcggttctcctgcctcagcctcccaagtagccgggattacaggtgcacaccaccatgcccggctaattttgctatttttagtagagacggggtttcaccgaattggccaggctggtctccaactcctgacctcaggtgatccacccacctcagcctttcaaagtgctgggattacaggcgtgagccaccatgccctgccaattttttcttacctaaacatgcaattcgtgttttcctcaaagtgactagaaagtcagcatctgctctgtgcactgcgtgcttctccgtcccgggtggtatcctctaaaaatgcaagttgccagcacatccgcctttataatgggccagtgctgcttttttagaactgtttttagacgttgtgtatggttttttttttttttttgacagttatatgtttaatgaaagggatactttcattaaataaatgctccttttgtaggtgtgggaattaacagctaacaatgtaatcatggtttctgctattggcaatgacggacctctttatgggtaagtagccccagcagggatgacctcggggattttttcccccttaaataactgaaaaattgttatctgtttgtgtatctacctatggttacttgtttatgtctgtctaaaacttgtcttaaggatgttttcctcatgtaaaaaaatactataggatgtagatgaacacccaggtactcaccactcacctcagcagttgtcacctcaaggccggtcttccttctatttatatatttttaaaattttgttacaaatagtaatttagaggcctaaagtttttattctaactactttttttccccaaaaatcaatcagaaaagtgaatctattagggattctgcagtgttgatgagatctgtgtgcaaagcatccgggtaaagaggcaaacggaagaggtttctgcctctctctgaaagagcaggtgcgagcacagtgacactcattcacaggggaagtgctggcgggcctaacggcaacatggccggtgctttgggagttgatgagagggatcatttaggagggaggcagggaggacagtgtcacaggggggcctttgtgctaaacttaagcagcgtgagatgcgaaacatttgccactgaatcccagccagtacgctcctgtctggttagaggtctcagttttctttccaccagcagcttcattttattctctagataatgtttataagtcatttcttgtgctcgaagtttctgtaggatgctttacacaaatccagggcataagacaaggtgaagctatgtgaagttcatgtttgcatatcagaaaacgtgaatattggcattcataggactctagcctaatagttgagtaaatgatcgtgaaccttgttagaggtccagggttctggattttgctgtcgcatcagtgatacgtatcatgagccatagatgtaagtggcatgaacataccctcgctatagctctgccatgacaaacaccagttattaagtcatctcgtcaggtgttcttgtctcccttttaaatgttcctcccatttctgatgtccccactcaaggctggcactcatcggttcagagtcaccaggtgtcagtgtttcctagcctgttttccaatcttgagtcttttcccaccccagctcttccagcatggacatgggtgaaactaggtgtggaagcagacaggtccgacctgccacttacggctgaggcaccgtcacttctctgagcctcagctccctcacctgtgatgggagtagagagcagcctgcagagtacctatgagactgaaatcagacagcagggggagagcaccatgaatgctgatgatgctctttgaatggaagctgctctttttcttttttgtgcgtatttctactgttcaaacatatattgtagcagttttctaatcaagaatctgcagcagtttattattgcctaatagatgaaatccacatttttcttttgtttttcaaggtcttcagtattctaggctgaattgcaaactttttctgtaaagggtcagataataaatattttaggcgttattgtgtgaaagcagctgcgggtgatatatgtgtaaatgaacatgactgtgttccaggaacgctgtatttgcaaaaacaggtgtgggcctggtttggcccatgggccgtagttggccaactccagccacaatctcagttcaccttgatcttccacttccccatgtacaccttcctggaatgagtgtcctccttctgtttctctcaggtcttccgcaccccatccctctgcccatcctcctggccatacctgtctggattcccagctctttcgcatgctgttcggactgttttgtcacacgctggctgccgttctgaaaccctgtggcttttgtgggtggttgcactccgtagcttcttaccagagttgtgagtttatggtgtgttgaaggagcagagccttgccaggaaggccccatctccaccttgtgtgtacgctcatgctgcctcacacagacctggccacctgctggctgttgaagtgacagaacgtggcatgtgatcacggcagcccagcttgtggtgggtgtggttttttctgcttgggcatctggtgggactgcttccagggctggtctgaggacagtaacatgcatacgtcagcccctctgggaatgaggcacacatcctccggtcccctttgctgtggtctctttgtctgggtcctgtgcccttggtgctcctagactctgtggtgccagcaagcctgcagcctcacgtccctccttttcaataccagcaatgatttcttgatgcgttcccttattttttaagggtttaaagtacactaagcattatagggcttagcaggtagaggagggtgggaaggtggtatttttttggtcaacttcagtgggagtttctgtcagtgacttctgtaccagcctctgctccttgagttcctgggaatgtgtaaacatctagcatcagtcatcagaaaatcattattcgttcctctgaatgaccagctggtaggatattggtggccagtgggctgaggaggcagtaccactttttctcggtgtgttgggaattgtcagttaaaaacacactctagaaggagaacttcatgctgctattatctcttaagccacttggaatcagttgtatgtagttgttgatttgtcaaagagttcattttttttggtagtggagccataataaagcttagcaatgcagttttataactgagtgtctcatattttcaaatggttcatctttatcttgactttacggtttacacatttttgccattatttatttcactataatttctttgcagatctagtgcacttaaggtattggagagactctaaggagctcaagattacagagtaatgatagtccttctacagttccctatgaggagggtagaacaccaccacaggtcaatcgaaaacttaccacttcctgaccttggcagatgtaaatgtgtggttatggtttcttccaggagaagtgtgtgatttagctggggagttaagatgaatgtgctgggaacaatttgaaagtgatgtgagaatgtgtcgttaggtgataaattgtgattgtgttaagtgttgtgaggttcaaggcaagtacagatgcttaaggcttggattgctggagggaaaacgtgagccttgagccccagtgtgccaagttgacagggaggagaagaaaggaggggcgttgcaggtgagagggcgtaatgtgagcacagcatgaacgtggcaggatcatgcgtttcacaggacagccgtgaggagctgcacacgtcttcccacagaagcagctcatacagtgttagattgttctgggagtattcgccctggtttgaatcatccattttaaattatttctcttgtttttttctttttcttttcttttttttttttttggtctcaatatagcactctgaataaccctgctgatcaaatggatgtgattggagtaggcggcattgactttgaagataacatcgcccgcttttcttcaaggggaatgactacctgggtacgctcttctttgctaaataattgtatttagctggacaaactactgtggctagtggcaccggttgttgacgagccttggggtgtatttgtaagtgcacagacaccctcacattcacatgggaatagccggggctgtgagtgcctgcccagccgtgaggacgagagatctgggccccgtcagcatctgccacttcactctggcaagtccacagctgctgtgatgagcaccggctgattctaagcggtgtttcccagtttaacttattaattgatttctgaggaactcacctttaggtgaattggggtcctgcccgtttaccctatctagtagtggtaagcagtcctcctcagtggtaggtgagatgatattttttgggggaggggagccttaagaagttggagaaaccattgagaacagcttaatatcaactctgctaacacagaaacaattgtatttagctggacaaattcaaaataactgctacagttaataattcagctgtttggggtttaattatgcagcacattcacccacctttacctgtcaaagtttgatgaaaaattagacgctcgtgcagaacagcagttgggcacctttgccctcgctgtggccgaggggagcatctgcccttctcattcttcagggtcagagcatctcttggtgtttaacgtcacatgccacactcggaggcctcagataagtccctggaaagattcccaactgcctgggaacactgtgggcctcgtccacactgtagccactttacaggatagccttctgcctgagcctttgtcctgtgacagcgtcagcccccagcgtccccgccactcagccccaccaggggtccccgcctcccacactcacgtgcctcttcctggagctgacctgttggctggggaccattctctcatgtgacagtctgtgcagggcaggctgcgtgtcctcccatccacgctccctcagcatgttccttgtgctgccggataatgggaaactgcatccaccactttgtccccagctccctgtgtaaatgctctcaccgaactgtggtgagatgtcatccactttgtccccagctccccgtgtaaacgctttcaccaaaccgtgatgagatgtcacgtccatggccttcatcaccagccagctttttaatggcatttgagaaatgtccttccatcatcacagctgcagtggaggatgcctttactcggtatcccagtatgtgcatccatggtccttgggtttgatggtcagaaaagggcttcccttcaaattgggctcctgttttctgacagaatatgagatcctattctaattttcgttttgccccaattcttaagaagcttaagcaagtacttattaaaacgttatcccaagttagtcgtgtggttatcttgttccttctcagtggtttcttatttcctcttttacaaccgtttgaaacatccactcataccgtgtacttttttccttgtaaagaaacatgtttgggtttttttacattttaattttctaatttttctaacatatttctaattttaacttatctagagataaagcagtttccagtttctggtcttggtgataagccagtgtccactttccagtctggcatgtcagcaaaattaaaatacttatcttttaattgctttatgcctttgccattgttctggttgttataaaatatatttttaaaaatttactttctacattatcgtttaagcttattttctgtattgtagtgaatttctttgtttttttctctttttttgggggggggggcgggtgcggggctgagggggacaggatctcactgtgttgcccaggctggagtgcagtggcacaatcacggctccctgcagccttgacctcccgggctcaggtgatcctcctgagtagccgggactacaggcttgtgccactacatctggctaatttttgtattttttgtggagatgggggtcttactgtgtagcccaggctagtctggaactcctgggctcaagcagtccacctgcctcggcctcccagagtgttgggattacaggtgtgagccttgcgcctggcctggagtgaatttcagactaaaaccagtaccttcctaaggttatacagtttttaactaacccatatctctgttctgatttgattcactcatgattgcatgcggctgtatgccaatgtgcgagatgtagcaaccaagctgcttttattcataggagctaccaggaggctacggtcgcatgaaacctgacattgtcacctatggtgctggcgtgcggggttctggcgtgaaaggggggtgccgggccctctcagggaccagtgttgcttctccagtggttgcaggtgctgtcaccttgttagtgaggtgagtgctgccccctagagaccagtagctcccacgtcaggacaggagcactcggtgccagcagagcaggagtcgtgtcttgcttctgccctgtcttgggtttgagagcttaggcccttcacagccttgctctgtctctccttcttcatctctgcaaagaggtaggagtcacttcttttatagttagatgaagtgaatgtgaacacactttataagcctaagtaaacaaagtgctgataggcaaaataacctgtttctttatgtttgtgttctgttttctaatatcccatttatgtgctagaactgtgatttttatatccaagcaagcataaatatcaggcagggaacaaatagtaagatatttccctgccatatatcctccatttccttggggattcactttaaaaaagaaaaacaaaaaacaaatcctactgcgtatatgtaagatatacagcatgatgttatggaatacatatagatagtaaaaaggaggttactctagtgaaacgaatgaacacatccatcttctcacagtgttacccatttgttgtttttgtgaaggggactcaccttttaatgttctctatagcaaaggatgtcagagccaccagggactgacagtcaccactctgctttgtctcactgaatctcatgcagttggaatggagcttagtgactggcccttaatcttgcagataatgaaactggaagaaagttctcaaggaggccgggtgcggtggctcacacctgtaatcccagcattttgggaggctgaggcagcaggtcacctgaggtcaggagttcaagaccagcctgatcaacatggtgaaaccctgtctctactaaaaattacaagttagccaggtgtggtggtgggcggctgtaatcccagctactcaggagattgaggcaggaaaattgcttgaacccgggaggaggaggctgcagtgaactgagatcgtgccactgcactccagcctgggtgacagagcaacactctgtctcaatcagccaatcaatcaataaagttctccaagcgagtagaccagagttgatgttcacatgttctcactttcatcggtggcccgtgtttctttactctcagttgtaaaaggatgtctttggggctggcatttatcttgttactgtattttccccaaaaataaattgtacttcttctatctagatgaagttttagttgagtgttgtgataacacacaaaactctgcgtatttggaagttattctatgctaatttaaaaattaattaatataggcaaatagtattaaatgtctttatattttaagttctctttaagtaaattgaatattgatttcagcttctgatgccagatattattttgttagtaatccttaataaagctagatacttggctggttgtggtagctcacacctgtaatcccagcactttgggaggccaaggcaggaggattgtttgaggctagtagtttgagagcagctggggcaacatagtgagaccccatctctaccaaaaaaaaaaaaggggtagatatccatctctttcctcctttctctgttcttcccttacagtttgcagccaaattcttgagaatgttgacattggccagactggcctttggagaataaccatgtgcttgctggaaacactgtcttctcttgccgttgttttcctctctccagtgttatatcaagtgaggaacagagtggagggaaggtggatagtgggctacctggcctgtttgcacacttgtatttgccaggtggagagaattcagttagggctgcagcttctaatgttgttgattctggaaacagaaaatactggttcatttctcctaaacgccatgattgttagcaggaagtgagggctctgccttcactgttgagcccgtcagctctctgctgttgagtaagcgggcagccgaggggttgttccttttcccagcagcttctttaagtacagatattttcagcaacaaggaagcctttcagtctcctcatctccctgcagcagatgaaactgccgttgtgatctctgtgtgtgacagtcgctcataatggaagccgagcagcagtggcgggcctcccgagctccagcctgatgatgctgtgaaaggcagtggaacgcaacccttgagttcactttataggcaggaagaggaggaagattgttgacccatagctttgagcacttcttttcttctgtcattaagaatctactttatctcctctacttatgtcagatttcccatttagaaaacctgcctagactccaacaccaaacatcatcacatacgaatatttaggaacttaggagagttaagttttccttttttgtgtactgatattcccacctcaattttaggaattaaaattcacttgtatttataatacataaatacacaaaaatggatgttgtaacgctagtatcaccaggctaagttcctagccaggtcacactgtgtgttaaagcttgttcagatgcattctcatggtgaaactgaaggtggccttaggtctatgtcgttctgaaaggcatcatccatcagggtggctcatcccagacaagcctcccaatctggaaacaaaaaggcaaggattggctttggaggcggcggtcctcactcagacctgtgcctcctgctagtcctgtgtcgtggcccctccccaggatctgaatgtgctcctccttctcccagccaggcggtgtcccatggcatcttcttcctgtgaccagcaggcttcctctccccagaggagtcagtacctcctatacattcatgccttctgcagcctatgtggttgtttagttgaattatcacaaaaatatgtgttactgatgcatttagcataagtgggtcccgtagaaggttgcggagtggtcagtcctggattgggtacagagatgagtgtgcactcattctctcatgcaggctgtgccagacaagcacctgttggatactaaacaagactgcaggcctcttgtgtgcacgtttgtaggttaggttttagtggtccaatttccattcttttactgagagaaaataggcaattcttgatttttcctccagcacagtccagaagcgtgagctggtgaatcccgccagtatgaagcaggccctgatcgcgtcagcccggaggctccccggggtcaacatgtttgagcaaggccacggcaagctcgatctgcttagagcctatcagatcctcaacagctacaagccacaggcaaggtcagtgcaccgccctgccgatgggtctttctctccttcactgggctctgggcgaattttccctctgcacaaaatacaagcctcaaaacagaaaatgatgactaagcacagaattctcggggtgcttggagaggttttgctgctgcttctacagggtgctgctggcagaactggtagctgctttcgcttactgatgtgatctttaatataaatggttaaaagtaatgatttctgagtggtttttttgcttttgttgtttactttcttagactcttgaaataatcttaggtttacagaaattttgcagaaataggagagagttgtcctacaaggttgcccagtttcccctgatgccaccatttcagatgagtggagtacagctgttaaaactgtcatacaaacactgacactgtgctgtaattcacctgcagaccacatacatctcgccagctcctgtggtactcccgtccggcctgggccctgctttgttttcacccttattttgaaatgattttagatttacagcaaagtttcacaaatagttcatgagaacccctgagtccttcacccagctttccctcaccttagtatcttccataacctcagtatgagcgtcagagtctggaaatgaaccttgatgtagcactgctgactgacctgcaggcttcacgcagattccgcccattgtcccacaggtcccttctctgggatccagtccaggatcccacattggatttcattgtcctgtcttcttggtttcctctaatcacagacggttcctccgttttccttcatcttgttattgggggtattcattttcatcatttgattaatgtggtctgtcagtctgggtcctccaagaagcagacgtcaagctaggattacatgttcaaaagatatgtggggagtgagggcctctgaaggataaagggaagggtgtgggaataggcaggaactgcagtgctgatctgacaccgaaaagttaggaggactggggaggaagaggctcgcacaggcctgaaaaagttttggctgatgggaaatccttgaaccagattgcctgttggaggagtcctgtgtccccccagaatgggcctgccctagtgcctcctgtgtgcttagtcattggctgggagcagccccaggggaagcgtggccttggcacagacgtgtgaggacctgagggtggcagctgcgggtgtcagccagcagtgtcctgcagaggagacctgagctgctggccctgtggggccagaggtggctcctgccaggtgtctccactgtgcagcccgtgtttcctttgtgacttctcagtgtcttgtgggggcatgtttcgagatggccttgtttcgtcacatacttccactcactcatgttagcatgccttgatggttcttgcctttggtgattactcctgacaactttgacacgtgatgattttctttttccttcattccatttacattgattaattggaactctcctggaaggaagagctgtcctttctgtcccatttatttattcagttctttacatcagtgtggacacatagatatttattttactctgtggattataattaatatcatttagtgggtcgttcaaattgtccccgagttggctgttgggagctccatctagttggcttatgtgtgttttcagcatgtgtccagccttttctgagcactttctgtcttcctggcagcacaggatgtcctgtcatgcacctctgtgctctagccttggtatcagttctgtctccaagcagctctttgctgatggcctcttctaaagaaatcaagacctgggcactcggggtgctccaagctgctgtgctcacagtggttactgcgctcttcggacagagctaggcaacgtgtggacacgtgcacagacacacacgcctgcttctgtatctgcctatctgtgtatgtactggaaacatgagttcatgccacctccaggttccagccagtatctcagtgttcattccagcctttccctatccttgtttctatttatttatttatttcttatttacagagatggtcatgttacctctgtttctaactccattctccaacagtgagaagcctggctctcattatccacaatatgttggcttatttgcttagttgtagtgtatacgtactgagcagctttggaactgctagcccatgtccttgtgagttttttgaatatagtatttgtgacagtgcgtcattatctttggccctacagaatacagttatagtgtttttttcagttacttaggttaattctttccttggtgtctttttaatacagttggactcatttattcgtgtttgtattcctttttagatttcccccacatcctggttgattataacttgttattgggtgtgtgaaacatgactgtggttctaaggatgtgttcgtttgttcttgcactgctataaaaaaatacctgagactgggtaatttataaagaaaagaggttcagttggctcctggttctgcaggctgtacaggaagcatagcaccagcacctgcttctggggaggcctcagggagcttccaatcatggcagaaggtgaaggggagccagcacatcacatggcaagagagggagcaagagagcggggaggtcccagactgttaaacacccagatcttgcctgagctgagtgagaactcagttaccaccagagggatggtgctaaaccacccatgaggggtctcccccaggacccagtccctcccactaggcccacctccaacatgggggattacacgtcagcgtgagattgggagggggcgagcatccaaaccatgtcagttcccactcgcccattctttctaccaggcttccgcacacgccttaggtaaccatgacatcaggtttgggtttctccttccccctgcccccaccaccccacaaatgagcacatacatagaaggatagcatcgctgtggatattgttttggattctgcttttttcacttaacgtcctggaaatctctccacgtcagtgcgtagagattctcctttttcacagccgtatcctgtgaatgtacaatcgtttaagccactacttgtctacatatgggcttttaagttgtttccagtattttgtaattataaacttgcagtgaataacctcaggcctgtgtgtcttagttttgttggaggtgttccttcagggtaaattcctaaaaatttaccctgctcagcattgagagcgtctggtagctctgttaggtaaggtggcactgctggtctgggttgagagcatcgggtagctctgttaggtaaggtggcactgctggtctgggttgagagcatcgggtagctctgttaggtaaggtggcactgctggtctgggttgagagcatcgggtagctctgttaggtaaggtggcactgctggtctgggttgagagcatcgggtagctctgttaggtaaggtggcactgctggtccgggttgagagcgtcaggtaacttaggtaaggtggcactgctggtccgggtcgagagcgcccggtagctctgttaggtaaggtagcactgctggtcagcgttgagagcatcgggtagctctgttaggcattgctttgtttctctgtgaaagggttgtgccttttggtattgcgtgagcagtgtgcgtgagtgccggtttccccaaagcctcactgacagagtgctctgtcttgttatttttacaaatctgattggtaagaaatggtatttcagtattgtttaatttgtgtttctctatttatgagtgagtttgaacacctaagtccatgtttaagagctttttttttttaagctttcttgtgaattgtctgttcatttctttttcaatggggtttttggtccctctttagagttctcgatatatgagtgttagtaaccctccgtcagggatgcatgttgcggatttttctgccactttgtcagttgtcttttgacttagtgtaaggtgtttttgccatgcagttgttttttaatagtcacatttgttactcttcagctgatgcctctgtattttgagtccttagaaagtctttttctgcactgagggaggtaaaagagaaattcacctgtgttttcttctaatatttgtttgctttcttttatttacttgaaattccttgatccatttggagttaatttttgtgtattgtttggaggtagggatgtaattttttcttttgccaaatggccacccatttgttaaagctcttgtgattaaaaagtccatctttgccccagtgatttgagatactgtctttattatgtactaagttttcatatgtattatgtctatccctgagctttccattctgttccactggtctgtctgtccatgtactggtaccacactgttttgattataaagactttatagcatgttttaatgtctgttagtgctagttccccttgtaattttttttttcggtgttttcttgggtattcttttctttctttcttttcttttctctctctctctctctttttttttttttttcttttttaatgcagcagggtcttgctctgtggctcaggctggagtgtagttgcatgatctcagctcactgtaacctctgccatctgggctcaggtgactgtcccgtctcagcctcccaagtaggtggactgcaggtacatacccccgtgccccgctaatttttctatttttagtagagacagggttttgccatgttgcccaggctggtcttcaactcctgggctcaagccgtcctcccgcctcggcctcccaaagtgctgggatgacacgcgtgagtcacttcacccggcccttcttggctattcttgcatgtttgttttcttcatatgaattttcatatcatcttacttaattctatgaaagaagcttgttggaatttttgttgcaattgcatcaaattttaaatgaacttagaagtaatatttttataatgctgttattttgtctaagagcaaaggatatgtttccatttgctcttgtgtgtcttccaggaggttttacagttgtcttcatataggttttacacatttcttggtaagtttaagtatttaatctttttgttgctgctgtagatggggctttctcttcttgtatattctctaactggttgattttatttctatatgttaattttatatgctgctacctatctgaattattgtttgagttagttttattattgcttctctagggttttccaggtgtactaacctaccatatggaaataaagatagttttacatcttccttgccaattcttaaggcttcattgattattttctgtctagttgcatgggctggtatatctagcacagtgttgaacagcaggggagagagtggctatccttacgttgttcctaatcttaatggaaatgcctcttgtatttctccgttaagtaagatgctggatttatccctaaggtgtgtatatctatatatatatgtatatattttttattgtgttagattatctgtctagtgctgtttttctgagcgttttcatgaggactgtggattgaattttgtatgttttttcagcatctagaaaggtaatcatatgaatactttagacctattaatatatatggtttatgatattaatgagtttcccaatattgaaccaatctgtaataaatgccactggtcttgctattttgttttcttaatatgatgttgaattctgtttgctaataatggtttcctagttaaatcatgttgaattagtagtcgaattaaactgattacagagcacaattaccagcaaagtttacaaacacatttcaagtagaacagatacctttgctgatgcatacaattgtagtcacatggccgatccattcaggatttttaaaactaggtagtacctatttccttttctttttctttttttggtgaacttcagacttgtgaaggtggtatctgttgagataacttaactgtgatatgtgttgattataactgcctgtgaaagtcacagtatccctaaagatattccatttggtttcttaaatagcaattcagttggcccagatacatctttgttattacaaactaataaaaagtactccttataccgtagttgctgtttgagaaaggctggcatctcctgtaatgaggtgaagcagttgcgcagagccgcccgcccactgcacgtgggtgcagcttgagaagcaggatccacgtatgcctggtgctctcagggaggccatcgtgggtcacgtcttgtctgaaacatttgtctgttcctgtcttttcacctgttcgggcgtagctgacaccgctgctgcactaggagtgatgtgaacccaacacaaactcagttcagataaggggaaaccatgaaaccaacataattgccagagcacttgtgtcagcacttctgacacaaattatgtcagggtccccagcacctctcccaggctcggtgctttagggctcacgggactcagcctgtggtcatactcccagctaagattcattatagtggcacagcaaggatgcacagcggctctgtaagggaaaaagatgcctcacacggagaaagcctggagaaatccaggcgcagcttcctaagctctcccctctctcctgccaggcagggtctcacagagctggcccctttcctagcagcaagctgcattgacatgtgtacgtgtttttgcccagggaagccctctagagactcaagtccaagtttccattagggctggtcacgtactcattctctgccagtgacaactcccaaagctccagacttgcaaaagcagaggtgtccctgcacatcacactgtctgtatagacagcaggctggcacagaggccttatctgtgcaggagcattccagagccaagttcccagatgccagcctagggcagcgctgtaagcaagcccttctgaagctaggtctgctttgttaactctgtcttgtacagttgtgttgcttcattgtagttttctcatatgatctactctaacactgtattctttatttcagtttgagccccagctacatagatctgactgagtgtccctacatgtggccctactgctcccagcccatctactatggaggaatgccgacagttgttaatgtcaccatcctcaacggcatgggagtcacaggaagaattgtagataaggtgaaacttctctctgacttggtctctgacttgatggtgaacttagacacagcccagacctttaggccatagttacttctgctgaagttaaaaaaggaaaagttctaggccgaggagagaggatcacttgagcccaggactttaagaccagcctgagcaacaaagtgagacctgtctctacaaataataaagaaattagccagggatggtggtgtgtgcccgtggtcccagatacacaggaggctgacgtgggaggatcacttgagtctaggaggttgaggctgcagtgagccaagatcatgccattgcactccagcctggatgacagagcaagaccttgtctgggaaaaaaaaaaaaaggaaatagccctgtctagggtaccagggctattggaagtagtgatttgttatatgctaagtctgttacagaataagtcagggtataaattaatgaaaccaattttacttttttgctttggcatcttgagtttggctcctgagtcagctaattacatttgatttttcatctatacaattttgcgcctataattaaaggcccagttgtagtatttcattctttatttttttttgagacagagtgtcactcttgttgcccaggctggagggcaatggcatgatcttggctcactgcaacctccgcctcccaggttcaagcgattctactggctcagcctcccaggtatctgggattacaggtgcctgccaccacgtctggctaattttttgcatttttagtggagacagggtttcaccatgttggccaggctggtctcgaattcctgacttcaggtgatccacctacctcagcctcccagagtcctgggattacaggtgtgagccaccgcaccagccagtattttatcctttaatgtgtttggaagatacggtcttttttttttaatattgttttgtaaatttttaaaaatcttaactatgtagacactatcacaataataaaaaatagggaaaaaccatagaaaactcgcttccagcctcagcatactaacttggccactgttttttaaatattcttttccagcccttatctgcaatacttattttttttgttatcattgtgcacttggcaaaaattcacaacttttttggtggttctcattatatcataaatattgaaaaattcagctgccaggcgtgttggctcaagcctgtaatcccagcactttgagaggctgaggcaggaggatcacgaggtcaagagatcgagaccatcctggcaaacatggtgaaaccccgtctctactaaaaatacaaaaatcagctgggcgtggtgacacacgcttgtaatcccagctactcgggaggctgaagcaggagaatcgcttgaacctgggaggcggaggttgcagtgggccgagatcatgccactgtactccaacctggtgacagagcaacactccatctcaaaaagaaaagaaaaattcaactatatgcatggcaccagtatacttcttaatggttgtttatatagaaatagtaaattataatttgtttgctattttcctttgaactgttaggtagttttcaattataaacatttcactgaatattattgcatatatggttttcttttattttgaattatttccttaacataaactccctggatttgctccctgaatcagagggtgtgaacagtcaaggatggctcttggcacatcctaccaaattctgtccagtggagttatgtcagcttagactgctgccagtggggttcaggagaagatggctccaccacaccttcactgggtgatttgcctttttttttctgagacggagtctcgctctctcccaggcttgagtgcagtggcacgatctcggctcactgcaagctccgtctcccgggttcacgccattttcctgcctcagcctcccgagtagctgggactacaggcgcccaccaccatgcccggctaattttttgtatttttagtagagacgggtttcaccatgttagccaggatggtctcgatctcctcacctcatgaccctcccgccttgccctcccaaagtgctgggattacaggtgtgagccatcgcgcctgacctgatttgccttttaaagtgtttttattccattagtgttttaaaaaattgagataaaatccacgtatcgtgaaattcacccttttaggtcgcacagtttggtgggttttagtatattcagaaggctgtgccaacatctccttcaggaacattccctaaaagaaaccttatacccattatcagccactccttcttccttccaccagcccttggcaaccagcctgctttctgtctctgtgggcttgcctgttctggacttctcacatcaatggaatcctatagcatctgtccttttgtgcccggcttccttccctcagcctcaggttttcacagtttgtccacgccgtagtgctgtcagtgccgcgctgcttcctgtgttggagtagtgctccactgggcgggtcggccacatggcgtttctccgttcatctcttgctgggcatttggctattctaggtggtacatctttcagctttcagcttagatgggggtaaaacgggcgccttgtgtaatgtgcacttcagttctttgtggggtgggtatctttggttgtgtttacgaattctgtttcctcttgtatgagttacacgttgatttcgttggcccatttttctcctggaattgggattttctctatcaatcctaacatgatcgccctgtcatagagaaattcaccattgctgtgtgttcagcaaaatgttcctccaggtgatgctcttttccctttaatattacttactgtggtggggatttttttccttctgtaaaagttttacatttcatgtagttgaatttttatgttttatgacttttattgttttgcagatggaaacatcattccagagagataataaaatttccattttatttttctactaatttttatgtatatgattgttaaatatttaattgtttcatctgtgttaatttgatgtgttacaagagatgggcgaaagtttttcacttgggaaccagtggctccaagagcattctttaaaaatcccttttcttcctcattatttgggacaccgtatcctacagatatttttctttttcatacttttttcttaacccactggcttacttgggaagtaagttctggctgtgtggattgtggagggaaatgagtaatttagattcgtctgaaataccggttagttgcaagctctcattgacgtctcttccagatggcctctgctcacgcttccctttctgcttttctcccacctggagggtagaagggtggtcatctcgcagctgagccagtcctccctccggccacctctttccagcttcagaatgtgactcgggacagctggtgtccctgtcatgttactgctttcaattaatgggatttttttaaagcatacaactaattgggaaataaccttaaatctgagagttttcatctatataagttctcttagtcagatgaagtttttcatcaaagaacttttgacaaaagttcccgttttataatagaaaaaaaatgtctccgtaaaattggaagctgtcagaaatagtggtttctagacttttctagtgatacgtccgaggcagtccataggctactttggttgtagttacttagtatctgtgtataaattttatttttccctatttagtgaagtatttctcagaaccagttttggtaagaattgagtttttctggtttccacgtgttttctcctggagcttttcactttagcctttgtctgatttctttttcctgcagcctgactggcagccctatttgccacagaacggagacaacattgaagttgccttctcctactcctcggtcttatggccttggtcgggctacctggccatctccatttctgtgaccaagaaagcggcttcctgggaaggcattgctcagggccatgtcatgatcactgtggcttccccagcagagacagaggtagggatatgcgggaaagtggcttgttttcttagctgtttgacatcacctttcagggagggacaggccaaatgcctggggtctccattggaagtacagttgacagataggcttatcctcgatggccacaattgatggttccagggcctccggagcagctggagtttgaagaagtagctcagtcagtgagtgctagggcttgccgttctgtggccacacaacagcagagaagactgttttctaccagatttcaagctcaaaaggagtgcaccaaaaatatacattctctaaaaggaaatgtagggttaatcctatgaggctctagtagtttttattgatagaatatgccttaaattttaactgttaaactctttaagtgtttgaatggacttagttatgatacatgaatctttcatcagacatttgttattggaaattcttgtgttcaaattatttaggttaagttgataaatagaaatgatgttttcaaacctgaaagtttctttctgcacaatgagggcgtttcaagtttcttttctttttttttagtcaaaaaatggtgcagaacagacttcaacagtaaagctccccattaaggtgaagataattcctactcccccgcgaagcaagagagttctctgggatcagtaccacaacctccgctatccacctggctatttccccagggataatttaaggatgaagaatgaccctttagactggtaagcacctcacaggatgcacttcacctccccagcctccgtggtgggaggaggcaccactgttcccgcaactcttggaaagatgttgctcagcttctcgtggagcctggactctgatgacgctgagatgttcaggcttttgccatgcacttagggcagcctgacttctcttttgaaactttcacaagtatgattatgcagtaaaaagcttgaagttctcttttccttccttctcccattgcgccagtcagcaaagctgtcagtcttaccctcaaactgcatcctggatccttccatctctggccttctccctgctcccaccctagtccatgccattgtcatctcttgcctggaccacatcagcagctcctgagtgccactgctgttgctgttgttgccctaaattccactcctcttctggcaaccttggtaatcttgttaaaacaaattctaacacagtttgcctcaagctctccagtgactgcctattctgacttcctcacccggccaagccccctggtgtgacccatgcagcccttcagaagctggcactgcttcccccgcagtccccatagccgctctccctgtgcctgttccctgcagggcagctgggctgactttctcttggtgcattagccaagctcatttctgcttttatgtttggactacgtttgaactccatgctgaaagtaggggaaggggaagcattgaaagatgtgaccaggatagttacagagtcagacttgccttttaaaataagatgtctctggcagccagattggaggggctcagaccagagacgggtagacaggaagtggtgggaagttcatagaccaaggcaagcccgttggcctgcaggagaggacctggagtctgtgctgctgggaggtgagaatgaggtgacccctagagggtgtatacagtgtcccataggaaagtgagctcatttgggagggacggggatggaaagttgaccagtggcagtgatatcagttagctgtgccgctgtcttagcaccgtggccctgcgtggcttgttccagcgtccctgcactcccgcggctatttgctaagctcttctgtcagacacagatggttgccagcaatttacttgaacgcgactgctacagtgatggtccaggacacattaaacatgtctttggccatttcttctggtcattttgtctctttcatgcacctgccaggcacatggtttcttcttatcagccatttccgtgtgtccagaccagagcacacaggtctcctaagctgatgcctgtgccagtgggccagccatccaggccttctctgtgggccatggcatggtgctcttgcagaggcggccctgtggccagatatgcctttattgccagtaaagatcgatcattttaatgctgtggcctattgtttttcaggaatggtgatcacatccacaccaatttcagggatatgtaccagcatctgagaagcatgggctactttgtagaggtcctcggggcccccttcacgtgttttgatgccagtcagtatggtaagtggcactgctgtgctagccagatggtctttccgcccactttggatgtttgttaaatgtctgagaagtgaatcccagttttcagtgatagctaccaagggagtatgcgccgtgggccccacagctgggtgagcctggggcgaggctctgaaacaggtggtggcggtgtgacattcagctgaaatacaagacaggctgattggagacagggacattcgtactcttttttctttaagttaaaagcagctctgctatatattttgctccttctcaagtgaatgaaaatctttatcctgagcaccacaagtgaaatcagatcacagttagtcgctgtgtattgctggatcctggtcctctactttttagtcccttttaaagtggtacagggtggcacaaaccagactgttaggtgtcagtaacctgagacatgtacctggtgacactgtttctgccgtggtggtgtcctgtcattcagaagtgacagttcccagctttggttctttgttcatcaggcactttgctgatggtggacagtgaggaggagtacttccctgaagagatcgccaagctccggagggacgtggacaacggcctctcgctcgtcatcttcagtgactggtacaacacttctgttatgagaaaagtgaagttttatgatgaaaacacaaggtactgttgatacgcattggtatttggataaaaaatgtgacttttggggaatcaaattctacccagcaaatacttaagtgatgatttgacctgttggtggtctttccagttggcacagacacattcagagagcttgattagaaaaaaagccctttcgactgagtgcggttgctcacgcctgtaatcccagcactttggaaggctgagttgggcagatcggttgaacctgggaggccaaggctgcagtgagctgagatcaagccactgtactccagcctgggtgtcagagagaccctatctcaaagagaaaaaataaaacacaaaaaagaaaatagtcctttatacagtagagaggttcttgaaagttgctcatagagtaagatgtttattgagtatgagtactgttaataatatagagggttcattgtctttccttgttaatcttagatatgagatacttcagctttaaacttctgtttaattcttttccactctctgttactgagtatatataaatttaaatgcaccaaaggaactgtttcttaaagaatatttcgagtaaattattgtatatttaaatattgtatatttacaataattaatttacttatatttatagtaattaatttactcaaagggaataatgtcctcccctttattgggatcaaggactcccaatgtattataaacataatcacctttatgttttgaatcggtttctttagaatctgtgactgaacatttctatgcttctttctcatctccttctccttcactgaaccttgctgggtctaggctaagcagttatctctggtgcatttcggtaaagtactgattttcatttcataaaataaattttgctttaattaattctacacatcagccgaagcacttaaatttgcagttttacccaaacccagacagttggtttcagttgaagccttagtgtggaaggactggattgtggcaggagaaattgagttttgtcacagagactaaataactgtgtatggagtgtcttcattccctgttccctgtgtgtctgttaccactttcccaggcagtggtggatgccggataccggaggagctaacatcccagctctgaatgagctgctgtctgtgtggaacatggggttcagcgatggcctgtatgaaggggagttcaccctggccaaccatgacagtaaggctctgtttcctgagggcgtggtcttaggtgtgagagcagaagctctacacctctgaagtctagatttcttgagaaagagaatggtgatccctcagttagctggagtctgtggaaagaactcaccagtattttcaaaagtacatctgtgaggctctagttttgtccagattttttttaaatgaaaatattttatgtagccattcctaattttagtgccacctattagagtctttatgtagtagtcccaaataggaactacctcacagcttcttaattatttacaaagtgctattcatgaaataactttgtgtttcccgtgtaggaagttcccccacaggtaaggttttggtagctggttttgagaacaacgtcgtaagcattcttactacccattctgcaggtctggacagcttgttttgagcctttcactgctctgagttataacatctattcagaaacctaatgttaatagtatttttctttgattataaaatgtattcagaaacctgatgttagtagtgttttttacttgaattttgaggagattacttgtactttatgtgtgacaaggcaatagcagctcctccctcaagattaaaaacaattaaaaaaatacatagcatctgaagaatgtattttgggtaaacgagtagctattatttattaaagtgttcggcgttcctgtgttcccttgactttgaacactctttcctagtgtattatgcgtcagggtgcagcatcgcgaagtttccagaagatggcgtcgtgataacacagactttcaaggaccaaggtaaaggatgccattcatgggccttttgcttcttctttctctcgctcccttttcccccgcttctctctctgtctctcatctctgtctcttttttaataaaagctttattgcatataatttacataccataacagttgcccttttaaagtgtacaattcggtggtttttagtgtatttacaaaattgtggaaccatcaccattgtctacttccagaacaattttatcaccgcaataagaaatcccatgcccattcgacattttggtttcttttaaaatttattgcaatattacttgaatggtacccaccactttgagaggctgaggcaggcagatcatgaggtcaggagatcgagaccatcctggctaacacagtgaaaccctgtctctactaaaaatacaaaaatttagccgggcatgatggcacgcgcctgtagtcccagctactcaggaggctgaggcaggagaatcgcttgaacctgggaggcagaggttgcagttacccaagatcatgccactgcactccagcctgggcaacagagggagaccatctcaaaaaaaaaaaaaaaactaccttcaaggttacttgatgaatttttttgttaccctttataaattgttctgcttctgtgattgccagattaccaaggttttagaaaaatgaaaatgtacaagattcgtttctgtcatgcaagtttgatactgtgtatttcagaatgagaggccccctcccttctaaagttgccattttctgtacgtggacgttaaggatagttttattagttgaaaacgatgaaaagagaggatttctcaccttatctacttgcaactggaatatagaacttatttttatattacctggaagggattttttccttttatcaaaagcaagtttgatcagtaactggatctgtgtttaataggttatatttcacctttaggcacataatgattgttttcacagtcacttggccatgggttagtgattctttctaaaagcatttctcatagacagtatcacttcaggttctagctgtaaacaagggatcaaagcggtggtctcattggcttgtaccctctgggagatccttgtttttggtaggtgggtggggagaatcagaagtagatttaaggatatgtgctttctttaggtgttctactacagtgtgaaaacgaaattttttaaaggggcattttattcccataaagactttaagttgaataatcttttgggtacaaaataagaatttgaaaataggaatttgggttatgcctgatcagaaaagaccctgatggcagaaataaaactcccatcaaataccacaaggcaaatggcggtgaatgtgttccagtttttcctgactgcttccctcttccaaagaatggcctattttttcttctactcagctcctagtaggattcctgcacagagagcagggaatgtcacgtttatagagctacagacatttcagatgttatcaacacggacaatactagattctgctgaagacgtacatcatgttctagtgctgaggaaagcaattgaattaggggcagagactcctagattatctggtggtgccactgatgatgctgcctgtggcatttatacatttttgacttcttgattcattacaaattttaaattatgtcatctgggcaaagataggaggctgtgctattggaacatgtgtctttgtgaaattaatgtaaccgatgtcttaaacctaaatataaatatgtggacatacttttaaaaattagttacatttgtcctagcttttcataataaaacgtgaaacctgggtattagtatatatgactgtattcatagagaaacctgtgtgtttagcaagatctgctggctgccctttgtgtaggtgtctgaaaacataggcctttcaggataataagaggggacacaatttaggttttttttttaagatagaggcagcacctttgcaattgtaaatattatgtactgccatggcaagtaaaaatgaaagtggatagatacggaaatacacacaaagtgaattttgctaaaacaaatcaatggcacttaagacatttctattctaaaaggcttattcttaaggcttttctattctaaaaatttgcaatgttttaattgaatattagattttgtaaatgtggtttatttgtcacgtggatgaaatatcaggaaataactcactgctcagtggaaactctcatggctgttgttttttgttgtgttgtttcaggattggaggttttaaagcaggaaacagcagttgttgaaaacgtccccattttgggactttatcagattccagctgagggtggaggccggattgtactgtatggggactccaattgcttggatgacagtcaccgacagaagggtaggaaaaacgcagatggactttgtgacttcggcactcagatcctttcttccctttgtctctggaaaggcgcccgtgagatgctggcagatcagccgacatctgttcacttgagccaggctcagctggagatgttgcagtcactttgattgcttggaatattttgataggtgtctgagtgtgcacacatttaataagcaaaacaaagctacttgttggggccatgatgcctcttctccatcttcaccttcctgaggccagcggaggcgggactcccgcgttgtggtggagagtcccttccctgacttccttggggcctgcccctcccaggcttcctacgccgtgctgcctggactttgtgggcactgccacgagggggcgcccttctctggtctgactcactcttttactggagggctggctcttggctgtccttccagacctggaattcgggcttttcttagcctttatcagtgaagagcgtttgttatctcgaggcgtgaaggggaggcaaataggcatgccagtcctcttccctccgcgtctttatgtcagtctctcgatgcatccgttggatttgggggcttgaggttgggcacagactatttttctcattttgtaaaggggagaaagaatggtaaaagtgctccatgtttttacctggtgagatgataatgacaccaggactgaaaggcaaccttctaatgcgctgtgaccactggggaactcgaggcacagggcgggtggtgagtgacaagaatgaggcactaacagcgtgcactgagaggtgtgtgtgtgcccctccgtttcaggctgaagttgactacattcctggcatttatgtaaatccctagactgggatgggtctttttaaaaatcaaaaatgggccgggcgtggtggctcacgcctgtgatcccagcactttggtaggccgaggtgagtgggtcacaaggtcaggagttcatgaccagcctggccaacacagtgaaaccgcgtctctactaaaaatacaaaaattagccaggcgtggtggcgtgtgcctgtagtcccagctgcttgggaggctgaggtgggagagttgcttgaacccgggaggcagaggttgcagtgagccgagatcgtgccactgcactccagcctgggtgacagagcaagacactgttttaaaaaataataataaaataaaattaaaattaaaagtgagggttaaagtcacacttaaaggaggttaatgttttatttccacagagattttaagacctgagatctcctggtaagagtctttattaaattgtaaatgcctgagagggtggtcctaggccttacatttaaaatggcagcttttttcatctttcaggggcattaagcacttgaccagaagtgccctttaatgagaggaaagtacttaatggcatttttctcacacggatcttgtctagtccaggttgatgttaatggaacttgaaggggcagacacaggagaaacaagatggaaacagaagctccaggtttcaataccaggttgcgccttccctctcagaaaggatcctttgtgaacgggagctgttgctagcccagtgcctcgactctgaggtgtccctgaaaacaaattgccctttctctgctgtcacacttccagtggtcagggccctgccgactcgaagcccagctcaagtgaacagatgctgcatgggtgttgagccttgcctccaccccctggggtgtcagtacagttccttctccccaggagagcctctgggacgcagcaggagccatggccctccgttctcctctccctgttgcccctgagaccccgctctcaggcccttcttttctcagtgggtgtcacatggtctcactgtctctgaatgagctccattctgcccccatccatgaggagctgagtgtggcactcaggcagttggtgcaacctggtggacagtggtgctgaccacctggaaccctggggcactgggagtggagccctggtcaggtcatggctgtgtgtgcttatctggctgggctgggccactgagaatgcatatcttatgagaataggggaatctggaacatgttggatttactttgacctaaactcgtgacttctgaactcccatttcccccacttttggggactaacttaaaaaaaaattcctttagagatttcttcttaaaagctaaattccgggccacgtgtggtggctcacacctataatcccagcactttgggaggctgaggcaagaagatcacttgagcccaggagtttgagaccagccagacccatttctgcaaaaaataaaaaattagccgggcatgctgtcatgtgccttcagtctcagctacttgggaggctgaggcaggaggatcacttgagcccaggagctcaaggctgcagtgagctatgattgcgccactgcactgggtgacaagagcgtgactctgtctggaaaaaaaaaaaggaattcctaaacaggcttgttgacttcgcagactgcttttggcttctggatgccctcctccagtacacatcgtatggggtgacaccgcctagcctcagtcactctgggaaccgccagcgccctcccagtggagcaggctcagtcactccagagaggatggaaggtgagtggatgggcaggatgccttggggagggaattggatccagctgaacatgatgctacttcagccagtggctgtgcctgccagcaagtggggccagtttgtgtgcgccgctgagtggttttcgtaatggctgcgggtagagcagcactcagcggctctaacctgccgagaggccatccttagtccccagagggccatgatcgaggacccagtgtgcagctgctttcccacgtgcaccccgaccctcacgccactctgagtgtgtttaccgtcccgctctcacaggtgaggacagtggctcctacagatcttcaggaagaatcaccaacattctagagcacttgccaggtcccatgcagcaggctgggatgctcccatggattacctcactgtcccctctcagtaatcctgtgaaaatagatgttattattcccagtttccagatgaggaaatgagagctgagagaaattagataactgcctgagatcgcctgggcggtatgtggtggtggagcctcaacccgcctctggggcctgtgctggtgccgtggggccgccagctgcttggcacttagtggggtgggtatcagtgcgtctaagtccctggtgtgctggtccttacagcgctgcccgtagaaggctcatgggaaccacaggcatcatttaaaattttccaggagctgcgtttaaaaagtaaaaagaaacacagatgaaactattttaataatatacttgagcccaagacatgaagaatattagaatttaaacacgtgataccttatttcacttgctcagtagctacgtgtggttggcacaatggtgcagatctaagaaatagaaagaattttgaaaatgcagagtggttttttatttggccagagaattaaatattttagaagagaagtattttttccatgaaaccggtctgtagcttagatttcgcaggtgtagccttgcgtgtgtcagtggtggtcagcaaagtttgaccagccagtgctgtgcacacatctgcccatcttcaagggaacggttctgattttctcacccaccttcagcaatggaaacacacattgtccgggaggaaccaatcaggcgtggctcctgcggctcatggaggatagcttaatagagcaccggggctctgtgctgtgttgtgggaaagcagacagactcataataaggccctcctttttcctttgcattttagtaatagagatgattttcttttttgttgatgttgctgctaaccacaggaaaccatcttcatcggtactccaaggttctggaggcccatttgggagacccaaaacctcggcctctaccagcctgtccacgcttgtcttgggccaagccacagcctttaaacgagacggcgcccaggttagtgtccgcctgtgcccttccactctttccacggggcttgtgagtcattgcttttcttataggagagaatggaattttactgacatcactatcgaattgtcagatcttcaagcttgtcatttgcgacagttatttagtgaacctcgtattggcctttggaaataggctctttggtggtatcctgcataaaaagtgctttggataattagcattttgttacatttggttaattcttttttaaaaagctgggatccaacagagtgatttcatgggagctggagctctaagtcctgtggttggggagttaagagctgccggctgcagtgtgttccctgtttcagacattgatgataagatacagatagttcccttcttctgtcatccccgggggccgcggttgcagcctgtccaagaagagcatgcttctgtgtcattacatcctgtgctgactgtgactgggggtgaaagcacccgcctccgatggcaggctgtgacctctgctgctgtctccacactcctgtgtgcagtgccgcctggatcccttctccagctcactaactcggcttcttcatttgcatcgtttcctttccgtacccagtgtttgaggtggacctgctgtttccctctgtggctaggaccagctcggcatggctggtcccctttttctccagatgccacccccttactttttctgtgacgtccctggcccaaacaggacaatataagaagaaagggggagcttctcctgagaaaggggatgaagccagggacagctgtcagagctgtgtccgtggccgggcaggcacacctcccaccccatcaagcaggagtcttgccctccgaggccccctggccgcctggtacccggcccctctccccagcccctcaggcaggaggctaccctcttgacaggccccctgcctgccttcttttcctccagtgatggtatggggccagggacggaggccaccttccgtcctgtaaggcgaagaggagagtgcccgtgtgaaggtggcgaggctgccttccgcctttactcctcatcataaaccgaaagtgctgaacacaccacgcactgactgtatgtcttcatttcgaatatgcttaatagaacacaggaaaatggtagaatcatcacattgtctcatcagtagctttcttcctgaaccttaatcactgggtacttttccattccagttcacatctcatcatttaaacatttctgataagtttccatttttgcatcttatttatttataaccttctattagcctagcattcaaaccagcatttatattccagccatggtcagcaattcatactcagtgaacagtgttagctgaatttccagaaacccaattattctccacagtgttgttcaggacttgaagcagataacaatatcctttctatccttggctatctacctgttcacatcaaataatccatcacatactgaaccggcccatccagcatgttgataatggacagctcctggaatttgattttcacaatcactcagtaattccttcttctcagtacgctgctgggttttacatttatcttgcttttcatatcttgttgaaaattattctcggtccccagagacctagatcgacgcatattctgagtctccaaaagagatttgagaccaggagacagctccagatgctgtcagcccagtgctgggggcaggcttccatctgtgaagtggagaggcgctttgggcttcttcgttggcatcaggtgcccatacctagggcagctgtggaagtgtcagcgtcctccctgagaggaactcctgctccggtggctcctcagtccttccgtcagtatgctgtaaagcagccacatggtaatgggtgtggactgttaccatgactgctccactagaaagtgccatcaccaaagaatgagattctggaacaggatatcactgttagaatggaaatatagcccatagatattcagctacaaagtcataaagcctaaatgtcattgattccgtaacttaacactgtcagtttaactttcagactgattaagcctgaagtgtaaaattaaatcctataaaatagggcgggttataatgagtgctcattggcattcaggcagttgccgagctgggagtatcgagtgggagtctctctcttgcctgcctagggaacctctactcagaccagcccttgcccgccagcttggcgttgactttcagcctaattgctgataggactggacgtctttgctttcacttgcccaaagtgaaagagacaggctgacagtttccaaatgaataaataacagaaaaatagagaaattttaatttgcaaacttactgtattcttccccctcacttaagccagagtagtgtttttcccatcgcgatcttcgctctagctccggtgtcctcccaagctctgtgctgctgttgccagcgtatcaacctctctgtcttcttcgggtctaagttgtattggcctgaacgagtttttcagatcccagagttaataatgatactgtgcaccacagagtgcaggaagcgcacacgttcatttgatcgtcccccgcctgcaggcaaggcagatggggaccccacgttttgctgctcagactctctcccactgttggttccttgtatgtttcgtattctccctggagacagtggtttcttcagagacaaagatgctgtctggttcccggcaccagtttgcccacttccttatatgcagtggttctggaatcaccattgcctccgactgctccaggccttagggagaggacctcgatagccccaggctcaggtccactcagcaggcttcagctcctccccctgacaggctccttccagggcctcgcttggagtgtcctcccgaggcgcttggtcatgtttagctttatgcaaaaacaggctcctgctggtcatattgtaaactcagtagaatctcatgaacagggacttgattttgatctttctccctcgggacgtggaaacggccaccatagttgctgtcagtggcatttaggtggccgtggacgcaaatggcatttcacatctccccgtagatcacttgctctgtcttgagtttcagttgaacttcctagactagtacctagactagtacaatggcttatttttgttttgttttaatccattttcctgaagtaacctttggaaacatcagaagctactctccattgacctggacaaggtggtgttacccaactttcgatcgaatcgccctcaagtgaggcccttgtcccctggagagagcggcgcctgggacattcctggaggtgagttctcggctgctttgtgattgtgctcagtcatcctgtattttgttcaaaggagtctccctccctcccccaggaggcgggccagactctccctgtctctgccttcctgggagctgtggtggccttggctcttggcttcttttgtggcacaaaccagcatgagcaagggcaggcctgacagattaagagattgttgtttcccttagaaaatgctacctagattttcacatttgaatttattttacaacggctgggtgatctacttaaacatgttcaaagtaacttgcacgctctttatgaaagttctgccagccacctattaacgtcccttacaggatgcctgtctgctggtttgggtcccagccaatggcagcagccgccctggctcccagccctcagcccagaaggccccttcagttctctgccctgcccccctgggagggacttgactgagctggggtgtgtcccttaggtggtctcatcctgtctgtctctccagggatcctgactggctacatagactgcctagggcaggttcttctccactacccaaggcaattggtaccaggcctttccagccgagcctgggcagttcttttgctctagagtcccctgtactcttccaaagagtttatagctaccaagaggagtttctctgggttccaggaattgtccagaaatgggatcaggaaggggcacccctgtctgtgcagtccagccctggacaccacgtggtggtgccagggtcctgagggccttgcgcataggtcacggggtgcgctgaaggtaaattccagagcccttggccttgcccagtcgtattgacattctgaaccagggtcctctgatggcctctcctggctttcagccacacgtcccctccatgaagggctttcccagaggcggggcactgccagcggtgcttcttccgccacgccccctttctcctcctcccactcagctggaaccacaggcccctccttctcccctggatagagacgtgcccatcttcccttgtgtttagagaaacacagagcgcctctgggcctcccttcggtaggttgtgacagaagcatagctgggcctgatcgtccgtctgcggggatcccagggaggaagggcagcagagatccaccgagcctccaccccacaggaagtggctgctctttgctctcatccactctttattaatagcctgggttactttagctaaggcttaaaaatgatgtatgccctgcaagcccagctagtgaaattagctcgcatttagtttctgatgaatccagccgtcatagaaaaaggccgtcatggtagctctgtggcgttcctgcctgttcaaccggctgtcctcttacagggatcatgcctggccgctacaaccaggaggtgggccagaccattcctgtctttgccttcctgggagccatggtggtcctggccttctttgtggtacaaatcaacaaggccaagagcaggccgaagcggaggaagcccagggtgaagcgcccgcagctcatgcagcaggttcacccgccaaagaccccttcggtgtgaccggcaacctggctgaccgtgagggccagagagagccttcacggacggcgctggtgggtgagccgagctgtggtggcggctggtttaaaagggatccagtttccagctgcaggtttgttagagtctgttctacatgggcctgccctcctgtgatgggcagaggctcctggtacatcgagaagattcctgtggatcccgtcaggagggacttagtggctctgccgccagtgagacttcccgccggcagctgtgcgcaccaaagactcgggagaactggaaaggctgtctggggtcttctgactgcaggggaaggatgtactttccaaacaaatgatacaaccctgaccaagctaaaagacgcttgttaaaggctattttctatatttattgttgggaaaagtcactttaaagacttgtgctatttggaagcaaagctattttttttgtcagtggaatgcagtttttttactattccatcatgaggaacaacatagattccatgatctttttaatgacagtacagactgagatttgaaggaaacatgcacaaatctgtaaaacatagaccttcgctttatttttgtaagtatcacctgccaccatgttttgtaatttgaggtcttgatttcaccattgtcggtgaagaaaattttcaataaatatgtattacccgtctgaagcttaaagatactgtgtaacggactctttccacttgtcccatttctctttgatgacggtctggaatgggttctgaatcaacctgctaattttgtgttcactgagacgtaattcacataacattctccactttatagtgtagagcgcagtggtttttggtgtattcacaaggctgtgcaggttccggaacatttccatcaccctagagcaaaaccccactcccaccagcagtcacccacgttcatcacctgcccctaggctgctggcggccgggctgctctgtggatcggcctgttctggacatgtcctttcaatgggatcgcacagtacgagtgggtccttggcgtccaactcttttcactcagtgtcgtcttttcagggttcattgaccagcgctgtagcaggtatcaagactcattcctgcatgtggctgagcagtgtcctgtggtgtggctagaccagttgtgtttctgtcttcctcagctggtgggcgtttgtggtggtcccactttttggctgttgtgaacagcactgctctgagtatttgggtatggggtttgtgcgacgtagttttttttttcgttttttttttttttttctgttgggagtgtacctatgtgtgaaataccgctttgtgtttaagtttttgaggagttgccagactttttttctaaagccgctgcaccatcttgcattcctgccagcagcgtgcaagagcccccctttctcctcatcctcgtcagtacctgcagttccccgtcttacaaatgctagccatcctggtgggtgtgcagcactgtctcactgcagctttcacttgcacctccctgaagactcacgacattgagtgtctttccatgtgtctgttgcccgtttgtcttctttggagaaatgtctgttcagagcctttgtccatattttaattgggttgtctttttattgaattgtaggagttcttaggcgagtcccttatcagcgatggaacttgcagatattgtctcttgttctttgggctgtcctttcactctcttgatgccatcctttgaaatagaaaaggttttcatcttgaagtccattttttctgtttttttttttttcttcggttgcttgtgcattaggggtcatattggaaaaagcattgcctgatcccaggcagcctgttcatcgtcgatccccacctgaacagggtgttgtatgctgactggccgagcaccagcccacacagcaaaggcgagggtgactgggaaggagggcagaggccgtgcggggactgacaagggtgctgctgaggtcacgggcagaaaacatctcggcccacgcaggggaggagccactgggccgactgtcccttgcagttcttttcgtccgcggcaggtcatgtgctcatcttgcagctctcactgcactctgcccacattgcttcgagaatccgaatgtgttgctgaggtcccctgaggcattcgttgctgtcccaagggtgtagggcgtcacacgcagcccgggggcgcgagcatctgccactcaggagccctgctgtccctagcaggtggctgcggctctgagccgctctccttacccacatggggccttgcagctctccttacccacatgcggccttgcagctctccttacccacatgcggccttgcagctctccttacccacatacgggccttgcagctctccttacccacatggggccttgcagctctccttacgcacatgcgggccttgtagctctccttacccacatgcgggccttgccgctctccttacccacatgcggccttgcagctctccttacgcacatgcgggccttgccgctctccttacgcacatgcgggccttgcagctctccttacccacatgcggccttgcagctctccttacccacatgcggccttgcagctctccttacgcacatgcgggccttgccgctctccttacccacatgcgggccttgccgctctccttacccacatggggccttgccgctctccttaccc

SEQ ID NO: 12285 - DNA, 6144 bp, Human
  misc_feature (1)...(6144): n = A,T,C or G
cagagtctggttttgttgcccaggctggagtgcagtggtgggatctcggctcactgcaagctccgtctcctgggttcacgccattctcctgcctcagcctcctaagtagctgggactacaggcgcccgccaccacgcccgtctaattttttgtatttttagtagagacgaggtttcactgtgttagccaggatggtcttgatctcctgacctcgtgatctgcccgcctcggcctcccaaagtgctgggattacaggcgtgagccactgtgcccgtcatttttttttttttttttttttgagatggagtcttgttctgttgcccaggctggagtgcagcggcgcgatctcagctcattccaacttgtgcctcccgggttcacacgattcttgtgcctcggcctcctgagtagctgggattacaggcgcctgccctcatgcccggctaatttttgtgttttcagtagagacagcgtttcaccatgttggccaggctggactcaaactcctgacctcaagtgatccacctgcctcagcctcgcaaagtgctggaattagaagtgtgagccagcacccggccccctttgctttttgaaatccactcctgtgtttcgagctcaactccacctctctgaagaataaccttcagtatttatttctaaaagagcctttgcacagtgagcctcaagcttcggcagaagtggagccagtcacacggctctcaagtgctcatcagacagagacctcagcccacgtcggcctcccctcagcccacgtcggcctcccctcagcccacgtcggcctccccacagcccacgtcggcctcccctcagcccacgtcggcctccccacagcccacgtcggcctcccctcagcccacgtcggcctcccctcagccacaggtttgctgcgagctggtcaccagtccactgcatgctcctctcagggaagtctttttgttctggttgcatctaagatgtttactttttaatgttttgaaaatttccaatgatgtatctagctgtggatgtttttaaactctggacttcttggagtttcctgtatttcatgaactccggaaagtcctcagtcttccctttctcctttcttgctctcttctccttctggaacttgtactggacatgggctggcatcgcctcctccctgggccgcacatctcttcccaacactgctcctctcttcagctgagttagtgctgcttctcgtgctgcttctcctgctgctgactgatttaacgttaatgactatgtttttcatttctagaggttttcattctgtttctttttcaaacataaactgtctgctcatggttttttgtatttataattgacataataattgcacatatcatgggcatacagtcttgactagtcttaagattgcttccttttacatctttatcaattttaacatacatttgttttctattatcttcacattttgagaatgaagagtcttattttctctcccttgaaatgaaatttactccttttaaaagctaattacccatatacacacctactatatggccacaaactcttttttaaaaaagctaattacaagaaatcctgtaacatcagaaataaggcaagtaaaataatctgatttaattattttaaaaaattacccccccccccttttttttgagacagagtctcactctgtcacccaggcttggagtgcagtggcgcgatctcgacccactgcaacctccacctcccaggctcaagcaattctcctgcctccgcctcctgagtagctgggattacaggcatgtgcccatcacacccagctaatttttgttatttttagtagagacagggttttgccatgttggccaggctggtctcaaactcctgnnnnnnnnnnnnnnnnnnnnctcagtctgcaagcccccagggagcacaggggggctggagggaaccgggggagggatgcacaggcgagaaatgcccatgacccggtccacaggtcatgcacgtccacactttctaaaaaaccacctacaagaaaggggttgtttcctggcccccagtggggtgcagaatgtcagtgctgggctgcaccctgggcagggctgctctgggcagcatcgccacacccgtgtcccattcttggggtgcatccccttctcacatctgtgtctaaagccaggaatgggcagtgtgacctgaggaaaatcagggacaccctctgtgtcctcatatgcaaacatgtctctttcatgccagttaaatgaagaaaaaggcaagacctaaatcctgaactcctaccgctataacacattcctctgcgctaaggaactgacattctaaaggtgcagatacccccgggctggaggctgaatgggcaagaagatcccggcacagctcaggctgagtcgaaagaccgtggtttttggccaggcacagtggttcatgcctgtaatcccagcactttgggaggctgaggcaggcagatcacttaagcccaggagtttgagaccagcctgggcaacatggtgaaacactgtctctacaaaaattacaaaactcagccaggcatggtggcgtgcacctgtagtcccagctactcaggaggctgaggtgggaagattgcttgagccagggaggtgaaggctgcagtgagtcaagattgcgccactgcactcccaagtcaggcgaaagagcaagaccctaaataaataaaatcaatttcagaatcttttttttctcctgctggtcccttgatcttgggttttctttttttctgcttaacttcagaatcttaaatgttggctgcaataagctaagtgattctcctggaaaacctttaggattcatccaagaaacgctaagaagccctgtacttacctgtacttaacctcatggtaaacctgctcttttactaaacgggatgtgaacacgacctctgttctaagcttgttttagaagatacaatgcagaaaacacagagctctatttgaggccctgagcctttcttaccctgattcaatttaactccttcacattcctgcagctttcctgcaaaatatggaataattttcttacattttcataccaagaagagcttatgatttatctcagatgcatgaaggtttaactcctaaccaggccctctcacagtgccagcagcatctcctgggcccattacaagggcccagccacctccccaccctgacagcctgtgctgcagctggtgtcagccacaccttgctcctctcccactctgcaccctgcaaagatttcccatcctcagcagcttcagactacttggtgtcaaggcaggtaaaaaccaaggtgaccccaagaaaatggctgctcccccaaaggaggcagaaggaggaagtgaagatgaggaaatgtcagaagatgaagaagatgacagctgtggagaagagactgtcacacctcaggagaaaggcaagaaggctgctgcaaccccagccaagaaggtgacagtttcccgaacaaaaaaggctgcaggtgccacacccaccaagaaagcaactgtcactccaggcaaagcagtcgccacacctgccaagaagggagccatagcaggcaaagcactggcagcagctcctggcaagaagggacaccccagccaagggggcaaagaacggcaagaacgccaagaaggaagacagcgatgaggaggaggatgactctgaaccagcagtgatgaaggcagcagcgggtgcccctgcctcaggggatgaggacgaggacgatgaggacgatgctgaggaagatggctctgaagcagcacctatggaaacaacaccagccaaaggaaagaaagcttctacaaatgctgttcctgggaaagccaagaggatggctgggaatgaagatgaagaggatgatgaggacaaggacgagggtgacgatgatgaagaggatgaagtgatgaagacgacaaagaggaggaagggtctgtcaaagaagcacctggaaaatgaaggaaatgaccaaacagcagcttctgaagccaagaaacacaaagtggagagtgagaagcacagaaccaactgtgccttttttttttttttaagacagggtctcactctctcgcccaggttggactgcagtggcgcaatcttggctcactgcaaccttcacctgccaggctcaagtgattctcctgcttcagcctcctgagtagctgggattacaggcgtgtaccactaccacccggctaatttttgtatttttagtagagacggggtttcaccatgttggccaggctggaacgtctttcaatctttgttggaaacctgaactttaacaagtctgctcctgagttaaaaactagtatatccatgggccaggcctggtggctcacgcctgtaatcccagcactttgggaggctgaggtggacagatcacaaggtcaggagtttgagaccagcctggccaacataatgaaaccctgtctctactaaaaatacaaaaattagccgggcgtagtggtgcgtgcctgtagtcccagctactggggaggctgaggcaggagaatcacttgaacccgggaggtggaagctgcagtgagcaccattgcactccagcctgggtaacagagcaagaccctgtctcgaaaaagaaagaaaaacaaaaactagtatccatgatatttttgctaaaaatgatcttgctgttgtggatgtcagaatgggtatgacaaggaaatctgactatgtggattttcaagctgctgaagacctggaaagagccttggaactcgctggtttgaaagactttggcaatgaaattaaactagagaaaccaaaaggaaaagacagtaagaaagagcaagatgtgagaatacttttggctacaaatctcccttacaaagtcactcaggatgaattacaagtgttttggctgggcgcagtggcgcagtggctcacacctgtaatcccagcactttgggaggccaaggcaggcagatcacgaggtcaggagatcaagaccatcctggctaacacggtgaaaccctgtctctactaaaaatacaaaaaattagctgggtgtggtgacgggtgcctgtagtcccagctactcgggaggctgaggcaggaaaatggcgcaaacttgggaggtggagcttgcagtgagctgagatcacggccactgcactccagcctgggcaacagagcgagactctggctcaaaaaacaaaaaagtgtttgaagatgctgtggagattggattagtcagcaaggatgggaagagtaaagggactgcttatattgaggttaagacagaagctaatgcagagaaaacttctgaagaaacgcagggaacagagatggatggccgatctatttccctgcactatcatggagagaaaggtctaaatcaagactagagagaccacttggaggggtgaatcaaaaactctggtttaagcaacctctcctacagtgcaacagaagaaactcttcagaaagaatctgagacaaggcaacttttatcaaagtgccccagaaccaaaatggcaaatctaaagggtgtgcatgcacttacagttcgcttcatttgaagatgataaagcagctttaaattcctgtaataaaagggaaactgggggcagggcaatcaggctggagttgcaaggaccacctgatgccaggagccagccatctaaaactgtctgtcaaaggcctgtctgaggacaccactgaagaggctttagtcattcgacagctttgttgggcaagggtagtcaccaaccaggaaaccgggtgccccaaaggctttggctctgtagatggcaacagtgaggaggatgccaaaagcgccaaggaggccgcggaagatggtgaaattgagggaaacaaaggtaacttggactgggccaaacctaagggcgaaggtggctttggggttgtgatggaggtagaggaagctttggaggatgaggtggtggcagaagccaggaaggctttggtgggcgaggcagcttctggggaggcagaggtgaccacaagccacaaggaaagaagacaaagtttgaacggcttctgtccctttgtctttccctctcccatttgaaagaaaggacgctggggtttttattccgttacctgatcaatgacagagctctctgaggacattcca

SEQ ID NO: 12286 - DNA, 74914 bp, Human
cattgtagccatcccaaagaaaacccttctttgccctttgcagtgccacttatttaggtaactgaagtgtatttccagtacaatttgattttgaactaagatttgatatagagttgtaattgcttacataactctttgaaaatgtatcatccctgggttctcaggtgaaggaggcaattcaaaagtaaaaaagaatattcgaatacaataaataccctctgttctcacacaaatgctgtttcttagctaacttgctttgacaacctactgatgtaacttctttattaatgtgaaatatttatattttgaaataaaattactagtgttgaatgaatcatgtggtaaacttaatctcctgtgtgttgaaaaacttgatcttttgtgaagccaaagtttcatgaatccatccgtctcttaggccttctgttatgccatttcctccggcaccattgtgtacactgaattcttaggagatactgtcaacttcgtaagggaaggtgtgtccaggaagtggacactgggcgccttaaagaggtcaagggccctcagtgcacaggggaaggtggccttgtgataggtaaggaagtggtgagatggttggctgagaagaattggaagaaaaagttggattgaggacctgtcctttttgaatgaagaaaaagaagctgaagcttggctatcttcaataccaaagacagctgtgcagcactggtagattgatgaagctgaagctacaggttgaagcactgtgaagcgcctttcaacggtgcttgggaaagagctttctgatgcctcaggttgatgtacccagctcatcaatctggtgttatggaagaagaaatgatccaggccaaggtgtccgggtggactggccagcctcagattcttttttactctgacaggttctcactggcagatatggtagttgacaaaacattttttcatgcttctcagtctgttgcttaagtctggaattccttcacggcgtgcatactgctgacaacctccttttggccttgctcctggagaccttagaataggagtcttcagctccccgcccccatcgtggggctctgtgcgagctcagagttgtgcttacagaactgattcttacccttcccctcaagtgagttgtcagaaatacacacttggtgttttcatgcaatgaacagttatgaagaaactgctctgtgcctggcactaggaaaaaacttcgaaaaatagttttaagaagtagtgttgaacagtagatgaggctttttcatgtttcttttaaatttcttttgaataagtctaaacagtagtgtgaaagatatactgacttcctgccgaatacccagatactccattaatgattgcattatcaaatgtttccccttcaatccagctcaaagtgtttgtgagaaatacatggtgaaagaatgagcagggtggagtggaaattggaccttccggagaagccccaggaagacattaccactggaattcccgtcccaggggaaaggcccctcccaacagacttgattctggttttggtctaccagtttcaaccccagcacagcttccagaagtctttgcgggaattcagagctgatttaggacgagtcacctatcgagaggacgggaagctttgctggggacgcttgtctgtccaagtaagaggaggccatgtggctgtgtgacagatgtgttttgtttctcctcgccaccctggcgagaaggtgcctggaacccatggaaggggtctgagaagagataagggcggggccatgtgggggcgggacccggcttagggggtggggttgcagggagcccacaccaggctggactgcgcgggcggggcagaggccgggggtgggcggggacatacggtgacgggcgtcggggacgcagggttggcggcggagccctgggggggcgggcccctgggggcggggtctcggttggcgcgagtgtcctgtcgccgccgcctcgggcgggtgggctgactggcggcaggctcgccgcggcgcggagtcccggctgcgggatagaccgagggccatggccgcctctcccggacccgccggcgttggcggcgccggagcagtctacggctccggctcttcgggcttcgccctcgactcgggactggagatcaaaactcgctcggtggagcagacgctactcccgctggtttctcaggtaaagtggcgcctggcgcggcccctcttctccttcccgccgcggcccgcgatggcggccgccgctcgcacgaccggacgggaggcagccgctgccccactttccgcgccggcactgcggcgttcttgtcggaccgcctgtgtggggctccgggacgggcctcggcccgggcggcgagagactggataatccaaactccggcggcagggttgagtggactcggcagcaggggaggctgcggggcgggggtgccggcctgggcctttgcccccagtacctgcctcgggtctgcggctcccgggtgcccccggccgggcgatgccccctccgcggggcgagtggttgagcccagctcccgaggcagagaggacccccgcggggcccctcgctggtacttagggccctccacgataaccgactttgtcaccagttcgcagcctggtcccgagcccggctcctccgcctggggtattcctcccggcctccccgcccagcgtgcgctccctgatcctttgtccctccccgccgtaggtcagttcgctggcctcccattcatcccggccaccctaccccttcccctgaacctgctgctgctcacttctgcccgcttctgtccggcctcgtggaagagtgacgtggagactgtatgacagttaatccagatgcacaccgttttgccaagtcccgtttgggatgtgtgcgttactgtatttgccaatcagctaaccgacgccctgagttttaggaaagtttttgtttctctgagctgggttatatgcagcttcagggctagaattcctcacttaggtctgtggtaagatgccaagcactgtggggagtgaattctgtgccttcgggagcgcgttggcgatgtgtgactcacatctaggttgtaaccacttcgtgactcatactaggattaccaagattttagaggtagaagaaatcttaaagattatctgactaaaaattctttctttagcatccttgacacctggccaccagtaccctgcttaaacatgttcagtgaaggggagcctgtagctgttgcatagaattctaaatgctattatctcttctcctgcccagccctgcgcatatttgaaaacagcagttacacatgtccctggattcctgttatgctggttaaataaacatccctattttcttcaccttcgcatggctaacggagcagtgatgaatatatctgacactctccttcccttttcctgtgtctcattgaggctctgaccagtgggaaggggcactgggatccctcagtaatgtcagaccctccgctcctcgcctatctccactagcacaacacaaccaaaacgagaaacactggagcagttttaagaggcagagagataagagagtgatggagttcaagttgatagtattttatccattttttaaataacacctatgtaatgcttactatgtggtaggccaggttctaagcactttgtaaatattaactcattaattctcataacaatcatgtgaagttggtatatattctcgtggtatgggagaggaaactgaggaatagtgaggttaaataatttgttgttagggctttcaataagtgccaaactgggatttgaatccaggtaccctggctccagaaggttctctttgctacactatgctgtgtcctctctagagattagaagcagtaatgagatctagagaaaaagatggtacatagtggaaaaacaagctagaaagtcataatctggagaaatggcaacttttcacagtatccactgctaaaaatgtatcagtcttacagctctgcattgtgtaactctggggtaaaagaagccagagaagggtaggagagcagaggaagaaaagtataaatcactgctgagagttagaggtcaatgccaaaggggaagaatgcctgcctttttttttttttctttttccagttaaagccttgttcagggtcacagctgaggttttgcatcccacacattgtgtatctacagctacatctctaccacaacaccataactgatattcctcataattgactgtccttaacaagaaaaagttaaaatcaagaagtgtattaagcatggccagaatactcggttaacaaagcagggaagtacaatttagaatgattttaaagtttcagtgttaggagattaaaacagcagttctccagaaaactcatatgtccacaagtctcattttctgagaatgctgtattattacccaactcatgtttcaccatctcatccacaaggatattttaagcattttaagcaaggatttattgtgtgcttatttgttgctgttttttgaggggcttatattctagttggtagataggtcatgtatagaacagcacatgcaaagtgtcaaatgaacatcatcaatggtacatactctaaaagctcagagaaggcatggatgagtcagcagtgatgtcatggaggaggcagggttttgaggtaaacaagtaggactggcactatacggtttaaagtagacagtttctattctggtatcatctagcttcttctgactctccaagtgaaaagtcctgggttactggccttattctaagaatgcaagattttatcaatattagaaaaatgtgtatagttttttttgcattcacagattataaaagatgtattttcctaacaatgatgcagaaaaagcattcaactaaattcagcttctaataatgataagaagcacttagggaactagtgttaggaaaaagtgtccttaacctgatagagtatctacagaaaacttttacttaacatcatagcaacagtcaaatttaaaataaacatttcctttaaagccagaaaccagagtggggtgcctgctatgcttctactcagcactgcactggaaattctagccagtgtaatatgacaaggagaagaaataaaaggaataaatataggaaaggaaaaaccaaaagtctcagtgtgatataataacctatgcagaaaactcaaaacagtctacaagtaaattataaaaattaggagtgttggcaagttcactgagtgtaggatactaaaatcaattgcatttttctacattgataacaaacaaggcacaggcgcactggctggtgcctgtaatcccagctactctagtctcagctattcaggaggctaaaaaatgggaggatggcttgagcccagcagctgagggctgcagttagctgtgatcacgccactgtgctccagcctggccaacaaggaccctgtctttaaaaaataataaaaaaaaatagaaaaagtaattattaaaaaaatccagttatattaacagtaacagcaaaatatgagcttcctaagaatatgttgcttttgctatgtatataaagagaaagagctctatctctatgtatacacagcaaaagtggtcaaacttcatggagaaaatttaaaaattttatcaaaagccaacatggatctaaataaatgggagaaaagtactgtgttcaagcctaggttgacatattatagacatatcagttatccctattggtcaatttaatgcaatttccatgaaaatttcagcaagatttttcagtagaacttgataaaagtaattctgaagtttatatgaaagcacaaagggccaagattaggcagaagagaaacaaggtggatggacttgctctgccagatttcaagactcattataaaactatagtaattaagacaatgtgggtatcagaacagggttgaaaaacatagacctgtgatacagaatagaaaaccctagaacagatccacacatatatggaaactcggtaaatgacaattggcattgctggtcagtggggaaaggaagaacttaaaaaaaattaagctgggacaattggatatctaaatagaaattatgaaattggatctctgtctcataccagtaaaaagtcaacttcagatggattaaagacaatatgaaagtaaaagctcacaacacttttagaaaaaaaaaatagggcagtatcttcattaccttatgctgggaaaggatttgttagtataccacaagtataaaccttaagaaaaaaatggataaattcgacttctttaaaatgaagaacctaggccaggcgcagtggctcacacctgtagtcccagctctttgggaggctgaggtaggtagatcatttgagtccaggattttgagaccagcctgggcaacatggtgaaaccccgtctctacaaaaaatacaaaaaattagtcgggtgtgatggcatgcacctgtggtcccaggtactctagaggctgaggtgggaggattgcttgagctggggaggttaagcctgctgtgagctgtgatcacaacacttcactcagcctgggtgacagagtgacagaatgagaccctgtctcaaaaaaaaaaaaaaaaaaaaaaaaaaaagaacctctgttcatcaaaaggaaaacgtaagtcattaagtgggagaatatgattccaacacaaataaccaacaaatgatttgtagtacctagaataaataaaatactccaatgaataaaaaataaaaagattagccattaaaaattggtcaaaaaataatttcacagaagaggaaacagctaaaagatataggaaaagatattcaacttcattagaactcaatgaactacaagctaaaaaatccacagtgagaataagtgttggtgaggaacgtggagatggtagcaatatccgtgttacaaccattttgaaaatggtttgttgtaatctattataattgaaggtgggcattacctgtggcccagcaattccactcctaagtcagtacccctagagaaactcctacacacctattagaaaagtggattggggctgggcgtggtggctcacgcctgtaatcccagcactttgggaggctgaggtgggtggatcacctgaggtcgggagtttgagacctgcctgaccaaccccgtctctactaaaaatacaaaagttagctggcgtggtggtgcatgcctgtaattccagctacttgggaggctggggcagaagaattgcttgaacctgggagtcagaggttgcagtgagccgagattgtgccactgcactccagcctggtaacagagtgagactctgtctcaaaaaaaaaaaaaaaaaaaaaaaagaaagatggattggaatgtggatagcatttttacttctgatggcccaaaactggaaacttcccaaatgtcttttaacagtagtatgtttacataaattgtgctatgttcatataatgatatactctgtcactgaaatgaataaaccacagctataattatcaatggggatgaatctcaaaaacataatgttgagtgaaaaaaaataaaggttcaataccagataaaactaaaccagatatcatttagggtatactgtatgtacaatagttataataaaggagtggtgaacacaaaattgggacaatggtttcttttgggacaagagagtgatatggacaaggagtagccagatagtacatgggctgtcagagatactgacattgttctcttaagcttggtggtggctgcacaggtctttctttcatttctttaaactccacacatatatgttatatatactcatatgttttatattttataattcagacattttcttgaaaagccctgggctaagaaccaagcatattttatgtagagtacctccccacctcctttaataatcactttattcttcctgtcagaactcccactccaagtcttataatgcttttatccaaggaagggaagaaggatatctgccacagaactccaccctggtgtggaatattattctactgcccactagtcttttcctgtctatgatagatttcctttattcactatttgtacagaccccttaaatttctaaggtagcctacctcattttcccattactctctgcattgttctggaagcttttcaggattcttgttgcagttatgttgtcgatgaagagagtagataaggcgccctctctgctctttgctgatttgtgtatgtgaatacatgcgtgtttttttttcttttttttcttttttgtgatggagtctcgctctgtcacccaggctggagtgcaatggcgggatctcggctcactgcaacctccacctcctgggttcaagcaattcccccacctctgcctcccaagtagttgggattacaggcacccaggcaccttacatcaagcccggctaattttttgtttgtttgtttttttgtagagatggagtttcaccatgttggccaggctggtcttgaactcctgacctcaggtgatccaccagccttggcctcccaaagtgctgggattacaggtgtgatctgccacgcctggctgatgggtacaattattatttccattttcacaggtgagaacacagagtcacagaaaggtcagatagcttgccacatggtcacatggcagagccagaattcaaaaccaggcagaatgatgtccatgcccttaactgctgggatattctttggtgttttgcacttcttgacaccctttgttagaagctatcaagtaaaccctaattcttattcttttattccacagcagagttctttagtacaccagatcttctttcttccccaagggatgccttttctgccctcttctctggttcatttaggtgttctctagactctggtgtcagggcaactccaagttatgactctcaatttaatatcattcctatttttgcagaactatagttaagattgtatttggcatattatgatttacaaagcactcttgctagttgtcttttccttgatccttaacataatcctggaaggtaagagagacggtgtagtgattaagagtgtaggtagctcccctggctttgtgacctcgggcaaatacttaacttcttcaaatttcagattttgtatctgtaaaattagggtaataatagtatgtacctattagatgctggagaagcaagcattaaaagaattgatacatgtaaaacacataggctagtgcctggtactgttgtgcttaacaaatgttagctagtcttattttttatatgataaggaaagtgaagtttaatctcaattttgtaaaactgtgtatttaagtatctatatgtacaaaacaagactggaaagaattatgccagaattctcagaggttagtaggattatgggtaatttttatttcttgaggctctcctatattttccatttctgtttataaacaataaacatgtataacttttgaacctaccttttaaaacatttgaaactaattttagaatataagtagaccttaaataaagaatgttacatattgacttagttcctctaaataaaattttaaaggcatactatatttggattgaacatttcctagactgctttccagtgaaaggaaggcagccacacctaattatgcactggggaaggcgcttctagtgaaagcaaaatgtgtcttttggaacggaacaatagttcatattttggcttaattgcaggatcttttctttgtaattgaaattttaaaactttatgtaaatgaaatatttaataaacagaatcaccttaatctgttcggattgctataaaaaatagactgggtgccttaaacaacagaaatttatgcctcacagttatgtaggctgggtagtctaggatcagggttcaggcagattcagtatccagtgagggtccacattctggttcatggacagctgtcttctcactgttctctcagggtggaaatgagtgagagagctttctgaggcctcttttaaaaggcattaatcccattcatgagagctcctcccccatgaactaatcgtctcccaaaggccccacctcctaataccatcacattgggggttaggattttaacataaggatttgtggagggggagtgggagggggaatgggacacaaacattcaatctatagcaagaacttaaactcctttccactgcagtctcttccaagatggtagcttggaatagtcaatgctgagcaagttctcttttttttttcatgtgatagtaacaattccctagagtctgtcaggtgtggaaaaggattaagctggtgccagtaggatttgttctgtgcttcccagcagcatggcccacagtcattctccaaattaaaattatcgtgactctttcacatgattatgtaatgagcttttaggtaacatttcaattaaaaaaaataggaaagattgtaaacctccagtaaaagaaggactattaggtgggatttggtgtcagtttaaacctgggttcaaattctaaactaggctacttattagttgtatgagccaagtatgcaattttactcagcctcagttttttaatctttaataatacctgaggattaagtaagatagctaattatagtatgtctttgaacacttacaataaactgtttatggtactatgttaaacataatgctttcattattttattaactcttcttatttatttatttatttatttatttttttcaagacagagtctcgctctgtcacccgggctggagtgcaatgccatgatttcagctcactgcaacctctgcctcccaggttcaagcaattctcctgcctcagcctcctgagtagctgggattataggtgcacaccaccatgcccggctaatttttgtacttctagtagagatgggatttcaccatgttggccaagctggtctcaaattcctgacctcgtgatccgcccaccttggcctcccaaagtgctgggattacaagtgtgagccactgcgcccagccaactcttcttactaacattataagtcagagaaggcaatatggctaagtggctaagaggctagtctctgcagtcagaatatctggatttaaatcctaactctcccatacttcttgatgtccaacttcctcatttgtaaaatagggatgattattacccccattttccaatttggggaaatgaggatgattaatattaacctatttcactggattgttgtacgacattatagggtaatgtttaggagtacggtctctagaattgaaatgtctgactctgaatcctaactctagcacttattagctgtgtgaccttaaataagcacctttgagcatcagtttccttaggctcatgatgtgagccttcccacttggccggtgaagtgtcttcatgacatgggaattgtctttccctagggtgaaccgagagaaagaaagatgaaaaccacagtgactttatgacttgccctcaaaagtagcatactgtcactactgttttattctattagttagaaataagtagctaagttcagcctgtactcaaggagaggggaatgagacttcacctatttaagggaggaatagcaaataatttgtggacatattttagaactacctacagtctaacctctgcacacaaattgtttaccttattctcacctgcaagtaacctcttcccatccatatcctctccaaagtcacaacatcagctggaaatccatgatgttggcatctattacaaatatgatccaggagagacttcttgtatgtagtagttccttaagtgtaacgtctttcagctttaggatgactactatagactcttctgttcaaaaaatgagaaaatagaaagtatagaataactgctatacagtcctgttcaaaaatggaaaaaaaataggagccactggtttatggtattctgaactcctcctgggcaaatgttgccagttccttgattaagactcaagtcctgggaatagttcatggctcttgattctgccctctaagtcattattttacatgaattgtagctcatgtttgcagctgcgtagatttctcagcctgttccctgcttatggaagtttggagcaggggctggtatgaaagcttcttttcatacaaagatgtattcccttttagtccaagctgatagtgtttctgccaatacgattatcttaaaaattttgttggtctcctgtgagtcatattgaattcattctactagacaaaagcccacacccacaagtctctttgatatatgctcttctttaacttgggcttctcctgggactgctgaggaataatatctttaggcttcttgggagatctgttgtttacctgaatggttgtctgaagcaacaccttggacctttctgagatcttaagattttatagtcgtacccttagcttcatctttagatgctttcttgacacagccctagattttatttttgcctggaagccattgttaattttagtatgatgtgccatctggagaagatttttttttttgagatggagttttgctcttgttgcccaggctggagtgcaatggcacgatcttggcttactgcaatctctacctcccagattcaagcgattctcttgcctcagcctctcgagaagctgggattacagccatgcaccaccatacctggctaacttttttcttttttttttttttagtggagatggggtttctccatgttggtcaggctggtctcgaactcccaacctcaggtgatctgcctgcctcggcctcccaaagtgctgatgattataggcgtaagccaccatgcacggcatggagaaggaatttttaaaaccagcaagttctggcttgtttttatttatccgtgtttcttttaatttttctcttctcttacattttactgtaagcagcaaaaagaaaccaggtagcaccttcaaaatctgctttgacgtctccttagttagatctcccagttcatcggtatatattctccctttcatgttaatgagggtgactttctgtcaccacataacaaggaaccccttttctccagtttccggtaagatttttctcacttttccttaagcttttacccgtcgcttctgctatggcctgattgttggcattcccccaaaatttatatgttggaacttaatcctcataatgatggtattaagagttggggcctttgggaggtgattaggtcacaagggagccttcatgaatgggatcagtgttcttataaaagaggcttcagggagccttgtgaggacacagaagacaccacttgtgaggaatgggtccttagtagacaccaaatctgttggtgccttgatcctggacttcccagcctccagaactgtaagcaggacatttctgttatttataaattactcagtttaaggtattttgttataggagccctaactaagacagcttcctcaaaggtcatcatgcttttgcaaagtttctttgacgtttctagtttttattcgctcgaagttctttcaattttcactgcccgattttacagccactctcacattttaagttttgttacagcctcaccccagatccaggcaccaaaatctgtattagttatctattgatgcagaacaatttaactgaaatttagtgcattaaaacaacaaacattatcttatggtttctgtgggttaattctagagtggcttacctggtggttcaggagtgaggtctctcataaaatcaaaataaagatgattgaccaagcctgcagtaatccaaaggcttgactggggctggagaatctgctctcaagttcactcactcagctgttgacatgaagcctcagttcttcactatcttttggccagaaccttcagttaccttgtgggactctccatagggttgcttgagtgccttccattatgtggcagttggcttgctcccactgtgattgatcctgcagagagtgagtgagtgagtaagatgaaagtcactatgtgttctatgacctactcttagaagcactccattattttcactttattccatttattagaagtgagtcaccaagtccagtccacactcatgtggagagaaatgaggctctccctcttgaggggagaatttgtggacatgttttaaaaccactacagagattatatcactttcctgcttaaaaaaccttcagtgatttcaaaccactgcggagattatatcactttcctgtttaaaaaacccttcaatggcttcaaattactacagagattatagtattttctagtttaaagacccttaagtatcttcctgtaatacatagaataaaatataagttctttttttttttttttttttttggagatggagtctcatactgtcacccgggctggagtgcagtggtgcaatctcggctcactgcaacacccacctcctgggttcaagcaattctcctgcctcagcctcccaagtagctgggattacaggcatgtgccaccacacccggctaattttttttttttttttgtatttttagtacagatggggtttcactatgttggccaggctggtcttgaactcctgaccttgtgatccgcctgcctctgcctcccaaagtgctgggattacaggcatgagccaccgcacccagccaatataaattcttcattccaattccagaaccctatattccacgctggtccctgcccatcccatctcttggatattggttttaacttgcccccgacccactatcctttagccacttccgacttcacctcattccttgaacaggagaggctcattcctaagggctttttttttttttttcctccactgtttcttctcctagaatgctctttatcctttgatgtttgctggtctgactgctttgctatcatttagatctcagcttaaatatcgctttgtcttagaaggaagaccagtcaatttcaggtagctacacagatactttatatcacactatcctaacattttgtacataacagttatattaaagtttattttttgtttacctatttatgtgattattagttctcccccactccttcactagaatgtaagccccatgggaacgtgggcttttctttcttgttgattgttatttcaggtttgcctagaattttatttgggatatgatagtgtgcaacaaatatattttgtgtaactgaattattgctattctaccatactgtaaacctaatggtggtgggattgtcttagtctcattcactgatacatccttaggaactggcatatagtagatattcaaaatttgatgaaaagcaatattgtagttgaggaaatttagatattaaatttccctagaccacttagcaagtaatcgccgagccaagacttaaacctaggtctattaattctaaaatattaatacctaaacatacatataaagtgcttggcacatagtagttgtacaaagagtagaagtgattctcttccccttcttgtaattctcttccccttcttttaatactagtacatgtacattgagcaatagttgggaatctatgtttttcatacaacatttctttaataaatattcttagatgtcagcatagttcatgtactagttccctaagatattttgaagaattatgtttgtttcagtgagctgaagttgtcaccttttgtattttatttcagggcctgggatcaagtgttaaaactctcggtatttcgtttattttgagtcggatgcaacaaaacttagcaaaatgtgaaatatagattacaatgctcattctaaagtatctagttaatttggtaaacatgtatggcacaagtactattttgtacagcctgtgctccatggtaggcaacggagtggaatggagaggaagaagagctgtttctactctcatagcatctgaagtcgtagtagaggaaactagacctgaagtactttggctttctgaatgtaatgatctatccgcttctacttttctccttaagatttgttgaaagatctggagggcctctggaactgtatgccccagataaactgcatgccccagataactgccctcaggtgaacttggagttgtaattaatggaaacattgtcttaaggaatgatgcaggatactttgctggttgtctctgttgaagcatctctaactattgatttagtctattgagctatacagtatgccaggcttcattttctttgactttgtgatacagcttaaaaaagaaaaggtattgagataaaagttgcttttatcttttatttttagatcaccacgcttattaatcataaagataataccaaaaagtctgataaaactctgcaagcaattcagcgtgtaggacaagctgtcaacttggcagttggaagatttgttaaagtaggagaagctatagccaatgaaaactgggatttgaaagaagaaataaatattgcttgtattgaagctaaacaagcaggtaggtggatattgattttgaagactattcataccacttttattgctttggttatgatgaaaaattattgatttatttggaataaagatatacagctctttgattatgtctgcctcagacattaaaggcctggattagcttccgcgaatactgcacttggcttggatcaagtcctaaatctgaaacataggactccttcactggtcagagttagtgatcggccatcctcatcagccattgagatgtgagagagatagagaagtgggagctgtggcctctattctctaagaacatattagtctactttccatgacataggaaatggaaataagcattagtatccattagtattctacagcaaacaaatcatagtgacttcaaacttcatgatggttcacagttctctatagatggtagcacagaagcctttgagaacctagagtgttttgaggactgcagctttgttgaagtatcatttatccattaattttttcaataaatattcactgaatgctggtgatataccaggcattcttttaggccatagggagataggcatggacaaatcagtccaaaatctgccatcttgggccttgcattctgctgagggagacagatcataaatgaatatatatgtaatgtcaggtggtgatcgttaccatgtaaaaaaaaaaaaaagcaaggtaagagttaggagaacaatgaaggtgctgttttagagagggcagggttttttaactttggtgctactgacatcttgggttggatacttctctgttgtgggaggttgacctgtacattgtaggatgtttatcagcatcactagcttctacctactagatgctggaaggtcccctctccttccatgggacaaccagaaatagctctagacattgccaaatgtcccgtgaggggtaaaaatggcccccagttgagaactcctgggatagggaattaggaagacctgctaaggaaggaacattacagcagagactgcaatggaatgaaggcctgagctatgtggatacttgggggaattttggactatgttctaagtggaatgagggattagtgggagattttgtgctgggcagtgacatgttctcatttgtatttttaaaagggtaactggtggctcctgtatagaaaatacattttagggggtgtgaggatgaattcagagaaaccagttaggaggttgtcacagtggtccaggtgatagatgatggtgacttagactagaccatagcatttgaggtggtgaaaggtggctttgtttcaatatattgccagggtggagctgataggattggctgatggtttggatgtgatagaagagccagggataactccaagatttgggatatgaacagctaggcaaatggtggtgccatctactgagatgaggaactctgagggaggagcaggtcatcagcaggaggagagtgattgcgataaaaccaagtaaatgtagaggggtggacaagatcatacacggtcctgtatgttatgtggatgatttcaactattattccatactaggagtcattgagaaattttgagccagatgaaagacatattgttttgtgttattttgttttgttttgttttttcaaaacaagaacatttcacagatcttttatgttagatagaagtctttctgatggtgtggaggaagtgaacgaatgaggacagcctgagagaaggttgagactgaaggcagggagattaatagggaagcttttgtggtaaaaccagctaggccaagtcagtgtaatagggctgtaaagagcaggaagagtgcacaaaatactcattaaggtggttgaataggtaaaagtagattgttaactaaaggaaagggaagaccctgggttgacttttggatttctagccattcactgggacagagaataggttttatgtgggaagcagggggggatatccttattctattcataatttatatttttcctactttagaaaaggatgtgaaagcacttacaataaaagacatgttcaataaacttattaaaataggatgtgaaaataaataaaccagaaactttggcaaacattattattttaattaagcatgaaatttatctttgtacttcctggaaggcaagacaaaaatgtgggaaacaaagggttatataatctcattgtttgttgaaaggaagcaaaccagcttgtaagaggagagactttttttcctgacactaaattattgtgtgggtgcttatgaaacagacattacataatggacaattcaacagaaaatgtagagatggtcttcatattactgtttcattttgcaagaaagctttgtggttaaaaaaaaaaagaaataaaaaaatgactgtttcttctaacaaccgttgattaaagcaggagtacagtatttttaaacaaaaggacaacctgagtcctgtgctccttgttggctttgtagcatgtcattgtgcccagtgtaaggtgagagaggaggacgtggtacactgacatgagtaccatacgcccaggcagctccataaacggagtattttggaagctgtcaggtttcatgggctccacatgtcatcttcctcctagtgtcactcaggtaagagtatgagaatgatgccttctggagttgtaaaatatagaagcctttttttctcttaacacatacaaatttaagacttcattaaatcactcctgtaatgtttctagcccactcaacccctacgaatcattttctttgtttgtcaacagtgttcatttgagggaactaatataaagtagtagataaaaaactggagctggctgggtgcagttgctcacacctgtaatcccaacacttggaggccaaggcgggtggatcgcttgagctgtgtttgagaccaacctgggcaacataatgagtccctgtctctacaaaacataagaaaaaaaaatagccaggtgtggtggtgcgtgcctccagtcccagctacttgggaggctgagatgggaggattttttgagcccaaggaggttgaggttgcagtgagcagtgatggtgccactgcactccagcctgggagatgacagagagagaccctgtctcaaaaaaaaaaacactaaagtcttagggtcagattgcctagactttaatcctagtgcttctacttgcaagcagggtatattgggcaatctattaaacatttctaaacctcagtgttctcatctataaaatgagactgttagggtttatagaggtgttttgatataatgcatctatcatttcacacatagtaagtgctcaataaatattagttgttattattataattaatttttattcttacttccctgtgttgaactcttacattgtattgttgctttttacttggctaccaggcaaggtttatatttatgttttatatggaagttcaacaaatatttgtgtttgattgaccttgggttttcctattaaggcacagcactagtaatgacatataataaattaaaaatgatacctgtgaagctgtaagacagctttgttacttttttagggaactgatttctgaacagtttacactttgaacaactttataatgttaagaaagcatttgcccatgttggtggagccaaccaaatgttactgtcccacgtacttatgagttaaatgcctggggtctagtcagaaaaaggaaaggttgaataatgccatatgtgcaggcttatatgtcgtatcctttgtggttgagaggtgtagaaaaaaattaacattttccagaggatcagaggaaacatttttatccttttagctattaatgataggatgcaaactgatacttttcctcctgccctttctgtatgccttaaggttaattctaagcacttttgttctctgttctttgctatgaaaactctgtattagctacctatttctgtgtaacaaattaacccaaacttagcaacttaaaaccacaaacatttactatgtcagtttttgagagggcaccaatcagggagtggcttcactgggtggctcagggtcagtgtgtctcatgaggtagcggtcagtgtgttgaccaggcctctgttacctggaagcttgagtgcactgcaggtctgcttccagcctccctctcatggttgttggcaggcttcacttccttgctggctgttggctggaggcctcacttcctctccacgtagttatctgtgtagtaagggctgcttatgacatggcaactggcttctctcagagagagagagcaacccagacagctgcctcagttattttagaacctaagcttgggagtgacataccaccacttccaccataccaaccctggtatgatgtgggaggggacagacagcacaaggttgtcaataacagtaggtggggatcatggggagcgatcttgaaggctggctaccacagaattcctctatctgtagagcttcagctattgtcattatacacaagacatccaagtctgcattaccagtccatgtcttgcgacttatctttggtgtattcctgtgttatttcaaactcctgttgtctgacagtaaaattatcatctctcttccaatgcccttcgattttctttaagcaacttaggtttacaactttgaggccatttttttactcgttctttccttcttatcattggtcaggtactaattttgtgttttcttaatgtttcccaaatcatcttcttaatgttcctatggctactatactagtaaggtccctactatttcacacccacaattgatacaatagcctggctctaagtctttcctttccattctattttatgtactcctactagactgatctttcttttttttttttgagaccaagtctcactctgtcacccaggctgaagtgcagtggcgccatctcagctgactgcaacctccgcttcccaggtccaagcgattctctgcctcagcctcctgagtagctgggattacaggcccctgccaccacacctggctaatttttgtatttttttagtagagaccgagtttcgccatgttggccaggcttgtcttgaactcctgacctcaggtgatccacccgcctcggcctcctaaagtgctaggattacaggtgtgagccactgtgcctgccagactgatctttccaaaccttgacttatacttcaccctgtggcctctccattaagattccagtactttttactcaagatccttagcctatgagctgacacattattgtgtgtatgtaatagaattgacaggagggcttttgtaagaaaatcaatccattaggcacacaggtatatttaggactttaaaaaatgatcttgaacactataagttggttaaaggtttattattttaaaaatctttttaacagtatggaggtttgaagaatattgtagccttgtattataatacaagaatacttggattgttttattagtagataattaccattacagaaatcaaaagttttgatagcaacagtgaagaagataatttttctagagggttgggagttcaattaatagaatggtttatgctgggcatcataagaagtttatataaattcaaactgtagcctaaatgagggccagcctgtggtttgaattctcaggagggaggcttttgttttgtttactttccccacccaaagtccaggctgactgacagacaaacttccttattgtttctttttgcctattgacagttctttccgggcccccattatattgaagatgtcatcccttggggcctaaagccctgtcttttttctctctctgaggatccgtgaaaacccaagggtgaaaacccaaggccgttcagcttgtggagattggcagtgacccctgacttctccccggcctcgccccagcccaagccttggcacctgcttactgctcgggttttagggtattctttggtttttgactcatgggatttctcttactgtcttgtagggcaggaggcttttagattgtgtagtttgcattaccactggaaacaaaaattatgatgtttttcaaactgggtgagggcaaaatttgtcacagttcttaagagtgtgctattattttctggttagaaagcttcgtatgataatccctacaatcgtcaaggtgaaaccgtttcttgttcctgaagtaagactccaaagctgagtttctcctcattgtgccttaccttcaaggttagagagaagtctagattttaatttgtatgcctgtttaactttctcccctcgtctttcttgttaggagaaacaattgcagcacttacagacataaccaacttgaaccatctggaatctgatgggcagatcacaatttttacagacaaaacaggagtgataaaggctgcaagattacttctttcttcagtgacaaaagtgttgttgctggcagaccgagtagtcattaaacagataataacatcaagaaataaggtacttacctttctgatgttgctgtatttttgtctttctgtgttgttcaaagtgctttttatgactcttagtggtggattgcttggcttgtgtgtcgatgaagaatgcagctagctgtgggaattaatgtgcaatgcaggatacattgacacactgatcatctgtacgttgaatgcacttgtggccctgggttcctcccggggctatgcatgtctgagcgttgcttaaaaaaaaaaaaaaagaaaagttctttttaggttaattgtaagtaatttggcaatgcttgtctattataattgtttataactctgtctgtagtttaaaagtagtgtttcttctatatgtgcaattcttaaatgatgggtatgctgtgcctaaacttttgaatgcaagtaatgtctcctcttagagaatcattatccacttgttaaggcttattggtaaaagctttaaatgtgtacaacatttggaaagaaaaggtgagcactatgataatgtatgtagcagaaacctagttgataaaaatactgaattcttctgtactttttttccctcccaaatcagagactaacaatatataacttaagacacagttaaatcagtggaaatgataattatccacagctacaaaatttctgtactcagagtccctaaatgttactgaataatctcaaaacttacagaacagatttaaactcttccagtccagaagttaatctctcagatgatggtcatgctccatgatcatctgggaatccagggtatgtacgatcacttcttgctttggataattccctaggcaaagaggagagcagttggccagggaaggagttgtcctagaggatttgaggataaaaccacttgataagtgttgaatgaatcagaaattggagaggtggatctggcagcgctggagaaatacaaacaaccttcccctctttgaaagatggaggttctcacagtggtggcaacgtgccttatcagtgttagtcgcctgaacttcctgagctgccagggcagattaacatgccaaatattcatcatattctcaggaaaaataagtaaacagaggatatctgtgtttttttttaacttatcttgttgcgactaaaacaatctaataatgttattttaaagaaaagtatttgaaaatatgtttcacatctatttactttgtttcttacatcaagaaaacacataacattttagtcactggctctaccagattcacacactctttattcacccctgatggcccattcctgactgagccagactaattttcccacccttaaagtcccacacttccctttcgactctatactctgaagatgatgaggttccttctgctttcctgagaatgttagggttcctgtcatcctggttcactgaaccttaaagcttgtgtgtgctgactttcatcctcaccccttcccagttctctgaagatttgattactgtggtcctgcccattcccaccttttagacttggctacataaatgatcccttcctttgtatatgtagtcatttcttttattctttttccttttccttttcaagtaactcaaaatctcatcatataaacaaatcattcccctaataattctgtgccttgaatctacttctacttctctgagcatccccttgtgtgtcttctatctggctcctcctcctcagctttcacctagaattcagaattttccttttcttctctctactcagccttgacaatctcagtctcttgagtagctctcaccaaataatgaattattatctgttttgcaggttctcgcaactatggaaagactagagaaagtgaatagctttcaagagtttgtccaaatattcagtcaatttggaaatgaaatggtggagtttgcacatctgagtggagatagacaaaatgtatgtattcatcacattttacaatcttcagataaatacatactttttagtttggatggaggtatgatcgttaggattgtttggactggtttctttgcttattaagtctatagccttggtcttgaaagcctttcatagataagccaggataaagtaagtagatctatatgtctttttttgtacatttataacagttaattttgttcccacctcacacactgggaaaggtcatacttgctatcagggctcaactcaagtacttcttccttttatttggttactttctcttttatgaagctttccatttgattcctctactagggctcaggcacataaaattgagtcatcatatgtattcttatagtatcttgttagatatttgttattcttaccgtattagattaatagtaataacccaagccattatttatttgcactgcctatgtgttaggtacttaatatacatgatctcatttaattttcaaaacatccctatgaggtaggtattgttaactactgttttacatatagggaaactgaacctgagacaaggataaactttcccaaggtcactgtgctagcagatcgaactcagttatatctgattctaaagtctgtagttctcaaactacaacatgatatttgttttttattttattttattttattttttctgagatggagtctctctctgtcacccaggctggagtgcagtgtcgtgatcacggctcactgcaacctccacctcctgggttcaagtgattctcatgcctcagcctcccgagtagctgggactacaggcatgcaccaccacgcccagctaactttttgtatttttagtagagacagggtttcaccatgttggccaggctggtctcgaactcctaatctcaggtgatccgcccgcctcagcctcccaaagtgctgggattacaggcgtgaatcaccgtgcccagccaatattagttccttatgggtctgttccccaattcagacagtaagctcctcagttttgggagatggaagatcatattatgtctaggattgacttttccttgttggggtatttgtgtaggagtctgtcttgttggcaggttaaatatatataataattgaccatttcttgggatggttctgggtgtagtcccataggctagtctctcagtttttgatatgaactttcccaattgcagctggagttgaaaaatgggtattggtctggcaagtggcaggctaaataatggcattggtttgtaataccaatggtgtttctataggcaggtactttattgtttcattttctgtctgccattattgttctttataaaacaaattttctttcttttccttctctttctcttaatcttccttcttctcctcattctccccaatgataattattagcctgagtatttttataataatagtagcttataatctagcattttcttgatcacttgagcaagcgtggcatgagtcataggttctaaagctaccatccttcagttacacttcctacaggatcctcttcagcttctggacataactgaaaaactttcaccatcattttgatttgtagttagaaatttggcatggagaacattttatttttctcaattcttgtaatattgtgatccaacatttaaaaacttctggctgaagtggtatctatttttagcaatttagctcattaaatgtgggacccctgaaacttactggcagcctttttatcatctgtgtttgataagtgctactcctgggtcacttttttggaatatgcatccagggttcaaatgctttctcctttagaatagtcaaaatatcctgcaaagagctataggtcaggtgcattctcagttttctcagcaaatattcatcagctgcttactgttaaccaaatactacactaggtgttgaggattcaacagtaaataaaagtgacaaaaacctctgcactcatggagcttatgttttagtaggggtgggaggagatagacaataaaacagaaacatgcatggtgtgttcaaagaacacgaaggccaatggatggatcaaagtgagcaaacgggaagggtaataagatgaaatcagagaggtagtgggcaggccaaactgtgtaaggactttggctttaagtaaaatggggagccattggaggttttgagtaggagaatgacgttttctgacttacattttaacagtatcactctagctgccatgttgagaatagtttgcatggagacaagggcagaggcagggagaccactcaagaggctattacagtaatctattgagagatgatggtgacctggaccaaggtggtagaaagtggcagtggtgaggctgggcatggtggctcatgcctgtaatcccagcactttgggaggctgaggtgggtggatcacctgaggtcaggagtttgagaccagcctggccaacatgatgaaaccccatctcttctaaaaatacagaaattagctgagtgtggtggcatgtgcctgtaatcccagctactcaggaggctgaggcacaagaattacttgaacctgggaagcagaggctgcagtgagctgagatcacgccactgcgctccagcctgggcaagggagggagactgtctcaaaaggaaaagaaagtggcagtggtgactcctattcaacatagtgttggaagttctggccagggcaattaggcaggagaaggaaataaagggtgttcaattaggaaaagaggaagtcaaattgtccctgtttgcagatgacatgattgtatatctagaaaaccccactgtctcagcccaaaatctccttaagctgataagcaacttcagcaaagcctcaggatacaaaatcaatgtgcaaaaatcacaagcattcttatacaccaataacagacaaacagagagccaaatcatgagtgaactcccattcacaattgcttcaaagagaataaaatacttaggaatccaactacaagggacgtgaaggacctcttcaaggagaactacaaaccactgctcaatgaaataaaagaggatacaaacaaatggaagaacattccatgctcatgggtaggaagaatcaatatcttgaaaatggccatactgcccaaggtaatttatagattcaatgccatccccatcaagctaccaatgactttcttcacagaattggaaaaaactactttaaagttcatatggaaccaaaaaagagcccgcattgccaagtcaatcctaagccaaaagaacaaagctggaggcatcacaatacctgacttcaaactatactacaaggctacagtaaccaaaacagtatggtactggtgccaaaacagagatatagatcaatggaacagaacagagccctcagaaataatgctgcatatctacaactatctgatctttgacaaacctgagaaaaacaagcaatggggaaaggattccctatttaataaatggtgctgggaaaactggctagccatatgtagaaagctgaaactggatcccttccttacaccttatacaaaaattaattcaagacggattaaagacttaaacgttagacctaaaaccataaaaaccctagaagaaaacctaggcattaccgttcaggacataggcatgggcaaggacgtcatgtctaaaacaccaaaagcaatggcaacaaaagccaacattgacaaatgggatctaattaaactaaagagcttctgcacagcaaaagaaactaccatcacagtgaacaggcaacctacaaattgggagaaaattttcgcaacctactcatctgacaaagggctaatatacagaatctacaatgaactcaaacaaatttacaagaaaaaaacaaacaaccccatcaaaaagtgggcaaaggatatgaacagacacttctcaaaagaagacatttatgcagccaaaagacacatgaaaaaatgcttatcatcactggccatcagagaaatgcaaatcaaaaccacaatgagataccatctcacaccagttagaatggcaatcattaaaaagtcaggaaacaacaggtgctggagaggatgtggagaaataggaacacttttacactgttggtgggactgtaaactagttcaaccattgtggaagacagtgtggcgattgctcaaggatctagaactagaaataccatttgacccagccatcccaatactgagtatatacccaaaggattataaaccatgctgctataaagacacatgcacacatatgtttattgcggcactattcacaatagcaaagacttggaaccaacccaaatgtccaacaatgatagactggattaagaaaatgtggcacatatacaccatggaatactatgcagccataaaaaatgatgagttcatgtcctttgtagggacatggatgaaattggaaatcatcattctcagtaaactatcgcaaggacaaaaaaccaaacactgcatgttctcactcatagatgggaattgaacaatgagaacacatggacacaggaaggggaatatcacactctggggactgttgtggggtgcggggaggggggagggatagcattaggagatatacctaatgctaaatgacgagttaatgggtgcagcacaccagcatggcacatgtatacatatgtaactaacatgcacattgtgcacatgtaccctaaaacttaaagtataataataattaaaaaaaaaaagaaagtggcagtagtgacagccttacccaagtctgggaaaatacttctggaggtattgggatgcttcgcttagtgcttcatggaccatctgggttttatggacgcctctgttttgtcctgtggaccagccctttccaggttgagatgccatctttttctgtcgcttgttatcaccatacagcctatggtgtcatatgtggcttgtaagtgtcaggtatggcatacacacttgatgcattgtcagctagacccacaggtggttttgaaaggagtcctgtccaaaatgttaaagacaagaggaatgggtggaaattttataagcaacctcagcctttatctgataggtacccatgatggatgatactcacatataggacacagttctttgggatgtgatctgcattagctttggggttatatgcactttgtcgtacactatttgtaattccatctctatcttttattaaatctatattgggatgcaagtgagtgagagtgatattattgtgtaggactaacttctgaatccattctaatttattcaagcaaatttactttcaaaggcaaatcattctcaaactttaggttttacttatttgtaagaaggggcctttaacctaacttacaaataaaaaaggctaacgtgacagggaaaaattttatgtaattcaaatttcaatgtccatacataaagttttcttggaacacagctgttcttatttatttgtgtattgtctctgtttgctttcacactacaatgacagaattgagtagctgtgatggagaccatatagctcagaaggcctcaaatgtttatctgggctttaattgaaagtattgcccacctctgatttagatataataaccaaattattaacagagtattttgttgtagatttgatcagcaaactttggctacctcatgtgaatagcacacattctattgagggctctgtgaggagaagtcaccccccaccaaaacaaattcaatacacagtgctttcttaggtgttccttttcaatcttgttggggaaaattatctacccaagaaacatcttaagaatatttcagagcagcatattgattaagattaagacaaacgaaccccaatttgagatgcatagcagttagatgggattaattagacgaggctccttaaagaatcgacttttaagtgtctgttttgaaggaaataatagtcaatagatgctcagtagacaatttacttttaattaggtaagacataggctgggtgtttctggttaggacgcagtgtgtgcatttgacgtgagaatgtcaggtatgacagaacaccagaatgtcagccatgtgcagcctctacctgtgtctcagtttctggctctctagcccttactaagagtagctttttctttctactcatattgtgttgatgtgtttatattgaagcagtgacagtttgtaaaactttatcctggtttttttttttttttcacttaacaatgttagtgaattcttgagtattagtgttgaataaatacttttttaagaaattgggttgttcacatggtcttagactcctccgtgattttatttcatatttaggatttgaaagatgaaaagaaaaaggcaaaaatggcagcagctagggcagttcttgaaaagtgtacaatgatgcttctcacagcttcaaaggtaagacaattttggttttactgtgtaataaattaataattagaacacccgactaaatgcatttaacttacataatttacattttaaaaaagatcaaagtgattacttagaacataggcctgaatagttaaatctcagttattatttataagaatgctaactttcttccccaactccaaataataactaatttatgagtcagctttgattgaacagctcagcagaacatggtgtattaggtgctatgaattaaggcctgtcacacatggtagctgcctgcagggtttttccagtctcattgaggagccagcacatatgctctagaaaaagctagacaagttaagatctgttaaatacagtggagtaagaagtcagcacttagtttattctgtaaattcaccctttaattcctgtttccacttttaacaaaattatcaatcaagagtatttccaaacagcagttggccagcaaattggtgcaattctagaatgaatgagtaaaatgtctctttagcagtttgtttggaatcaccttttcttctgagagtatttaccccatgctagaatcagtgaagccacaaaaacagacttcgtggaacccactcagaagactctattttgtctaggcccttgagtttttcatttacatcattttttaaaagtcaagatgcatccatgatcatatatcatctcatttttcttcattctttttcatttctggcatgtgtaaggcaacatttaaaatagttttaatcatgatgaaaagagattttttcctaaaaaatttttaagtaaacttactgttgaagtataaaggtatagttttgcactctgcattttttatttaaccttgctatcgctttttactcatcctgcttccactttagtgaggagaagcagctgagtgagccagggacccaggagattttggtaaagaaccatttttcttagcatgacatgttctctgtaagatttttgtgcattatgacataaatcaaatattaaaataaaaattttcaattgttttgaagacatgtctgaggcatcctaactgcgaatcagcccataaaaacaaagaaggagtatttgaccgtatgaaagtggcattggataaggtcattgaaattgtgactgactgtaaaccgaatggagagactgacatttcatctatcagtatttttactggaattaaggaattcaaggtaagaataaagagagtatatttttatttttctcttcttattttattttattttattttaattttttgagatggagtctcgctctgttgcccaggctggagtgcagtggtgtgatctcggctcactgcaacctccacctcctgggttcaagcgattcttgtgcttcatcctcccaagtagctggtactacaggcatgtgctaccatgcctggctaatttttatatttttggtagagacggggtttcaccatgttggccaggctggtctcaaactcctgacttcaggtgatctacccgcctgggcctcccaaagtgctgggatcacaggcatgagccactgcactcagtcttttctttccattttaaaggagcatcattatgtatagtatccatatttttgtgtaatgttttagaacagtgcttcacaaaagcaaatgtatctatttaaagcaatgccactctgtacaaacttgttgctcagtaatatttacattaaaggtgtatttacaaagaacactggtctttggttatagtagctactctggctctgtttagctgtatggtttagctgtagcctcctgttcaaaagaatgttcccttcctgttttttgagcagtgccatatctttttgagcagtaccatccataggatgatggtgagcagcaaatcatttctgctagaattcctgcttttctctgtgttagagggttggtactttgagactatagtaatagtattagtaataattaaaatttaaaaatcaacagtaatacacactaacagttattgagtccttattctgtgccagcccttttctgagtgctttaaatatatgaacttatataatcctcaaagaactattgctattatttccattacactgttgaggagcttgagaaacagaaaggatattaacttgctggctactaagtaccagagttgggatttgaaactaggcagtgtgactccaggaagtctgacttctcatcagaagtcatagacatggtgaagatgctttctgggtaagagcagtgtctgagttgggagggccctaagaagtcatctagtacaatgccctcctttaacagatcagaaaactaaggccctgagaagttatccaaatgctaaaggttcccacctctctaacagacagggctatgatgagaatggcattctttccattttactgcactttgatttattttatttatttatttttgagatggagtctcactcttgtttctcgggctggagtgtggtggcacgatcttggctcactgcaacctccacctcctgggttcaagcaattgtcctgcctcagcctcctgagtagcttggattacaggcacccaccaccacagccggctaatttttgtacttttaatagagatggggttttgccatgttggccaggctggtctcgaactccggacctcaggtgatccgcccaccttggcctcccaaagtgctgggattacaggcgtgaaccaccacgcctggccctggactttgatttctaattgtgtgaaggtctaagtaggaacatggggtgaaaagacagtaatggaaagaatatctctttttgctcttaataaatattttatttaatccctacctgccctttaggtggatataattatatactgtttttttttgttttgttttttgtcttttttttttgaggaggagagctagtaagtggtagaacccttctttaggcccaggattctctaatcccaaagtccatgacctttcactttacacctctgggtttgtttatatgatgccagtcctaccactgagtcttcctgaggggaaagaaactgtacagaccaaaccttctcttagaaattttattgctgaaagagatcttagagattatttttctaatcttccctttttataaatgctgaaggaggagatgtgttgtcaaaggataattagggaaacaagtaagtcaagtgagagacatctttcaccacctgctgctgcatttctagtgcaggtgaaggaggggcagtgctctgcctgtggctgctgccgacagctctggctgctgccctctcgccatcaggcatgctggaggcagagctgttataaataggctcagtctcactgtccatgattatctctttggcatcttgctttttttctgatggagagtataatctatggagggaaactgggtactttgctgtatttggtaccatgaatatatggacaaatgttatgaaaccatatcagtaaatagcctctttaaaaaaaccccacaaaactccactaagttgctgtctaaaaacatgtatattttctctctaaagggaaaataaaaaaccttaacataaatggtatgagaccaatataactgatttttatgttttaattctgtttaaattctcaaatttaattctcttaaattaataaaataaatttaattctctgagaagatccccattgtaaattccataccttactattatctgtattctttcctagcttaaatacaagtttctgtctacctaggatggagtgatcacctgacacaacttgggccaagagcaggaggggaagcaaggactctcctatggcatcttgactttcccaaactttgatattttcatggatgatgttaaaatgggtcacacataaggattaattaaaataacatttgtgaaaggactttgaagtgttaaacaaatgtaaggtatccttattatcacattcattgtgaccataatcatgatcattaccgcttgttgcctcttggcccaagttgtctgtgtgacatatttcatggactgtagtgttttacagggttgaaatggcatgatgcatcgtagaaagctgagagagaaagactgcacacatgagcatgtgttcatcacatagtcaaggaactccaaacaggatggctgaagtgaaaggttgttagggggttcagggggtgagatagactgttagagaagtatataaagacaggccatagaggattttgtgctatactacatagacgtttgggcttgattctctatagatggcgaggaactattagagggaggtggcagtatcagatggtttacattttagattatacagaccctctggtagaggatgtttgggtcagtaaggtgctgttggggactttaaacaaaatgtagggagaccagttaggtgactaggagagtctttgctgaattaacaaaggaaaaatggatgtcttccccagtgcttctcacaccccacatcttccacaccatccttccccctgggctcagcacatttcatatttgggtgtaacttatcttccaggactttgcctaggcattttctcagatgcaaatcttttacctggaggctggttcatttttcctgccagttgctagaggatgatgctctttctgccttagtattcactgatctcatagcaatgtcattgtattaattactctaggaatggtgctttgcatggatattgaaggcttttgagcaatgtatccttctgggttagtggcgaatatagatatcattggtggctgtatttcccctcagcttgggaaaaggaaatgctagtgttttcctgggcactgttagaaattacagcccattttggtcaggtgggaatattgactcacatggatggatagatgtcctttttgttctcagatgaatattgaagctcttcgggagaatctttattttcagtccaaagagaacctttctgtgacattggaagtcatcttggagcgtatggaggactttactgattctgcctacaccagccatgagcacagagaacgcatcttggaactgtcaactcaggcgagaatggaactgcagcagttaatttctgtgtggattcaagctgtaagaactttttttaaaatcaaagtaaatcttatataatggctttcccataaagttttgcaagatatggaagttacataatcaccaggagtatgaatttgttccagaatgggacaggatatctcatcccttctttccctcctagttggccaaaatatccttcccatctagcacttacaatacttgacatttatttccaggcctgttgactctcattctagccagtctcaattatatgcctctgtcactatcactagttcacactgttgtccctactcttccaccaaactcacctctggaaaattcctccccaaaatacttcttcagagtgaagaacagaggagtagaccccctcctagaggttcttgggacctgagcctgactgctggagccattcacatgtacacaattcttacctctgaggacagctgatttacagagacaatgatttagaaaacttattggggtgtagattcaatgaaaacaagggtagatccagctggcaagtaaaagcttttcacccttgcacaaattcctggtctaaaattggtgggtggccactctgtgagccttaaatgggctgttggtgtgcttcaaacagaggagcttatttgggcaagaatggccaagactgacagaagtgggacagacaggaagtgtgtgtacacaatctcttatagcaggtggattgcaaagtggagagacagagagccctgggacatgtctctagcattatttatttcttaggcccaggctctgtcagaaaagtatttaacatggcttacaatatacagcagtgatagtacaaatctggaagtcatgaacaaagctttggcagtaaagatgatgaaggagggtggatatggctgagactgaagaaagaaggagcagttgatttccttgtaagtagattaatttatgaatgaaagtagatatgaatcacagatttctctgatgttttcttggcatcacagtagtgcacatgttcttattaacagggaatcttgccctagagtatagtcgtgtgagagacttgagcaatgttttgtgtttagtttgaattatctgtgtgatacacaatctgaagtgtagattgcttcagtgttcagttttaagtccaacactcactataaagagttgcttgtgatgaaatactctgttgggaatgtgattctatcaatactcaaatttgcaattagcaaatgtcacaaatttagcaaatttacccgtgcatatttcacaagcactcagatctctgatcctgcattctaggtgtatttttcattcattcatttttttcagcagttgttactggtgccttttatatgccaagcaccataaatctaaagatgaataagctaaaatctttgtctgcaagaattttacaatatagaaatttgcgggaaggggtgagacaagtacaaatagctttgtaagtatcctaagagaaagtgtagactatgcattgagagggtttgaaggaggacaaatttatatttagggagggggctcaagaagtcttcatgaagtagtgatatttaatttttatttatcatgcaaagaattgaatatctacgacctaccatttgctatgccaggtactgtggatttagtggtgtgcaaaatagatgtgaacccagctttcgtggcctagtggggaagatagactttaaacaaacaaaaaataaaaaattccagatggtttggactgaaaaaataaatatgtaattgcaaactgggacgattatggagcaaaaagattacagtgagtaagaagagggtctgatttagattgagtgatctgagaaagcctttctgagaaaaagacatttatgtaagatcttaaagatgagtaggattttaatttttaactaggttaggagtgaaagcatggacattctaggcagaaaataaaagagattaattttagacttgagtttattaaagaaaattagattttaaaagttcacctttcaatataatccataggttcacagaaaaataaataaataaaaaaacagaagttcatctatttgtagttagcattgaaaaatataactaaactgaaattttattttccactgtaacttaaacaggtaaattttgaaaatctacttttatagttcacagaatagtattaaaatttattacaatttacagtccaaacaaaattgtaattaacagattaaagagatgcggtaacattacatgtatactttttaaaatttttagcaaagcaagaaaacaaaaagcatcgctgaagaactggaactcagtattttgaaaatcagtcacagtcttaatgaacttaagaaagaagtaagtatagtttgaaatttagcctcttctaattctttgtgattttcatgttgtatgggtgtatgaaatacattagtattattagtatgtctctgtgcctagaaaatggttttaaaagttttcctttgaggccaggcatggtggctcatgcccgtaattccagcactgtggggaggccaaggtgggaggatcacttgagcctaggagtttgagattagcctgggcaacatggcaaaaccccatctctacaaaaaacacaaaagattagccaggtgtggtggttagcacctgtagtcccagctactcgggaggctgaagtgggagaatcacctgatccccagggctcaaggctgcagtgagccatgatcgcgctactgcacttcagcctgggtgccagagtgagactgtgtctcaaaaaaagaaaaaaaaaaaagttttcctttgacatagttattttgaagccatgattttattaatgccatcattctcaaagcttgcacatgaattttcatcactttattcataataataaaaaactaataacctagaattccatcaacagaggaattgataaatgaattttggaataattctaccaaatactattcagtaataaaagagaacagtattgatacatgcaacaatatggatgaatcactaagacatactaagcaaaagaagccaggcacaaatgattatatgtataaaattccatttagaaaaaaacaattctagaaaaggcaaaactaatttataatgacataaatcagatcagtggctatcttgggtcagaggttggggtatatttactgcaaaagggcatgggaggactttttggcatgatggaaatgttcaaaattagttgttgtgattacatggctgtatatgttcatcaaaactcactgaacagtatctttaaaatgggtacattttgttttatatcaattctatctcactgaaataaattttaaaagatattcctttggttgagagggtttccctgttccctgaataaaaaattggtcatctcatgacttagttggccactctcaggttattgaaagtcctatggtcactttaagtcaggtgttcacaaactacaactggaccgttttcgtcagtagagtgtatggggacacaatgctgcccatctgtggacctactgtctactgttttctcactacaacagcagagttggatagtcacaatagggcctaaaatatttactctctggcccttcacagaaaaagtttaccaattcctgctttaagtcacaaaacataatctcagttgaaaattagaatgttaatcattatttaaatcttcatttagttgtagagcttctcccctgttccctgttttcccagctccaactagatagagctgggaagatgtggtctcttctccctttttcactttcctcaccctccgttacgtagctgttgttgatttttgtcaggttgtggcatagagagagaagagagaaagttgagaggcagaaggtttttagtgaccagcacccttatcaaatggctttgggcttggtagacatttacagtggactctcactctcatggataccttagtggttcttcagaggctttcctgttgccccccctacccccacccctgcccctcaacccctttatcctgttgctccctgcgctttgaggcatgcctggaggagggagtcacagtgggcacccagcagctctccagacagaccctcctcacacagacctctcatttcccttagctgtgctttcttaattcttttatttttatttatttatttttttgagatagagtctcactctgttgcccaagctggagtgcagtggcgtgatcttggctcactgccacctctacctcaggggttcaagcgattctcatgcctcagcctcccgagtagctgggattacagatgcacgccaccacgcccagctaatttttgtatttttagtagagatggggtttcaccatgttggccaggctggtctcaaactcctgacctcaaacgatccacctgccctggcctcccaaagtgagccactgcacccaggcttaattcctttatattcttgaagacagtcaagggctcaagacaatgaaattagaattttaaaaaaattttcttatttttgagatggggtctcactttcttgcccagacaatggtgtgaacatggctcactgcagccttgaccttctggtctcaagtgatcctcctgcctcatcctcccatgtagctgggccacaggtgcatgccaccatgtctggctaattttttgtagagatagggtctcactattataagctcaggctggtcttgaactcctgggctcaagcagtgtttctgccttggcctccgaaagggctgggattacaggtgtaagccatcatgcctggctgaaattggtttttggatgtttcttatataaattttatacgtggtgatctgtttcacatcttacttggcactgatatgtctattgaaatctccatttaaacatcctgttaaacatagaaagacatggttttctatgctttataaaaagcctgctgcccttgacacaaggaaaaaaacaaaacaaaacaaaaaagaaagaaaaaagcctacccatttcattccagactattcagttttaaccaaagtattgttaaaatcctgactgtcagtagaagatgatctccttgtgataaactgagtggctttccacaggcttcattttcattacctcttatatgggtatatccatgtcaacctcatagaattcttgtaaggattaagggagataatgtatataaggctgctgtcaggacgttgcatagagcaggaactttgcgtttgtcctgcctccctctcttacacgtgacaagagttacatgaccttggcaagacacagtctctgtggagctgtttcgtagtctgtaaaataaatgactggcattagatattctctaaggtcctgctggtgaaacaaaatctttttaagttcttatgtggcatttagtttccacggaaagtgaattttagtttctttgtttctaactgtaattattctcacttagttgcatgaatgcagagggtatcctattgttaattttggagacaatcctctaatttgaattgagattggattacttccaggaaaaaagaaatcacttcattcaaatagatttaattcaaagtcagatttttctgagaacaatgttattaaaaatgatctatttctggacaaccccaaaataacctgtcacatcattaaaaaaaaaaaaaaaggcaagataagaagaaaagattttggagttaatagtgtccaaagatatccagtaagagtgagccaggcattccacacaaagtcaataaaaccatggggttcgtgttaccctttaatctattgtttctcctgggacccaatttgttcatagaggcagagagtacaagatctggatggcaactatagacagattctaacctccctgagggcaggggttgtgtcctacttgtcatgtatgcccagcctctagtacagtgctacagtgcttgccatgatataggtatttaataaaatttattaaatttattgaatctcacattggtactttttcaaaagtatgctaaagaacttattaatgatcacaaagtgccaattttcttagtactctaaatattgcactcttaatactcttaatactgtttcattcctcaccaactttaagattagcagaagcatttttcacctaagggaaaagctacatgggaaagagctggttgataacagaatgaaaaagggacaagggtattcagccattgaatacccagttcatcttctagaaacagcattaccactggcaccagggggttaaaggatgaattagatatcactcctgcccttgagagaaactgtaagctcaccagtgctacacaactcctactgttacacagggaactttacaccctcccctcagtggaacccatggaactgctttgcggcttctctttattaatagtttttaaagtgctgatgtggtgcttggtcacaaaatgttattgtttgttttctttccttcatcacccttctccttctccaccctcccacccccccacccacacacacatctgcagcttcatagtacagcgacacagctggcagcagatctattaaaataccatgctgatcatgtggttctaaaagcattaaaacttactggagtagaaggaaatttagaagctttggctgaatatgcctgtaaactctctgaacagaaagagcagcttgttgaggtgagtaaacaaggtgctaaagaaattgtagtttaataatggctttattaaactatgtgggaatgttaacacaaatacagttttgggttaatttatctgagcattttctctctcctttggcatcttaaaagcataccatgtatctgttctgttcctgcaacagtctggcctctaaaacaaaacaaaaaaaatgctaagacccacaaatgaacttcttaatcttcttttccttatcctctcagagaagttagaccttggagtagagccatggaggtacgtcgtatgaccttgtttctgtttgaatctgtcagggtctcagcagggaggagatgacacactcaaattaggacaatttgaagagagtttaataaagaagctgtttacaattgcatagacagggcatgggggaaaccatacatgagagagcagtaattggggcgagtggtagcaaggctggtaccaccccaggcccacatcagcaggggaatgtggaatggggaagcctttcagagaactgccttgagaggtttgtgattttaggactaggcccagagacagcccaaggtgaccctcccgggaggagcatgggagtcaaggcccattctctcctcagtcctgctcatctgtggatggggcttcccattggatatcccattaggataatcctaataatccaaacataggtgtagacaatataagtcagtctcccagggcaaaaggcagatgtgagaagggaggagagcagttaaggagggacaatgagaagacatctggcacatgattccaaatcttaattatgagttactgatgcttcacctgatacttgtgttataattccagttaggcttattaattgatattctgagccttctgcctattgaaaatgtcagatatctactagaaaaaaaacccaactgtattagtctgttctcactctgctgataaagacatacccaagactgggtaatttataaagaaaaagaggtttaatgaactcacagttccacatggcagaggaggcctcataatgaaagcagaaggcaaaggaggagcaaaggcacatcttacatggcagtaggcaagaaagtatgtacagggggggaactcccatttatgaaatcatcagatcccatgagacttattcaatatcacaagaacagtatggaggaaactgcccccatgattcagttacttccacctggtcccgcctttgacatgcggggattattaccaattcaaggtgagatttgggtagggacacagccaaaccatatcaacaaccaaacaaaaaacggaacccatgtatagcttgtatgtatgaggtatttgctagccaacatgtgtataaatgcacagatatgaaccatctagctatcttcacataatctaacataccctgttcaccaaatctcaaagactaatggttagaaggaacctttagactaattgaactggcttcctcttctttacttgtttacataggagccaaaaaacttctgggggaacattcttaaaatgactgtagatatagcttcttcatttaataaatttgatgctgctatgtttataaaccaaatattataactatagggaaactgcttattttaggaatcttgcagcaaatctttttaacattgaaaaaaaaaatgttctctgattttctgttttaagcgtcaagattttcagtaatttcctctgatatagggtctgtccttattataccagtctgcctaatccagtgttagctccattggaagacagtgttgatagaacatgtagcttgtagtaactctgacatagtttagctgtgagaccttgggcaagttacttctctgagccaaatttcttttttttttcccaaatttctttatatataaaatatgtgggcactactaggtctttccaaaggttctttctgttttaatattctgtaaccaccttgccatgattggataggaagtagaaacaatgttatacctttattgatatctgctttgttcccagagaatctgttggtgaccaatataatattataataatcttctcagtaatgtttaagtttattttaataggttttaagaaattttatttgtaaaattttctttttaattataaaatgatactatgtattgtggaggatgaggatgtgaaagttaaactgtagacatattgtcttgtagacctgtcgattgttacgacacatatctgggacagaacctctggaaataacctgtatacatgcagaggagacatttcaggtgactggccaacaggtatgataatagcagattgctccttctgtattgtgtcctatctgagtgttataacaagttgtgtggatggaaggtataaatggtttttcataactagagtccaaatatacatagagaaagaaagataatggaatttctgttggtagtgtgccagaacatggctaaccttccattggagctggtcatctgccaaattggagactggttcatttaattaatactctagtttatatctattttaaaggaagctgtttacaatgcacttgttataacatgtttggagattaagttatcatgacataagaagccatatgttatgtaatattcacatttcaacctaagattcaaatacatttcatgctaataattaggacatgagactaaaacacaaacaaaacaatgttatgacattacttacaagattcaattgggaccaggcatggtggctaacacctgtaacccagcactttctgaggctgatgtaggaggatcgtttgagtacaggagtttgagactagcctgggcaacacagcaagaccctctgtctacaaaaaataaaaaataaaaacaaacaaacaaaaattacccatgtacagtggtgcttacctatagtcctagctactcaggaggctgaggcagggggatagctttagtccaggagtttgaagctgtagtgagctatgattgtgtcactgtacaccaggctgggtgacagagcaagagtctatatctgggggaaaaaaagatccaatcagaagcaaaataactatcttaaattaggcaaatagtacattatagtgttaaaataataattatgataaccagaattagcaaccactgaaagaatgttctgttcaatgttaaatgaaaaaagtagggtacagatttgtatgtatacaaattattcccataatttcatatgtatagagaatatatacatatgaaaatacctatatgacaatatccttgtttagctagggtttttttctggattttctatagtagaggtattcatttgtccttataattttcaaaagcctttttaaaactgattatctcatttaatactgttcctgtcaaattaatctaaggaaaatggttaaagacagagcttcctcctttttttttttttgagacggagtctagctctgtcgcccaggctggagtgcagtggcgcgatcttggctcactgcaacctccgcctcctaggttcaagcgattctcctgcctcaccctcctgagtagctgggattacaggcatatgccaccacgtctggctaatttttttatttttagtagagacagggtttcaccatgttggtcaggctggtctgaaacccctgacctcatgatccccccgcctcggcctcccaaagtgctgggattacaggcgtgagccactgcacccagctgtttccttctttcttagagtctaagctctaaaataacgttttgcagttgttcttttgtttatttttttaaatattatttatattttaatttatactttatttatattcatttatttactgtcagccaaaaggattcctcctaacttgcaatattgggcagtagaggttgagtccctgcatctttgatttatagctgagaacagtgcaagtgacctagactcaacgatggtgtgtgccctctaggagaatcatgttggatgttggagggatgatctcatgctctcctgtagagaacagtgtcaaaggcttatcatgaaagcaggaactatatgaatgaacctccacaatgattatctgctgaacactttattacaaccaagggatctgtttactgggagaaactgtgtcttcaatattggcatgggagtcacttttcttgccttggctgcaaaagtattccaatagaactggagggcttgactctcctgccatatgcaatcagttgttgctcctatcctcaggccctgcttgccatctggttgcaatttttggtttattgttttattgcagcagagatattaggaatagccatattttcttccccaggatagtggcagagcatgttgttaataacctgcataacttgagaagctttttctgttcccaaagccttagcttccactcctagtctttgccatctgcctcacaaaaggataatttaaggacattgagcatgcctctgggataatttatttctggatatctctgctttggcaatgttatttttatacttcctttaaaatgttagacatactgagggaacagttgaacagtttgtacactagttgagaggagagcaatgccaaaatctagcctgtagtccatggcaagttatgtgcctgctttccctgaagaggggaaccttgttcttataacactgccatctgcttggcaagtgctgtgcctgtgacactatgcccaccccagagggaggaacagctagctgtaattcattcaaaggtaccaactattaatatattagctaacatggccctgtaattcattcaaaggtaccaactattaatatattagctaacatggccctgatcatattaatcttctgtaagttccccaatgactttctcactcagaagaaaatccagtccttaccatctatgcttctccattacatggccactggccaccttcctcttgctcatgtcagtctgttcctctggcttacttgctgttccttgaacactccagaagtgtttctgccccatcccaaatgacttcccctcgattttcctgtagctccctcaccttttcagtgactctctaacttaaaatactgtgaccacctaatcccctccatcattctcaccctttattttgatacatatttttattcccttctaaaatattttataatttattttaattgtgtctctcccactgcttgttataatgtgagtcccatgaagccagggacatttatctgtttcattcacagctgtttccccagcacctggaacgtgggcacagtgcctactagtatgtagtgggtgaatgaatagtcatgttagttgtatacatgtgtgtgtgaataatcccatataatcaactccatggaacaacaacatcacttgttagtaatgggcatctctatcacattatcctattaatttccctcatagcagttatcataatttatagtattttaattgtgtgcttgtttatagttccaaatctccactagagtataagcttcataatagagggcttttatcttctttttttatcaccttatccccagcacctagcatgattttttcacatagtggattctctaaaatactacttactagatgagtatttgatataatatccccagtctgtgaaacaagaaggtagacagaatcagtgcctgttgtcatgaatagaaggtgaaagtggtagaagggaaaggatctgctgtgaacatatcaagactgaactctgaattcctagctcctggatctttgtgtgtgtgtgttttatgtaatgggccatcaggaaatttcagtaggttgggtctggtcgatggcttctattttgaggtagaagctaaagtgtaatttctactgaatgtcaggtcaggaggtgtgtgaagactcaacccagccatccattttctgcctatattacaattagcatccatcaagtcctttgtgttagagagtgattattatatgaaagataaaatgttagttgattcattaattcattcatgtagtagctaacactaaataaaaccccaaatgccaaaatctcaggcttaatataatagcagtttatttctcacttgtattaagtcctgattaatggtatgtctttctccctcttggcaatccggtcccctttcattttgtgcctcgctagccctcaggacctcaaagtccctactggagcctgtgcattgaaccatcagatgtggaagggagagagcactgaggggcacgagggaggtttggatcagttaggatggaagtggtgacccacattcaagtggggacagaactcagtctcgtggccatatgtctccaccagggaggctgggaaatgtaatcttcctatgtatccagagggaagacaaacagattttgatgaaaacatagcagtctctgcaacaatttatttatttattcaacacatttatttagcccatgtggtggtacgtaaaagtaccaggatgatttctgccctctttacaagtgttttgtgagtggcagtgtgatgtgatggaaagagcctgaacttggatcaggtagatctgagtttagatatcaactctgtgtatactcgtaatagggtctggcacaagttactgggtatctcggagcttcaacttttccagctgaaaaatggaataatgcttatttggaaaaagtagtattttatttgtatattttgggggatattaatgtattaatgtatctcaaacaccaaacagtatctcaagcatgtatctaccaagtactcatgggtgtgtatatatgttacttattattatcactaccattcctactattaccactgctactaccaccaccactattactgctacctttgctactctgtatacagtacactttttgtggtctgagtataactgtttgaattattctatgggaacaactttgttcaaacagagttttacttgagtgaagagaattgctccctgaatgcaggtttgtatataataatgcatactatttgtctgcaggtcagattataagaaacagcaaattttgtcctactgtgcatcttcatattgcccaacatggagcttgtgtatagaaattacttcatagttgtttattgagttgaattgaacagcagacttacttacctttggtcttcaaagtgattctgagggctaagattttgaaattcacacaggtgtatattgtgtttctttagataatttctgctgctgaaacattgacattgcatccatctagtaaaattgctaaagaaaacctagatgtattttgtgaagcttgggaatcccaaattagtgacatgtcaacactgctgagagaaatcaatgacgtgtttgaaggaagacgaggtgagaaactgtccacataatgaaatatgttattattttaatgtaactcttgttagttttttaatgccaaacctcaactgcaaatgaattcttgtcgtaacccagctgggttatttttgtagtaaaatattgttcacaaaaaaattacaaaaatattattttatcctcctttattttagtatccaagcagtaaagtttgttgtacaacagtgtagtaggccaggtgtggcggctcacacctgtaatcccagcgctttgggaggccaaggcaggtggatcactttgaagccaggagttcgagcccaacctggccaacatggtgaaaccctgtctctactaaaaatacaaaaattagccgaatgtgttgatgtgcgcctgtaatcccagatactacggctgaggcacgagaatcacttgaacccgggaggcggaggttgcagtgagctgagatggcgccactgcagtccagcctgggcgacagagcaagactctgtctcaaaaaataaataaataaataaataaataaataaataaaacaaacagcatagtagatctctgaattaatattaacatcctagttttcctattgaaatagtcatttttaaatttcttctgaattgttttttaattataatacaacagctcttctataatgcagtaattctatgttttaattctactaacttcataatgaaatgaatgtagttatttgatttttgaattgctttccttccacttggatggaatctctttccttgatgactacataatcttggaatattgcctgtggtgggtaagttcattggtatttctacaacatgtagaatagtgccatacaatgtataggaaggcatcatttttattctttattttaataccgagtggaagttttgtttattttccattgtactgtgtgtcctgttatttatatttacatgtttatattttttctcttcaaatggcttctgtagtgtcaaagcttgcttatttttttaaataaaatgtcatttacaattatatcaaattacatattttttattgagtatgcccatttaaacatttcatattttaaaaatactcatttaggataaatgttaatttgcttaaaaatcagggcataatagaattatagctataacatcatttgtaaagtatgataaatgtttaccatgcttccacatttaaaaatttctgtgatagtctgaatggcaaatcattttgatgctttgtatttatagttacatagattttcatatgagccaaattttggatattaaaaggtaaatgatataattgatccacttttaaaaagaagagtggtcacttagccttagggactgttgggaaatgaagagaagtggcttgctgttgtgataagatacctggtgtgggttatcctggagtatctgtaaggcccaggtctttctcaaactggtgttaggcaagcttttccctgctccgggcccaagtgtccttgactcaataatgaaagtcttaggctcagtgatctcagtgacctgtcagctctaaaagtcttttgtgagcactacctgaagttagtgtactttcgacttctgggcatgaatataccctgcactgtgtctttatcctggctggctctctttaaaggccagaggaatattgtcttctggctttatcagttgtcatcagcccatgacatcagcccagtagggaggctggaggagtgccacaggatggctatttttctggcatgtgactgactttatgtacttgtaaacgtgttccacgtgcactgtgagaagctttactaatagctgcagccattctggaaagaatatggcatcaatcctggccagctgattctcctctttaccagaacaccattgagcttagtacaggtatctcctatagtgttttcagtgctgaagaggtttgtgttttcattcttgtaaacatgggctatggctgagttttcattacttgtacttcttccatgtccctaggccagtgagttcatcatcatctgaaatggatatggttctagttttcttgaccaagggcctgagcccccttcctctttgtgtttgagatgctcgcagtttctaaatcgggctgttctaccagcattttggtctattttcttctctcttttatttccataagaagaggagttataacaggcttttcccccctctcaagaaagatagcagtcatttaacagttattctctgccttaatcccaggcgatgttctgagtagcaattacggtagcaattagaggttgataagcttggcaagggggttttctttctataaatataagtaatttttttccttaaaacagaaaacaaacccaagttgcattttccatcaaggggtctcttccttcctctgagatctgagtgctaatctcatgttagggatagaattgggtagaagttgaaatacaggttctgaagtggactgcctaggttccaatcctgcctctgctatttcctaacttaatctctctatgcttcaagttttacatctgcaaaatggggataatgatgacaaaactacctaatatggtaagtgtgaagattaaataaaataagttaattcacagtaaattctcaacaagtgttacctctatcagcatcagcatcatgaccactgttaccttgtggtaaaactaaatagtttatgagaaaacattaggtccaatttctcttacttaatctcaatctctcctactttctggcatccatctctccctatgtcctttctcctactctagggaggactagccagtctggccccaccgtagaaaacctctagatctgcagaagcaaaggtaaactccttgcttctttgtacaaatgaagctcatcccttctccaatggtgaactgacaccctctgaaagattcctctcaccggacatctaatgcaacattaattcagtgttctccttttctgtctctgagatttgcctttcttctaccaaagttaggctctttaaaaaaaatagctagggaagtttaaggaaaagtaaaagccacaggctactagggtctttgtgggtaaaattgtaaacatgatccttcagaggcccgtgactattataaccataaaaataatagtagctgccatctcttgagaatgtactgggttccaggtactttcataagtgctggatgtccattttctcatttaatcctctcagtaaccctggagacaggtattatttccacattttatgtatgatgaaactgaggctcgaagtatcccacagtgagtaaactataggagctgggacccttactgaggtttgaatgatgccaaagatgaaattttattaactacccatactctattactcaagcagttaaactccactccaatcctaaagttttctaatgagaatgaaccaattctgtgaaaaatgctcacaactgcagctctgagttctgcttttttccctcccaaagctatttcagaaatgactgagagatcccaggaagtacagggcaaggaacaagtaatgactgtattcttgttttggttggtccacttattggctgaggatggggccagctaaattacagaagaggtaaaacaatctgttagtaatggaatcctgggcacattacctgcccttttgagtttgtttctttatttcaatggatgtaaatgaaataatgtgtaatactgcttgcacatcctatgcctgttttcagactatgtgagcactgtggtttcttttactttcaagctggatattatgtaaataatctcttctttaggttcagttaacttatgttaaaaaaaatcagcattacccaaacttcctaaggactgaacagaaattccttcttacgtgggaaacgcctcagccttcagtcaatgagacacttattgtttcactgggaaagtgcctctctgttcaggaagggtttatgtaggtttcattgagatggagttggttgattgtgtgtactgcctttatttgtcctgatttttatcatgaacctcatgagcatagctttttcctcaaagaagtccatctctgggttaaccattctgactgaactgaatccagtgccacagtgttgttcttcctgttatgcatggttgatgtgacaaacctgctcattaccttgcacctgcccactgctttccatacaaaggtgtattcttcaggtcctgatttctctttgctgctgttatgactcctgttatgactattgttgaaaagcctttgctgtattctagccaccttagttctgctctgcataacttgcctcctgtgattggcaaactaccaggcatacttgtaagtatcattcaaccatccaactaagtggtaaacatcacgctaagcaataggagggaggctttagtgttcacatgctaaaagttagtctgagacctaggtcattgtccaccttaaccccagacactgaaatttcacactaggacctcctgggattgtttcaagaaggtaaaaatcaatacttgtcttcctgtcttctgctttcatcccattctgccttctcacccaaacctccagggaggctgtggtccttgtattagaagggaccacacctaaaagactccacttttccttagtggtgaatatgtgtcagtttagaatttgagattattttggataataagtgtcagaaaaaagccttatctcagagcttgcggtctctatccttcctttaaggaagctgaattccctttgttctatttcaatcatttcagagtaaatatgactacgcttcagtttatagagatgcagctctaactaaactatgtagggcagttatgatcacaatcgtgccaagaatcttaatttggttttcagttctgtaactacttttctcattttcctggcagccctatttcatagccctgcatttacattatcgtttggcagattggatgccactaaaaatgggggtacaggaagataaacatgttcgtgggtaaagatgagtttgtttggggatggtaggagcctgcaacaagggagtgatctatccagagaagagatgatggtctatactagggtgatgatagtcaagatgaagataaggggactaagaagaatttaaaaactaatattggtagggtttattggtcaattgaatatagaggtgagggagagggaggagttggaggatgatagctgggtttagattagaatacctcattcctgctcctgagtttagctgataagctgcctatgctttagtggtcagggattcattttaagtgggtctggggacattaattttttgattgatcataccatatagagtgcctccagaactaaagatagctaattataagaaatgtgaatcagggataatttagcacattttcagtgaaatgataaggcttttccattcttggggaattcgatttattttgtagatatacagaaaggctctatatattgtaactgagaacatttctcaattaggttttcataagaaataattttagtgctcccttaagatgagagggcctttaaacttaattgtgaacttaatttatctgaaggtataaactcagaagatggcacaattgtagtgttgactaaacaggatttagggagtattaaacatacaatacctcgttgaggacagtgctttgaagacaattctatatatcagatctgtactaagtatattttctccaaatagtcctgtttttccaactatttttaatgtttataatatgatagagttttgtttatgctacttctttgatataacagctaaacataatttagccagtttattttattattattattatattttggagacagggtctcactttgtcacccaggctggtgtgcagtggtgtgatcatagcttactgcagcctcaaactcctgggttcaagggatcctcccacatatctagaactacaggtgctggccaccatgcccagattttttaatttttttcccccagagatgggagtctcgctgtgatacccaggctggtcttttttttttttttttttttttgatatggagtctcgctctgtcacccaggctggagtgcagtggcgtgatctcagctcactgcaagctctgcctcccgggttcatgccattctcctgcctcagcctcccaagtaactgggactacaggcgcccaccaccacacccggctaattttttttttttgtatttttagtagagacagggtttcaccgtgttagccaggatggtctcgatctcctgacctcataatctgcctgcctcagcctcccaaagagctgggattacaggcatgagccaccatgcccagcctactcaggctggtcttcaactcctggcctcaagtaaccctcccgcattggcctcccaaagtgctgggattatgaacatgagccaccgtgcctggctgagccagtttattctttttttttttttttctgcttagaatcaacggcaataattagattcacatggaaataacatctataattagccgagcgtggtggtgtgcacctgtagtcccagctactcagctactcaggaggctgaggcacgagaatcgcttgaacccaggaggtggaggttgcagtgagccgagattgcaccactgcactttagcctgggtgacagagtgagactctgtctcaaaaaaaaaagaagtgggaaataacatctataaaaaaattgggaaataacatctataattaactataatttagatctcttgttagtattagattgctttttcttgtgttattgtcaacttgtttggtttctgttggaactgggggaaagaggaagaatcttacctgcatagtatgtggaggaggcctatctgaaaaaatgatcaattttgcaattatcctcaaattcgtataaatcatgcagagtctaactaaaggatgggaataggaagcaaaacaaagtatctgtaagaggaccagagggattagaactatcaagtgataaatactactaggtggatgaaaatagtagcaaatcaggttacataaaagctttcttttcattggatttatttctcaatgcatttatttatacattctacttgctttaactctgtggtatcttagagatataagagataccgaaacagttggttttgccccaacttgtggagagtaaatatgaacattttagggccatgggcactatagatgattactaagttagataatacaagattactcctgtagctgatgacatttaagtaatgatagtgccctttcaaaattcaaaattcttttttctttattatttatttatttttagtactttcccactttgtttttttttttttttttttttgagacagtcttgctctatcacccaggctgaaacaaaacaaaacaaaaaacagaaaaaagaacagactacaggcatgcaccactacgcctggctaatttttgtatttttagtagagatggggtgtcaccattttggccaggctggtcttgaattcctgaccttgggtgatccacttgccttagcctcccaaagtgccaagattacaggcatgagccaccatgcccgggttcctacttctgtttaatgtgccctttataatatgctaagagcactttttaaaggatattatggacaggattcagactttgaattaagatagatggtgaattttgaaattctgagtgaccggaagactatcttctgttaatattgcaactaaatcgagcacttttcacatcagagcttagagccaaggcatgaaaatagcctcttcctttttaagttttttcccctcaccattctgaaatcagaaagccattaattaataaaattcccttacaattttgacattacaaggaaatgatttgaatcataaagctattcccaagtaccattaactcactcttagtaacagttcttcttctagatcagcactgtccaagagaaacagaacgtgacacacatatataatttgaaatttcctaggctaggcacagtggctcatgcctgtaatttcagcactttggcaggccaaggcgggaagatcacttgagcccaaggagtttgagaccatcctgggcaacacagtgagacctcatctcttaaaaaaaatacaaataaattagctggtgtcacatgcctgtggtcccagctactcaggaggtggaaggtgggaggaccaccggagcccaggaggttgaggctgcagtaagcctgtgatctccaccactacactccagcctgggtgacagagcaagaccctgtctcaaaaaaaaaaaaaaaaaaaattctaacaggcacaagaaaaattaaaaagaaacatgaaatttgttttaataatttttaacccaaatatccaaaataccatgtaaacatataatcaatattttagtatataatcaatattttaaattaatatattttatatattttttctccctttgtactacatcttcaaaatctgttatgtattaaacacttgtaagtgtttaatacacttacacatctcagtacagactagcacatctcagtacagactagatgtacacatctcagtacagactagccacatttcaagtgctaagtagtcacatgtggctagtaggtttcatatttaatagtacagttctagatgaaattttaaatatttgtataagccattctgagacaaacaggtttgcccatttcctgtaatagtcattctatgagaaaaggtatgatttagtgctcttatattatgtttacttttattagtttggaccatatgaaatttcaaaatggttgaataccagcaatttcatatggttcaaactattctattatagctgaatatacttgttttccttgaagaagaaatttttcttcaagaagcaattactgcttaggtcttgaatttttacctcagatgtcacaaaccagcatttataaaaagtctattattcattgtaatctgactgtatacatgacctggaagttgtaaagatgatagatggggcagggatgatgtgggcattgcccgtctccttcctttcctcgttatcatgcttcatgtgacgtgtcaattcacagtcaaaaaacctcctgttatttgctttatttcatcttcctatcttgtacagagggttttcttcttccctgactgagagaatacattatgaggttagttgtaaattatttggtctggtacttgcagaaatggaagaagcgctgatactggtactgataaaagaggaatcaggtttcattagaggcaaactgctgtaaaaggagcactctgtgaatgaagctgattgcaagtggcagtaaatgtcagtgggacatttgcctttctcccttaatgttgggagaggtggagattgaccagcataggtaccttagacatgcagctgttgaaagtcttcatgttcaccagccaaattacaattttatttctgaattttatgtaatgaatagactgttatcaaaactaatgtactaacattcctgtttgtttaattaatactttaaaagttaactatgaataatagaaaaatatattaatagaaaaaattttttaagttatatgtgttatttgtaggagagaagtatggctacctttcacttccaaagccaatggtaagtagaagaattatgtacattgcagaatgtttttattcagaattcaaattatgctcttgttgcctgttgctgctcccctctaccacaaataattgacatgacagaaaaaagttaggatattaatgttgacttcagagttgttattctgggtagcaatctagttgtggcttacactctgaatatttgttttaggtttgggggtttgagagaataggtaacataatttgtgattaataaaaagccatatcccagtaatagcatcataaaaataaataaataagccatatctgaagtcagaagttgttttgttcttccaatcttggatctactttgagaagtcatgttggaatcactttcagcaaactaaggactttcatatgctttctacctagatgaaaacatgtcacatgtcatacttatgggaaagagatacagagtggtatattaaccaagtagtggtcccaagatcccttttgggggacaaaaatattggaaattgtgggctgggcacggtgtcttatgcctgtaatcccagcactttgggaggccgaggcgggtggattacctgaggtcaagagtttgagaccagcctggccaacatggtgaaaccgtgtctctactaaaaatacaaaaacaaaacaacaacaacaaaaaaaattagccaggcgtggtggcagaggcctgtaatcccagctactcgggagggtgagtcaggagaattgcttgagcctgggagatggaggttgcagtgagccaagatcgtgccactgcactccagcctggccaacagagtaagactgtctcaaaaaaaaaaaaaataaaattactgatgattatcaatagtaacagtgtggtgaagaacaacagatggtgagtatcagaagagagaacttgcaatgaagagagatattaaagtcttaagtctggaattttagaaatgatagtgggaatgcttgatggtgtaggggaagaacaaatgataaatcaaatccccaaatcaaaaaatggtccaaacttaattagtgtactttttgaaaagggactggcatttaatactgaaatacaacattaggaactgaatgtagctggtgtaaaagcgatcatgatactgcaaattaattctgtgacttaaaaaaaacagtttttgtgccttaagctattgtcagaacagtttgaaagtacaaatagcaatttgtctatttttgttattttaagataaccctaacagatggttttatagctaatatcctactgggtttaagcaagtaaggatagactcactgtttttgtaagtgctataatttagggctactacaaaataattttttgagaattagaaaaggcatcacaaagcttttaacaggttgaatggaacaaagattttattcaactgaatagtattttttatctttagtaacaaatcatttcagagtcatgaaccattttcttagttgagggatagcatagctaattatattcctagaaaattatagttctctcttttaggaagtgaagttggagtctggtgctatttatatttaggggactgacgtcttttagctttatataactgaaacgaatgaatctgactgcattccaaaatagtgtccactagatggcaagcttggttacattattaagatggtttatttaccttttcaggcaattccatttcagtcgtcattaaactttaataatcatcatcattagtaaaagtaaaaataaaaatcatgaaaatgcaactatatttaaaagaataatataaagtataaaattctgaataaaactaaacctaaaaaccttgagggtgttccttactttcttaaatgttttatcagttgccttatagtcaactagaccaaggatggagataaagatgatgtgaccattcaaggaggagccagagagatcattggtcatatttgtttattctctctctctctgtctttgtctctttctctctgtgtgtgtgcatgtgtgtgtaacaagagttcctttatttttattttctgtccttcaacttcacctgtttctttaatagtaaacatcattagaaaatctcaaaagggctatgttccatgagcagatctaaactccacgaggctgttttgttctgtggtgaaactggtgacagaatagttggtcagaagtaaaaagtcatggtaataagggaaataaaaatatatgtatgagaagatctttttccttaaagtattagtgatgattttccttcctaagctaagtgtacacatgagtgttttgttttattgtaatttatactgtgtgtgcaggtatgtgaatccatacccaatgtgtgtttgtgagtgtgtatgacttaaatatatgtttccattgtaaaaagttggcccccttttctctacaaaccctagctgttctgggactcctgcctctaccatgggagctttcaccagatctcagagttggaggaatcccctctgtgggctatcatctccagagaacttcggaatatatttttcaaagaaatgttgctattggtggtggtgtgatttgtcctggtactctattcttcaagtatacaggcatcagtggactagcctggtctaactaggatggaatattttctccccttctagggaaaatacactctgagttccagatagtttacatgaaaacaaactttctctttcaaaaatagggaaccattgaacattggttcacatattaaattcagaatcctaagtataatctctttataacttgggatatgagattagcagttgtgatatctatgaagctagagagttgaaatttagccttccaagagcaaattagttaaaggaattgaattctggagtcataacataaggaatgtatagaaaactacatatagtggctaattttaatatatcatttcataagaataattcaagcattataagaatcttgttgaacagagaagccagggaggtttgggggacataataattggactccaggaatactgcagaagttgtcttgagtccctggaagcccttgtgaaaagaggagagcagctgtaagcacagaggccacagagcagggaaggcactgacttgctttctctggctccagatttcaaactaacaacctattcaaagctgaactcacttactagtagagtacttgcaattggtaaaatattcagtcattacatactgaatattttaaacttttgttacaagtactttgttatgctttgtattactattgtatttccttacagtttaatgtactgctttttaagataatcttaatctttttattgtcacagaagaataatgcaaacctgaaatcattaaagccagacaagcctgactctgaggtaagaccaattcctacatctaatcttcctttaacatgaatagtgataaagtcgttgtgattaaaacgtctgtttcataggagcaagccaagatagcaaagcttggacttaagctgggtttgctcacctctgacgctgactgcgaaattgagaagtgggaagatcaggagaatgagattgttcaatatggacggaacatgtccagtatggcctattctctgtatttatttactaggtaaatgtagttgtatttttattttttaaatcagtataatgatatctggtgtaaagaaaaaagttccatgttaaatcattgacaggttaaagtcggtatcaaatatatggtaaaaagactaaaagtagttactatgacaatttacgtaagtgaatgcaacaacaagacacatgtatttaattaggatttagatttagaagggatcttctgctaggtttctgcccactctttccatcattgaaataattttacatcctgcttttttgttatcctgcattgttaatgcctctcccagccagcatcagtacgttaagaaaacatgtcttttatgcctttatacagtgattgactagatacagatgaagattgattagacacagatcaaagaatagagctatgaggactatgtcaatagcgtgccaaatctctgtgagtcaccattcattatgtagagaattcccctaactttaatgttatctgacctatattctctgtcttgatcatattacaagactcttgatcaaatgccttgttgatgtcaatgttagtcatatttcagtcttccattttagtaatttatacataaggtatagtaattctgcttagttaaaatcagttatctgctcaaaaatcccttctagaattttctcaaggaataacttcaagcttttcactcagtttctgaaatctatctttttcatttttggaaacctgggaaatacttgatatctccagttttctggctcctgtcctactcattctgattttggaaaggttatccaccgtgggacacacctgcaggttgcttcagtattctagagactgaagctcaattaaagtagtgaaggatctctacaactgtgtgggatttgggactcaataaatagcaccccctgccgggcatggtggctcacgcctgtaatcccagcactttgggaggccgaggtgggcggatcacgaggtcaggagatcgagaccatcctggttaacacactgaaacccggtgtctacttaaaaaaaaaaaaaaaaagttagccgggcgtggtggcgggcgcctgtaatcccagctactcgggaggctgaggcaggagaatggcgtgaaaccgggaggtggagcttggagtgagctgagatcgcgccacttgcactccagcctgggtgacagggtgagactccatctcaaaaataaataaataaataaatagcaccccctattcccacccaagttttgaacaaaatgaaaaataagcaaaagaataggtagatgggagctggtaacatttatattgataaagctgatattggagaaagtactttatgtccataggcaattaagttttgaaaaatgatccctagaattacaaagtcttacctcatagggacacaatgtatctctataaaacacatggaagaccagttatatctcaaaggcagcttcacttccaagagaaaaaggagaaaagaaagggttaatgtgttcaatttatttttgcaaagtcaccagaaagactgaaaagatgagcatccacctccttttatgggatgggataggtgaggcagcagacagaagtgagggatcctgtgctcgtgaagattccttcctatagaaggaggattaagagtggggaagatgcagtcccaagcttagaggcatcattttcctcttgatgacgtcttctaccttttctagatagataattctctggaaaaagaaggcagaaatgataggagttagaaattttgctgctgtttagctgtcatttgtcagtaccttatcatattttccatcattggagaccattcctttggtggtttccttccattgttcttaactgttgttagcaagcttatcctgtgattgagtcttcccaacatgaattttgacctttttaagttcatacctttttaaaatctgatggcccaggcctctaaaagaatgcaaaatggaactcctgtgtttacccacaataaatttgcacagactaactgaaataacaaaaatctcagcttttggctggaatcaagctagttatttccatggtgatgaaaatcatgcttttaaaaaatgtttttgactaataagacttgggggaatatattattaatgaatatagtttgatatgtaaaatattcccaaatgaagggttcatcaatagacttgcctggtttttttttttttttttttgagatgtagccttgctctgtcacccaggctggagtgcagtggcatgatctcggctcactgcaacctccgcctcctgagttcaagcaattctcatgccttagcctcccgagtagctgggattacaggcacacatcatgacgcctggctaatttttgtatttctttattttttattttttttgagacggagtcttgctctgtcacccaggctggagtgcagtggtgcaatctcggctcactgcaatttccatctcccgggttcaggtgattctcctgcctcagcctcccaagtagctgggattacagttgtgtgccaccacgcccggctaatttttgtagttttagtagagatgggatttcaccattttggccaggctggtctcaaattcctgacttcaagtgatctgcccgcctcagcctcccaaagtgctgggattacaggcgttagccaccacacctggcctaatttttgtatttttagtagagatagcgtttcgctgtgttagccaggatggtctcaaactcctgacctcaagtgatctgcccaccttggcctcccaaagtgctgggattacagacatgagccaccgcgcttggccaactttttaaaaaaagattatagcatctcctttgattagttttatttcagaatatttcaggatggcatgctcagtattttttgtttcagtgtcagaattgtagagtatcccatggacactgggaaacatgaggggttgcactacgaggggaagctctgtggaataggacttcttcctagaatatagttattggatagtagtgatgacattccagaatagaaaatggatttttctgtaatagataaataccttgtagcagttttcctgggcagatttatagcccttcttcaggttactgtttaaggttgtcttaataatttatatgatttcttaatgatttacatgtaatcattcatatttcttaataatttagatatttaaggttttctagtgccttatagtttttcaatatttcaaacatactagtaccttattgtttttaatgtggtttttgcttcatcatttcatttgattttcatgacggtttactggagaacaggaatgatatgttcacatctcctaagtggcagaactggttgctactagattccagattttctgacttatccctagtccattgctcttcttaatgcatttggttattcttattgtaatttacttttcattttttagagttcttaattcttcttggtagtttttaatctgctgttcctcaatcttctgatgagagtggtagcacaagtattattatgattgctttattcactcaaaatagaatgttcagtgatatgcctcatcaaggttagataactgagttactaccagaattgaaataagaattagaagtgaaatgtcctgagttttggtttgatcctctttccattacgtaacaaaggctttcggtcaagacattatcaaatctcacatatttaatttatgaagtaaaatgaaaaaggttaaaaagagaaatggaacttaaatattacttgtttaaaattttttatattatgaaattaacataaggtttacttggggaaaaatatcttaataaataattgtcaaatattaaagttgctttaagcataaagttacaatattatcagtctattcatattattcttcaaaatttaggatttgttaatacacaaatgctctaaaattttaatattataaagtcaattttcaggtaataactttttgttaccttcttaacaattaattttattttagaggagaggggccactgaaaacttcccaggatttaattcatcaactagaggtatgccttgtttccgttttatgctagtactttaatttcgggctaaaagtgggtaataaatgttttccagatgatttattatatcatgtgtatatgcttacatctgtacctacctgtgtattacagagagcagtagaaaagtagaaaggtagatggcttgcaatgacattttgcaaaactatcctgacctcattggaaagaaacttaaatattatgagcataaagtagaatgggctttgttggtagtcaatagatgcaataataagctttaggtttacctaagtaggtgaaaatatcctgtaagcagatgcaaatccagagttctagaaagatttttggcctcttcattattgaattggataaaatatattgattaaatgagataacacatgagagagtatctgttaaaatgcttaagactattagagggtattaagtacatcttagtttccttctttccttcagtattcatgatgatttagggcattaaaggagagacagatatgctaacatccactcttgtgccatgtgtcttaacaggactccacataggcccatctgtaattctactccctctagttagaggctttagattggcaagtgggttgcaaaattccttttatgttttccctgatccccatgttagcctgtttgcctctctagaaccaagagcattcttgtgtgtaaatttgaaatttctgtcactttatcactcatatagtctcctttggcattcccatgtacatctgagatttgaaatttctatcactttaggccaggcgcggtggctcacgcctgtaatcccagcactttgggaggccaaggtgggtggatcacgaggtcaggagatcgagaccatcttggctaacacggtggaaccctgtctccactaaaaatacacaaaattcgctgggtgtggtggcgggcacctgtagtcccagctacttgggaggctgaggcaggagagtggcgtgaacccgggaggcggagcttgcagtgagctgagatcacgccactgcactccagtctgggtgacagagcaagactccatctcaaaaaaaaaaaaaaaagaaagaaatttctatcactttatcactcatatagttttatttggcattctgtgggaaagggatttcagcttaagaggatgattgtcaacataatcagaagtattatagaaaatgtgtcttctggatttttctgtaaagcagactataaatgagctatttcccttaagatagttgaaattctgaatttattttttttttcagtttggcccaagtccattctgtcataccgccctgtaggggtgttttactacaaaagatccactacttaccttcttcctatgtgagcttagtcattaaatcaatgttcaatgaattgtctccaaactgtgatgaacataaaattgcatacttcattcaacaaatatttattgaacttgtgctatatgtcagatctgggagaacagagctctgtggagaaaagtgaacaaagcaaagctcctgcccccatagagcttatgttctaatggcagaatatagacaataagaatttaagcattcagtgcacatatgtaagtacttggagataaaatcacgtacgactagaatacagaggtgatagaggggtggtcagaaaagacctctctaaggagccagtgtttgaatagagacagtaatgaagtgagagttggatggataaatgtgggtagaggattttagatagccaaaacaagtgcaaagccccgaggtgcaggggtagggctgggtgtatcagaagagtaaggaggcaattattgatgggagtgaagtgagccagaaggaaaggggtaaaatatgatgtctctgtaggccatgggaaggacttttttttttttttttttgagacttagtctcgctctgttgtcaggctggagtgcagtggcacgatctcggctcactacagcctccgcctcccgggttcaagtgattcttctgcctcagcctcccgagtagctgggactacaggtgtgcgctaccacgcccagctaatttttgtatttttagtagagacagggtttcaccatgttggccaggatggtctcgatctcttgaccttgtgattcgcccgcctcagcctcccaaagtgctgggattacaggcctgagccactatgcccagctgatcctattatgttttaagtaaggtttttggcttggccaacagagtgagtggtagtgccattttctgagacagggaacactgagggagaacactagatttagagggtggaaatcgagcattttgttttgcacatgttaagtacaaaggtcagataggatatacacttggccctccctatctgcaggttttgcatctgcagattcaaccaactatggattgaaaatattcaaaacagtaaaaacagtctgggcacaatggctcactcctgtaaccctagcactttgggagaccaagctgggaggatcacttgagtccaggagtttgagaccagctggggcaacatagtgagaccttgtctctacaaaaaaacaaaacaaaaaaaaaaaaaactagcggggcatggtggcacacacctgtaatcctagctactcaggcagctgaggcaggaggatcgcttgagcctgggaggtcaaggctgtagtgagctgtgatcacaccacttcacttcactctggacaacagagtgagaccctgtctcaaaaaaaaaaaaaaaaggaagaaaaccaataaaatataacaacagtaaaaaaaaacaaaatacattttaaaaggttagagttccaagggagggaaaacaatacagtataactgcgatttacttagcatttacattaacttagatattataatttagagatgagatgatttaaagtttatgggatgatgtgtgtaggttatatgcaaatactacactgttttatttaagggacttaagcatctacagattttggtatccttggggaggtctgggaaccaatctcccatggatactgagggatgactgtacaagactgatgtcaggatagttcaggagtggagagagagacctgggagttaccagctttcaggtagttttaaaaccatcatactgtatgagacagacatggattttgtccccaaggggtttgcaggctagaaggaaagagaaaatttgcagaatagaaagtggtaacatgaagtgataaggaacacttggggaagtgaatcatttcatttggttggagtctagatgtaaagcttactggtttcccttttaaagggaaggttgcaaagtacgatttgaccttgagatcattttatccagtgatagcaaggtgttaagccttttgaatagagggtaaaaattaaccctggaattattgcctcctccttcttagtattctttaatttattatgaagacctattattttcattcacaaaccactctcagattttccctgttctctccattattactgacgccacctaaaactaagccttcctccctttactcccctggcatctcactctaaaatagtctgcaaaccattttaacataatatgctaaatacttctgtcttacctgtacaaccttctttttcactctacttctccatcatcctgttcatctcattaaattatagaattcatggtacatggtgaatagtgaaaattaatctgaaaaaaagtggcaacaaaaaccaaccacctggattggttctctcaaatgtctggttatggaatatgtatgggtgacaaattttgtcttgcctagatggaattgggaaggtcctaacccttttgacctcatgcttgaaaattcatcatccttttataattgagcatatttgagatgagctctaggtcccttgcgtaatctagacataatttgtgtggctgaatatcacaggtctgtgtgaccctccagaataattggaggtctggtgtagagaagcctctccagggatggattctgcatctggtctgtggaaactccttctgaaaacagttaaacccttgtgcattcctggtactggaaaaagtttaggagttcctgacagactttttatatctaggctttatttttaaaattctacgtaaaaattattagtaagtatatttcttaccaactatccatagacatcagtctaaaatagtggtgttttctctttctaccaggtttttgctgcagagggtttaaagcttacttccagtgttcaagctttttcaaaacaggtaacacatgtctacctacctggagctggtggtggtattatgtataacctactttgggggtataatatcaatgtataaatgtgtttaaggtattaaagatggagttttgttgcgggctgttataacttgttaaattacatttcagctgaaagacgatgacaagcttatgcttctcctggaaataaacaagctaattcctctatgccaccagctccagacagtaactaagacttctttgcagaataaagtatttctaaaggtaaaagagacatatgaaaaactttcacacatctatctttatctggttaaagcccctttttcttcaaataaactgttagtacccacagaagggcaatttatttccttttttcatgccttgtctacaagaatcatttattatctactctcataactgaccccagagagtagcagattcaccaaataaagtagttttttggacatcattaattccatagcactgaacagctgcccttcaattctgaagtcattacctctgcaactaggacacaggtgcctccgagtctggtctcccataatttgtctgagagaatatgggtttgtgcccacaaaatagagtgcaaggaattgcaaaggatgggatttaattccactatttggagtgttttgagaagcccctaaacagcctgcagtagaatgattaattttccacccactctttctgctggggttccatgagatagacatgaaatctaggcagctacccctgcacctgtgtcctggggctttgagtcagctcatgtgcctaaatccatatctctttcaagatcccttagatttccatatggagaaattttatcatgttaaaactaaataaatggtaaggtcttttaagtactacttttagaatatcatttgcatgctttttgtcattgtaggttgacaagtgtattacgaagacaagatccatgatggctctcttagtccaacttctttcactttgttataaactgctgaagaaggtgaggtagtttttctattttagactcatactttaaaaaatggtttaaaagaaaatagttactacttaattttgtaatttttttttcagagtgaaaccagatactaattgtcttaactctttccagcttcagatggaaaataacggatgggtctcagttacaaataaggacactatggatagtaaaacttgagaagcttttggggtcagatctctggaacatcatgtgatgaagctgacatttttaaaaatcaaatgatcctttatcttttcagaaattcatcaattttataaagaaaacaatattgaaattttgctctattttctgatcatgaaactgattgtaaagctttttgacaactaataaatgtcttggtaattgctagattctaattgtagtgtgatttttaaaatagaacattgcactaatgttctttaaaagtcaaaccaaatatcccaactgtctcaaggacaatttaatccacaagaagctattttgaatatgtgcttagctttggcatattttaccttaactgttttctttatcatctagatcactaatgtcagcagcaaacatacagtagtctgggtgaatgcagggttttccttaaacctgtggactcttcaatccctctgtttaccaagtgtgacaaaaatccccttgatgaccctgtcccagattgtccatgccagcagcaagtttgttccctaataagcattttgtacagcaagggtgggtctgctgtgctgtgtatgtccctcacctactcccaaaagtaaggtaatggaactccacagaatcctggaacaactcctggagagtatgagatgggtttttggttctagttctagcatagctggccagtctgccctgaatattagctgggattctaagcctatcttatagacttaaaagatattttgaactttctcagtattgattgatggaatggaagacaaagacagaataaggaagccaagaatctatttaaattctgaatatcacacatttgaaatgttcactataaaacaaaacaaaaaacatctttctttagtctttttaatttaggagtttaaagcttttcttgtttttgtgggtggggtcatgattgaaggatctggtttataggttttctccttataatatagtatggccaactttgtgttagacttcagtcgtagtatttgtatcttaatgctttgacattcattttgaaatctaacagggtatgtcagttatcaaatggcagtagataatataagcttatctgatgatctttatctgggtcagccaccacaatcagtattcacaaaagatccggaagaaccacagtaatgccaattgaccacagctagtcaatattttattgaggaaaattttcactgtagtccttcgggagaaaatgtgatgcactcagctctgttaataacctttttaaaatctttccttaaacagtcaaaatcattaagcatgatttttattctctgaaaccaaagtactcttttaaattacaatagaaataatgggagaatgatgtgaggtaatgttacatgtaaaatgttatacacaattcttttactacgtttactgtcatagttttatgacgccttcaagagtcattgtgctacttaaagtgaggatctgctggtttgtttatattttcagctaatagcaccatcatggaggtgtttatccacttactacatgtatcatgtctggggggtatatttagggggatagtcatgctggcactcagattacaagtttttcctatgaaccaaaatgttgttttatttacaaaataagtaagtattattttgtaaataattaaaacttaaaaattccaacccccacttgtactttcattagataatatttttgcatacctgaaaaaatactgttctctagtgaaagaaagagcaagtgggggttgggaaggggtaacttatgacttcaacagcataagaggatagataaccaatggaattaatacatcgaatgatttcttctgtataaaagtatattttatttaaaaacagtgatattgacatgtatgttatagcccttacagaaaaataacacgttttatagtccttttatttgaaattcagtgtaaatcactcttaaactataaattcacagttgttggaggtttttttttactttaaatgatgtgaaagcatttgttccattcaaaggcccctatgcctttgaatgacatattctcagtaacttctttgccagtaactagagtatgtgagactgagtaactataatgtgcatatttcaagaattagcttcccgctgcattataacacatttcctaggaaagcctttgtatttttcatagccttttcacatatccctcatttaagaagtcacagtgttgc

SEQ ID NO: 12287 - DNA, 285986 bp, Human
  misc_feature (1)...(285986): n = A,T,C or G
gtctttatgtctgtgtgtacccaaaatttagctccagcttataagtgagaacatgtgataggtggttttctgtttctgcgttaattctcttgggataatggcctccagctgcatccatgttactgcgagggatgtgatttcattcttttttatggctgcatagtattctatggtatatatgtactgcattttatttacctagtccaccattgatggacacctaggttaattccatgtctttgctattgtaaatagtgctgtggtaaacatacaagtgcgggtatctttttggtagaatgatttgtgttcctttgggtatatttccaataatgggattgtgggtcaaatggtagttctatttttagttctttgtgaaatctccaaattgctttccacagtgactaaactaacttacattccccccaacagtgtataagcattcccttttctctgcagcctctccagcatctgttattctttgactttttagtaataaccattctgactggtatgagatggtatctcattgtggtttttatttgcatgtccctggtaattgatggtgagcattttttcattcttgttgggccacttgtatgtcctcttttgataactgtctgttcatgtccttttcccactttttaatgggtttatttgttttttgcttgttgaattaagttccttgtagattctggatattagtcctttttcagatacatagtctgtgaatattttctcccattctgtaggttgtctgtttactctgttgatagtttattttgctgtgcagaagctctttagcttaattatgtcccacttgtcaatttttgtttttgaggacttagacataaattctatgcctaggctgctgtccataaggctatttcctaggttttcttccaggatttttatagtttgcagtcttacatttaagtctttaagccatcttgagctttttttttgtatatggtgataaataggggtccagtttaattcttctgcatatggttagccagttttcctagcacactttatcgaatagggagcccttttcccattgcttatttttgtgactttgttgaagatcggttagttgtaggtatgtggctttatttctgggttctctattctgttgcatttgtctgtgtgtcttttttttgtaggagtaccatgctcttttggttactgtagccttattagcatagtttgcggttggttgtaatatgatgccttcagctttgtcctttttgcttaggattgctgtgtctatttgggttctttttttggttccatattttataatagttttttttcttctgtgaaagaaaaatgctgttggtaatttgacaggaatggggttgaatctgcagattgctttggacaatatggacattttaacgatattgattctttcaatccatgagcatggaattttttttatttgtttgtgttgtctgtgatttctgtcatcagtgttttgtagttctcctagtacagatctttcacctccttggttgggtgtattcctaggtattttatttttttgtgtggctgttgtaaatggaatcgtgtttttcatttggctctcaggttgaacatcattggtttatagaaatgctattgatttttgtatgtagattttgtgttctgaaaatttactgaaatagagaacatatgatgtcctctcttcctatttggatgccttttatttctttcttttgcctgattgctcttgctagcacttctagtactatgctggataggagtggcgagagtgggcatccttgtctggttccttttcttaaggggaatggttccagcttttgtctgttcagtattatgttggctgtgggtttagcatagatggttcttattattttgaggtatgttcttcaatgcgtagtttgtttaggattattatcatgcaggaatgttggattttgtcaaatgcttgttttgcagccattgagatgatcatgtggtttttgttttgaattctgtttatgtgttaaatcacacttactgattttcgtatgttgaaccaacattgcaacccaggaacaaagtttgcttgaagcagtgaattagctttttgatgtggtgctggatttggtttgctagtatttttttgaggatttttgtgtctatgtttatcagggatattggcctacagtatttttttttgttgtgtttttgccagattttggtatcacaatatgttggttttgtagaatgagttaggaaggggtcccttctcttcaatttttggggattgtttcagtaggattggtaccagctcttctttgtatctctggtagaattgggctgggaatccatctggtctagggcttttttttttttgttttttttttttgtttttttttgagacagagcttcactctactggccaggctggagtgcagtgctgcaatcttagcccactgcaacctctgcctcctgtgttcaagcaattctcatgcctcagcctcccgattagctgggattacaggcgtgtgccaccatgcctggctaattttttgtgtttttaatagagatggggttttgccatgttggcctgtctggtcttgaattcctggcctcagtgatctgcctgcctcagcctcctaaagtgttgggattataggtgtgagccactgtgcctgactagggcttttttggggttggtaggttttttataactggttcaatttcagagttcattattagcttgtccagggtttcagtttcttccttcttcagttgtgaagttgtgtgtttccaggaatttattcattttctctagattttctagtttgtgtgcatagaggtattcagaatagtctctgaggatcttttgtatttctgtgtggttggtcgtaatgtcacctttgtcatttcagattgtgcttatttggatcttccctctttttttttctttgttaatccagccaatggcctgtcaatcttgtttatcctttccaagaaacaacttttcatttcactatatggttttctttacatggctttttgggtctcaacttctttttgctctgctctgattttaggtatttcttttctcctgctaattttgggatttgtttgtttttgtttttctagttcctttagatgcgatattagatagtttgagatctatcttcttttcatttctttttatttttggtggcagggtctcactctgtcagccaggctagaggtcagtagcacgatcatagctcacagcagcctcaagctccagggctcaaacagtcttcctgccctagcctgagtagctaggattacaggtgcatgccaccatgcttggctgattttcagcatttttttttttttggtagagatggggtcctgctttattgcccaggctggtcttgaactcttgggctcaggtgatcctcctgccttggcctcccaaaatgctgggattacaggtatgagccaccatgcccaggcctttctgtcttcttcttcttctttttattttattttttgaggtagggtcttactttatcacccaggatggaattcagaggcacaatctctgctcactgcagcctcgacctcctgggttcaagcaatcctcccacctcagcactccccaagtagctgggactacagcaatttatttattttattttttgaaattttttgtagagacaggagtcttgctatgttgcccaggctggtttcgaactctagacctcaagccatctgcttggcctctcagagggcaagaagtacaggcatgagccactgcctccagccatttctatcttcttgatgtaggtaggcatttagtgctgtgaattttccttttaacactaattttgctgcatatcagagattttggtgtattttacctctgctttcatttgtttcaaagaatttttgttttctttcttaatttcgttgtttgcccaaaagtcatccaggaggaagttgtttcgtttccatgtaattgtgtggttttgagtgtttatcttggtattgatttctatttttatttcactgtggtccaagcacatacttggcatgattaagattaaaaaaaaatttattgagacttgctttagtacccatctggaagttcttgttttatgaatctgcgtgctacaatattgggtgtatatacatttaggatagttaagtcttcttgttgaattgaactttttatcacgtaatgatcctctttgtccttttttattgctgttggtttaaagtttatttatctgaaacaagaatagcaacccctgctcttttttgtttttcatttgcatgatagatctttctccatccctttactttgaggctgggggtatgagttagtttcctgaagatagcagaaggatgggtctttttttatttttttcatttttaaattcaacttgccaccctgtgtcttttaagtggagtgtttagactgtttacattcaaggttaatgatacgtgagatttttttcctgcggtggtgctgttggctggttgctttgtagccttgattgtgtagttgttttatagggtctgtgggctgtgtacttacgtgtatttttgtggtagcagatactgtttttgtttccatgtttagaactcccataagcatctcttgtaaggccagtctagtggtaacagattcccttagcaattgctaatcctgcaaagattttatttctccttcgcttatgaagcttaatttggtgggatatggaattcttggctggaatttctcctaggatgctaaatataggcctccagtctcttctggcttataagatttctactgagaagtctgctgttagcctgatgaggttccctttataggtgatatgactctttttctagttgtctttaagattttttcttttacatagaccttggaaagtctgatgactctgccttgatgatggtcgttttgtatagtaccgtacaggggttttctgagtttcttatattagcatgttgacctgtctagcaactttggagacatttttgtggattatatcctcaaatatgtctttcatggtgcttactctttcttctcaggaatatcgtgggttgtaggtttggtcactttatgtaatcctattatttctcagaggctttgttcatttgttgaagattctttttctttatttttgtctgactcagttgcttcaaaggattggtcttcaagctctgagattctttcctctgcttggtttagtctgttgttaagcatctcttataaggccggttgttaagatttttaattgtattttgaaattcctgtggtgaattgaatttcagattggttcttccttagtatagctatgttatattccaaatcttggattgtttttctgacttccttggattggatttcaaccttctcttgggtcttgttgagcttccttgccatccatattctgaattctgtgtctataatttcagacattacgttctggttgggatccattgctagggagtatatgcaatcctttggaaataacaaaacactctaactttttgaattgccagagttcttgcactgattacttctcatctgagggaactggtccttctttttgtttttgaatttgctgttgattgaatgggttttttttttttaaatattcttttttcccttgagagtttgatggtggtaaatgttgtgtatagtcagttggcttcatttctgggtgctttcagagggccaaggctctgtatgagttccttggttgtagataggtttctatgagggtttcacaggctttgcatgttgaagcagtgtattttgttttgctgtgtaattcaagctgcagttggtgcttaaatataagggcagataggctcttacacagctgcgcatgctccctttgtatttcattgtgtcctcagcagtgctctggagagaggacgcagggtaagagatgactttctctcatagtctgttcttaagccttggtggtatccccctcagctactggcactgtctcacgtttcctttgctctgtgtggggctttggtgggcttctcttcctgctcgcttagatatgattcaagccaagggttaggccaccaggagacctgaaactccttagggacctaccagtcccctgtgcttgtcagtaagagtgggttgtggggtatgtctgcaggtggtctggtaatgcagtgggtcaagcaagggtggtagatcctcaggcagggaagtggcaccgtatgtgtgtgtagccagtatagtgaccatggcccgggtttgcagcccagccgatggctgtgtggccctcacaacttgcactcccctgacctggttggtctctgtctgatgtctgtctcaggagcaggcgcaaccagactggccaggcttgtctcaaaagccctgcgtgcccagttcgttgagccatttcagatgctccaagccacggagcttcctggggaagaaaccttggctggctgtcaggccacacccatcctggactggtcttctgaagagaggttgcttagtttccatgccacactcttctctgtattctgagagtgaaggctcctttcctgcccaagctcaggccacagagcttaactcaatacccctgggcagtgtgcttgagtcctggggaagtgggaccaggcctgcacatttgtcctctggccccttaggatcagccagcaggctgccagcagaacactcaggcagggaagtggaggctgttctgtgggcactgtcttgcaggagcagccaggcaggcagtctttgaagagttggcaggcaaaggggcatgtggatcagatacactatggtcctatggcagtggcagtcttactctcttcgccctgcagatagcaggacctgcagccactcagtacaagctggagagccttggaggatgggccctatggtggtgttttgctgcagctgcaccgtggtctgtggggctcatggctagaatcttgtagctaggatcccagaggaccatggtgggagtgtggtgccccagggttcctttactcagccctcccttaggtccacactggaactgggggccagtcctggtgcctagttactccaagcagtctacgtcgcttcttccctcttcaaacactgtgtctgctttgcctctctattggctttcagtgttttctctcaaaagatctgttcaaagttgcaggattttgtattgtcaagttttggtggttcaaagtgtggtggcttacttgatattttggttccttttcatggaagaggcgtttttcagctgtaggtagttggccgtcttgcctagaactcttttttatattcttaatgatgtctttcaaagagcaaacccttgctattttgaaatagtctaatttatcagtatttttcttcattttatgctttttgtgttttatctaagaaactttttctactctaagcttgcaaagatttactcctgtattttcttctagaagttttgtaaatctagctagtttatttctatatttgatcttagttgcactgtatcagtatgatctatatatacagagaagaataatttgtagaaggtaatattagaaagatacaggctgggcattgtggctcatgcctgtaatcccagacttggggaggctgaagtgagaggattgcttgatcccatgagtttgagaccagcctgagcaacataatgagaccctgtctttaccatagaaaaaaattagctggggatggtggtgtgagcctgtagttccagctactctggaggttgaggtgggaggatcacttgagcccaggaggtcaaggctgtggaacctgatcatgctactgaactccagcctggttgacagaatgagatcctgtctctaaaaaaaaaaaaaaaaaaaagatacagcttaaatattaggatatcctttaattaaatagaaataacaggaaaagcttcattttgaagactgtaggagagtcagcaatattgtcatgttttaattactattttcaaactagttatattcgtctcttctcacataaagatactactcgagaatgggtaatttatgaaggaaggaaatttaatggactcacagttgtgcatgcctggggaggcctcagaaaacttacaatcatggtggaaggggaaacaggcacgtcttaagtggtgagaaaagagagagggcatgtgaaggaggaactgtcaaacacttacaatcttagtggtgagaagagagagagagggcatgtgaaggaggaactgtcaaacacttacaaaaccatcagatctcatgagaactcactcactatcacaagaacagcatgggggaaaccacctccatgattcagtcacctcccaccagatctctccctcatggggattgtggggattacaaattgagatgagatttggacggggacacagagccaaaccatatcagtagttaaaatgatcttgaatatgttctgagaaagagtttaagaaaataaattttctttcctagctggtttctttcttttaaaaatttatttagaaagattataacctaacttgaaaatacagttagttggtttctagagagcttcaaggtaacttaatttttattgtactatatatctatcagttaattattttctgtagctagtcacttttgttgattatatttaattagtatcaggccccatatgaatttatatttctattagtttatttgctctgttctagcttctggattttagaaaataggatttgactattttgcaaatatatgccattgatcatgaagaggaccgttttttttctactagagaaatttaaagtttgagggtcagaaggatcttgtgtgtatgtgttttatgtgtccttttgagttgtgtgtttgatgaaaatacctccttatttaaaatgcttggaatcttctagctttaggagaacttgttaaacagtagagacagttttacatcaataaacctatatattacacttaaacttctagctagttataaattagattctaagcaattcaaactgacaagttttcaagttataagggtgtttcaagttaaaaaattaaaaaatgtaattattttataaactagctgaaatgttttgattgcaggttggaattttaaagtaaatgtggcctctgcagtgatttgttaattttaaccaaagctactttattttctaggtgttcattgtactcatggcttcaatcgcactggtttcctcatatgtgcctttttggtggagaaaatggattggaggtatttgtatcttgttataatggaagatgtattttgtaataaaaaattttattgatattttagttgcagaattttgtattgtcaagtttttggtgaactcatgattaatgtaatttgaactgcttttcattttagatatggttaatctttatactaccattacttggtgtgtgtgtgtatgtgtgtatgtgtatatatgtatgctttgttttgttctttgagacaaggtttcctctgtcatccaggctggagtgtagtggtgtgatcatggctcattgcagcattcacctcttgggatcaagcaatcctcccgcctcagcctctcaagtagctgggaccacaagtatgtgccacccatgcctggctaattttttcttttttgtctagtgaggaggtctccatatgttacccaggctgatcttgaattcctgggctaaagttatcttccacccttggcctcccaaaatgttgggattacaggcatgagccaccacacccagccaggtgttttgcattaaccagcaaatcactttgagtgcttatgaatttcataaactgtatattcactttttcagatttttttcacctcttacagaattatcagagacagattcttccaatattttgtattttagtatttttgggagagtgttactccatttaagccaatcaacatgtctttattgagcatctgttatttttgaagtgtgtttttagatcctgagagattacgactttagtacccaatattcttaagagaatatattactaactgaattttcttgttgactgagggagcatcattatttatgtttacaaagattttcacatagtaggtccttttttgaatataatcagttgaagtacacatatgattttgaattttgcagtatgcattgttggtggttctgtactgcatgtactttctagctctgaccattcagatgctctccacaatgatctcagtttcctatgtcagatttagcctatgcttatcctctctttgatgatctagactcttagtgcctggatctgttgaaagttcctgtaaaatcaatatgcttttactttgctcacattgttgtttttttgactgatgttttgctgcagagtcagacctcaaccttcaagactaaattcttcacagaccctatctaggtctctactatatactcatagcaatttatttttagaatttcagaattttctgaataccttatattaaaaccttttcagaatgaatgtgtcccttaatagattgaatgacttgagggtgaggattgtgatttgcccattttataaacttctgttgtactttatatggagccttgaatataataagtgagtttttgataagcctgcataaatagaggatagcgaggaaattgcatggtgtttgtttcctatagtatcgaagcagcagttgctacttttgcccaagccagaccaccaggaatctacaagggtgattatttgaaggaactttttcgtcggtatggtgacatagaggaagcaccacccccacctctattgccagattggtgttttgaggatgatgaagacgaagatgaggatgaggatggaaagaaggaatcagaacccgggtcaagtgcttcttttggcaaaaggagaaaagaacggttaaaactggtaatgtttaaaaatattataataggttttttttttcctttttctgcaagcttattgagatttataaaaatggaatattggccatgtttctttagctaggtttgtcagatgattcatcctagccctttctaaaaaaaaaattttttttttttggagagaaagttttgctctgttgcccaggctggagtgcagtggcagccttgaccttctgggctcaagtgatcctcccacctcagcctcctgagtagctgggactgtagacatgtgccaacacgactggctaatttttaatttttacattttctgtagagaaggttctcactttgttgaccagtctggatttgaactcctgagctcaaagtgatcctcctaccttggcatcccaaagtgttgggattactggcattagccactgtgcttggcctttaaaggttcttaatagccacgagtctgtcttttcaaagagaaaaattgcagttacgtaaatttttcctgtttttgtttcttatgtctttagatattagataatatctaaaagaacttttagatattagattgagaacttactatttctttacaaagtattgtgagatttcaactaaatacctagtgaatatttttactaatgctttacaaaattgtcacataattaaaataactttacatatgaattctgcatccccctccctgggtgatgctttcatggtttccataaaattaaatcaagaagactctcacttctctagccaacctttaataatcttctagaaataaaagagctaaccataaatatgaggagttatcttcttttactggaggataggggaactgttgagaggaaaagtattggttgtacttgtacacacacaagtatatgatataggccaaagggaaaagttagggaaagtatggaggtaattgtgttaatgaaattattaattaaggttcctagtatattatggttgagtggtatataccacgactcatttattagtaggcatggttcacaggcaaggaagtaaatgctttgttagtttatgtaaaccatgtaagttatttttggcttaaaaatttttttttgtttgtaaaacaatgttttaattgcatttacacattttaaatttcaagactataaggacactgaaaagtgtaaattgcttcgaaacatagaaattatttcaaaagtaatttattattttattctgatttattatttcctggatttagatatctgaaattactgagtcacatacctagaaaaataacaatcacattctaaggaaacttcaataagcagcatagcataaaatataggttttgtttgtttgtttttggagacagggactcaactctgttgctcaggcaggagtgtggtggcatgattatggctcactagtggcagcccagccttgacctccctgggttcagtgatccttctacctcaacctcctgagttgctgggactactacagtgtatctcttacaagcaccatgttgctgggttttatttattcaggcaacagtttttgccttatcatttagtccatgtacatttcatgtaaagattagattcaaattgtcttactctttttttgtgccactagtggtatgttcctttcttgccttctttatggttgcttttattcttctattaccccaacccattgcttgttgaccatacattcctttacttttcttttattagttactcaagatttcatggccaggtgcggtggctcacgcctgtaatcccagccctttgggaggccgaggtgggtggatcgtgaggtcaggagatcaagaccatcctggctaacatgtgaaaccccgtctctactaaaaatacaaaaaattagctgggcgtggtggcgggtgcctgtagtcccagctactcgggaggccgaggcaggagaatggcttgaaccccagaggcagaggttgcagtgagccaagattgcgccactgtacccagcctgggtaacagagtgagactttgtctcaaaaaaaaaaaaaaaaaaaaaaaaagatttcactatacatctttttaaaggctggtatatattagtacttttgtcactttttagacaatgcaaaaatcttatttgtttatttttgagacagggtcttactctgtcagtcaagctggagtgcagtggcttgttcatagctcattgcagctttagatccctggggtcaagggatcctcccacctaagcctcccaagtatctgtgattacaggtctgtgccaccataccctgctaattttattattttttttgtagagacaatgtcttgctattttggcagggatagtcttcaactcctggcctaaagtaatcttcctgccttagcctcccaaagtagtaggattataggtgtgagctgagccactgcgcttggccaagaattttacaatcttttattccatttacttattcctatcttttttggtattgtgttttttaattctatgtgtatcttaaaccccatgatgagaccttttatttttatttttatttttttttaaagagataggatctcactctgtcatccaggctggagtgcagtggtgtgattgtagctcactgtactttgaacttctgggctcaagctatcctctcatcgcagcctcctgagtagctgtgactacaggtgtgtgccaccatgcccggccatggcatttttatacagctattattggttaggtatacccacatatttaccctttctgctgctctttctttcatgtatttttgtggttccattttggatagttttccttctaactgaagagcttcctgtattatttccttccatgtgggtatgctgttgcacattcttttagtatttgtgtgaaattgtctttttcgacatcattttgaagaatgttttttctgagtataaaaatcagggtggttagctgggcgcagtggctcacgcctgaaatcccagcactgaggcgggcgaatcacgaggtcaggagttcgagaccagcctggacaacatggtgaaaccccgtctctactaaaaatacaaaaaaattagctcggcctagtggcaggcgcctgtaatcccggctacttgggaggctgaggcaggagaatggcttgaacccgggaggcggaggttgcagtgagctgagatcgcgccactgcactccagcctggtcgacagagtgagactccatctcaaaaaaaaaaaaaaaaaaaaaaaaaaaaagatcagggtgcttgacagttattttttttctagcactttgagtgtttcattccagaatttatttctgttgagaagttagctaccttgttgcttctttgaaggtaatttcttattgtttttgattttcagcagttttaccatgatatttctacttgtggttttctttgtatttatcctgcgtggtgtatgtaggaattcttaaatatatagttggagtttttttcctaatttgttttagacaatttttggctgttatctttttaagtattgtttcagatctatttgttctttcttctggagctcaacctaataccagtaggcctttaaatttttttttttttcttttttcttttcggagacagtnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncttaattaaggattgagctgttagaaactagactttagttttggggcagtggtctatttttgctctgctcttattcctatagcctgtgaggatcttcattgaaagtgtggggaattaaattggactccttccacttgaagacctgtaactccagcttttatttcccattgctgtgatattactgaaatttctgttcagcttcttagtgtcttagctaccatttttgaaacagtgcctctagaggagagtactagaaaggaaaagctgtagaagatgtctagctcacctctctggcctcccttcctcctgagtttttggcccttcaagtccttattgcctttctaattctctgaggtcttcaaatgaattctttaacattgtccagcttttttttttgtggctacaaagttagtctaattaggctgggtgcagttgctcacacctgtaatctcagcactttgggaggccgaggcggaaggattgcttgagctcaggagtttgagactagcctgggcaacgtagtgagacctcgtatctacaaaaaattaaaaaattagccaggtgtggtggtgtgcacttgtagtctcagctacttatgaggctgaggtggggtggattgcttgagcctgggaggttgagactgcagtcagtgagctgtgatcatgtcactgcattcacctgcacttcaacctaggtgacagagtgataggctgtctcaaaaaaaaaaagccgaaaccttctttctctctttttggagaaagcaattagtcttgatttctgttatgagttggtgatttttgagaatatttgtgcttatacctccaaaggccgaattaggaaaaaaaaaaagttctaaaaccttatgccttttggtagttttttcttttttcaaaccataattagtaaatcctaaaattattaaatattttactcatataagtaatatattaaagatgaaagaacattaatctttagtttattaaagaaagtttgaaaacgaaagaaaacttataatccttcaactttcatactaccattggtattgttgtctttttagaataatttttccctatttacttatttatttagctttaaaacatacacagatgacttaaagatgagtttttttttttttgtaaaatataaatgcaaacatctaggagtatatagagttaaaaggcaaaatatttcttcattcccaagccatttgctctgtactttttggttatttctttgcatatgcacagaaaacatagtatagaagaataacttagtgtagaagaatatatactggggagatacatatatataatatatatatatacacacacacacacagtatatatactaaaaattatatattgtaaaaattaagtcctatataaaagtaatactagatatactaagaaaggaaaaattaaaaatttttctatttgagaaagcaaatagaacctttctttagaagacaagagaggctatcaatccataaaataatagcaggctattaagaagaggaacaaattagagatcttggaaatgataagattaaaaaaccacttagtatgtgggatgagtagcagaatgaaattatcaagctagaggatctagctatgaaatccttccagcatgcagcatgaaaagacaaaagaaatgtaaaatatgagaaatagtttagaattaacttaaagggagcaatttaacagtatgatttcatggagaggacaaaattcaataaggacggaaagtatttatctgaggattattttctgtggtgcagtagggctgggtcagactggtaattttaagaagctaatggaaggcgagaaagtggagactgagttgtgttaggggttccctgtaccaccctcacttctggagatttattagaataactcaggactcagcatatggttgtactcataactcagatttatacagcaacgtactaaggatatacagctcaatcataagagacaaagacaagtagagtctcgggggagttaatgtgtaggctttcttgtgctctctttttctcatgaggggtcatcctgagctcactcttcctgcagcaatgtatttgtgatgtttctgtccatggaagctcattacactctcactgctcaagatttttattgatggccggtcatgtaggcactctgtgcttagcatgtagcaaaattccaggattccaggaggaaaaaaatttattcagcataaactgtatttttgggacaagtaatctaggtttggtgagccatccttatcagttgactgagaacactccaaaagtcaagttctcaggtgccattcaggagccaactttgcaagcactagtgttaggttaacccttttctgcacactactataaactattcattcaagtggcttggttatgataaaaaaaggagcagaagggtaattgatgcagacatagtcagaaaaggctttttagtatgggataaattcaagcatatttattagtgtggataaggagctagtgaagtcaatgaagttgaaagtaaagatttggggaataatgatagagaaatctctgaggaagtgcaagggaatggaggtcaaatgcagtttttggagtaataggtcttcagcaataggagggaaatatctttcttagtactggagatgtaattgagattgtgattttttcctcagtaagtttcagctgcctatgtatgagagtggaaaagactaacggtaggttgactcaaggctggagaaattcagtttgggtgtgatgaagaacaagagggtaaggggcactgaggctgtcagaggaaaaataattgaagtaatcagccataggttctaggctgaataggaagtaaggtcaggatgagggtgctgttagaatatgtaaaggagaaatgaagggactgttagtcttggtgaaattgaaaagtgagcagagtgacagtaaaagagtttatagtgacatgttagttttagaatgctgtcggcactcaatcaatgtgagttgtattgaatcaaaaggtagagtggtttgaaatgattgtggtagtgccatggagcaggatgttccagttggacaaagatgagggtcattgtaaatgagatgacctattgtaaaggttgtacaacaggtcgagttatttcaatggatgttgatgttaccaatataatgatagaggttagaatagtcagaaagaccaactttttttgatgaatgtagggcaatatctttcaatacacaaaggatagagggttttactagtttagactctctgactgtaaacagcagaaaataacttaaactggcttaaatattaagggtacttattcatgagtaaattagtggaactcaggcactggaatgtgccagattttaggacaatattggaacctggacctggaaagttacttagaacctagtttctgctctttcttcttaatatcgcatctctgcttttgtccctttatttgtatcagtcttctcattgtctctgtctctcaagattggctcttcctgattcctgattttcctgggagatcattaactgtctcgaagcttctaaggtaacctgttataattttagccacatgcagagactaactgcttgtctcggaatcccaattccaaattaccaggagagagaatctgatggcttcagattgagttaggggttattcgtgctcccatcaactttggctggagtaggatgttatcttgtaatgtcatgtaaaatagctattaggccccatctttgtgggttgggagggcagcccttaaagagagttgttatgccagtacccacagtggatttctgctttactacagctgagtggtatagctgaaaggaattagtgtaaacacaagagggccttttgaaagagattaggaaagcagtgaggaggtatagaacagtagtttaaattactgccatggatcttgggctgtgggagaataagtagctttaagatgacatgatctgtctagggagagctagcttttagttgagacacggtacggggtgttcaagaaaatggttgaggtgatggggaaggttatttatgaaaaaggaattccagggtttacattggaactctttgggaaggtgattattgataagatgaaccaaggaaaaggggctttaaagcagtgagtacaaaaccatcagagaagaaaggggactgaagagttgaattgtggatggtgtcaactgtagttgacctatggttgacagggatgagaagcacagatataattacttattacatttatggttggaaaagctttcatttttcttttatttccatctgaggttgaagatagttaacagaggcaatctaagagtgactattttatagatcacatctcttgacataatgaaggtatttttggtttgagactttatttttgttaagtacagtcttttctgattcttatattgatataactatgtattcaagtaatggactccttgtaattaattctgatagttctctttgggtttataactgtggcacatgtccgatgctgtgcttggccccttacattcctaagacaccttctttattcatcttttgagtacatgtgttactaagttggaagagtatgacttacaggtatgttgcttactccttgaactgatgtctgagatcatttctttgaatacaacgatgaatgtattttcctcattatgaaaatatgcctgttgtacgtatattcttgtatacattttctctttacacacacacacacacacacacacacacacacacacacacagagctctctctcacataaattgcctccatcttctgtaatatttactaaatttctgtctaaaggatcactcatttctgttgtgatagccatgcagattttaattttaaggctagctgactctgtttatgaaatatatttctataaacatacttttttaactttcgatttttctttattttcacaaacagaaataatttgttgaaaagtgaaaataaatgtcagtgactttaatactcaattatagtatgttcacaataattccagaccgaagacattgctatttaaaatttatttttaaaattaattatttattttttatttttataaatagagatgggtctcactgtgttgcccaagctggtcttgaactctggggctcaagcagtcctcctgactcagcctcccaaagtgccgggattactggcatgagtcaccacatctggccactgtttagaattagtgatctttccattataaagatttaactattttatgctgaagtggccatattttcaaggagtgaaaccatctcatacataacaatgaaggtagtcagctgtagacttggaatgagatcacatatggggatgatatccttctagttagcctagtactgctgtactggtctgtgtgtacatgcggtccttcaactcaggccttgcaaggcatgccggctgtgccatgtttgtaaatggggcagaggaagctacaacaatggaaaactaagctgtttatgttaggtacagctattaaaacaaggtagggatgaggctaggcccttaacttccctaaggcatacttttctagctaccttctgccctgtgtctggcacctacatcctggatgattgttctcttttatccattgtggatttttaaaataaaataaatatgaaaagcatcttgatctcttgtttgtgagaggtgatgccctgagatttagcttcaggaatatgtcatggctcatgcttcccatatttcccagggagggaaatacaggattttctaacactggttaaaaatgcaaattcaagatttggaagggctgatataatgaaataatgagcagtatcagcacgtgcaaagcttgtttaaaagattttattttctcccctcttagaccttttgcacatttagaatcttgaaacagtttctagatctctaacatgaaaatgaagatgggtattttcaggttgctttcagctctaggtagaaataaccagaattggcttacattaaagaaactgcatctagaaataaataaaaaaattagtggtctttcttggagttatataattttgaataatataaaaatggtattttgtcagaactattgtagtaacattaaatagcaaattatgttagcctaaagttaccaaggatgatttgtgtatgaagtgtatcatacttttttttattggacttctacctttctttttacttatttgttgtggaagaaaatagaggaagttaaaaaagaagttgatgcatggtaggaaagattaaggaagaagaacaataaatggatgacagacatttactaggtgattggggttaacttttataaccagactcagtagttgttagatctgtactgatgctcagtatttattggctctgttaaattaaaaatattcagctttttcaaccccatagaaatgttattaaaatatttctgtggtaatattgtgggaaagtgcttggttgaatgtgatcatattttctatgtgttagtcctttttattatatgttaaaaatataaatagtgtttgtgtttttagtagtaacttaggttaatttggcctttgcttttattttgcccatttcagaagttaatgtaaatttcttaactttgcataggaaatccacgttgataaatgaagctagagactttctttgtgtaaaacttaaaaagaacatctcatgctgttaataccatcagaattaggatgcttaatattgaactctctaaaaagaagtgttcttttttaattagcataagaaacaattttttaaggatattgaaattatctgagcactcaataagtaaatatgttacaaacctcatctatctggttgagctttcttttaaaaatactctttttttcctttagctgttgtacttaatgataaaaatggttttaaacagaaatgccattggctagtacagagaaataatggtataatagtagagggatggtactctttgatccttgggcttatgaaattcctaaattttggttatttaaggaaagcaaagtagaagacagataagtacaaaaagtgcttcaaaattagggacaaaaagtaggactagtgtctgctggaaggactcaggattcttccagatttgacaagaatgtatgtggatgaagtattaattgttctttttttcttttctcaagtggctcagattgccaggtctttgccagaaggttgaacgttgtagcttgtagactaacttttttattgcctaattacattaacagctagaattgttttatagatttttcttaagactgatgccagtccctttatggaccttaaaagaactgtagcatacatctagactattttttttaggtttaaaaatttccagaagggttccttatttgtttgatattctctgtctgctttacttcgctgtgatatttcaaaatatgtagttctgagttaaaaaatttagattaaaaattccatgatgagtaatattttgttctattagtatgttaatatatccaatgactgtggcttagccactttgcctacactcttactctggtttacaaagatagaggttttggtgtttatccccttaaagtccatacttcattcatagtaacacagctcctttccccttctctccattggtggttggtatagtgtaggcctgttcaaattctgtcttttaccacttgatttacataaaatctttgtgccttatttactcatctttgaaataaatacagtacagtctattttttcagtgttgtaaggattagagagaatgtttgcaagatgccagacattctgcttggatctcaataaatggtagataaattattattactgttatgatttgagaagtgcctatagagtacatacgtatattgaagaaaaccatgtgctggatttaggaaaactagtgtacaatcttaggggagtttatacagcagaccgtttctgttagatatattgacttgctaagatttgtgagaacaaactaatttatctctcagtctcttctttgtaaatgaatttgaactctaataaaatatttttctttcccttatttttcttattttttttttaaagggcgctattttcttggaaggtgttactgttaaaggtgtaactcaagtaacaacacaaccaaagttaggagaggtacagcagaagtgtcatcaattctgtggctgggaagggtaataaatatttttaaatttttaaataaaatttgctcttattttacaacacttaatacaagcattgacatatcttcttggctccttgaagttagtatgtttgcaatagaatactttaaaggtgtcagatttcgttcaagacaatcaatgcaataaccagacagttgagtcaaaattagatgactcacatattttcctaaagtaatagaaaattcttgttttcactgtctagtatttgtttcgtgtctttgactctactgctactgattaatgtttgagctagtctctcaatttgataagagggaagaggtgaaatttggatctgcctcattttccagtttttctgtaatcagaagtctaggaaaatcagctttaaatataagcagtgaatgccatgacttgaaaatatctttcagacatttcgtagtggattcaggagagcatacattgctcttatctgttgctctcaggtcttggcctatggtcatttctgctgatcattggtatctgtggcagagaactgtaatacagttgaatgtaaggaaaaaggattattgttaattcctaatataaattcctaatgaaaagaacttttattactgttacataaatactagataaatcatctagaagtagttttaactaaaatatgaaaacaatgaagaaataagatcggttttaatgttgtgttaaaccttaatcttgacctacacccttggttttaatgttgtgttaagccttaatcttgacccatatttctcctgttttgtcacttctgggtatcttttgaggagaaagttgccaaccttgcagttatgtcaagttggcagtctcacgttggggaaatatggggtctagaatatcatgtaaagtaattaagccaagatttaaacttcttcctgaagtacaagacttgtaaacatacctgctttactatttagatcatatatactaatattttaaaattagctcagtgattataccatagcagtggtaatttagaactctgttaacttgcattctaaaatgtcaagaaaatgataatcttttattagtatttttgtgaaagcggatgttattccagctgacattaatctcatcatagggagaacattgtgataaatgtgtgattcatttgagattggtttaagacatgtattgctttgtatggataccagccacgatagtaatactgtgttcttctttaaggtctggattccctggagcacagcctgtttccatggacaagcaaaatattaaacttttagacctgaagccatacaaagtaagctggaaagcagatggtactcggtaagttagacttctaaaaaaattacacaaataaccctaatgcttgaagaatattgttttattgttagaaaagtttacactccttgagagtgtgaatttctaatgtgaatagcaaaataaatgtttcaaaaattatatatttttggttttgctagtgttctaagctgtatagcacaagttatctctcattctgctaaatttttggtttcagagcttagctagtttaacataaatctataactagatgttaagtttgaaagtgtttttctcttaatgatatggtttttggtatgtctgctgcccactgccttgttttttaatgatattggacatgttgaggttaatagataaattgccagtttgtaatctaaaaatgatgaactctctctgattcattctgtattctcctttgaataatttgccttattctctttatatactcgcaaggttgttgcattattacaacaaagcttaatttcaaattttatatttctaagttttaagatttttttaatttgagacaggatcttgctctgtcacccaggcggcagtgccttagcacgatcaaggctcactgcagccttgaactcctgggctcgagtaatcctcccacctcagtctcctgaatagtagcttagcctcctgagtagctgggattatgggaatgtgccaccctgcctggctattttttaaattttttgtaaggatgaagtctccttatgttgcccaggctggtcaagatattagtagaaattttattcttcctcagcaacattttatttttttcttttgtaatccatatttttttgcatctattacagttttgctatatgtatgtattcatttagcaagttgaaataattattttaacagatattaacatagaagtcattaactatttcataataaaatgttttggaataactggcagtacatatatattagcttttaagtgttattttgaagatgacagattctatttaatttttatgagttttggaaagtcttaagtggcagttatactctttgtatcatgccatctccatctccatttaacatgtagttaccttaaaagatatatatggagaaaagaagtggagcagatacaacctattttcattattaggtgactataatgatattttaacattatatgctttctagaatgtttaagtattttattatatttgatttttattgggaatatttaaaaatattttcattcattttaattgtctgcctctgttggaaacaatttttcccctcagtttagcattttttagcttttttagggtattttataggtaagacatattcatttgacaaaattcagaaaataacattaaaaaagaagaaaataaaaaagaaattttatcacctagagattatcactactgtccttatggtattgacctttttctctgggttatatggcaggtgtggtttttattattattattattttttgagacgggttttcactcttgttgtccaggctgaagtgcaatggcacgatctcggctcaccacaacctccgcctgccaggttcaagcgattctgctgcctcagcctcccaagtagctgggtttatggcatgtgccaccacacctgggcttattttgtatttttagtagagacagggtttctccatgttgggtcaggctggtctcgaactcccctatctcaggtgatccacctgccttggtctcccaaagtgctgggattacaggtgtgagccaccgtgcctggcctgtggtttttattattaatgctttgtgtactaattcaagtagttaaataacaagtatttgatatttatatgtttatttgttcatattattttgaacttccttaatgaactagccttaaaaattaataataatgtataatgcaaaattgaaacagtgtagaaatgaaaaaatgtgccttgtgtgcttgcagcagttatacaaagaaagatatagatccataaacagaatttggatcatttacccattctgcacccttccctgtggatatgtgtttttgatggataaatgaaaattagcctttctgcttattttcagaatattaaaattatatttatttaatatgttgggttagattatgttcagaatctattaaattggtagtaaggatgttaaggatgttgttgagacatacattttaatagatacgtaaaaatgtcttaacaaatgtcttacttctgtgggtggagaaagagtggaaaacgtgaggtcaaggtgtctatctctaggctttacactacgaaatgaactggggatttgggattgaggcatacatttaacctcttaggagtttcatattttaggtactcttttttttttctgttgaaatttattttattatcttatttttttgagacagggtcctcactctgttgcctaggctagagtgcagtggcacagtgattgctcactgcaaccttgacctcctgggctcaagtcattctcccacctcagcctccagagtcgctgggattacagacatgcaccactatggccagctaatttttaaaattttctgtagagatgtgatcttgccatgttgcccaggctggtcttgagctcctgggctgtagtgatcctcctgccttggcttcccaaagtgttaggattacaggcatgagccaccacatctggccttatatactctttactttctgcattgctttcttcacagtatcatggtaagctttgggcaaaataataaagcctgcaaaatttgtctcttgtttctgccatccaacttttgttgattttgttcctcctctgtagttgtgtacccctttctctgtgtgttggtattgttagacccctagatgattggctaaagtaattttttatgaagtaattggttaagatgtttttgattgctaatggaaatatctaatttctcctagaaccaggctccaccaaaaacaaaaggaaaaccctgagtatttattgaatacctactctgttttaggatacttttttctgggagagaaaaaattttgcaaggtgtttctgggccagtgtaaaatctatcttttgcgcactaggatttaagtacagtagcatggaagagggactttctgtgattgaataaggtgaaaagagcctgaggaggctgtagaatggtcttagaggctatgaaataagagtaactgattaatagctatgagtcctggactccatcgtcgttaaagctatgtcaggatacagtgtaggatttctttttattatccttatttcataatttaatggcaatttattatatctcgtaacaatatttaaaccaaggatctctgaaattgagtgtaataggaaacctggatatagttaacagtaaaaggtattgtgtaagaattttgcattagcctgaccaaggcctgagggcctggagataacagtaagtagagtggctttttttttttttttttttttttaaagaaattgtgttttgctatgttgctcaggatggtctcaaactcctggcctcaagtgattcttccctgttggcctcctgaagtactgggattataagtgtgagccattgaaccctgcctggagtggttttgacaggaaactttaatggatttgaaaacattgtagaatagggaatatttctgaaatgtaaagccaggtaatagaaacagaaatatgaaagttattgaaaatgaaacagtgagaaatttatattagttgtaataggtgaattgatggagactaagccactgtaatctcagaaacagatgaaatgaaagtttgtttgatggaagaattaattgtgtttcgtgtatttcaataaactcatacttttaaaaatgagatgtctttagtttttatagttctgagtacttttggttgcagtttttgatctctaataattaagcatttaaaaaatcttctaatttggaattatgtcagacttagtaagtcttccaaaaatagtacaaagaatttccatgtgcccttaaccagattcctcaaatgttaacatcttatattattacagtacaatggccaaaatcaagacattaacattgatgtattgattattgacgttattcagatttcaccaaaagtgtcaatattatgccctgtttctggtccaggatccagtccaggatcacgtgtttcattaggttgccatgtctcttcttttttctgcaataattctttttttttttgagacggagtctcgctgttgcccaggctggagtacagtggcgcgatctctgcttactgcaggctccgcccgctgggttcacgccattctcctgcctcagcctcccgagcagctgggactacaggcgcccaccacctcgccaggctaatttttttgtatttttagtagagacggagtttcaacgtgttagccaggatggtctcgatctcctgacgtcatgatccgcctgcctcggcctcccaaagtgctgggattacaggtgtgagccaccgcgcccggcctctgcaataattctttaggctttctttcataactttgacacttttgaatagcattggccagttatcttgtagcttgtctctcagattgagtttgtttgatgtttcctcatgattcaagttgggcatgcttgcaagaacatcacagtagtaatattcttcatgtcatttcaggaggcacataatgttgaattctcctattagtgatgatgttaactttgatctcttgatttagttggtgtgtgccagattgatgaagttatttctgtttattattttatttttggtttgtactttatttattgataaaggcatgtctgccatgataaagttatttttcctttgtacttaagaagctgtgagggagatactctgagatcatgtaaatatcctatttcttatacttttcgccattatttttaacattcattaatgattcttacctgaaacagttaccactgttatgtttgctaagtggaatagtggaattcagctcttaggaagaactttcccttctttctcatttctttattttcttgctttttttattcctatcagtgtggactcatagacacgtattatattctgtgggttataatctgttttagtaattattttattgctccaaatgtctcatttgaccgttgagagccccatcaagtgactcctgtcttttgacatctctccctcattttttgagtactttcttgtttctggcacccctagatgttgtggacttaccttgtacttttcctaccccagccctggaatcaactgtttctctaaggagtggtatttagaaaccaatttttgtgcacaagttgggctcattagtactgggatgtcatttcttctaggccctctcagaagatagagctaggaaatatgtgtgtgtgtgtgtgtgtgtgagtatatacataaatacacacctatatctatttcagtatctgtctgtatgtatgtgtatgcatacatttttttttcaaaatcacgagttcgtactgatacttccaaatctaatgcactgccataggatttattgaattttttctcattttctatttgtaactcctctctctgatagggagacacttggttttcattatccataatatttactataatacacataaagtagttttggaattgctatccaaagccactgtgagaaatccatttgaatagagtgtaatatttgtgaacagttggtctgactttagccttagggtatataaagtgtactgtgttccaaagttacttaattattttctctcttcctgccaaaccctttagtgtagatagttttcatttgtaatacaattagtttcatttgtttctgcttatattctgagtttgccctcatcctttgttgattttaatttttcatttttctgagtgtgtgaaactctactatgattcagagtatgctctgagaaatgttactttctcctatcccttttaaccctttccctttctcttatcttttcattctgttcctacccacccccttaaataatcagcctcatcattttctgatttacccttcttgcatttctttttgtacagatgagcagatgcacttttctttttcccctttcttttaggaaagataccatacactttagaattagatagtcttttcaccttgctttttccacttaacagtatgttctagaaaccactgcatttcacttcagatattctcattctttttttacagctgcattgtacccattgtgtgagtagtttattcaacgactctcctatatagagatatttagattgtttccagtattttgtaattacaaatgatgctgtgatgaataactgtgagctgactttccctccatattgttgaaagtctaacctcagggtcaatttctagaaagaaggattgctgagttgaaggctgggtgtatatgaagtttagttagataccacgagtttctgctccaaaagggtagtgccagattgtattcccacaggcagtttgtgagaatgcctgtaccaccacagccttgctaacagaatgtgttggcaaattttttcaccaatctggttagtgagaaatggtatttcattctagttttaattctgaatggagtcaaacatcctctcatatgtttaagggctatacttatcttttttgtgaattatctgtccttgtttcttttctgttgtcttttgactttgttcatgtttttttgccatacaaaattttattatttttatgaagtcaagtttattaatttttattgcctcttgattttgatttatagttagaaagcctttccttatactgagattgaagaagaattctctcatatttcttctaatatttgtatggtttgatttttttaatctggaagactttttaaattataggcaatctaacatttctacaaatttaaaaactccttttattgtcattgttattattattactttgctgtgaagaattaatgcataaattcattttgagtgaaggctgtcttctaaggttggaactgagtcatgctgatccacttggaagtatgtcatcctgatagtgaccaccttgcctgtgtactgggtgttaatatacagaaggcttattttaaatgtactattcagcagtgtgttttgttatttctttgcagtatgttttataataatggaaggcttttgagatgagaaatatatggttttggtaggagttgaggtcaaaaggaaggcctagtatctctaattctgatccacagggttctaacttaactttgcaaagtaagacatggatttacaactgttttatatagtgcatgctgtgcacctacttcccaaatgcacttcgatttttttttttttttttttttttttgtcataaagagtctgggctccttcctgttcttctctctacaactcagcctgtacctgagtggtactagctattcttatattgcttttctatggaggaaaacacagtcttctagagctgaaatcttaagaatgttttgggaagattagagagcttctttagaaaaagtttccaggcatttaatcatacttagtatcttagttcatttgtgcggctatagcaggatacctcagattgggtaatttataaacaacagaaatttatttttcatagttctggaggctaggaagttcagaatcaagatgctagcaggttcagtatttggtgaaggttgctctttgtttccaaaatgatgccttgttgctgcatcttcccatggctgaaggggcgaatgctttgtgctcaaatggtggaagagcaaaagggcctggctagttaccaccagctcttttgtaagatcactaatcccatgcatgagggcagagcccttgtggcctaatcacctcctaaaggttccatctctcagtactgttgcactggagattaagtttcaccatgaattttcaaaccgtagcacttggttatattttaacttgttgaatttttgaatttttaaattttatttaactttttcctgagctttgaaaattatttcttgttacattccccaccactaagactttagtaatacactaaattatagtttctgtttcttggattcctctgtgtgtcaggtactgtgctaggttctggggaaacagcagtgagcagtgtggatactgtccctatctcatagaacttgcagataactatttaactaataataaattatttgtggataattgattaacagcttggcacaaattcaatttagagcttcagcacatatctcatagccagataaattcccagttgattaaataagtgtaaataaaatttattttctgagaaaacaagatagcagaataaattaggttaggtatacctctggcacatgtttcctcagcattctttggatatttaggtagttggatcttgggtttaggagaagaatatggattgaaagtacagatttgggagacaatagtatgtgatagtaaagacagggatgtggacaggctgttgagtagaggaagcaatggtgactgagagtaggggaggtgggagaaaaccaggagaaatatctgtcattcaagctaagggaaagtaaaaatgtctccaaagaaaggttaaatcttatagagaattagtaatctaaggagtgaaaagtgtctgttgaatttagcaacaagatatttgggattgggttgggatgttctcagtttttgtatagtatagagtagggcagtgggagtaggttgaaagtgatgacacttttcctttaaacatttcctctctttcttcctttggctgttgttaacaaatgtctctcctgagggagattccaagacagcaaagagaacattattaagagttagtgaaagtaccttatttcatccaagagacaggtatggcagggctttttatctgtcagtgtctgcctgcctgcctgtctgtctcacattgaaattcaaatgtgagataattggcaaaaattgttcattaacttgtgtatttggaataaaaatgaagttggacttttcctatcagatagtgggactttcgatttggctgaggttttgctagtgagagttggtcaaatgagttttacatagcaagcatttttgtgtagattaaatcagccaaaactgcagttttgggattttgatgaaaatagacttcaagcatttgataaaataaaatcattttatttagccataatattggtgaaggtgtattgaaatataacactccctctgccccctgcccccactttcagagttaaacaaaatgattctcaatgaaagacttgcagttacacttgatagtcgctttactatgtctttatgcctccttgattagattgtccttcaattttgttgaaagctgccaaataatcaaagtgtattttaaaggaactcgttgaatttctgacattccctaaaatacatttaacttttttcttaatatttcttttgtcttgagtactcttgtttcattattttcatggctttccccaggaggggggagtcagttctacttgagtgtaaatataataccaggaaaagtgatataatgttactacagttacagttggaattgaactgtcttgtaattgtgaaatctgctttttcacacatattctgggaaaagatagaattttataataggatttatctgtgtacttagtttattagcagattttgtaatgcaattaaataaattgtcttcaaaataattcaacatcaattgaaagtgatgaagacttagaactatataaaaattttagaattaattttcatgccttttattttaattctttctgctgagagtttgagtactataaatttaatttcaactattattgaatcagtaggtaaaaaccaaatggttttaataagtactgttgtaaaacaaatagtaaagtaaaagataataactcagattatgctcgacacaggaaaaatgtaaggctgtgggaataatgtaacagaccaacaaaagggctggtgctatggttgcaatttttacatatgtatctatatctgtatttatatcttttgacttacatatttatataatacacacacatatacaagcataccctgcttcaagaaaaactgaatataaaaggtaaatttgggacttgctttataaggaaaattattgcagggaataaaaaagccacttaggcatttatggaaatgtaatttatattcagctttttataacacatctgtttaagtaggtgaggtacatttgtataatacttctttgaaggaaattatagacaggtttattttcctgcatcctggtctgggaatttcctccctccctcccttccttcccttcttcctttcattcattcattcattcattcattcattcattcagaaattatattggaaacttatttacccctagggctctgtgttaggtgctgcatggattaggactgcttaagacagaatcctcagctttaagtttttcctgtaatccagctttaagttttcgttctaaactttttctgtgaaggacgtagtagtaaatattttatcatttgtgggttgtgtggtctctgtctcagataaaaagcagccatatccccctgattttacataaaccaaatgatgtatttcaataacatttggtgggtgtatttcaataaaattttatttacaaattagcaggtcacatttggcttttggatcatagtttgacaacccatcattgaatacattctccttaaaagacagtctttacatcttaaatgttctttctttgtaagaaagtgtaaaaagtgagcttaaggtagggaaacatatttaatataaagattttttaaaatttgcttttttaaagttttgaagtaagatttcttcccattaattgtaagttcatgctaagccattggtactttgacaagattttttatgtaatttactaaatgtatacatttgaaagacaaattttttttttctcatgaaaatcgtgtcctatgcctttgttagagcagggtgctcaatgtgtggtcatactacatgtgccctaacaaatacacttcgtgacttgtgaatagcgtgttgtagaaatagttgttgtgtggataaactgcagtatgtttaggcagcttctgtatttgctgctgtaacagtatttatttatttatttatgtagagacggagtctcactctgacacccaggctggagtgcaatggcgtggtctcagctcactgcaacctctgcctcctgggttcaagtgattctcctgcctcagcctcctgagtagctgggactacaggcgcatgccaccacacctgtctattttttgcatttttagtagagacagggtttcactatgttgccaggctggtgtcaaactccttacctcgtgatctgctcgcctcagcctctcaaagtgctgggattacaggcatgagccaccgcgcctggtctctaaaggtttttatacagaaacatgcagttaccccaggtggttaatagcttgcttgggtcccttgatatgtatctcattaataatgtttgtagtgtatgtttatgctaatgactggagccgaatgttcagacaggtatagtgtggataaggtaatgagatgctagactagaaaagttttacatgctgaggagaatattaaagaggtttcagatgtctctggaataattttcagtgaactacaaacaaaaaagtatatcttatttaggaacagaatgagtcaaattatgatcaattaggtattgtgtatactgctttcatttagatttgttcacttagctctttataaatttctttttggctctagttttcttctgaaagcaaagcaaatagctcctgatatgtaacataagaactagagatgaaatgaatattggaattaaataagaatttatctcctatcttattatttacaaacaaatatcagttatagccatgacatcatatctagtattcaggaattcagcagtaaataaagttatgtctgggaaggacttttacttttttaattgttctggggaaacttagagtttttgtggaggtgtctgagggaccagactccacaaaagtaaaatatttgtttcaaatcatgtaagtagatagtggcaaaatcagcatcattctgtattctagtacttgggcttttataattaggttttggctgggcgtggtggctcatgcctataatcccagcactttgggaggccgaggtgggtggatcacttcaggtcaggagttcgagaccagcctaaccaacatggcaaaaacctgtgtctactaaaaaatagaaaaattagccaggtgtggtggcttgcatctgtaatcctagctacctgggaggctgagacacgagaaacgtttggacccgggaggcggaggttgcagtgagccgagattgtaccactacacttcagcctgggctacggagaaagatcctgtctcaaaaataaataaataaataaataaataaataaataaacaaatgaaattaggtttaaggtagtttttcctcataataatggaaattatactaactatactaattttaggactcagttaatgtttagtgtcatacctctggtgataaccaaaactcttagagagaatgtaagccagatctcgtcatttaaagaccccagccctgtttttaatagtagtttcatcagaactatagttagggatccaggccagtttccttgcaactggatgggacacaataaagctcctgtgtttcttttttatcacggggaagtgagactaccagagaatatttagaggtcaactcagaaacactgtttattgatctgaagctacgtttgatggtatcttgtggtaaattggtttaaaaagaaggactctttgactccctccccaagcctaaatctttctttaagtccccctatatgaaacagataaaagcagtaatgctttggttgctgcaaattgaggaaagcatatggggttgcattctggtgtggcgtctgaggttaccatggaactttttagggcagcatttccagttgcgctaccatcataggaaacttttattaaaaaaaaattcagagattcaaattcattaagcctggattggttctgagaaaatgcatttttgaaaagcaccccgattacttgtgatttttaacctgatttgggagccgctatctgtagtgcctcatggaacaaaatttaaaaatcagtgacccaattcaaagtagtatttagccagctattgagttaagaacatacctgagaatttctctgttagttggtggagacccacataaaatgcttattatacagcactcaatgcatattagttattgttgttataactgaagactgttttgaaaaccattattacatgagaaccaacattgatttcccagagttcactcagaattcttttagggtgtggtatagttattgcacaagaagaaaattaagcaaaggcaaaacaatctaacattttaaaaccaaatctttgaaatacccattggttagtagtcacatctttaggatttactaaaggataaaaaggtcccttaaatagcagtttctttaatcaaatcctaagtatgagagttactactagttaatagagatactgtctttgaaatggtatttaaaaataaaaaccaaccaaatttattacctattaccaaaatctgctagagaactcttagagctgagcagatacagataaaactttgattgcaaacataggtgcaaccctaactcagaattttcagttggccaggttctgggggcagcaaacatgtgaagctttgaaagattaaaacaaatgaatttttcgttaatattttcaaacattttttcccctatatagagctgggctactggacccaaacaaatgagaaacaaggaatacaggataaagagattgaatttgtctctttgttcattcatgtagttaacaaatatttattgaacatttaccatatgccagagattgtgctagctatgataggcttagcaggtaattagaactaaactatatgatgatgatgatgattgttttttgagacagggtctcactgttttgcctaggctggagtggagtggcacactcatgcctcactgcagcctcgacctcccacctcagcctccagagtagctgggactataggcgcgtgccgccacacccaactaatttttgtcttttttttgttgttgagatagggtttccccgtgttgtccaggctggtctcaaactcctgggctaaagtgatctgcctgccttggcctcccaaagtgttgggattacaggcctgagccacaatactcaggcatgattatttttgtatgctgctttttatcttaacatgagtatatttcattgttataacatgtatttttaaaatgacttaattgctgccaagaaaaaatagttcaccctcgattataggggcatttagactccagtttttttgttgctataaataactgtactgatcttcttatacccatctttgcataaattttgacaaaaatagtattacttagatatagtatggaaacctttgaagtccttgatataccttgctagaggttgtagtgatacactccgaacagcagtgcttgagtgtacatccttggcaatttggggtagtttcacttaatataagtaatgtagccaagttgacaattggaaaatgaatttttttcttaaaagattttattgatgtaaaaattaaaggaaaatgaattttaaaattgctttgattagcagttttttttgaatactagtgtggttgcacaagttcattctgtattttggctatagcaacagttataacaagtaatacttgttgaacacttaatgtgtattaggcattgttctgagtactttacatagaacatttatctcatttaatactcacaacgctgtaagatagcattgtgaataagtagctttttcaaggtcacagacacagttattgtaagtagcaggactgagatttgaatgcaagtgatctggccccagagcccagaatcctttttgccaggtcatgtcctcattattttttcaatattttgatagttatttttactgttttatgctaatagatgaatttttctgtcttaaaatatattttttctgataatgtcttctgtcttcctcataaaacattaaaaagaaattaaaaagttctccctgtgagaacttttatcccaccccttgggataatcaatattaagagttggatgtttggtttctcgagacattataccttcatcttcttacctgctgttttctttccttactttctgatcctccatataatgggatatgatataggctgttctcttataaataaataatagaaaaactctattatttttttttcaaattgctttgtgatggtaattcaaattgcattgctcctttcacttaatgggataataaatatatttgcagacaatatttactgctttaatagataactgttaagctactgtaagctttagaaggtctcaaagacaatacaagacactagaggaaagtaaaagtacaattcctactctcagcaggaaaatgaagtacaatttaagatgtagtaagagatataacaaaactatgtatagtaccagacaactaagtaagagatactaaagagctaataaagagcattacttgatactgtatatgaaatatgactgcttgttttgattttaagagtgtgatattgggtgttcatagatggatttttaaattttatataggaaataagtaagatatatttagtattgaatattgatatttagtattgagtagtgctgctgaccagatggaagaacatttgctttgacccatctcagcagtagagcttatctgttagatgaggtgttaactggattttcatattttttttttttacgattctgtgatactttcttaactcattatttgctcacatactcttattcattatgtgtgattatggaagtggcaaatgctggcttggataaaaaaggggaaaaaactttatcctctttgtgaatctgtgaaaaattgtttgaaataattatagttgatttttctagaatgcatgctttatacaaaagaaaactgaaagtaatcagcgagtcagggacaaatgtaaaataaaacttttgggaaaattcttttgatcttttcttttcatgaagatggattactttataaaaattaaaacgttgtttacatgcctctgtgataggtagtgctgcccagaatacgttaagtggcttttaaattttattccatatcaaggtaaatctttagagcaataaatgtggcataccctgatggaagatcacttaaaagaatgctgtattttacatatttaacttgtattgctacagagttctgaaaagcataacctgttacataaatggtaattaatgcaaatgagtatatcatttgattttacactttgaagtctaatgaagacactgtacattctcattatgagagctacttaatctgaaagtaactaattaaaataaccaagagaggcttcttatatacagaactggttgattcatgagatttatttactagtattggaaccaattacctgatctgtgctacgaataataagtttgcagtgtcctgttattttgcaagcttttcaaattctcttaattaggtcaagatcaatgagtatgtctatatcttactaaacctatcttattattaatggtagtagttgaaactttttctaacttggacttgataagcattttagtaaaaatttcttttttgccttgtgattctggtcttataatgaaaaaatgataatgtcttaaaaatgtgtttccccattataaaagtcatttgtattcattgtagaaaagttagaaaatgaagataaggaacaggacaaacacgaaaaacatatgtaatttcaccagttagagatggttgctgcttacattttggtgtgtatgcttttagacttttccctctgtctatatatattttttgtttcattgactaaatgaaaaacatattcattccacaattttttaagtgtctgttatgtgccaagtaccaggttctcttattttcttcctttctttttgttgaattacttattctggtaattatgcttttgtcaatagtacatacattcttgttctctgcctgtaccttttcatgacaaattgttcttggtttatggttgtgatagcttcttgaatctctatgagaatactagttaaaagcatatttaaagttatctttctcttccttgaatcatctttcttctttatgtttctagtttcttcaaatgtgtggtgatccttggttggctgtgcatttgaaacgaggcagagaagctgcttggaagctccatgaatgtgggctgggtttgtcaatttctgacctttgctttatgataagcagttgtgcttaggtgctcttccctcactacccatttggttcagtttcttttactttctttcttttttttttctgttcaccctcccaccctgtttcagtttctttagagaagagctctctgatttttcttttcttttgcttgaggaataacctgtgtgttgtgtgtatgagttgtgagaatttaattgttgtacatagctaaaaataaccaatccctccttttcagtccatatgtcactgtagtcatcctgtgcacttgatgtttctgggtctggatcttctttggggttttgtaaaataggcacctccatctgtgaatcctgctacctctgtgcatgcttctcagcacttttcagtacttctccgtctatttcttgtcaaccagaaatttattgaaatagtgcatctgctgatgctcttttctccttcccttcattatcttcattgttatagccatttctaataaattaccctaaaattaccccaaaatataacagtttaaaattcaaatatttactgtctcatcgtttcttgggagcagtgtggttgggtgagtcttttttgtttttcttaaatccatagcctcaagcatttatcccttgttacaagcaatccaatgatactctaagttattttggaaagtacagttaagttattgatgactatagtcaccctattgtgctatcaaatagtaggtcttattcatttattctttttttttgtacctattaagctgggtgattatggttcaatgtcgtctatcagattgcagtcaagctgttggccagggctgttgtcatttcaagggtccacttccaagctcatgtgtatggttgatggcaggcctcagttcctcagctggctgttggcatgagacctccatttcttaccagtggggaggaaaaactttcctgtacccacttaggttcaatagttaggggcctacaaattaaactgacaaaacatagattagcaagagaaaaaacaaagtttatatgtgtatggaagcacataaaagaagtggcttacaagatggttgaagttagtattcctaacttaatgggactatgcctaaagtttgtattcctaacttaatgtctcaagtttgtatgtctaatttaatggtggaaagggaaggtggagaataggcttcagtgtaagaaaaaaaatggaattctttaggaaggataagtggatttttagaggaacaaataggaggtaagaaatgtttgtttttatgggggggaatggtcttttccatcttcttcgtggccataaactcctggagaggggatttatgatagttttactctcagtcttctttctgggagtgaagccacctagaagaaaggatttatggtagcttaattcccggaagtttctgcttttagtcagataaggaaagctctgaacagccacctttctgcatttgttgactctcaaatgtcttctggttaaaataatcttcataccagctctggggttccgagtgggttctcacagctgcctgagtgtcctcaccatatggcagccagctttacttatagcaaatgatctaagagaacacccaagataaaagtagtagtctgtttataatctaatctaatctagcccaagaggtgacatacaatccacttctgccatattctatttgttgtaacgtataagtctagcccaaacttaaaggaggggaattaagctccatctcttgaggttaagagtgtcaaataattttgtggactttcaggacatatttttcaggaccatatagctttatacttaaaaaaaaaaaaactctgctattatttcagtagtgtcttgggaagaatcattctattgtatggaacattccattgtataagtgcatcatactttgaaaatttctgtgtggttgtaaatttagcttgttttgaaagttttgcttttataagaataccatgataatattattctaaataacttttttgaatgagtaattattcatctgatagcttattataggagtttattgctatggtctgtatactctagaatacatttatggaaatatgcatacattttctttggagcaaaatcctccagtatatttattattgtagcagtttttgtagtaaaaactacaaacagcattttctgaaataattaatgtattttaatgatttattgaatagatctgaacaattgtcacttttgatttcattttgggatcttatgacttcgctagatggcagcagaggaccaggtttaattcagactgcttttgtgaagcagtagaattctaatggtatccagtgcattggacatctattttataatacaacccagaatattagctggggattattaagaatttagtaaggattagtgggatcatatatacagcattactgaaagcatagccattttgacaatgttggtatgttcttttgtgcattgcatctgaattattatatttgcaaatgaccttaaagtgccattttggaccttttttggtaaaaacaatgtagccgtattaaagtccctagaagtgttttttctgtatcaggaaactgagacattcttaagttgaaatctcagaagggaagaatgatatgaagattctcttttatcccatttggatttttttttttttttttgctcttaattgtgttgggagcaaaggagtctaatagaaaaacatgatgttggaatgtagctcttttatttataggcagtgaaatttatgttcataggatagaaaagttatttgacttgtatgtggtatatgaggaacagtaatttttatatatgtgccctaatgatatattttggggaaaaaattctataaccatatgttttaaaatcatatataggatttttattttctggaggaactacatttggtttttgcatgtttgatggtaatttgcttctcaaaaggcagtaacatgtgaactaggtaaagaaatcagaaaatgagcaattctgacagtgcttttaaattgtgaagtctgatttgaagattatataggtggcccatcttagtatagtatcactctggctttcagcccagatttaatgttgctgctatttttgctggcaggtgagcttccttggactcattttattttagtaacatttttgaatttagaaatttaatttttaaaatacttttgcatgggcagaaaactaaattttgtctccctatgaattatctagaatggcatttaggtcttttacatcttatgtcagcctgatagaatgtaaactactggctagagttgcaggatataatatataactagaacaaatcaaattgctgcataaattacagcctttaagcagctgaactttgagactgctctatgatgtggccttggtagttgccttaatgttatgagtccataatatatttatttttatagtctcagtagtattagctgttgaaattggtgcttctaggatttctcctggtacttttatgtgaacttgaacaaagactagtagcaaccagttaatttctaatagtttgattcattaagaattacttactagtgttaaaaggaaaataaaaatggaggtcacagtttagatagatcccaaggccaactgcctataaccctgtaacccaaactcaagtcattctgattcccctgaaacactatctctacttataaaagaaccacaaagcatgaggtttacatctttgccagcatgattcagtgaaattaaaccaatcagctatagacaaatataaacagctccacttgcattagaataatgttagtgtctaatggccagtcacgaaaaaggtcaaaatactttctcctttataaactgctataactcctgtgaggaagcttcttatgacttgaagtttcagatctcaatctgtactttttgcatgacagtgagctttaaaatttttcctaacttgatctaattttatgtttgataccagtaaatggagaaattacaactctcttaaaacatttggtgcacttagatacggttttgttatttagatttttcctttgtgcatgaagcaatattaaataaaatcaagcatcatcatgttgtacatcttctacatgtgtttttaattctctttcttaaaaataccttaattgtgttattagcacatttctaaatttaaaataatgggtgatctttatagtaaaatatttatggtaaagtataatgcctgtgttaaaagtaaatttatttcaagtttcttgtagattattaaaatccctttcagtaaaatttttttctgaaaatgttcattgttctatagaaataacatgagagtatgaaaaagatggtgcttgctttaaaggaaattcctaatttctgacaagttttaaatggctgctgttttgactacacactcagagctgccaaatacaatattttgatatgtggtcaatttcaatggcagtaaagttttaaaaggaaaaagagtttgtgtgtatttaagaaaagaaaattgaagatgtggttcatgccctaaaataggtcaaaatctaatgaacaatatgaagtataattgcatataaatgacatgacatagactctaataatgtgggagttcttaggaggatgatgagtgaaggatgagtaacaggggtgaggggagcaatgtgaagaaagtcatgaggtagaaacagcctgagctggaccgacctgattaataattgatataaatccacaatctttgtaagctcttacagttaaggcagttaggtgcttatgagaaaattgttacactggtggctgcataaaccctttgtttatattttgaagcatgtcagagttttaatgattgctaagccataagcttctgatttaaactttgactatgatgtcaactcccactccttgaattgttcttaggaggctattaaaatgggagatcctttatctcaatcttcttgaagtttaggaccacctgatttgctgagtcagttggttagccccatagcctttgaggccttaaaagagctgtttttttttttttggaaatcaggtaaagagtgtggtaagagactattttccatagtgatacagaaggcagggaaatgaacactctgaggaatagttgctgtggcagtggaagaggaagcacttcacctacttatgtgactggaggaagaaaaaggttgtgatggcacagaaagctaagcctaaggggctttcccagccggaggcacaggaaaaccctatagtaattctctcccagtcatccttcccaacactttatttcccattttcagtataattaaaagactgttaggtgaaccttttttgggacttagtgaaaattttactcaaagtagcttacttttagcattcattcaatgagtctagccaatagtgaatttcaaaggttgcataatataaaatgtgaaaattagaagactgattagaattaacttgtgatcatacttagtttttcttttcttcttcttctagtactctttgctctttttaatcctagttaggatcaaaacaagcacatttctatagctaagaagagaaaatctattgaatataacttttggacagattcttcagtgaaaactttttttttcagattaaaagaatttttaaaattcttttgctttttttggacatctgctgtcaggctttccattttcattctctctctctctttttcttttttgagatggagtctttctctgttgcccaggttagagtgcagtgccatgatctcggctcactgcaacctctgccccccaggttcaagcgattcttgtgcctcggcctcttgagtagctgagactacaggtgtgtgccaccatgcctagctaatttttgtatttttagtagagatggggattcaccatgttggccgggctggtctcaaactcctgacctcaggtaatctgcctgccttggcttcccaaagtgctgggattacaggtgtgagccaccatgcctggccctggcttttctattttcttttgcaatttgagtgttaagggtggcttgaggttatttagtctagtgcttctcacaattctatgtgtatgtgaatcacctggaaatcttgttaaaatgctaattctgattcagaaagtctaggctggggcccaagattctgcatttttgacaagtttccaggagatgctaatgctattggtccagggaccacattgtaagtagcaagaattgactccgttttctcaggttatagatgaggatatcaaagctagagagaccaagtggtttttacaaggtcccatacctagttagtaagggtggacttttaatttttaatccgataaagtcatatttttcagcataaggaaatacttaaaaccaagagaaatcttcctcttcccctaaatagatggcagctcatttgttaaaccaactttattcaatttgaatctttaagatgtgtcttaagattttctcttccatccttattgcttttgaagatttgaagaaaaataaataaatggatacattgatttatttgaatgtgtctgtatccagttattagagtccttactttctggactttagatgatcaggaaacaggtttaagtgaccttaggagatagtaaaatatattatattcaaatctagtttttgaggtagaagcttcttgctatggtagggtaaatcatgtttttatttaaagtgactgttaatgtacactttgttttcagacatttacaaactggaggaggtaatgtaactagttttttgtgtctttggtagtgcctgtatgaatactttttgctcttgtctgtgaatctagtctggtttttcttgtgccttaggaaattttaggattgtcgcagcactggaggtggggtataaacgtgtgtaagtgcatgctacttgggagatatgggactacataagaaccctttcaacccttgataattccataattctctaattctttgaagattggtgaaaaggaggaggaagcatattctatcccacggaagtggcagttaatgagatgcatgttgcccttagcaaatgaatttagtcctaacttgacaattcttttcaaaaagtgaaagatatgctttgataatttgctcgttgcacttccccaaactgttagttgattttataaatttgtagagggtggagactttatcagtcaatttttattgttatgacagttattatatttctttttggtagataaaggaaacatgaacccaagtagatttaattataattttatttaagttatcattttactaatctttattttaatgagatagattgtgggaccaaaacatggtcaatgataattttccattgtgtattatagctttcgggtttattgtgtatgtaccattattgttagtaaatcttaagaaattcttttggtatattgggatatttcaggctctgggtttgtttttatcattctaatgtttagaaaacaagctcttagacagattgagacctacctgattcaagtttttaaaatatgaattctctgttttgagttatcgctcattcagtgcagcgtctgattttacaaaatttactttggttatacctattcatagaaaaatgaattaaggaactattttactatagttgttgactgcctttgtgtaaatatgtttatatgtttgggtgtgtggtctgtgggtaacctttaccaagagttacctgtgattcatttctctatgtttcaaaatttctgtgttcacttatctctttctcttctgtgttcaaaagggatggcttcctgtttcctgtttatagggttcttaaactaatcctttctgttttattcagggttttgttttatcattaaccccaactctaactcttctttggattgtgtaaagtagtactagtagcagctgtagttgtagtggtagtagtggtagtcgtagtactaatgatatctagctttaattaagtacttaattaagtactctgtgccttggacataataacaatagctgatactatattactgtgtattaatcactgttctagtatcttttatatattaactcatttaattcttttctttaatttttaaaattgtggtaaattacacataacataaaatttacattttaaccatttaaaaatatgcagttcagtggtattaagtacattcatattgtgtgcaactgtcaccaacatctatcttcagaactctttgattttgtataactgaaattctatactcattaaacagtaacttcctattctccccatgccccctggcaaccactgttctccattctgtctctgattttgattactctaggtacttcatagggaatgatacagtgtttgtccagttgtgactggctaatttcacttagcataatgccctcaagtttcatatgctgtagcatatatcacaatttccttccttttaaaggctgaatatctttccattttatgtatatgctgcattttgcttattcatccctccatggatacttggattgcttcagtggtttagctattgtgaataaggctgctgtggacatgaatgcagtaactcatttaattcttaaaactgtcttaggacagtttaaaacttctggtgaggaaacagacacttagtcaagtaacttgtgcaaagttacataattagtaagagctggtatgggatgaatggttcttaaccactatagtagagtgccatataattttctatgctggtaccttctcttttgcctacagatatcttcacccctctttgctatatgttaacatgtaattaatggtatgtagtacaaatacttttaatgctaatgttggcaaatgaacagttcattttatttattagtgtttgttgcatttcaactatacttcaacccaattacaaaatgaagttgaaactccttaagctggattttaacactcctacttgctccctgtatgcttctctttcaccatgatgtgatcatttattatatgtagtagctatataattcctggacaaattggagtgatagagtgctttgactaggacctgttaattggagtatgggagatttcatgggagttttgaataggaatttgaagatatgtattttgagacaggctggtgtagtagtatagctacatgggcttagaaacagacatatacaaattcctgagcagtggaggatggcaaaatgagaggagaataagcaagttgcaactgtgaagttaaagcatatagttaggagttggaccttcataatattggatgagatttttggttccagtctgcctgcttgatttttagggatctagatagcaagcactattgagtctggaattacaggctctggaacttggatttttcatcagagcccataattatagcagtcataccattgacagtttgcaaattaattttttaaaattgttgagtagtttggaaaaaatttgctccttccttacacttggtatttaatatgtcattaattttgtggaataagagagaggaatctagaaactgacactgggccccatgccctgccaaactctgtcatagtgttgctttttaaattgacagatttacacaagactctaaatcttgatggttgaagggactttcttgaaacagactttgaagacgattaataatctgttaatagaaataagcacacacggtactttgataaggcttgagattttttgattctttatggtaggtatctctacgtcttcaaaatttacttgtgatgaattaactaaaattaaaatgaaagttacagtcttttgactgtcgacttttctatagacataatttacccagtactgttcattaagattaaactgtttagataaacaggacatagtaaaaaatttgtggtagaagccacatataaactaaagatggctatgcttatgtagaagacatttaaatgttggcaaattgtccaaatcttcagtggcatgctgctggcctgccgtttaatatacaattaacattctaagatcaaagactagttagattaatttgacaattaaattggtgaagaagtgaataggctttgcaatttaaaattaaataatacatgttgtctgcttaattactgttgtgttcatgtaagtgatcacataatagaagggagctgtgggcttaaagtgaatttaagaccataaagccataatcagtcacatctgtttcatgactttaagttgatgtggtacgagtgtgaaagaagagctcattctttgaagaggcctgctgtacttacagaatcaataagtcaaaacaaaaataactgtagggttagaatctcttatattgccgaatgaaaattttgatagtttttggtaaagagattatgttagagctatgttgtcatttcactgactgttagcagcagtaaaaagtcaaaaaatggttagacagtgttactgtgtgtgtgtgttcttttaaatttgttaatgtgaaactgaggatcttaatatgagtccattgaatttctgggaagatgacataaggtaaagtcctcaagactgccccctcttcagacacagttgcaagtcttagcctccagaacttctgaccagctagcttcaatttggagttctcacaaccccctctttggattcaattaatttgctaaagcaactcacagaattcagggaaacttacgtttactggtttattttaaaggatattacaaggaatacagatgaagagatgcataggatgaagcatggggaaaagagtgcagagctttcacgtccaccctggatgtgccaccctccagtaacgtccacgtgttctgctgtctggaagctccccaaaccctgtccttggtcttttgtggaggcttcattatgtaggcgtgagggagtaaaccattgaccattggtgatcaacttaatcttcagcccgttctccttcctagaagatgtggggtggtgttgaaagtcccaacactctaatcttgccatgttctttcctagtccccatcccgaagctacctagagctgccaaccatcagtcaactcattaatatacaagaaagcatcattttggtgtttctgaggattttaggatttgtatgccaggaaacggttgaagaacaaatatatgtatatttcacaatatcacagatgcaaacaaatgatgtttaaattatctggtctttttctgagattcattaagtttagattgtatttctatggaattatagtataaatcataattaggtgcctaaactagcctctaaagcttattcctaaggtagctaaattacttattatgtatatatactatgaaaaatgacaaaatgtactgtttcaacactggtaattaagcaaactgccattgtaacataagaagtttatgaaaactattttgaataatttaaaaactttggggaaaactggattttataagataaggagatagagactattatataaggaggttgtgaaaggggttttgacactgattctttattgtctagatggattaaacaacttattactttaaattttgctttatacagaagtgtcactagctttgatcagagttttcgttggttcatgaatggaactaagttaaaggaggtgagaaggagaaatacgttttttctttttaaaaagttgtaaaatatacttaagatttcttatttaaaaaaaagagttgaaagaaacaggaaaaaatgggttaaagaagacatgggtatatcttgcaaaagaggttatcagaggcagaatttactgagcagtgaggtaatgagagaaacaggcaaagtgtgcatgagccccatggggaaggaagaaagttggagtttggcaagtcagctgttcttgtattgttttttgaacacatgacaggtgttggtgagtagggggcatggtgtgaccaactgctcctatgtgaggaaggtttatatattctgtctgggaaagtggtctgaattttctttataagaaattttagtatacttgaatttatttctgtatactaatacaacattgagaattagctttcagggacttctgtgccaattctattgggaataaaaatgagaagaaaggtagcttgtatagaaatagcagaggtttggtagtgaattcttatgagagaaaagatgtacagagaaagtaaactctagaattagcattatacacttgtctatgttgaaggatggtaaatagatggtgtgtctcttggcatgaagttaccaggtaaagggctagtattatgtaacccttggtattaaggatatgttagggacattacagtgggatttcatcataggcacattaaacctccttacatttagctgtatatattgaggcaaaaacaacaacaacaaaaaacccattaacatgttttttttttttttaagttaaaaaaaaaatagagatgtggtctcactatcttggccaggctagtcttgaactcctggcctcaagtgattctccgctttggcctcccagagtgctaggattacagacgtgtatcactatgcttagccttcttgactgtaagcaatagaaatcaactttggctaatttatgcaacggaataaataaggagaaccacttttggaaaatggataggaatcaagggaagccagcagcaaggaccagagccaaggtcagggcacaggaacactttgattaggaagccaccattagcacttgctgacaatgtctttgctgttgctataaataattctgcaactattcttgtgcctctctgtcactcaagttaaaagttttgggaaaggaacatggatagtctggtctagatcctgagcctatttccagcctgctaggggtagggaaaatctgggcctttggtttccatctaaactcatggtgtccatcgtttcttccaaacaaaatgggacaattactgcttccttcttaaatgccccatggctcagtaaatatgcccagttcctgaagccagaacttggaacttctctcattttctcagtcacatatccagtaaatagcatattgaattactgtcagtctgcaacttgaatatcttgagtttatctatttatctctaaaattattgttactactgtcgtagtcactgtgatttctcacatggtctattacagaggccttataatttctcttgtctacagattgacccctattctgttggggtatacattatgtggtgatgaacttttaaaaatgcaggtgagattatgtcattagtttgcttaaaacattttagtggtctgcatttatttacctcccatctctcagttcgagtccacccttttattctgtgttaggggctgggactttgcaacctacatttcccagactcccttgccagcttacttcgtgttaagttttaccactgggagcacaggcaggaatttggaaggtgagagaagggactactcttattcccagtttctgtaaggacacctccaaaagcaaaggacaactattactccattctccaacttcttttgtcactctctgcaccagtcttgctgtttcctctcagagataccagcttctgggcaaggcatcctaggtagatagagtgccacttgtatcacttcctaacctgctggactttattcccttagtggtttgaccatcctctattggacacctgttcatagggattcaaacttaagctacagggccatttgtgaccacctccttagaggttagagcattctgccacatggacctctttcaccttcttccaggcatagccctataatgcttttcttccaagctcctagcttttcaataacagacctctttcattttgttcccctagtcctgcgggtcatagtgcttcctgcaactattaatctctgagttatttcagccttcctgttctatgttctcagctttccagtatctttgtaaccaatgtgctgtattatatatatctcctgggtttgaattctgcattatggtttctgtttgtctcatacaagtagttttttgttttctaagataaagttaaaaaaaaaagttaaaataactagtagctgggggtggggggattaaacagattttcagactgagtacggtgacttatgccggtaatcccagcacttttggaggctgaggtgggaggattgcttgagcccaggagtttgaggctgcagtgagctatgttcacaccactgcactccagcctgggtgacagagtgagatcctgtctcagaaaaaaaaaaaagttttcataattcctatttgtctgttacttctttagtctcatttcataccattttcctgctttctctttacacttgagtattctgaaccttttttagttaccagaacattgctgcattctatcttgtctgaaggacattgcacctactagtctgtgtactccaaccctcccatccctcatttctcttcttctctcacattacaacctgtgctgggttgactcctacatattgaatgtgagggttagtatactgtagagggtgtacaaacaaactattgtctaaattttaatatcagcgttgccgttgtgtcagcgttatgacattgggcaatgtctcagtttcctcatctggaaaatggggataataattttactgacctggtgaggttgttgtaaggattaaatgagttaataaatgagttaataaaagtgctcttttcttcagaacatagtaattgctcagtaagtgtaacctgttgttattatcagctatgcatgaattcctctggaatgccttccatgatctccaaactctgacaggctctacctttgtaggctcctgtaatagcttcttcttcactgttctaatatgtattatggttggaattatttaatatcttgttttctttttaagagtgtaaatgatgtgaagttgagaagagagtctgtgccatttgctgttataaccctagcatctagtactgcctagcatctagactggctccaggtcggccctttaacttatattttaaaaaataattgattaaaaaatttaagagaaaagccataataagtttgataggggctaggaaaaatggatagagatagagatggtggtgaaataaatcaatgtaaatgatcagcttttctgtttttattgcccatcaaaatgctctagtatggaggctgtatgacagaagaagaggaatatctgttgttttgaagccactgtggtacaaagaacaagggttagaatcctgtcttaattcattgccactttgcaaagggaaaatgtttctctgggtctgattatagactacatttctggcttggtggcttttttcccccttgtaaagctttaattttgccccctgtgtctaaaagcaatttgtgtttatttctaaaaattttgaaagtacagaaaagcttaatgaggaaagcaaatatcattgataattctaatacatagagatggggcagctcttactattttggtataggctttactctatatttacgatatacatacagttttgtcctcctcctttcctctgtaattatttaatgtattctggttttaaacttgcttttttcccactaaatatattgtaaatctctttccatattaatgaatatttttatcattgtttaaaaaatgcttgactagtatgcttttacatgaatatgcaatatttattttacctatttgctgaatgatggacatttgagtttttatcctttcactgttataaaatattatgatgaactttgttgtacatacagctttgcttaacaaatattgagtgccttcctttagtgtgtattcaggtagactgtgcaagatacttaagctgtgagaaggaacaaaatagataggatttctgccttcatagagtataagataaattcctgaattgatgatcagagttgggtctaaattggtgataactttaaattaccaggagtttaacgaccattttactctcagactactgggaggaatgtgaattaggactctaaggtggtattagttaccattgttttctgtcagttttccttctctttaattatgtacttcctaattttattaatgtatatttggttgttttacttaattatatatctcacatctcagcaactgctctgaaagattatttccagttttggtagaaaacctgcatttacagtaaagtagtctatacatctggcttttctgtaatccatatacctttggtttatatactttagcattttctatctgggaaacgtatactgaattaaattttgccttttaatgggaatgaatgaatataatacaaatacctattgataattctgaatattaaatttgcagttgagataatttcctaattaataagaaattatattgcatcatagttatatactaaggcagtatctgacagtttgtgaggtagttgcttctttttaaagaatctggctgctttcagggactttggagtgatgtggaaatatttccacattccttacatgaaatagctccttactttttgttagtatcgcataacaaaagaacatatgatttggaatgactggagttcaaactaaaaatcatagctcaggaacttgtgttccaaagcctgaaaatttatgtgtgcagaagaatccctaaataccaagtgctaaataatttctctggtgtttctgcagatgcagaagctatccttttgtaaatcccgtcctctaaagctttttcttccttagtcttttaaatctgtttatacacatgtgtgcatagaaaatattttcttttgattgatactctacttgatttaaaagaaaaggtctgatactaagatgtgtgtgtgtgtgtgtgtgtaaaataaatacatcttcaccctgggataatacctattgtgtttaaacattaaatttaaaattctcaacttctgggcagtcagtgaaaggggaaatataatttcagttatcattattacatgatcataagagtaaaccatttcttttttctgaattctaacatttattagcttaagtcagcttttctcaaattgtaagtatagaataccaattctgtcaaattttaacagatatcaggattaagtttaggaaacaatggactaaataagatgaacagatttatttatatattttatcataactttaaatatcctaatatatatcttgacgttctaagagaaagatacagtggtttcctaacttatttgccttgaaatacccttttggtgaatatcagctttgcaaaatgccagcctaagtccttaacaacatgatgggttgtgtgtcttccatgccatttttgcagatgatgtcatcattgctttttatttgatcttcccttttgttgatttaaattccttttgaaacataatccaaggcaaagcttacttcttccaagtagcttagattctctctatccaccaggaattgctgcttttgaaaagcatgtgccagagggtcttgcgaactaagtattcctgttgtctgtgtgccagctggcctggcatttggtctaggagtctttcagatacacagtcagtccagactgaggctgaatttatttttcctagtgaaacctgagtccccacactccccatctactagggctgcagctattatagcaagggcctgagctctccatctgctccccagacacctgctggaactaattatcattattattaaaactttaaaaaaatttttttctattatgttgccttttttcctttcctttttcttttttcactttttttttttttggaactgattattttggaaacagcaaagaacaacatacttcacaatctaatccaaaaacataagcccctttggtcttccatgctgctcttttccattttgtttgtacacttgttttcccttcatcagctctcctatttctcctcacctatcctaaacatgtgtactttgctcttcagaacattggtttgtggttagccagttatccactattatattagcttccatatactctgttagcttgcatgtcttcatgtaatatttcttctgtcccctaatcttaacttgattcagctgcatctttcagtcgttgctgccttttttttggacatacctcaggtactttgcgggtaggaggttgggcagtctggtcagtgttctctttcattttcgttggtacctccagaccactcttcttccattctttcatttaacaccaaacaccaaacaaaaacagcctaacaaaatgattctgtttctttgaggcttatgccttttaactttctaatcttttttgctataaattttttctcattctttgaagactttggttcttggatttgatcttcattttcaccccaagtcttcttattatccatttggtagcatagcttcccagactgtaatgtcttcaacatcagtccatctggactttatatgtggtgtgaaatagaactccattcttgatttgctgatgggaaatcagtgatgataacctaaccatttgaagaatgacaggttgttaagtgtatgaattcccccatatgttgattgagtttaagaagataagagataattgaaaatcttatggctgtgtttaaaaatattttaattttatagtcataaatgagaagaaaagttatacctgatattgtggtacctggctatatcatgatattgattcaaagagagggattagctgttttgctaacaggtatggtagaaagagcactggataatttaaagtctggcaaatggcaaatcacttaatgtttttcactgcttttttctattttgaagtggagagaatacctaatccatatagttattgagctagtaaagtacatttatatatgtgtatatgtgtattttgtaaactttgaaaggcttcaatgtttaagatctcataaaaattagagaaccattctctgttaggatggattcataaggttactcctgaatatcacattatctccataaaaaacttagaattccctatactctgtgttttctataggaaatgaaaaaagttaaaaaaattattatttgtggactaggcgtggtggctcatcgctgtaatcgcagcactttgggaggctgaggtgggcagatcacttgaggccaggagttcgcgaccaacatagtgaaaccccatctctactaaaaaaaagaaagaaaaaacaaacaaattagctgggcatggtggcacacacctgtaattccagctactctggaggctgaggcacaagaattgcttgaacctgggaggcggaggttgcagtgagccaaggttgtgccactgtactccatccagcctgggcaacagaggaagactctgtctccaaaaaaaaaaaaaaaattattatttgtgatactttaatctacatgataaagagactccagtgaacattagtctacagatgtttaaggtctatggaaaaccagtatgttatttctcatgaccctgttcttgatattatactgtaaatattagctttttaatgtttcatttacaggtacatgatgttgattgatggcacaaatgaagtttttatgattgatagagacaattcagtatttcatgtttcaaatctggaatttccatttcgtaaagatcttcgtatgcatttatcaaatactctcttggatggcgtaagtcatatttatgtatactataaaattaaacattgccatttttcttttccttgtaagtaaatgtgtatttctgttggttaagaaatttcgaatgaaatctaacttttttttttttttttttgagacggagtctcgctctgtcgcccaggctggagtgcagtggcgggatctcggttcactgcaacctttgcctcctgggttcaagtgattctcctgccttagcctccccagtagctgggattacaggcatgtgccaccacgcccggctaatttttggatttttagtagagaaggtgtttcacatgttggtcaggctggtcttgaactcctgacctcgtgatccacccgcctcagcctcccagagtgctgggattacaggcatgagccactgcgcccagccaaatctaacttttattaggatgttaaatttcatttatttcttatgtatacttatattgaattaaggtcctcttaaagagagatctgccaactgaatctttgagcataagtaagactttgagatattttctttggtggagaaatttgttaaagatatgtaaagggtgttaaatgagtgctctggtcaaatatgtatacatatggatagttatataattttgcatgaagagaaacaaatgttacatgtggttagtaacttgtctttttccccacacttagcaatgtgttttggacatctttttcacataaatgtctgaatggtttaccattgtgtatatagagaccataaattggggtttccaaactatcttgactgtgaaaattgtagggttaaaaaattgcttgtttaaaatatgaccctttccaatagcatatcctagaccatatgaattggaatctcccaggggcctacatgtccgtacaagtgaccaagtgattgtaattaggcaagtttgagaaatagttctgtaatttatttaaccagttcccttttgttggacattttgatttttgtattttttcctgtatctagtaaattttcattcctgtgacagcatgagtaacaaaataccactttctaataaaaatgatatatatatacatatgtacatgtatatgtatctatatgtgtatagatttaactatcatagttaatgtgactggtacccttggggttgtatagtacataaaagtcatagtcatttgtggcagctctggtagttggttcatgggaacagcaggaacattttagtttttgttatctttatttaaggtactttttttagcattataattaataaaatataagaaaggaaaagacttaagtaatagcatttgtcaaagtttagtatagtttataattgaactaatgtttgttgagtgcctattatgagttgctataccaagagtacgggtattgcttagagggttgaggagaaggcctcacccttgaaacattttgcttaattgagcagggtggagaatgaatggtaatgatggaagagacctttgaataaaacaataacccaaagagaggtatttaagtcctgaggtagtttagaggagaaataaatcacatctagttagttaggaactaaatatgttttgtgtaggagttggcattagaaacagaaagatttctatagaaagatttttgatggacgtgggctgagggcattctaggtaggaaataatgcttaaaaattagatatttaaccatctacagatttaacttagcaatactatttatttcacctcaaacttggataactgagagcggcataatagattcttgtgaagttttaaaaatagcagtatgattcatgatgtcaatttacttgggctagaattatagttgccatatctgtttttttttgttaattaaaacagtcctgtagtttcctgtttcttctacattttcatgtgcaaattgtttttgtaaaattccaaatccaagaataattcaaaccacctaattgtctgactgtcagatgtgagcattgaagcttttgttttgctttgcttaactatgttctttgacctataaaatgtggaaaataggaatttagaaatactgcattaattcacttgaaacacatcagtgaaatttaatcaacttaatattgagactaagataagaatatagcagttaatcattaaagttaatggcaagaattttggaaaaattccatgtctttttcaactattaattttttataaaacactacatgcttattgttgaaattttagaaagtctgtaaacttagaaaaaataaacaatcaagagatgacattttatattttgatgttaaaaggaaatatccttttagtaactttgttgtgctaataattatataacatgtataaccaatatgtatatagctgacatttaatatatgttatgtatctggggttctgttattcctcttcaatctgaagaactgcttttaggattttttttttttttaaatttagttctttttttaaaaaaaattgagatacaatttacatactatgaaattcactattttaagatgttcaatctagtggtttttagtcttttccacaaggtcataaaatcaagaccactatctaattccagaacatttcatcacctatatggactgtgatgattagaaccaagggagccttatatgaaagatttcaaggaatgagttacagagatgagccttgaaggcccacaggttttgaaaacccttcagtggttccctgttattcatagcacaaaagccaaactgttcaatataatattctttatatctgaagcgtgcctgtgtcttcagtctcatctttgattgtgattgctaatcacaaatactcagctttggacaatttcatgcctttgttataccatttggcctatccactatcctgctggaaaatatactctgcatctttcaggatgcagctaatggtcatgtaccttattaccaaactttctcttattcttcaagtagaaataactacactccttgtacttaggcttaggtaatgctttcttacaacaacaaaatatatttttcctaaatcagtgtgttttttttgtaattttagatggttgtacatggaatttctgttataaaattagatagcaagaaaacctatctggtttcctagtaagaatatgaggaaagaaaaataattttaggtcaaaaacatattaataattaaaattttaagtaatactgcattttatacctgtagtcatcctttaatgtccttatcttgttctgtcagactgcattttttttgactttttaatggctatggtagatttgcagtgatctgttcatactcccttgccctgttccctttgaacaaagcctagtaaagtggtatgaaaccaagaaaggccacatggctcacatgggaattaaatctataatgaggatgccatttattgtcatagattttatgattaaagtaattggtgtataacaaaatttaaagcattaatgattaaacaaaaatatttttaaaaaagatcctgacgtttagaatttaaaatttgtagtcttcctacccttaattgtcacttagtaattcaagcataaagcaaaatgtagcatggaaattcaaatatgaaaaatatgatgagatattgtcaggtgattctatttcagtatagaataaatgcatgatggggatggggggctaacagtttattgatatgatctgggtacaagtgtgttcactttgaaatttcatcaagttgtatatttatggtttatgtgcttactgtgtgtatgccatatttcaattaaattaaaaaaaattgttattaaagtatgaagaaacttaccttcttttctctttcaaggagatgattattgacagagtaaatggacaggctgttcctagatatttgatatatgacataattaaattcaatgtaagtacctataatttataaaatacaagttattactgaaataatgaatgtatttttgacaatagtctttggtgctgccttagagatagtaggaaagaaaatttgtgactcaggttactcactgggaatcttttttttaatccttttatatctccttttctttctcttattgttaattttcacacatttctttgttttaggtttctttaacttgcaagtgagtaaagaataatggcataactctgataaaataagacagcatttcataaaatgaacatttctgattttaattatcctgtacttttttcttttaaatctcatgagtttatttctgtcaccaaaacagcaacaaaacaaaagagaaactgattatgagctgttgaatgggtaataaattgcagtattaattcaggattgcattaatccaggttattaaaagacatttttttctggacatttttaatgcacacatctaattttttgattgaaattctgtatttaaaacaaagaacttcaaatttaagagcctcagggccagaaaacatcaagttttattttgttctgtttgactgtattcctcataagtactgctttccagaactggcttaatctcatcacagatcttggaataacattcattggcctataactagacataaggggtggcggggtggctttgtttctttgtgagtagggaagttctgtctcctttacttcttgacactgagctctgctttaatacatgttcagtctgggcttactctcacttcttagctgagtactgtctcttagatagcagttttctaatactttttaaaaatatgaaaaatttcaccatatagaagagtctgaaaaataatgtaaggaatactcatgtactgaccagctagatttgttaaaacttcatacttttggtccactttctttttaataagacatgattcattacgaatccaatagaagtttcttagttacacctctctcctaatctcaaatctcttgcccagaatcagcctctaccctgaatttggtgtgtttattgttcccatgaatgtttcagatacttttactacctatgtgtgtatccatgaaatatatatgatattcttttgcaaggtttctggtgttatataaatgttattgtactatacctttgctgacctttgctcaacaagataatgttgagatttatttgtactaatatgtctagatttagttcattcactttaattaccattgagtattaaattgtataaatatacagaatttatcctttttccttttgatgaacattaaggtttccattttttgcttttatattactactatattgaacaattttatgtttttttcttgtgcgcacatgaaaatttcgctaggacagttgttctcattcttggaatgtaattacctgggaagtgtttttaaaaactctgttccgtcattagtgtatcatggagatggtgattaaatcagcagcttcagctatattatctgcattgctaaatttctctcagaaatagttgtttcagtttgccaaagttcgttttatcacacatttatattattaccaatttgatgtgtgtgaaatggtatcatcctgttttaatttgcttttccttgattactaacaaggtttaacatatttcttattttttttttttacttgtttggaatttatatgatttaattgcaagtttgtataatcttataatacaatcttctgtttttcctatttggttgtctgtttttttccctgattaccaatgaagttggacatatttctgaggtttatttttatttgtttgtatttttcttttgtaacttaattgcaagtttgttctatttggttttctgtctcttttttttcttcttaatatgtaggagtcaattatctttcctagattctagtcctttcctggttatatgtgtggcaatatgttttccaaatcagtgtttattaatgcacagaagctttaaattttaataaagtcaatctcatcagaccttcccaaatattatactttttgttttgtttaagaaattaatctatattttattctaaaaatgattgttatgctttttgtccttaggtcaataattgtttattcaatacatatttattgtgtgcctattaccatattttatgattttaagccacgtatatttttacatttctgatattgggatgcatttataattgaaagtatcgtatatttaattctttaatttactatggagtctttatggatgattaacaatattatttattttgtatcaccaaatcagggccactgttagaaaaagaatttttttgaaataatatttaaaatcttttcagtcccttagtttattagcttgtccagaaagaatttcatcaatcatctttttttttcaccctctgactctcagcatcgatcatcttttatatgtcaagtacatatgtactgggtatacaaagatgaatgagacataatttcttgcctttaaagaattcacatgctagtgtactggcttccaaagaaggccatttgcacagcgtttcattggaatttgggaagaacacaggagaacttaaaaaaaaatttaatattttattttgtcagttttataacattttacattaaaaacgtaacattttgtaatattttacagttgtgtatgtatacacatttttaaaaaacaggcattttttaatgtatttgttaggatatgtgtttagattggatataaaattaaagcaaatttgcagactattgatgaaatataaatgtaaagaaataattataactttaaaatcataaacataacaaaggtatataaaagatatagtggtattagagaggtgagagtattccaacttccctgggtatagttgagtcactgaagcatggaattgcagaccgagaaagtgacacaaattagttttgaaggattgagtcatggaggtcaggagcattagatggtttgttagcatacatttttttttttttttttgagacagtcttcctctgtcacccaggctggagtgcagtggcatgatctcagctcacagcaacctctgcctcccgtgttcaggcaattctcatgcctcagccttccgagtagctgggaccacaggcgtgtgccactacgcccagctaatttttgtatttttagcacaaaaatacaaatacatgaggttttgccatgatggctacgctggtcacgaacttctggcctcaagcaatctgcccgctttagccttccaaagtgctgggtttacaggtgtgagccatctgcacccggcctgctagtatacttgacggatggtaaggtgtgggacatagcaaaaaatgagaatggattgttaagtagagggccagattacttgaataaggcattttaacttagttctttatgtaataaggcattgttaaagggttttcattatagtaatgatatgaatatacttttactattttgaaagataactagtggcagcatggatagtgttttgaagggagtaagaactgaaaacagggagacaagctagtcaataattattgagtgtttcctgtagtctcttctcagtaattcaacacctatctgttgagagcttaactttgcccataggcattgtggatttgaaggtgaacttgctttcagtctattcttgaagtttggtgaatttatgtataaaggtagaaagcttctaggagggaatttagacatttacatatgttttaacagttgttagactttttttttttttagaacataaaagagggcttacttattctactttaattttataggtgtctgaattcttttaataactctaataaaccagcctaacgttttagatttttcaaccttgttgatgatgttgattgcatagaagagatgacacatggactgtatggttatttactagcatttccccaataaatatcctttacagatggttgtatgcctttatgtaaagagaacgtgtgctacctcatacctctcactcactttgtctctctccttattctttgctgaatatcaaagttgtcatccttctaaagttgagaaaaagacatccccaaggtatatttaatgtttactccttaagcaagtgctgccacccctatgtaaacattaggttgagtaaatgttaggttggagaatatacattggagaagaggaaaaagacagaaaagatgggggaaaaatgcacttaaggtgtgtccagttgcaaaataaaagagtagcttatgtgccattgaagcgataattactaatctggatggttactgtcaaccagataatatgttataactgtgtttgtatatgccacatggataggacgagacttatcctcaattcatacaaaagtgttcatgtactttttatttcacagttcaaaccatatatgctttaagaacattcaagggaaagtgtatttgagggagagtactatttctttataactgtataactttgaacatattatgtaaacttctgtgttagcttccagagttgagggtgtatttgatacatgtcttctacttgctgatgtctatagcattagcactttaaacaacaaaaaacattgtaggtaactgtgcgacctattttggtgtgttactcgcttgtacttttctgaattctgtggattttagtttttatactgtaatagggtactgttaaagggtttcaactaatttatataaataattaaaaaagactagtgagtatatattttttctattttaaaatgattctgtacctataaatagtaagtatattaatactttaattcagatgtgaaattgtttattttattttttattttttaaaatttggaagtggtggtcttgctctgttgcccaggctagcctcaaactcctgggctcatgtgatcctcctgcctcagccttccaaagtgctgggactacaggtgtgagccaccacacccggcctagatgtgaaatatttcgatcaacttacagtagaattgtgccactttctcatactgttttatacagttgtattttaaaataagtctctttgtgtgtttagatagttgtattgttagtcaaactaattattagggttggtatatatgtttgtgcacgctgtgcactgaataactccagaggatgctgtttacacagactattatgtacattgtggcagccttgataattatgctgataaaatagttgttagtgttgaaatttaactaattctttatttaattcagtcacagcccgttggagattgtgattttaatgttcgtctgcagtgtatagaacgagaaattataagtcctcgacacgaaaaaatgaagactgggctcattgacaaaacacaggaaccatttagcgtcagaaataagccgttttttgacatctgtacttcaagaaaggtaaagtttaatttttttttaaattagtgctaataatgtctcataattcagcttacaagatgaatatgaatgacattttgctgcccagttgtcttgactttgtcagaaaatactcgaattgggtatagcgctgttttggccaaacatggtacgactcctaggctttttctcttgaataagattctcagtggtggcacctgaaactaggctgtttccctttttctcataatagtttttgtttcatggtcattggtcatactacgttttttaaaaagctataagcaacatagaactgtattgaatgaaaatcattaggcctgctcctacacatcctgaaggtaaagtgtttggtacgtactcttattaaaaagatacatttatatatatgtgtatgtatatctatatatacagatatatatatagatatatatacacacacacatacattgaaggttttcttttagtatttttgttgtttccacttaaaatgaatcatatactaaggccaggctcggtggctcatgcctgtaatcccagcactttgggaggccaaggcgggcagatcacaaggtcaggaactcaagaccagcctggccaatatggtgaaacccgtctctactaaaaatacaaaaattagccgggtgtggcggcgcatgtctatagtcccagctactcgggaggctgaggcaggagaatcgcttgaactcagaaggtggaggttgcagtgagccgagattgcgccattgcactccagcctgggcgacagagcaagactctgtctcaaaaaaaaaaaaaaaaaaaaaaaaaaaagaatcatactaaatattccaagatgttggttctttttgttttgctttgttttttcacttaacagtatggcttggagatatttccatgtcagtgtatagagatttgccatgttatttgttaagtgctgcatggtaatgatagtaaaggtgtactatacattatgttgtaattgatgggtttttagattgcttctagtcctttgctattaccaacactgtttcagtgaacatttttgtttatatgggtggatatttcttcagggtaagtagaatttttggtttaaagattatgagtaatgttagtaactactgccaaattcctttccaaataaagcaattttgtctccagcagatgagagagctcattttcccattgccagcactctttttttttttttttgatctgtaggcaaggcagtgtattgtaatgggaaggtgagtatgagttttttgttttgttttgttttgttttgttttgaggcagggtctcactcttgctcagcctggagtgcaatggtgccatctcggctcaccacagccttgacctcctggggtcaagtgatcctcccacctcagcctaccgagtagctgggactacaggcgcatactaccatgtccagctaatttttttgtatttttttctagagacgaggtttccctgtgttgcctaggctggtctccaactcctgggctcaagtgatcagcctgccttagcctcccaaagtgctgggattacaggtgtgagccaccatgcctggctgaaaagttcatttttatgtagttaaatttggcagaatatttcttgcatcttctggttttctgtcttgcttaagaagcccttcatctctaaaatgtttttatattatgttctaatattgctatgattttgtctgatgattacatttagatgctctatttttactcttccattccttcagggaattgtcttctgtttgcatagtctatttagcatccagtttcttctattcactgtctcttcttcatgccctgtgttctcacatgaacatactaattctgtttatgcctcatcttctccattttccttttcattctcttttttttctttgttattatttttagtatcactcatatgactactgttattactggtactactgttattgctgctgcatagtttgttttcagtgggatatttaccagatctagtgtttaaaagcaattgtaccttggtatttctgttttttttaagacatataaactgcatattgactatttcctaagacttttctccatttctcatttgtgcttttggtgagattcttatttctttgtatataaactatacatggtgttttctgtgtgcctgttatgtgttaggatgtctgatttattgaacccaccttttaatttgtttttcttctctgacttcccgttttcctttcttccttgttttataatttgtctgcagttttgaatattcgtaagacattcttgcttttggtagtggttaactttcttagcaaaccgattgatggttctaattcatagatatgttagttggcagtcataaagctctgctctccttatcagaatttaaatgtattttgagcctgcataccacatggtcccatgcttgattgtatactgataaacatttgaaatgttttagaagttttagaagggataagggggcacatttggcattcagaagaaggccagctggctatttcctaagaagcctgaaggaatgttacaccttttgtgaaatttgtcatattccagaatcaggtttgtagcttcacagattcagaaactttgggaggcatttgctctttttatatttctctattgtgagttgaatttatagttcagctttgatactgggttatgagtacttttacattaaaattgcacgtggcatccaagaagttgcattgtggtgggattttattttctaaaccagtgttttatatgcctggtttagggcatttgaaaaattggtggccatgaagaaccatggtctgtttacattcaacccagggaatagtacccaaataatttatattttttgggaggagggtggttatgatagaattgtacaaaaatatagcaacatatgcaatcatgttttaaactcttcacctgctcctactctagtctgcttaatttggtgtcagtctttggatatgatattagctgtaagtaatcctagcactattgagtggctatctttttcattcaacaaatacagagtaatcatcctacttttattatgattttgtgtaacacctgcttggcatgggaattttggttgacctctgccgctatgatctttcgactgttcactgcttgccttttgtgtctgttttggcagcagggatattaagggggtacctacaagagcctgtgtactactgtgccctgtccaataggttgggtaaagataaagttaatatttaaccatctgctctgtccacggtggaagtctattaactgaaactgtgttctcttatgagaacattttctaaattgtaaatacagtataaaagttgggcaaaagccagattcctttggtttgtgttcatttttaaaaaatgaatttcacaggttgtgctgtcataattcagagttcagcatttaagaaaatgtgtttagatagtataatttcattagtcaaatcagtactgcttagaaatatttgctaatgtgtaatatcagaactattttttagggatttgaaacaattatgtggaacaacttgttatgtagtttttcactagaaagacagtgttcttactatgtttttctttatacttagcttatgtaattccttaaaatcataggatatttcttttttaaaagcaattcttgctaggcgtggtggctcacacctgtaatcctggcactttggaaggccaaggcacttggatcgcttgtgcccaagagttcgagaccagcctgggcaacatggcaaaaccctgtctctacaaaaaatactagaaaattagtcgggcatggtggcacatgcctgtagttccagctattcaggaggcggaggtggaatgattgcttgagcctgggagtttgaggctacagtgagccaagattgtgccactgtacttcagcctgggtggcggagtgggacactgtctcgaaataaataaataataaaagcaattctaatttttagaattttgaatagtctcctctcctcactttcagttcttattattgttttttgtccttaatgtctcttactgaagtattttcggttgtagaatacaaaaggaaaacacactttatagcagaattggcataacatgtaagaccttagtaacaccagttataggataataactacaattgacaggttattgctgtggagatttttatctttgctaatgggatggtaaaatagtgatattacgaaccttacagcattttcagggaagtatagatcatttattttaagaatggtagcttttatgaagttttaaacaaaatttacagctataaaacatgcatactaattttgtagaaaaataatagaatttcatatgtgtatctttaaaatctcaaagatgattctgattttaggaatttattaatattgctctataactctttgttttgtttaatttgatctgttaaacacaataaagggataattgttcagtttttaactttaatatacagtcagaatacaacatccaaaatagtaataacaagctgtttttcaaattgcgattctatttacatttccagtttgaaggccaattcaaaaagaattatttgaacagactatatatgactaacaaaactttaaaaacatgcagtaaaaagtttctctgaaagctccccatccatttatcaccttctcagtaaccattgctgttagcttttagtgtatccatccagaatttctttagcaataaataaacacatttatttatattcttactatctccataaagtgatgatttttttttctttttttcgaaacagagtcttgctctgtcatccaggctagagtgcagtggtgcgatcatggctccctgcatccttgacctcccagactcaaacaatcctcccaactcagcctcctgaatagctggaactatagaccggaaccaccattcctagctaattttttaattttttgagtgatgggattttgctgtattgaccaggctggtctcaaattcctgggctcaaacgatctgcctgcctcggcctcccaaagtgttgagattacaggcatgagacaccatgaccagcatggtgattttttaatacactgttctgtcgttttctttttttctttaaaaaaaacttgacagtatctcttaagtctcttcactccagtataggtacacagagattagatcatcttcatttctctttaacagttgcacagattttcattgtatcagtatgccataacttagctaacatcatagtcatagacatttgggttatttttagtctgttgacatggtttttttttttttgcatatagatattcagttgtttctataccagttgaagagactatccttttctcattgaattacttttgcacattcataaaaaatgaagtttgttgtgtatgtctggttctgtttctagactgtctgttcagttctcttgatctatttggctgtctttactcaagtaccatactgtcttgattatttttggttgttgtaaatcttgaaatcagatagtattaatgttccaactttgttgttcttttctaagttgttttggctattctaggcctttgcattttcatgtgaattttataattagctgtcaatttctacaaaaaagcctactgggattttggttggaattgtaatgaatatataggtcaattttggggaagaactaacatcataacaatgccaagttttctagttcatcaacctggcatatattttcttttatgtaggtcttctttattgtctctcagcaatttttgtagttttaagcatgagattttgctcatcttttttcagatttatttcatactttttgatattgtcataaaagtctttgtaaaatttccgtttctgactattggtagtatatagaaatatacttttttccccaaaggagtacgttgatttttgtattttgatgttttatcttacagtcttgctaaactcaattattatactaataattttttgtgaatttcatcaaaattattacatagacaactatataagtgaaaaaggtgctacttttccctttccaacttggatgcttttaattttattctcctgccttactgcactgactagaatctattgtttaatgttgtatggaagcagtgagagtgaacagccttgtcttcttccacatctatagggaaggaaaattttgtttttaactattaaatatgatgttagctataggactctaggatagatgccttttatacatggttaggttttaaacttgaaagctgataattttgacatacaatcttatttatcgaactctcttacttttgttattgcttgcaataattttgcaatttttttaggtattcatattaagtgtaaatagtgatatttttacttattggatttttcatacattaacttttgtctagtttgattatacataaatacagttttaaattgtggcagtagttatggggattcttttttcctgatttgagtgggaatgcttctggtgtttcttcagagtatgatatactgcctttaattctgagatctgttttatcaggtgaaacaagtatgcgtttgttttatttttaaccaagaatgggtgttcagtttggtcaaatggcttttcatctactatagatcgaatactatttttttttctgtttagatctgtttatctcaggaattatatgaaaatatttcctgatgttgaatcattctctcattcctgggataagccctactttgtcttaatatattattttaaaaattgtactgcccagtttttttttctaacttttttaaaggatttttgcattgatgtttataaataatcttgatatgttgtaaatctttggaaactttttcatcagtggtacactctgttatactctgttttcatcagtgtaataaaaaaacttggtttaaaaaaatatgttctagagcttttttttgttgttgttgttgttttaagacagggccttgctctggtacccaggctggagtgcagtgacacaattatagctcactacagccttgaactcctgggctcaagtgatcctcctgcctcagcctcccgagtagctgggactacaggcacgtgccaccacactcagctaattttaaaattttttgtggagatagtgcctctcagtatgtttgaccaggctggtcttgaactcttaggctcaaggctgtgctctggccttggcttcccgaagtgttgggattacacggtaagccaccatgcccggccagagcagttttaataaaaacattggaattacctgcttttttaggtttttgaggaattcctccacggaattatttggattgtagtgctttgggtttgggttaatatctttttcacttcctatgtgaaaattggtacatttaaatttttctctccctttgagtgcaatatccatttattaaaatacctgaagtttcttctttcttttttttggggggtatttttttgcacttgatcttagccaagaagttgagaactgatttttaaaaatgtgatagctatttaatttttttctcctcccatgaacttttagattaattttttatttctgctcttttcctaagccaagcctagttctgtttttattttattttagagataggatcttgttctgtcacctagtggagtggagtggtttgatgacaactcactgcagccttgacttccttggcttcagcaatcatcccgccttagcctcctgagtagctgggactataagcacgtgttatcatgcccggctaatttttgtatcttttgtagagatggggtttcaccgtgttcccctggctggtcttgaactcccgagctcaagcagtctgcccaccttgacctcccaaagtgatgggattacaagcgtgagccaccacagctggcaaatatctgataatttatttgtcatgttagtaagggttttgcggttttggtttattttttcatctttcccaggattgtgagagttttaaaatttctagtggaagagtctttattttctgagtttattcttaatttaaaaatttttattatagtgacatgagagaatattatctgcacttttctactttttggaatttattataaagtgtcatcaattatatatatatataaatctcattcatatgtcatttcagagggaaatttaagaaaatcatataatgcatactaaagagaattcatactttcatatggtgaacctaaagatttattgtcccagataacttcctttggagtagtaaatcatatatatatatgtaaatcttatatatacatgtaaatcttatatatatatatatatgtaaatcttatatatatatgtgtgtgtgtgtgtgtgtgtgtgtgtgtgtgtgtgtgtgtgtgtgtgtttttaatagagacagagtcttgctgtattgcccaggctggtctcaaactcatgggctcaagcaattctttcacctcagtgtcccaagtagctgagctgcaggcgtataccactgtgcctggctaattataatactttctaaaactttctggtacagatctatcaccttaaaattctggtagttactgactttttgtcctgctctgaagtttaatgtttttatacgatgtttttcataggcattttagtagatgttttggaaagtttgtaccaaatctgctagacagacaatattttaaactacaaagctctgttattacttgcttagtctgagaagctgctttttatgtttcataattattttccccttattttcagggaataggttatctgtgtatataagtagatgggaaagaccactctaaaattgctcatttgtggagtgataacatttcctgatatattcttgtctaattgcctatttttctgcccaattggcaaaaataataatgcattctcttctttgacaaatttctcatgtttacttttcctgttgaaatagtatgttgtctttctttattttctgcttgtctgtgtctggaactctgtacatttcccttagagggagtcagttgtgtatagttaggatctagtgaaagaacatgcaaagaatcactcttgagtgattttaggaaattgtgcttgattaaaaaaaataagcaagtccctgtcccctttcccccatttcaaaagctagaattaaaaaagaaaacaaaagaacagataatctcttgaagttcctagtggcaaagcttttctctgcttggagtcattttactttctactgtctaattagactagaaaaattttatgtggaaaatatttttaaataatttgcttattgctgtttcaaaagtaaaatgtttgctttataggatgaaagagtagtaaatgttaagatctcctttctaataactgttgagagtattaaatagacaattacaaaggttattcttttactacatttaatttttcaagaacacatctacttttaaaataattttattaatattagttatttgcatgcttcgttaggcaggaatttaaattttatgtttatttatgtatttcatttggcattcagatttattttctatgtattgcttttcttttctttattttcttgtttatcactaaatataaatttataagttcttaagtgtctgttcaagactagtagttcataaaaccataaggcttgttatttttatatcactgttctatgactgtatcagtgttgtattgtttgtatcatagtaaaagaaacagaacctttgagagtttgttatggcaactgtggttgaagagaagaaagaatttttgcataaacatgaagatctattgttcacacatagagattttcagtgattatgcctaatttttaatgaaattacagatataatggtgcaactgcattttgatttgaaagcagatgcaagataaaatgaggatgaccattccttatcatgtttgtggtgttcagttttgcattatctagtctattaatatgtcattcattattgattattgaatatggcctgatggatcctttcaatctcattcatatgtcatttcagagggaaatttaagaaaatcatataacgcatactaaagagaattcatactttcatacggtgaacgtaaagatttattgtcccagataacttcttttggagtagtaaatcttattcattgacacatgaagaaataattgtatctcatgccatatatatttgaaatatttctatgaaagatttttaattgtaacatggagaattttctatgtttgctaaatatgagagctaattttttttataattaacattcaaaaaaatacctatttgtagattcagaggaaaatgatgattattattttattttattttttattcttttttttgagacgaagtctcgctctgtcgcctaggccagagtgcattggtgctatctcggctcactgcaacttctgcctcctgggttcaagcgattctcctgcctcagcctcctgaatagttagatatcaggtgtgcgccaccacacccggctaatttttgtctttttagtagagatggggtttcaccatattggccaggctggtctcaaactcctgacctcgtgatctgcctgcctcggcctcccaaagtgctgggattacaggtgtgagccaccatgctctgtcaaaagatgttattggcctccaaaataattaagaggcagttactttgcctaaatctgatcaattaattgttctgtgattgtgaatttgctgcaggttaacaaagccataggattgacatagatcacatgactgtattcacattcagctgaatacttttctaaaaattatgctttaagttctgggatacatgtgcagaacatgtaggtttgttacatagatgtgttacacacatgtgccatggtggtttgttgcacccatcaacccgtcatctacattaggtatttctcctaatgctatccctcccatagcccccaacccccaacaggaccccatgtgtgatgttcccctccctgtgtccatgtgttctcattgttcaactcccacttatgagttgaagatgcagtgtttggttttctgtttctgtgctagtttgctgagaatgatggttttcagcttcatccatgtccctgaaaaggacatgaactcatccttttttatggctgcatagtattccatggtgtctatgtgccacattttctttatccagtctatcgttgatgggcatttgggttggttccaagtctttgctattgtgaatagtgctgcaataaacatacatgtgcatgtgtcttttagtagaatgatttatactcctttggttatatacccagtaatgggatggctgggtcaaatggtatttatggttccagatccttgaggaatcgccacactgtcttccacaatgatggaactaatttacactcccaccaacagtgtaaaagcgttcctatttctccatatcctctccagcatctgttgtttcctgactttttaatgatcaccattgtaactggcatgagatggtatctcattgtggttttgatttgcatttctctaatgaccagtgatgatgagcattttttcatatgtttcttggctgcatacatgtcttcttttgagaagtgtctgttcatatcctttgcccactttttgatggggttgttttttcttgtaaatttaagttacttgtagattctggatattagccctttgtcagacggatagattgtaaaaattttctccattctctagatttcctcttcattctgatgataatttcttttgctgtgcacaagctctttagtttaattagatcccacttgtcaattttggcttttatttccattgcttttggtgttttagtcatgaagtctttgcctatgcctatgtcctgaatggtattgcctaggttttcttacagggtttttatgggtttaggtcttatgtttaagtctttaattcatcttgagttaatttttgtataaggaaggggtccagtttcagttttctgcatattgctagccagttttcccaacaccatttgttaaatagggaatcctttccccatttcttgtttttgtcaggtttgtcaaagatcagatggttgtagatgtgtggcgttttttctgaggcctctgttctgttccattggtctatatatctgttttggtaccagtaccatgctgttttggttactgtagccttgtagtgtagttttgaggtcaggtagcatgatgcctccagctttgttctttttgcttaggattgtcttggctatatgggctcatttttggttccatatgaaatgtaaagtagttttttccaattctgtgaagaaagtcaatggtagtttgatggggatagcattgaatctataaattactttgggctatatggccattttcacgatattgattcttcctatctgtgagcatggaatattttcccatttgtttgtgtcctctcttatttccttgagcagtggtttgtagttctccttgaagaggtcattcacatcccttgtaagttgtattcctaggtattttattctctttgtagcaattgtgaatgggaattcactcatgacttggctctctgtttgtctgttactggtgtatgagaatgcttgtgatttttgtgcatcgattttgtatcctgagactttgctgaagttgcttatcagcttaagttgatttggggctgagacggtggagttttctaaatatgcaatcatgtcatctgcagacagaaacaatttgacttccagtcttcttatttgaatacactttatttctttctcttgcctgattgccctgtccagaacttcaatactatgttgaataggaatggtaagagagggcatccttgccttgtgctggttttcaaagggaatgcttccagcttttgcccgtgtagtatgatattggctgtgggtttgtcataaatagctcttattattttgagataagttccatcagtacctagtctattgagaggttttagcatgaagaggtgttgaattttatcgaaggccttttctgcatttattgagataatcatgtggtttttgtcattggttctgtttatgtgatggattacatttattgatttgcgtatgttgaaccagccttgcatcccagggactaatccgacttgatcgtggtggataagttttttgatgtgctgctggatttggtttgccagtattttattggggatttttgcatctgtgttcatcagggatattggccctgaaattctctttttttgttgtgtctctgccagtttttggtatcaggatgatgctggcctcataaaatgagttaggttggagcccctctttttctgttgtttggaatagtttcagaaggaatggtaccagctcctctttgtacctttggtagaattcagctgtgaatctgtccggtcctgggctgtttttggttggtaggctattaattactgcctcagtttcagaacttattattggtctattcagggatttgacttcttcctggtttagtcttgggagagtgtatgtgtcgaggaatttatccatttcttctagattttctagtttatttgcatagaggtgtttatagtattctctgatggtagtttgtatttctgtgggattggtggtgatatctcctttttcatttttttattgtgtctatttgattcttctcacttttcttctttattagtctggctagtggtctatctattttgttaatattttcaaaaaaccagctcctggattcactgactttttttgaagggttttttttttgtgtctctctctctctccttcagttctgctctggtcttagttacttcttgtcttctgctagcttttgaatttgtttgctcttacttctctgtttcttttaattgtgatgttagggtgttgatttaagatctttcccgctttctcctgtgtgcatttagtgctataaatttccctctaaacactgctgtagctgtgtcccaaagattctggtacgttgtgtctttgttctcattggtttcaaataacttctttatttctgccttaatttcattatttcattatttatttcttccttaattaacttctttatttctgccagtagtcattcaggagcaggttgttcagtttccatgtagttgtgcggtttttgagtgagtttcttaatcctgagttctaatttgattgcactgtggtctgagagactgttatgatttctgttcttttgcatttgctgaggagtgttttacttccaattatgtgctcaattttagaataagtgtgatgtggtgctgagaagaacgtacattatgttgattttgcttggagagttctgtagatgtctattaggtctgcttggtccacagtttgagttcatgtcctgaatatccttgtcaatttcctgtctcgttgatctgtctaatattgacagtggggtgttaaaagtctcccactattattgtgtgggagtctaagtctctttgtaggcctctaagaacttactttatgaatctgggtgctcctgtattgggtgcatatatatttaagatagttacctcttcttgttgcattgatccctttaccattatgtaatgcccttctttgtctcttttgatctttgttggtttaaagtctgttttatcagagactaggattgcaacccctggtttgtttttttttttttttttttgctttccatttgcttggtaaatcatccctttattttgagcctatgtgtgtctttgcacacacataggagctgggtctcctgaatacagcacactgatgggtcttgactctttatccaatttgccagtctgtgtcttttatttggggcatttagcccatttacatttaaggttaatattgttgtgtatgaatttgattctgtcattatgatgctagctggttattttgcccattagttgatgcagtttcttcatagtgtcgatggtctttacaatttggtatgtttttgcagtggttgatactggttttttccttccgtatttggtgcttccttcaggagctcttttagggcagccctggtggtgacaaaatctctcagcatttgcttgtctgtaaaggattttatttctccttcgcttatgaagcttagttggctggatatgaaattctgggttgaaaattctttcctttaagaatgttgaatctctcctctggcttgtagggtttctgcaaagagatctgctgttagtctgatgggcttccctttgtgggtaacccgacctttctctctggctgcccttaacattttttccttcatttcagccttggtgaatctgatgattatatgtcttggggttgctcttctcgaggagtgtctttgtgatgttctctgtaattcctgaatttgattgttggcctatcttgctaggttggggaagtcctcctggataatatcctgaagagggtttccatcttggttccattctccctgtcactttcaggtacaccaatcaaacataggtttggtcttttcacatagtcccatatttcttggaggcttcattagttccttttcattctttcttctctaatcttgtcttcaggcttcatttcattaagttgatcttcaatctctgatatcctttcttctgcttgatagattcggctgttgatatttgtgtatgcttcacgaagttctcatgctgtgtttttcagctttctcaggtcatgtatgttctctaaactggttattctagttagcaattcctctaaccttttttcaaggttctcagattcgcattgggttagaacatgcttctttagctcggaggagtttgttattacccaccttctgaagcctacttctgtcaattcctcaaactcattctccatccagttttgttcccttgctgatgaggagttgtgatcctttggaggagaagaggcattctggcttttggaattttcagcccttttgggctggtttttcctcatctttgtgcatttatctacctttggtctttgatgttggtgaccttcggatggggtttctgagtggctgtccttttgttgatgttgatgctattcctttctgtttgttagttttccttctaacagtcaggcccctcttctgcagctctgctggagtttgctgggggtccagtccagaccctgtttgcctgggtatcaccagcagaggctacagaacagcaaagatttctgcctgttcttcctccggaagctttgtcctagatgggcacccaccagatgccagccagagctcccctgtatgaggtgtctgttgacccctgctgggaggtctctcccagtcagtaggcactggggtcagggacccaattgaggaggccatctgtcccttagcagagctggagtgctgtgctggagatccgctgctctcttcagagccagtagtaggcaggaacgtttaagtctgctgaagttgtgcctatagctgccccttcccccaggtactctgtcccagggagatgggagttttatctataagcccatgactggggctgctgcctttctttcagacaccctgcccagggaggaggaatctagagaggcagtccggctacagcagtttgtggagctgaggtggggtctgcccagttggaacttcctggaggctttgtttacactgggaggggaaaaccacctactcacgccttggtaatggcagacgcccctccccccaccaagctccagcatcccaggttgacttcagactgctgtactgccagtgagaatttcaagccagtggatcttagtttgctgggctccatgggggtgggatttgctgatctagaccacttggctccctggcttcagccgcctttccaggggagtgaacagttctgtcttgctggtgttccaggtgcctctggagtatgaaaataaaactcctgcagctagctcggtgtctgcccaaacggccacctagttttgtgcttgaaacccagggccctggtggcgtaggcatccgagggaatctaccggtctgcaggttgcaaagactgtgggaagagcgtagtatctgggcctgagtgcactgtccctcatggcacagtccgtcatggcttcccttggctaggggagagagtgcccaaaccccttgtgcttcccaggtgaggtgatgccccaccctgcttcagctcaccctctatgggctgcacccactgtctaaccaatcccaacgagatgagccaggtacttcagttagaaatgcagaaatcaccgccttctgcattgatctcgctgggagctgcagactggagctgtacctatttggccatcttgccaggcctctgaatacttttttttttaaagtgtgtaactcaacaatgtgagccactactttggcattgtctgacttagtaggttttttagaattttaaagtgaaatatggcagttaaataatagcgtctgccctttccacttgcatagaagcttctgttggtcattgttgaaatgatggaggtatttagttccagcacattaattttaaagtaatttttatagtatattatatatatatatatacacacacacatatatatatatatatatacacacacatatatatatatatatattttttttttttcttttgagacagggttttgctcttgttgcccaggctggagtggaatggtgtgatattggctcatcgcaacctctgcctcccaggttcaaatgattctccttcctcagcctcccaagtagttgagattacaggcatgtgccaccatgcctggctaattttgtatttttattagagatggggtttctccatgttggccaggctagtcttgaacttccggcctcaggtgatctgcccatcttgtcctcccaaagtgctgggattacaggtgtaagccaccgcacctggccgatgatttttatacttcgagcagagccagtcttactaaaagtaaaatatagaaaacttgtgtgttattattgaattattgcaataaaattttaaaatactttgagaaattacttcagtgaagccgttaaactcgtaggtttaagttaacttctctaaggcatgagtgtgaagacaaatgcatgaaaacaaactgtaaatcacagatatgattctagtacacaattggtgatggtgttgaagaagggtgtcagacaactctgttgtttatatggaaccagattttctgtaccttgtttaccaaataagatgctatcggttgtaaaccatgccccctgcccacctttttcttttcatacctttggaaatctcttacccagtggtacatgaaatcaactgtgatttgtcattgtaagataagtgctgttttcagacatgtgaacgtgtgggctgtgaaatggggaagtatatatttcccaaaagagggaagaactctatattttctatgctaattgtaaaattggtttgaatgaaccaggcatttgaatagattagaaagagatcagcatcaatttgtttgtgttctaccattgtgccatcagtcttgccttactttgttggacacgggtgcagagtgaggagaaggatagtggaaaatgcaaacaatttatatgaacataaggaatatggcaactataaggcatacatttaaaaataatggtcataatcagagcaattttgtatattagtgatagctgaaaagctctaatagtgaactatttcagtagaagaccaatagaacacactgtgctttgcagtggaagaaacagtaccactgtataacaaagtttggttgtagacacaaaacaaaggcaaggtttacatgtattcaaataaacatttttaaaaaaatatatgtatgtcaaacatatacacactgatttggaaaataggctgtatttatttaaaagtaatggttttcaagttagtatctctgattagatgtttagaatgctaccaaaattttgttactaatgtttcgatgaatatctctttagataacttagtgaaagttcatgagttatttccttaggataaattctaaaaatggaatctatgccaccaaatattcttgaaagtttgtgctactgtgtacctccacccatgtggtaggcagaattttaaggtgaaccccaatgcctgttgtgtaaccccctcctcttcagtgtgggtgggatctgtagcttgcttctaaccaacagatggcaaatgtgatgggatattgtgtcaattattaatttatattcttagttctcagtgtacccttcagtgtatgctctatgataactgacagacttcctttaagcattttcacttaagaattttggcattttgtaaataatttttggttattcttttcctttcatttttacttacatgttttttagaaaacagacagaaggctgggtgtggtggctcacacctgtaatcccagctctttgggaggccgaggtgggaggatcacttgaggtcaggagtttgagaccagcctggccaacgtggtgaaaccccgtctttactaaaaatacaaaaattagctgggcgtggtggtggacgcctataatcccagctactctggaggcagaggtaggagaatctcttggacccaggttgcagtgagccgagatcgcaccactgcattccagcctgaatgacagagtaagacgtctccaaaaagaaaaaaaaaaaaaaaaagaaaacaaacgtgttttcaatttattgcagggtcctttttgttggcgtcttgtttatatgtgttttctttcaaagcagacctgtccaacggaactttctataagatgaaaatgttctgtaatctttgctatgtactacagtgcctcctagccaaacatggttattgagtagtgcttgaattgtggctagtgcagctgagggaactagatttttaatgtcatttaatttaaattttagtagccacatgtggccattgaatagcacagttttaatatatagttgtgtgccacttaacagtgttttggtcaactttggactgcatatataatggtggtcccataaggttataacaaagttgccctatacaggtgtaccattttttatcttttatacataaatacttaccagtgtgttagagttgcctacggtattcagtacagagtatagttacatgctgtacaggtttgtagcctaggagcaataggctgtatattgtatagcctagtgtatagttggctggaccatctaggtttgtgtaagagcagtcggtgatgtttacacaatgacagaatcacccaacaatgcatttttttcagaagacactcctgttgttaaatgatgcataactgtatttttaaatttaatttgctggtatgtaggatttttgtgcctatatcatagattctttttacatttaaagcaaaataaaacttatcttgatgtatacctgtatgatctagttcctgcccaccttgctgctaattttctatgattttcttttacagttactgttcactagtgtttttatttcttgtatttccacatatgatattttatagttcatgttaagacatttgcactctggaactgtgcttagcttttatagctgcctctttctagttctcagctaaatctcaactcttttgttagcctgatctttgattttttttccaacaacattttatttagaaaaaatttaaatatacagaaaagttgaaagaattttattgtgaacacccatgaaggcctagagtctatattttcctgtaccagctctaacacatattaattcatctatttctctatccatccattagtctattttttggggtgaatttcagagtaaattgtaatcttccatttattttcagttttattttttactgggtttatctctttattttgttggagaagttctttacatatcttggatattggtcttttgtcagatatatttttctgatatattctcccactttgtaatttgctgttttattttcttaacagaggcttttttttttcttttttccttggatggcattttgctcttgttgctcaggctggagtgcaatggtgcgatcttgactcactgcaacctcagcctcccgagttcaagagattctcctgtctcagcctcccaagtagctgggattacttacaggcacgtggcaccacgcccagctaattttttgtatttttagtagagacggggtttcaccatgttgttcagtcaggctggtctcgaactcctgaccttaggttacccacctgcctcggcctcccaaagtgctgggattacaggcgtgaggcaccatgcccagccaattttcttaacagaggcctttgatagcagaagttattaattcactcgtttgatttatgaattatttttcttttatggatagtgctttcttgtgtcttgcgtaaagaaacctttgcttgcctaacccaaggtcagaaatatgttctcctatgttttattctgagagcctgtggcttagtttttatgtttgggtgtattatctgtctcaaattaatgtttctgttagtaatgtggagtaggaattgagattcatatcaccctccccgcttgttattctagcaccatttgttgaaaagacttcttttcctggacacctttgtcaaaaattaaatcactgtattataaatgttgatgtatttgttggttgatcacctgtttttaattgccatcctatcaatgttcactctttttatgtgatacagacacactttctgataaaataatgtgatagatttgccactattgcaaatgcctggaacgacggaatgggtgatagaggttggtctgtagttgacagtagatggagaatgattttgtagttgtctgtttttattatgtaaaatgaatcaggggatttatacctatttttctatgacagagaatagtttatttacactgtagtgaattgttctgtgaaagcctgaatgaactcagtcctaaaataacttttaggatatttttaaggaggaaagtctttgaaaaacatagttagcaacttttaacatttttatgcgtcacctttgttaatatgtcatttttagaaaattatcaatgtcattaaaatgttcaaatgtattatattggtgttggacatatattttcttttaaattttgttttctacgtatctgtgtaactttagcattgtgctatcatctcgaggggaaatccaggtgtatgtttgaatcccttcccaaatgtgtctctctaattccctgagcccactaaaatctctacttgtttccttttcccttagcagtggccttttgcctagggaaaaaatatggattttctaagttttgccatatgttaaaatcaggaaatgcccctagagaaaaactggctgtataaattcagttcactttttggcccttcccctgactgcacagcacttaacagaatgttttaaaatttgaagtttatcagcttttcccatttgttttcaacttatttatttttcttagttctaattttgttgttgtttgtttggtgactagggaatgtagttggtatgatttctaggaatttgctggttttttttttttagtggcctaatatatcatcagttataaacatttctgtgaatgtttttatgttatagttttgtcataggtaagagaggaatattaaaatgtttcagtgctattacattttgtcttttttctaatatattaaaattttagcacataaacatttattactcatttcttcattatgaattttattatcgaaatcagttgacaccattttttctttcagtttgcttaggcatattttatacagaaatattaatttcttttattttgcttttgtttactttgaattttgcttaatcgtattttgcttagaaatattaatataggtttgcataatatttaattttccttaaaaattttgcttaacatgtgcttctatatattttatcttttatacttttctttgttcttctttttgtattattggatagttcctcaaaatgccctatatttcacacatctgatttttagcatagcatatttttcagaaatttgagaatgtaaaacatatgctttctaaaatttaattagcacatttttttctttagtgtttctaagcagacttttgcttggggatgtataacacacactgaaacatacacaaatcataagtttgcaacttcagaatttatttatttttttgcatgtgaaggtccggttgttctatcaccacttgttgaaaagactattttcgtttcattgcttttgctgttttgtcaaagatcacttgactgtatttatgtggatctatttctgggttctattctgttccactgatccatttgtctgttcttttgccgatattatactgtcttgattactgtagctgtatagtaaattttgagtctggtagtgtcagttgttgctcttattcttctccttcaatattgtgctggctattttagatcgtttgcctctccatacaacctttaaaatcagtttgacaatatttagaacataactttctgggattttggttgggattgtgttgaatctgtagatcaaattgggaagactgacatcttgacaatattgagtcttcctatctatgaacatgtgctgtctctccatttatttagttcttctttggtttctttcgttggaattctgtagtttttctaatacagatttttatatgtagttgttatgttatccctaagtatttcatttttggagggtgctaatgtaaatgttattgtattttaaattttgaaattcacctggtatataggaaagtgattgatattttttctgtataccattgctggtatgtgggaaagtgattgagttttatatatttgtgtcctgaaacctggctataattgcttattagttccaggagtttttgtttattcttttcatactttctgcataggcaatcatatcatttgtgaaaaaagacaattttatttctaccttcccaatatttataccttttacttgtcttactttattagctagaacttcagtatgattttgaaaggagtgctgacagagaatatctttgtcctgttctgacattaatgagaaaatatttgattgttttttgattcttcctctcatattagccaaacatggagggctgggtaactggccaatgttttaaaattttgctttctttatttaatagtgtggaactgctagcctcagataagtcatccatcatcatcatcatcatatcatcatcatcagtaatatattgttaaaattagactttttcactgggtaattggtaggagcctataggttttcttgtgataagttcagtcctcagaaagcaccactcttgtggcatttcagggcttaaattcttaatactctttgcttggttttccaagtctaaaacactgttccacatatgattctgtacaatctcatatctagtcatattgcagtgctgagaattgtagttccagagaggcatgtgtggagatagggttttgagaatgttcgtgaaatgtttcacctacctagtaggtgaaataatttttgaaaggtgaaataaagatccgcagctgtagcaggtagatagaaatgcctctttcattgctggatgggagacatatattgtaagagagtgatcacgtttgatgtggagtacttttaaataataatttagcagctgtctgttggtagagattaatgaggtagagtggaagagaatgtcagtagagttgaaaatatttaggatcttggacactaggatgctgagtagattgtccacatgtatggtagcatacatgaagaagacaaggatgattcaagtactaaagtccttgttggtagtttgatgaattacatggaaaagttagggttaagattagagtagctggtggttatgatgccaaaggattaggactctttactcaaaagtaatgtagtgtcttggaaataacattgaatttctaggagaatgcagatcctactgtttggatggttgttttgtggcacatgtgtttattagctgcatgagctctttcagcacccctttcagaatttgccctttttcattctttttttcttggggctgtttaattcatgagccccgccttgcctttcctgttactgtatctgtgagtgtaacagactatttctacttgaaaccttcctcttaatgaccttctcttttctatagttcagttaggtgctaagacatcatttcaggaaaaatgactttatcttttatctaccaaaaaatatatttaagttttatataattttggggaatacttaatgttatgaagaatactattcttgacattaaataattttttctaggtctcatagatgttataataactgtatatttcaaaattaaattttctaataatttgctgtttattgaattatgaactgaaagaaagtaggttgaagatattaaaggactagtattattatttttattgaaactgtgatgtggatataattttacctatcagcaaacaaatatgtttaacagaagtctttttatttattatgacataaatgtatggtcacataaatggttttggctaactaaatatagctctgtatagaaaaaacataatgattaaattttgcagtcatttattgctgattttaagagaagttaattttattaaaactgttctcagtatgtatcacaaatttatttttctcttgttgattatggcttttgcagcacaattacaaaacattttaaactgggtttatcatactcgtaatgaattggtagttaatttcatagccttattttatcagtaactgtgcattcatctttagcctgacttgatttggttcctgatggacgaaataaacttttttctttttttctatgagtcggagtttcactctggttgcccagactggagtgcaatggcaggatcttggctcactgcaacctctgcctcccgggttcaagcgattcttctctcctgagtagctgggattacaggcatgtaccactatgcctggctaatttttgtatttttagtagagacggggtttcaccatgttggccaggctggtcttgaactcctgacctcgggtgatccacccgcttcagcctcccaaagtgctgggattacaggcatgagccaccgcgcccagcccaaagtaaacttaaattatgctcctggttaacccaatgtcttgagcttatgtttctaatatgctgactttcaaaaaatgatagtatatttggctgtatttttaggtgtttaagaatacttaggaacaattgcacataatgctcaacctgatggaaattacagatggttaaaagaaaataaactgttagatgttgactcatcttacatctgtatagaagaatgattttaaaatgatgtgaataggccgggcgcggtggctcacgcctgtaatcctagcactttgggaggccgagacgggcggatcacgaggtcaggagatcgagaccatcttggctaacacggtgaaaccccgtttctactaaaagtacaaaaaattagctgggcgtgttggcgggcgcctgtagtcccagctacttgggaggctgaggcaggagaatggcatgaacccgggaggcggagcttgcagtgagccgagatggcgccactgcactccaacctgggagacacagcgagactccgtctcaaaaaaaaaaaaaaaaaaaaaaaaaaaatgatgtgaatagacttggatggtgaaggcatgggataggttagttatcatttaggttcagaggttggcaaagtacgtgaaggaatagggttaaggttgctgattagtttgaggagacatgatatagttcagagtggtttattagttttctgatagttggagaatatgagtgtgtgtgtgtacacgtatgtgttgtgtgtatatttagtgtatttatatctacacctccccccactttttttttttttttttttttttttacttatttttttgtagagacaggatctgactttgttgcccaggctggtcttaaattcctggcttcaagcggtcctcacaccatggcctcccaaagcgtttggattacaggtgtaagccactgtgcctgggccacattttgggtaggatgaccagaaaaattaagctgtaaaagatccaaaaaatgtaccttttaaattccatctgtctgatatgtctgaagtgagataactgtacctacttagtccagatatatggtatgaagaggttctgaataccttgcatattcctttttgctgtctgagaagaaaggggtttaaatgaaaggcatgtatatatttaggattccttttacatacgctagaccagagtggtttttgctctagagtgtacaaggtgccaccgttgttcttcagtgtgtctctagagcttgcaacaagctaaaacttatcttttggtgcttcaggtctaaactgtattactggccagactttaaggattgagttcaaagttccagtgttgatttgtatgtgaatagttttaggtctccatattattgtttggaaataatgagaatctctcccccagcctgtgtgccccctgtgtccccatttcctccttagactgtgattacttccaggaaacaatgacattgaaattttaagtactcatatatctgggtcaccttttctaagttttggtgtattgtaaatcaatgctttctctagatataattagaataggttttattactgattctagggtgctcgcaaaggtttttttgaatgttattttcaaatggaagcttgaatgactcatagtttcatatacttgagaacaaaagagtaataaatttaaattggtggtgttattggtttaagtacattgcttttccaatacctaaaatatactttgcttagtcttacctctgatacctagtattttatgtcaaataccccattatgtgctatgggttttgtcccactcgttctgttcattcttttttctcattaaagaagtttttcatttcttcccccttttgtgtactttgcccttctttttgcgtgttcttagaattcttagtcttagcctagggactataagtgcacatatatgtccccatatactgtatacacatatgtgcacctcatgagaagattgtaactcactagactgaagtaggatggaatcttcctgggagataatgtacatatagaggcatggaagataactaatagaactttaattttgacattggagcctaatgacaataaaatgaatgaaagtcagtattctttaaaggtgttatgtcaaatcccagtgaaccatgtaattactttgctgcattaaattgttgataaatgcttaattttaagtacaggaaataaaatcaccgtaacagaggtatacatattttgctattttgttcacaatatatttcatacaacattctagatagaaatcttaggtcttatttttatatgattttgagctttctctttctgtcctagcttaaaattgatacaaagaatagggaaatgttatacttttttatattgtggaaagtaaagtttatttctgaaagtctcacttccattttcctgttactttattaggctgcagaacatgtttagtttacagctaaaatgccatttggtatcccagtgtgggttgtcctcatccggagacatcaatgtctattaaagtgaagctaaaggtctcatctgtgatggctaactgggtcactttactcattaacagagaaggcaactatcgcatcattctacagtctgtcacttccggaacagcttcttggcaataatgcctcacaggggaagtcataagctttcctgctgatgggtgtgactttgaggacagctgaaatggtatcaactagagaaatacagtgacaaaaacctattggaatacgtttaggccaaccgcatggtccttgcttcagataccagcctcaagtttgggggtccctagggcctcctttacttcagacttgctggctttagatactgaggtccccactgactccctcagatttgataattcactggtatgacccacaaaactcagagcactaagaattatagttttattataatgaaaggatacatactaaaaccagccaaaggagagacacgtgggcagaatctgggaggggctcaaaagcaaagcttctggttgtgctttcctggtggagtcatggatgctgttacctcttcctggctatgatgtatgacagtccagggaagttaatgcaagcttttggtgtccacagtttatactggattttgttcacatactgtccctgtgtctgacctttagtctttatctcctcccaaaagttcaggctaatacatttagtttctagtttctttggagatcagagctgacagggtattccaggaagctcccatcatgagtcacattgttagactctccagtgactccaggtactcttatcaaggaggatatcccctgggcctagagatcgtttcccagtagctgagggcaaaggccaggccctctctttggtaaagtgaattcctcaacacacctatttaaacagagggtatatttttgcaatttctcatattactctttatttgaaaatcttaaattttattttacaaataaatgattttcccttaatgttcaaattagaactatttagccttttccttttttttaaatctctctactttttctccctcatgacatccagactagtcatttatgcagtttagttgtatttttactgcattatgtatttatggccaaatatccattgtattcgtatattcatttcaaaagtacttactattcttctaaactgataggtcatgcttttctatccacaaaacaaatactcacttatatttcttgtcagctgcaatctggatacagagtatagcatgaacaaaggtttaatgatatcaaagtatataaatattttagaaaaggtgagcatttcattgtgatttgattatagacatattcaggagagttttcccaggaaaaaaagggctttaaaagctatactaaggcaacttggactatagacagtgaagggcattcaaatatttttagatatgaccatgacacacaacaaattgtttgttttagaaagtcagtgagtagcatagtgagtagaaatagtttgaagaaaggaaattcacctagaagcaactctatatgcccagttaggacgttattactgttgtcttcactggagatatatataggtaataaaggatgatttattaggaagttattaacttatgagagatgactttagcttttttttaaaatcttacccctttcataatacgtacacaagtctaatcaacttttaaacttctctaacagttttttatgttttcattttataaaacctcttgtgataatacagcctatgtatttttctacctaacctataacctatggttataacctagccttaccagcttatttttatagattcttgcactgtgttattcattttatatttatttaacacacatttgttaagtgagagcttactgtgcaccagattattgtaatagatgttgaaaatacaatgaatgtaagatgtgattcctgacctcaaaaagcatacatatcaatttagtagtcagacagatgggaaaagcttgtgatggagggaagcataggatactttgatagtttattgaaggagcatataacctagactagagtagagattaggagaagtttttgggactctgacactctagtttagaatagcagctaacaatatggactctggagccagaatgcatttggattctcagtttcttgctgtgtaaccttaggcaagttcttaacttcacctttaaaatgggaatcacaataatccctactgtatatggtaattatgaggctaaaaatgttaccgagcaaaagggcttgctgcctgatgtgctagaagccaatactatgacacttgagtttttgggaaaataaaagctttttattgcaagtcgactaacaagaggaaaggagtccagctcaaatctgtctctctgtgctgactttaaggcagtaatttcattagaaaaggtttagggagtgtgttcagggattggtaggttattggtggaaggagaggagaggtctggaaagtcctcaggcatgcacagctatttattcatactacctcatggatctcatgtgcaagtttcagggggagttagtatgcagcctgtggtggaaatttgatctgtgacaccggcaagttcgttctgtgcaaacgccagtaggccatatcggttccagttgatttcagccaggttttaaatctcataagtggagggagtttcagcgtttcagcaatttgtttctttttttaatttgccaccctgcaggctcaataatttctgccagtcactggtttctttaactctttagggcatagtttaaaaataagttaaaatatgtaaagtgttggaacagtacctggcatatattagtagttttgtatgtattacctccttctcttgctcttctcatcattttctaaaaatgaatatgtaattagtactcagtaaatatttgaataaatccttaaatgatagatgaaaatataattgctgttttgtttccttagaagtctttaagcatctctattgaaagcatttaaggtaaaaaaactattttatgtgtatttaggtccatattaactcataaattcatgagcttcataaagtgtaatctcatatgatatgtaaacaatgttgaatttgactgcttgtagatgaggatgtcttctccagttggtctcacgcgtccgtcttactgtataccctgtccagttcaggttatggcctggcacgtatagacatttgagtttggggtctccccactagaccctgccacctgctcttccaagatagacatggagtaaactcttttacatctcaaacacttaacacagtggttgtcacttattggtactaagtgaatgtttgttgaatgagtgaatgatgcctaaattatgaaataaaaaagaataattagaaatctgatgaaaagaacttttattgttccatgaggatgtggttgactacttctttgtggatctatgaagggattttggtaaaaataagactaacggcaaccaaaattaagagggtatattttctagagaaattttgtttgagattttctaacttgtcaaataggattcaccagaattattatgcctctttttaattgcaataatattggttaatgaaagagccaacaatagtattgcaaaagcgatttatattttgattagctaacttgaatgacatagttgtttaggcactattggtaaatagtggcaatcaagtcattcttttttaaaagaagataatgatgttggctttgtgatgagcaagaaggatgacttgtaggattattatttactgattagaaggacattcagagtacagaagcattgaataatcctaacctgaactagaagttagaatttgggattgaaaaccaataaagattagtatccaggggagtgcaaatttccatttttgggggggttttaaaactaaaccttggatttgtggggagttatgaaagcacataaaagagtcaagagatagaagttactatattgagtattctcaggcaatgagttgaggctttgtgggaatatctgctcagaagatgtctgagtagaatagaccagaactgaaaggtggaggtagtttattcttttttaagtattccattggtatattttccatactataatgaattgatattgccaattcgtatttctaataacattggagattgagtttcttcttcactgtagtcttaagctgtcattttgcttattatttttaaaaggctcctttctatgctttgtaactttgcagtttctattttatttctcatgtttctaatgtcaagccttttgcattatgtttctctgcttatgcatttataacaacttggttttcggttacatcatgattcatagacataaaacatcaactcagagtcaatcatatggtaacctttgtcagttcctccaatctttggtccatgctacatgccctctgtaggatatttcagatggtattcaaagataagattatgttcataagtaagcaaatttaagttttataggaaaaaccttatgaaaagtatcatgctttattaaaaattgatatataatgtctactgttttacttttcatccaattatcttcgaattttgtctggagggaaaattatcaagaaaattgtaattctgaaaaggattgtatcctagtttagggtgattgaccagatattccactttaaatttctccaagatttttcaattaaccatttctaaattaagattcttttatttgttagaagtgttttaaaaacatctagggtaatttaagtagaaccacgtttctgaagaaagattgacaaggagaaattgtaattatgtcatcacatttaaatgtttttactgtcaaattgaaattaaggtattatttaggcacattggccaaggcttatgttgttattgggtcctcatatcccattagcatgtcctaatgctggcttggtttctagcattggaaggcagtcaggaaatatctatctcatgaacactgcatgcaattgtatttttattgggatgttaatcaaccagtgaattatctatgaaaaacttagcttagtacttcttacattaggataccagtgcaactcatgaataagttttactttatatatagaaaaggagaaaaagaaacagtaggttattttttgaatgtaatatcagacacaaaagaatatcaaagtgagtttaaaattatatctgttatttaaattattaaataaaacctgacttttcaagtcgtgctattttaagcacattgagactctctttttgactttttgctaactcctttttttcatggagactgtgcctgacagactcttctctcaaaggctgcccatcatcgttgctgaatacacttcccaatgtttggtttgacttacaaccttggcctctcaatttctttgaaattttcatctcagcgacttaattttgaaatttggaaattcattcctacctattactcagtatgctaaatttggacatactgctttgatacaacttccatctttaaaggcagctgggacatttcatcagcttcaccatccagtgagctatggctgttccgtcttcagtgaagtccggtcttagccttaggaggggagaagttgtttttattgtgtacactatctcagcccaactggctattttttatatctgagattatgaaattctttacagttctccttactttcttaaagtggaagttgaggtcgttgatttgtaacctttttcttaattttttttattataaaaatgggtaaaaaatttttttttgcttttgttaggcgatatctaattctgttgcccaggttggagtgcagtggtgcaatcaggactcattgcagctgcaacctctggggctcaaatgatccttctgcctcagcctcctgagtagctgcgacttaggtgcatgccaccatgcctggctactttttaaattttttgtagagacagggtctcactatgttgcccaggctggtctcaatctcttggccttaagtgatcctcccacctcagcctcccaaagtgctgggattacaggtatgagccattgtgcctggtcattgatcttctttttaattaggtatttcatgcagcaaaattttctgtaaatatgctttagctgcatctctcaaacattaatctactctgtttttgttttcattctgtttaaaatactttaaaatttcccttttaatttcttcttttattcttgggttatttagaagtgtgttatttaattttcaaatattggatgactttccaaatattgacatctaatttaattcattatgatcagagaatatactttgaaatgtgttgtacgcatttaggaaaaaaaagcattttttcctggtttgggtggagtatttttataaatgtcaattaagtcaggttgttttatagtgatctacgcttccatatcctcactggctttctgtctgcttgtgttctgtaagtcttttcaagatgtctttactactagtgatttttttttctatttgtccagtcgtttgctcagagaagagtgttaaattctctatgtataattgaggatttccccactatttttcttatctattttgtcagttttattttgaagctttttttaaggtgtgtatacatttaagattgttacagactcctgatgaattgaccccctttgtcagtatgtattgttttcatctctagtaatttcttgttcagaagttctcattgtcttatattaatatagcctagatgcttcagcttttttccattagccctgaatttgacatctttttccatctctgtactttatacctaacggactctttatgtacaaagtgggctgttgtagacactattatatagttggttccttttttttttttaagagggatctcactctgtcactcaggctggaattcagtggcatgatcttggctcactgcaacctccgcttcccaggctcaagttatcctcccacagcagcttcccaagtagctgggactataggtgcatgccgccatggcctggctttgactatggttttgactttggttttgactatgataaacctacattttttaaaatattttttgtagagatggggttttgccatgttgcccaggctggtcttgaactcctgggctcaagctatctgcctgcttctgcccctcaaagtgctggcattacagacatacatccagctggttcttgatttcttaaaaaaatttattaataatgacaatctctgcttgttgattttgtaatgttgtggtttttagaagaaatatcattagaatgaaaacaatctggtttaaatctactatcatactacttgatttactacatggcttgccccatgttttctcatttacttttttccttttgtcttgccatcatttagattacttgagaatgttcttattccattatatctccactttttgggcctattagatatatatctttgtgtatattttagcagttgttctaaggtttatagtgtctgttttcacaatttacttttaaataatagtatgccacttcctagttggggttcttacctcatttccttttatacaatttgtttttacatatgttataaatcctacaatacattgttaatatttttactttaattagtcaattatattgtaagaaaagaaagaggaacacagatttcttatatttattctagtttttaaccattccaatgcccttcattatttcagtttagatacagattttattcttgtatcatattccttctacctgaaaattttcttttaaaatttcttatattctagcttggtggaaatatgttttatcagctattgtctgtctgaaaaagaactctactgtgcctttattattgaaagatattttcatttgctaaagatttttggattgacattgtttctattaatattagtatgttaaaggtgaggtttcattgtctcatggctggcgtaatttcagataaggagtctgctgtcaatcttatttttgttcctctgcctgtaatcttttcccccttcttgctgggttttgactatgataaacctacatttttttttttgtttttcttaaatctttcttcctgtcctcttggagtccattggggtgtgtgtttgtgtttatgtgtttaattaattttgtagcaattggaggcattatttctctcagttggtttctttgcttccttgtatctttctttttgttttcgcattccagctgtacaaatgttctgtctttggctgtagtctcccagctctttgattctcagcactgtttcttttttccctctttttttctttttgtatttcagttggaaaaagtgccacgtacgtttcttctttaagtttagtgacttttctcttctgtgtccagtctgtggataatctcattgattatcattcccactgattaacattctttttctctgatgttgtgtgtttttatttctgcattttcaattgtttcatttttattgtttccatctctgctgaaactccatatccgtttatgcatgttttccacttttttgtctagatcatttacaatgttatttttatttatttatttgttttatcaacttttaagttcagggtacatgtgcaggatgtgcaggtttgttacataagtaaacacatgctatggtggtttcctgcacagatcatgccgtcacccaggtattaattcagcatccattagctattcttcctaatgctctccctctccccatgccccccacaggtgcctggtgtgtgttgttcacccccatgtgtccatgtgttctcatcaatgaactcccacttataagtgaggacattcagtgttttgttttttcgttcctacgttagtttgccgaggataatggcttccagctccatccatgtccctgaaggatacgatcttgttcctttttgtggctgcatagtattccattgtgtatatgtatcatattttctttattcagtctatcattgatgggcatttaggttgattccattactttgctgttataaatagtgctgcaatgaatttacacatgcatatatctttataatagaatgatttatattccttgggtatatacccagtaatgggattgctgggtcaaatgatacttctgcctttaggtctctgaggaatcaccacactgtcttccacaatggttgaactaatttacactcccactcacagtgtaacagtgttcctttttcaggccgggtgcggtggcccacacctgtaatcccagcactttaggaggccgaggcaggcagatcacgaggtcaggagattgagaccatcctggctaacatggtgaaaccccctctctactaaaaagacaaaaattagccaggtgtggtggtgcgcgcctgtaatctagctacttaggaggccgaggcaggagaatctcttgaacccgggaagcagaggttgcagtgagccgagactgtgccactgcactccagcctgggcgacagagtgagactccatctcaaaaaaaaaaaaaaaaagcgtgttcctttttctcgacaacgttgccagcatctgttgttttttgtaaatgttatttttaaagtctttgataattccaaaatatagaccctctctttgtctgcttctgttgactgccttatctttgaatataggccatttatttttcctttgtgtatgtgtgtgtgtgagacagaatttttaaattagacgtctttcgtggatttttctttcctatatgaacaaaagagactgaggtaagtatctttatgcttggtaacaggcatacttcttttagtttgttaataggcttcatttgtgggtggggaggggtagtggttgaatcagcctgttctatgtgttgctatataattacatcttcagtgctccaaagaatttatattttctcagcagttggctgctgttacttgtatttattgtaatgcctagagtataaaagggttttctcctggtgtttctgtttcacgtttagctttcagtaggctctgctcccctgtaccacagagtgttctattttcatacttctagtacttttccccatatgtaaacaactgtttcttgccgctcagtgccagacttgtgaagactgtggagttttcttagtttttcttctccagccttagtattaagcagaacctgagcacctgaatcgcaggcatggggttttcctcagtgggtcttccctctccctcttgccagtgaagttttgccttgcatagggatattttgtcaggaccaagtctttctgctttttatcaatataatatcattggtccaagtctgtctccagcttcttgtatagctgcatatggatttattcccaggtaacttttgcatcatatcaagaagggtttggaaagcaggagggttttaacgtctgtgcccaaccaaggtgggggcattctcatgtttcctgccctgcctgtggtctttcttgtgaagcctgatagaagcctgagaaaaagtttgtatctcttgtgttttgggcttccagggattctaaactgttccactcgcccagacttagtttttaagaattggtcagttgttgttttctttgtactcacttatggctgccacttcctcttccttttctctaccaaagaagacatgagttcatatacttcaccctcctttggaggggctgggattcagtttatttggttgcctgcagatgtcagctttctgatggccataacaaaagttattatttgatagattatctgcttttttattatcatcagtgtagaagcagcattctcttactatttttcacatcgtaaatgaatgaggaactttttcttaaaccaaccttttaaaggtatcttcaaagagcaaagcacttctaagattatgaacatagatctatggaatgaatgaggggaaaaagcattttcttaacattagtcaaccagtacttgtagcttgggataacatctgcagttataatctcatgtatgatttgaagaatgctgtaaatcagagacagcagcaggaaaaataatggaaactggctaaatgacttaaaagttggctctaatgatgaagatactgatatatggaagatggccgtaacaagtttggatactttttttttttaagaattgtaaataaacaaaagctaatatttctaatttaataaacacattacatatatgatctcatatgaatatataaatcagttaatataaagtatacaatattaataacatttttagattacatctctattcttagaaaaccttttttccttcaagaattttatctcccttcatattcactttattcatatagtatattctataatgcatttaaagtctataaaatttttgttaaatatacaaatggggtcttgctgtgttggccaggttggtcttgaactcctggcctcaggcagtcccctgcctcagcctcccaaagtgccagaattacaggtgtgagccactgtgtctggccaagtctataaaatttaagtggctattggaggacctatatatttaggaacttgcagaaatctttggggcatttgtttcagagagtcataagactttatttagttatctctttatttttagttaaagtctgatgtaatctgttctgagtgattttactttactctctgaattaaagctagttgcttatgtctgatgacctcagtttccttttctggcaaattgagtaataattcaaaacttgagaatacacatctcatgaggagttatgtattttgaatgatatgttaagtaccaagcacaacactccattgtaggtctttgatacatgataggtgatatcataaatattatgtgtcaagtaaagaaaaaaatattgtctagagtaatgcagaggaactcttattttgacccatgaattttcagtcctttaaatactctgatttataaaaagagtagaataaaaaatgaaattactttcatttctgcagcaggtagaatcatgttatgtagagtcttgctaactggctattttttattgttactttacatacaggcatggtccattacatgaatttgagaagtttggttgaagaatggaaactaccatgttaacttgccataaatgatgtacctacaatacaagtagagcaaatgaaagattaaaggttacatttttttaaccttttttttttttttgaaaaaagagattattgtggtatttggtttttattgcatcattgctcagcagaaatgctatgaatttagttttttttttttttttttgagatggagtctcactctgttgcccaggctggagtgcagtggcacaatcttggctcactgcaacctccacctcctgggttcaggtgattctcctgcctcggccttgtgagtagtagctgggactacaggcgcgcgccaccacaccggttaatttttgtattttttagtagagatggtgtttcaccatattggacaggctggtcttgaactcctgacctcatgatctgcccgcctcagcctcccaaattgctgggattacaggtgtgagccaccatgcccagccaactttttcatctttcaaaactgaaactcattaaagactaccccccaagcctctggcaattactgatctaatttctatctcagtgtcagaaaggaacattaaaattttaaggaaatatagatttttaaactcaaatttgaactgccctcagtttagagaaattatagattttgaaggatgaaatggcagagaagatgaagtcacagtttgggaagagaatcacagatttttgttgcaagtgaaatacgtacttgaagttttggttgttgcttttggaaagcaaatcttgtaaactctttaagcatagtgctttcaagagtgtgtgattgtgataaaagggatgtataacacacagcatatccaaaaatttagaagacatatttgaatcctagaactatcctgaattttctgttaattggccagagtctagataacctggtgttgtgggagggacctggtgggaagtaattgattcgtgggggctatttccccccatgctgttctcatgatagtgagttcttatgtgatctgatgcttttataaggggcttccccctttgcttgacactcattctcttgcctgctgccatgtaagaccatgcctttgctcctccttcaccttctgccatgactgtgaggccaccccagccatgtggaacagcaagtccattaaactgctttttctttataaattacccagtctcgggtatgtctttattagcaagtgtgaaaatgaactaatgcacctagctctgtgaaagtatgttttgttctcttccccaaaatgcagaaattcatgtttcaggcctccatcagtgatatacatgttgagttcttcaaaataataaaaatctgtgaaagagatacattaaaactacgtaatcagtcagaattaattagagggtatagggtctataactctgttgatatggcattgaaaaaactgttagttgtatttttcacggtgtattctttgcaatgaaattctctgcttggaaaaatataaaaaagacacaaaaaaaccccaaagtaagattaaaaacattctctaagggttcttggaaaacacagtgtatttatggattataatctccatgtttgagctggtttgtggttacaaattcttgcccccaagcaagtttgtttgtagctttggactataatcttcatgtttgagctagtttgtagttacaaattcttgtccccaagtatttctttgcttctcctgtttttgtgtgtgtttattttttattccttttatctattactttccagagtttctactttcactttgtttttgcttctatgtctttcttccttttgtgctggcttaggaatacatttaaaaatatgttttcagtgctttattcattattttggttgttgtagttaggactattgtttagaatatctagcctgccaaggaatggaaatttgtgtgtgtgtgtgtgtgtgtgtgtgtgtgtgtgtgtctgtgtgtgtgtattcaaatcttacgatgtattaacttagattcctttagacctatccctttctcttattttgtatttcagttcttataacttatatattaagaagtttttataaagcttagcaagaagtttaaatacttttaaagtgattattatatttttaaagaatacatgtgtatttattttatagctacttgaaggaaattttgccaaagaagtgagccatgaaatggatggacttatttttcagcctactggagtaagttcatttgtctgtgtgtgtgtgttcgtttgtgtgtttgtgtgtgtgtgtacacagatatacatatacatacacatacacatgtatgcctcaaacttatttacttgggattgattactgctgtgattgccacttttccttaaaacaaattgctcattatgaaagattttatttatatctaaatacatgtaatactaaaatgagcacccatctgtttttcactcagcttaagaaataagcatttttggtcgttacatttcaaagaaaccagtcttttaatataattagttattaaaaaataattttctaccaatagcattacataaatgtttatttccttttgtaacttggtatacttttatgtattaatctctctaaaacttcattttgctgtagtttactgtagagtaaaattcatactttgtcactacttgagaaagaataaaacttttgaatattttttccatgttaaatttttgaaatgcactgaagaacttttaccaacttaatggtcgaatcatatatttgaagtaagttgtattttactctatagcaggttttctcattctcaaccactgatgtgttgggccagataattctttgctgtgggagctgtcttgtgcatggtaggatgtttagcagcatctgtggtctctactcactagatgccaggagtatagatgccaggagcatgctccctattcccatttgtgacaaccaaaaatatagtctgacattgcccagtttcctcagagaacataattggccctacttgataacccatgttctgtaggacggtgtttttcaaaatgtggcctgtagaggaggattagcaccacccaggaagtttcacagatgcagctcagccccacacctattgagtagaaactctggggatggagtttagcggtttgtgttttgacaagttctccaagtgattctaatgcatgttcaagtatgagagctacttactctataggaaagagtttatttcatgtgcaaccacctcatcatatgctgctttttttcttcaccaactcttcttttagtaattagagtataagctagttgagaatttatatatggagacatcagactgggtgcctggggtcaaagaaagggaactaataatttgaacacagtgtattaaatactgtacaggttgagtatctctaattcaaagactgatatgctataaaatttataatgttttgagcaccagcatgatgctcaaaggaaatgctcgttggagcattttggatttttgtattagggatgctcaactgttaagtatatataatgcagatattccccaatctgaaaaaaatcagaatccaaaccacttctggtcctaagcatttcagagaaggcatattcaacctatgcatgtaaagcattatatctttacgtgtgtaataaatctctgctaaaatgcaaatttagagacaatgtgatatgtgattggcatctgtctgtcttctagccccccttgccaaacaaagaacagaaatatcttctgtggttaagggaggaggagagggaggaggacatggaggagcactagaggttagggacggaaatggaagaaaatactattttaggaaaattaaagttgaatcttttagttctaatatattccagtctccctagactgaaagaagcaaagtctaaatataacaataaattcagaaaatttcagtgtgtgaaactcatggttcagatctgtacatatatggcatatgtaggaaaaatggcctgacaaataagtgagtctctttcttggatgtctagtataggcagttgatttgtcattccgttccctttctagtaaccatactttttttttttttttttttttttgagatggagttttgctcttgttgcccaagctgaagtgcaatggcgcaatgttggctcactgcaacctctgccttctgggctcaagggattctcctgcctcagcctcctgagtagctgggattgcaggtgcgcaccaccatgcccggctaattttttgtatttttagtagaaacggagtttcaccatgttagccaggctggtattgaactcctgatctcaggtgatccgcctaccttggcctcccaaagtgctgggattacaggtgtgagccaccgcgccgggccgtaaccacactttttattacaatgactttgtaattgatatctggtattaagtcaagtctccctgttcgccagcattaccttaaatatttgttgacaattggtttaacgtgaaagtttcagaatcaatttgtcatgctacccagaaatttttgttaggagtttaattggaacatctttgaatttagattaacgtggagaaaattgatgtgtttgcaatgttaaatcactttctcaatgaatgctatggcttttttttttcaggtctttttctgttctgtaactgagtttaagttttttattattgttatggtaacttctaaatatttgtcattttctgcttttgtggtaaattgtgtctttttttattgctacttctagtacactgccacattattgatttattttattgattcaacaatcctgttgaattctgttagttctcatcattgtctaattttacacattgaccaggacctctagtattgaattaagtattagttctagttagataagggagaagacatttataccttcttctcaacctcaaagggaatgtaactaaattttctccattaagtatgtttgtggtagatttctgttagatatcctttattgtgttaagaaatttctgattctgttcttccaataattctttttaaaatcataaacaggttttgggctttaacaccttttaaagcattaattttaaggcagtaatgcctcttcggtatctactaaggttatcatgtcattttcatttttacaccatttatgtagtaaattacactgatttttctcatgttgacccatccttgcattcctgggataaatgctacttgatcatgatatatataattttttaagcatacttttggatctaggtataattgcttcttgaggatttctgccaccttatttcttacagttcatttttctctctttttttttttttgagacagggtctcactttgttgcccaggctggtgtgcagtggcacaaacatggcttactgcagcctcgacctcctgggttcaagcaatcctcgcacttcaggtccccaagtagctgggactataggcgcgcaccaccacgccttgctaatttttgtatttttcgtagatacggggttttgccttgttgccgaggctggtctaaagctcctgagctcaagcaatccgcctgcctcagcctcgcaaagtgctgggattacaggtatgagccactgtacccggccaatttttctcattttttatattcagaataatgaaggtaatattttttattgttgaaaaaattatgtaagttgcacataatccatggtaatgcctatccatgatttaaaaaaaccaattaaatgagtgatttgtgctgaaaaatagaacagtctcttaccaaacagtctcttacctttttctgcactctgagtactactcctaggaggcaattattttcctcttttttttttttttttttttggcttttgcttctacagttctacacagtctatgctgttcttttttggttttgtattttatacataatctgcttactttgtactgtggaagaataggattgagccctctaattccactaaccccctccacacccctttctccttctgtcattctattgtaattacatcacatatttggtcaaattaatattcaatttttatatttttatggtgacataaatattgttcctatctgggtcaaatagtatacaattgtattttctttttttagaaaagtcttgtcatctagcattaggaatatttttggttattataattattaatatttctttctttaaactctccaaaagaactgtttactttttatcaatgcagtcaaatatataaggtccatttttcatttgaaggcattctttctgaagccttccattctttagtcctgctgcatagccttttcttcttagagtttcttttcactatttcatccaggaaatcccttttacctttcttctctgatagatttccctacttttttgactttatcttttctgcttttttgatttgagtgatcttgaaaacctaatgctgtacaaactggtccttatacttatggagcttttgtttcagctgtaaactgaacatgttattttcagtggtctctaatctgttctacaattttatggctctgacttagccccaaattttttattgtgtttgtgtagttctgtgcaacttggtataatcttgattatctcgtaataaatcaagcctccctgtttgccaggacgttcttaaatatttgcagacattttgtttaacacgtaagtttcagaatctgtatgtcatgttacccagcaatttttattaggagtttaattggagtgcctttgaatttagattaatttggagaaaattaatgtgtttgcaatattaaatcatcttcttatatatactagagaattagggaaaaggtgcaataaaccgtagctcaggactacctgtctaaatgtcagaaatttccagaagttttagatctactcttagtttacatattcaattttgtatttttaaaaactttatctcgtaagttataactgatagcaatattagacaatagaactaaaaaggagagagtagttgtactcaaattctgtatttgtaataagcttcctaagacactggctttctcagcctcttccaccttttggatggctgtctttatacttgtcttctaaggtagttctatccccctttccttctcttcatagagaaaagtgtattttttatggctatagctgttttggttaaatcaacctttaacccatgccttttgttttgcttctagtactctatttcttcgttcatattatacatttctactagggacaaccaatcttcaaacaatcagtgaagtctgttaagtggctcatcactttgtctttttgggttgtccttgctatttattccttatttaaaaaagaccatgtcagatttggctcaaattgttttatactcagcctatttcagtagcttcttaactgctctttgtatctgtattatctttccagtctacccctgttttttgacctagtaaaattatactatggaagaaacccttatatgggggagaccagtactgactgatagaaatataacatgtaacacaaatatgatccacatatatactttaaatgtttctagttgccacattaagaaaaaaagtggtaaaattaattttaataatatattttacttaaacgactatatcaaaagtattatcatttcaacatttactcaatataaaaacaattattatttttgtactgagtatttgaaatccagtgggaattttacacttacagcatgtcttggacttgccactgttcaagtgctcagtggccatgtgtgtaagtagatagtgcaggtatagatatattgatttattgtttcccatttcttgtatgtgctcatggcatttgtacatgattcatttgtgatcttcagttgaattgtaattctctgtgtaatgatagatttttcttctccagcttgcagaacaaaataagattacatttctttattcaaatgcaataggcaggctcctacactccttccccttccaaatcatagtgcattgcagtattgcgagggtccctttttttatttttatgttcttcccttttaaaattgtgctttgagttgtttatttcttgttttttgtttgtttgtttgctttttttggtggtggtttttaaaaaattatacttttaagttctgggattcatgtgcggaacatgcaggtttgttacataggtatacacgtgccatggtggtttcctgcactcatcaacccgtcatctacattcagtatttctcctaatgctatcccttccctagcccccaaccccccacaacatgccccagtgtgtgatgttccctccctgtgtccatattctcattgttcagctcccacttataagtgagaacatgtggtgtttggttttctgttcctgtgttatgtgcttcgagttattaaacgtgttctattcaaggggtcttgattccggacttcagtttctgtaacggtgaaatgctactgagtttgtagatggaaaccattttttgtgcatttactgccttcagccctctatgttgatagtgttgaagagaggtgtttttaagctacacctgttagtctgatggtagtattttagggtataaagagttgaaaagatagttgctaggtttctttcgtatcaccttagtcatgaatatttaatcttaaacctctttaaacaaaattgacacatacatatttgcattaaataactattcctctatcatcacttttatagcagcttggtcagaagtgatacacctttgtctagaattagatctttccttccatgacagcctaggtcctgatcatcaacctgtaccttctacttctctgatatggagatttttcagttctctggtagcagctgttctcattctgaggccaccagtctaagagagatgagatcttagattcctgtgcacactctgtgtcttcattgctctccattccataggatttgtgggagattgatttgctttcatgaagctgaaagcaatatctttttctatcttttctcttgaaaaattgttactaattgccaaattgcttcagaactaaaactgattgcttaaatgattattctcaaagcaaaaatggttctctttaaagatgcctttctgtttctagctacccctcacaagctctcttttggttatatttttgcctcacaaaatctatgggctgtggttatatttttgcctcacaaaaatctatgggctgtggttatatttttgccttgcaaaataatctgaggttattagtcctttccttccttatttctttttaaacctccattgtctaggatagcgtttagcccagtatgtcttagaaactgtttgttaaaggaatgaaaatgcatctttgtgttttccccagtctttcagatttgactagttttttatgttatcaatgtaggtaaataccttttaaatttataggtattttattttccttgctgcataggaatatgtgtaatctaatttatgctgttatcttttttcctttcaaaaaacttatcagtggctttctttaaattctcacttttctttgccaagtccagaatccaaacaccattcttccctaaaacaataacatgagttttgtcctctgcatattctcttcagaaacttcccagtgggttaggagtggtctctggttaaacaaacaaacaaacagacaccactgaatatctttttgattctccagtttttcatctgtaaaatgtagaggctgtaagagcttagctttgaaattctcttatggtcatatgatgatcagtgcaaatgatataaatcagtacttgaaaattctttctgccaataacctggtgaaaatttactaagtaatgaatttttaataaaagaagaaactcttttattttagtttcctaaaaataatttatgttttaaatggcaagttagacaattaaaataaactagacttcttatgaagtttgatagtatgactattacatgactgtattctattgatttttttctcctgccatgatttctttttttggtgggggagacagagtctttctctgtcgcccaggctggaatgcagtggcgcagacttggctcactgcaacccatggttcccaggttcaagtgattctttagtagaaatggcattttaccttgttggccaggctagtcttgaactcctggcctcaagtgatttgcccacctcggcctcccaaagtgctgggattataggcatgagccaccacacctggccatcctaccatcatttcaatagacttttcacttttatatcttttatctcctaagttgttaagattataaaatatatggaatgtctctgaaagggtcacattttgttcatcagtggacatggtcagcttcttccaaaagtattaatttatttttattagaacagatttattttatttataacagattctagattagtttacatttataacttatttcagaaaacatgttttacaactacctattttggtaacagtttaattgatggcatagcactgtactatactagttataagtatctagttcatcattttcattttctatgaaattttaatgatttcagtctttgtttcttaatgttttatttctgattgtaatttctcatgatcgttttctgtctagttttttatttcttaaaagcacatgttaccaactttaattctcttagtttttatcactaatatgtacctttcatcatatttttgatgtgctctttaattggatggttaatttctaaaacagcatctggctgtaagaaggatgtggtacataatcacatgtctacccatcctagttaattcagtggttattttacattcctactattttttttggtaaatattctaaagggtattctaagtataaatatatattaacggtgccatccagaataggctccagttttgcataaatccattcgggtagcaggaggcaattttctctctcaaatgcaaaatttcattatattgaattgtgtagcctttgttattttttccttattttggttttgcaatttcaacctccgattctcctgcaaaggctgattttttcctatttttagtttatcctcagtttaggccaccatcaccagagtggtcttatgtattccactttcagacttttgatttgccaaagccccagattaaacctgtacttagctcttatgcagagatttatgacttttctacctctttaaaaaaatggaaatatgtttctattaaaataaagttgaatgacattatcagacactatatgatattctgctaaagaaagcagagtttaagacacatttttctaataattcttactcataaattctctttatgactttaaaagaaagaatacttaagatttttctcacttcttttgtgcttatacattgtcatcaatttcctttttaccagttcaaatagcctttttctgattgctgtttgtatattcaaaggaaccaccttaattttccttttcacctgcactaggtcttatttgtaaggaggaagtaagaagagagttgattatagacagatgtggcttccagtggtgagaggagacatgattttaggtggtccagggacagggcatcagatgacactgcatcatacaatgagaaatgtagtcccattcttgtttttattcagtctttcagattataaggagaaagtctatttctagtttttaatatctaaaacttgctgatcttttcaacaagtgtgtgggcccacttttagactattcaataggcaacatatctactagaatttagtatcattgattaatttctgtcttttctaattttaggactactggttatttaaggtaagcaataccgttttctcgaatagtatcaatggtgtaccatttgttataaagtttccatttaaaatatatattttttagatttttagagtgaactattttaaagaaaaatataataatagttatggtattttgatgtgacagaaatcctgggccgagcatggtggctcccgcctgtaatcgcagcactttgggaggccaaggcgggcggatcacgaggtcaggagatcgagaccatcctggctaacgtggtgaaaccctgtctctactaaaaatacaaaaaattagccgggtgtggtggtgggcgcctgtggtcccagctactcaggaggctgaggcaggagaatggcgttaacccaggaggcggagcttgcagtgagccgagattgtgccactgcactccagcctgggcgtcagagccagactctgtctcaaaaaaaaataaataaataaaataaaatttagaaaacgtgatggtactagctagttactgtattagtttcctatggctactttaacacattaccacacacttgatggcttaaaacaacatacatttattcccttacagatctggaggtcccagcaatttgggaggccgaggtgggcggatcacttgagcccaggagtctgagataagcctgggcagcacagtgagaccccatctctataaagaatgaaaaaaattagccaggcatggtggcacacacctgtagtacttgggaggctgaggtaggaggattgcttgagcctgggaggtcaaggctgtaatgaactgtgatcgtggcactgcactcaggccttggtgacaattgttttttaaaaaaaattgaaaaaaaaaaaaaaaaaggtacttgtgattgcatttagggttcatctgggtaattcagaataatctcccctgcccttgaatggccttaatttaatcataccaccaaagtctcttttgccatataatgtaacgcattcctgatatctctaggtcgccatttttcagcccaccaaagttatagcttaataagacgtttccgatggatagctgtagaccttaatacccagtgtaatttctgattctgtctttgtaaaatttgtaaattacctttctttcttagacttcctattaagagcaagttctaaatgagaagtttaggacccttaatcaggccaagaactttttaagtaaaatttgccaacatttcaaaatttttcttctggggaagtctaaaactttctgatgaactcagctttaataattaagtgcagggcaagtaatacattgttatgagaaaagtaatatagtatattagaggtaatctgcattttaaaaataatgtcaaaatgtgtataaatttttcttttatttttaaattggaggatatacaaattttataacgtgtagttattttccctgaaaatcttttaacctgtctggaggtcaatccttcagtcttttgcctgctcttactattcttggagtagagaaggtaaaggagctagggtccactcttgggtaaactttcacttaaccttgcagtttcagtttttctcttctgttttgaatcttctccaccatagctctgccttcagctttttcacagaataaacatatctcctgccttttgcccgcagtggaggagagaagctagaggtttagtggtccttctatagactttccctggtctccttgttttatgtcctatgccttacctttatcccctggcagccttctaggttacctgttatttatatgactcaatcctttctggggcactgcaccaggaatgacttgcattggcgtccttctttgcatgtacttagtatttggttttctttgctgtatgctgtgttaacttctgtactttctatcttttaaaattacattgctatgggtttttttctgctattgtcagtctcctatttttgttttccctttctgttgatacctcttgttttctgtaactctcacctttagtgaggttttatatcaaagcgggcataaatacatgtttagtctaccatttatcctaaaatctttgaaactttttatagtgtggtgttgcatctattggttcctattagccaacaattcaagtaaatcaagaaagggatagttgagtgaaagggtgagtgtatataaagtggagaacaagtcctgatgaagcacaggcaaagcctgttatccatcctctggtaccacagaaatattccaaaggcaaatgaatggcaaaagatgatgaggattactagtggatctacttgtgaaaaaactccttggcccaactgtgtttggtgctagttacttaaaacttagcaagaagtttattctgctgtgttacattaattataatgagtgaattgaggttgaataaagggtagaagatgttagtactgttgaaaaaagaagatatatctatagatatctacatatttgagacagagtcttgctttgtcgcccaggctgtagtgcagtggtgcaatctcggctcactgcaacctccgcctcccgggttcaaatgattctcctgcctcagcctcctgagtagctgggactacaggcacaccccaccatgcccagctaatttttgtagttttagtagatacggggtttcaccatgttggccaggatagtctccatctcctgacctcgttatccactggccttggcctcccaaaatgctgagattacaggcgtgagtgtaattaacacacccggcctaattttttgtatttttagtagcgatggggtttccccatgttggccaggctggtcttgagctcctggcctcaggtgatccacccgcctcagcctcctaaagtgctgggattacaggtgtaagtcaccgtgcccggccaagaaagaagatactttgaatcctagcaagttattgaagaatagtgataaaaaatactatattaagatgatgattctattgagaacaaactcccaaaaaccagcttaggagaaagttttattgtttagcttttgatttaatattctactttcagagacataaccatgtaacacattcataattggacatagtttacttattacttttataagaaggaaaagttaatcagtggtttaatcaaggaaataaaacttaggatatttgtgtttataaagaagtacactaatatcttattttgagtaagacacagagcagtcattaatcatcatgaaagcctggattcaaacaaagtagattaccttgcatttacagaattatagaacatcagaggttatctagttcactcactggtttcaaaaatataaactccaatgttctaggtttctgtgaagtgccttaggtgactgcatggagggataggttactaggtcagcattctgtttccattgcagtgctgctgatttactaatattacttttatatattgtgcttgtagatgagattatgttttaaaaagggctttagctgctaagtaaatgatgttcgaatcaactgcttttttgaaaggtcgccagtcatctcctttaattaaaaaatcaagataattttcacccttttttactggatcatttagcattagtctatattctgttcactctttcttgaaatactttcttttatggcatctgtgacaccacatgctcctgattcctcctagtcttttgccattctttgcggtccctttcgagctcttccgtcttctaccagccattgaagtttggtgtttctcggggctcagtgcaccagatttcattctttctcatgccctactctttctagtagtctcatccatacctatgaatttagttcatttttatcagcatgttactcagacttcagatttctatgtaagccccaaatttggttatctttttgcccactctgatactgccttttgaatttctcaaaaacatcagaaacacaatacagacagttcccagcttatgatggtttgacttatgatttttctgtggatagtaatgccgttgtaagttgagaagcatctgcatatcaaagacaaactctatctctatttctgaaatgatcaaataagcagacatacaaactggttcttttccagcatttccacctcagttactaaatgcagttacttaaatcagaaatctagctgtcatctttggcactgtccccttccttcatctccaagtctttctttatcttttaagtatctcttaaattattcccttttttctccattgtcactgctactactctaatccagtttgtcattcattgcctcttgctggaaccactacagtggcatcctaaccagtcttacagcatccattcttgcctccctccaatcttttcttcactccttttttttttttgtttttgaaatgaagtttcactcttgttgcccaggctggagtgcagtgacgcgatctgggctcactgcaacctcagcctcctgggttcaagcaattctccagcctcagcctcctgagtagctgggaatgcaggcccgcaccaccacacccagctaatttttgtatttttagtagagacggggtttcaccatgttggccaggatggtctggatctcttgaccttgtgatccgcccacctcggcctcccaaagtgctgggattacaggcatgagccaccacgcctggcccaatcttttcttctctccatatcgagtgatcttccttaatctctagtgctttctccttgttctcaggttaaccaacatttctcaggaaaccaacattagatttggagccagtttacttttttctttatcatattttgccttttggtttccctgtgtgttttgctgttgattcaaaaataactttaatgttttttatttaaaggtggcttaattatattattcacaaacagtgatataaacaataatataaacagtcaattagtcagtttggggtgctgtaacaaaataccataaaccgagtggcttataaacaacagaaatttatttctcacagttctagaagctgggaagtccaagatcaaggtgttggcagattcggtgtgtggtgaaggcctgcttcttggcttatgttgtgtcccacatggcagaaggggcaagggagctttcctgggtctcttttctaagggtaggagtctcattcatgaaggcagagtcctcttgacttaatcacctcccaaaggtcccacctcctaataccatcacattaggggcttaggatttaaacataggagttttggaagggacacaaacatcagtctgtagcacagtgttttaaaaaaatttgaaatgtaacctatacttgacaaaaatacttaaatatttgagaaaaactttggtattttcttcaaaaggaaaaaattatctgtttgttttcagtataaacctattttctaaggtttaaggttcaagctttcctcaaacagaaatgatcatttttaaaaagaaccactatcaaattgaattttccatctcattatcagcttctgtaataaactatgttttattagactcctatctatatggttttcagttctgtgattacacttccattttgaattgctaatttttggccattcgtcacttaaaaatgaatattttaacgtgatgatttggtattttaatatgcaggtattcaatcttttacatgatagctattagattgtttaatttacaaagttggtagtaaaatgaaatcttatttgtttactagcttttataagttgattttagtgtagatttatgtagcatattacagttttacatgtggaaataacattaatttttaaccttttgaaaaatcagctttgattttacttttatcatctggagaaactatgtttctagacaagaattgtatgccattaatctatcactatgaaataaaaacagaatagtggattgtataattgaagtaagaataaaaatcttgaaaatatttttgttttatatttagaaaaatggcttttcttgttgtacccactaactctactatggttagtaaaacataattgtttctattgagtctagagttatttactttcaagtagtagagatataattgttttttaatgttttcatcactattttgattttcctataaggtggttcagcttgattttatgtatctggtattcatcagtttgcatagaaatttagagtcagctttgattttaatattgcattcttttgaaatattaatatttttattaaatctttactactgccaggtatattgaatgttatggatagattgtaaaatgaaaattggaattagcctaatgccttgtcttgaagtacatgacaaattagaatggttttcctctgtagcaaggatgttaccatggtgagagcttctgtttccatgacatttgcttgcatattttgataggtcttcatttgaagaagggctctgttttctggcaggctgcaaaagtgtcattctatcttttctcaaaatgtgttacttttattgaaaaatataattttccaaggaattgtaatagcaaagtgccaagaaagaaaatataccttattttatttttttttccttgttcatcttttagagcacagcaaaatattcttagcttgctttgtgtaaggaagaaaaagcaaaacatcattttcaagtttttaaaataaatatttacttttttttgaattttgttggcaaaataaacagctacagatgcataatttgtaatcagtctcagctagatatagatatatctgtacaactaaaaggaattgctaatgatgatatattggtagcagagaaaggggaaataaatataaataaggacttcacaaaaatgaaagaagcggtgaattcctagagggtaaatatacagaataccaaatcagttctcatataaatgatacatattaaacacttaatgaattagggatagttctttttattaataacttatgtttaatgttgaaacattaatggtagatttttaaaattgtcattttacagtggtataattttaatttttaaaccagataatacaatcacgtggttcagaaattttaacatgtatttaaaaaatacatagaagaaaatttccctctcatacttcttcccagtttctttatatatatagaagcaaatacaaatgtgtgaatacattcttattttcattccacttttttaaaaagatagcatattattttacactttgcttttcagaatttgtccgggtatatttttaatgtctattttgttagcgctctgatttaggcatctagggagacatattggaatcatagcaaaaagatagggtttattaattgatatttcttatcccttatgcttatagcaattccacattttagaaggaaatatttaaaagcacacattttgtctatgtagggtcagaaaattgattttccttttgttgtccaagttcagtgataactttagtagctctttctactgacagaccaattcattctgtaagagctacaaactgaaatagtctctaaagaatatgtatttatacatgctatttcttctgcctgaaactattttcttttctatattactcccatttatccttcaactatcaagttagatgtgcttccttgaggaagcctggttgtataggtgagcatgactctcccctgtgcctccacagtattcccattggcctcaaagcacttaacgtgtattaatttttagttatttaaacattaccatttctcttactagattgtaagtaccatgaagacagagaccatctctgtctcattcacagtgatatttttagtgcttgtagcagtagggtgaatattaagtactgtgctgtacgtgtgggcaatctgaatgtctgctgctcagattcactgtactttctcttgtagctacttaactcatccttattgcctgtataattctcagcttaaattttacttcccctgggaaatttgtttttatctttttgactgtgttacatttcattttctcagctattatagcactctgaacttcatctttcattaaattcttcacagttttttgtaactgcttattatttgtctgaaacccccattatctttatcttactgtcctctagcacagaggttgacacaggcttagcagttgatcaataggtactggtttaaaaaaaaagaatgaatgcatactttagatcagtgattctcaactggcatgattttacttcccaaataacatttgacagtatgtggggacattttttattattttgattggcccatagaggccagggatgctgttaaacctcctacattgcacggaacagcccccacaacaaagagtcaactgccccaatgtcagtagtattgctgttaaagaaccctgctttagactgtggatttctttgctttctccatattgtcttagatttatagatttataaatgtatagggcttttgaatatacttgaacagatatcttaaccattttgtcttttttctttaaattctatattttgtgacaatttaacttttttgacgtatagaaattgtatgtatttagggcatacagcttgatgttttgatatacattgtgaaataatcactacattccagctaattaacatctgatatctctgtctacctgccatttttgtaccctttgaccagcatcatcccatttctagttccttccgtttccaggcagccaccatcctaatctctgcttctatgagtttgactaattgagattccatgtataagtgagatcatgcagtatttctctttctggcttatttttgcttagtacagtgctctccagctccatccacgttaccacaaatggcataaattacttttctgggggtaaggctgaataatattctgttatatgtacaccacgttttctttaaccattcatccatcgcagggcatttaagttgcttccatatcttcgctattgtgcataaagctgcagtgaatgggagagagcagatatctcttcatgatcctgttttcaatacttccagatacatactcagaggtgggattgctgaatcatagggtggttctgtctttaattttttgaggaacctcaatactgttttcactaatgggctgtaccaatttacattctcaccgaagtatacaagggttcacttttctccatatccttgacaacacttgttatttcttgcctttttgataataggcatcctcgtaaatgtgaagtgctgtcttattgaggttttgatttgcatttccctgctgattagaaatgctgagcagcttttcaataggtctgttggccatctacgtttcttattttgagaagtgtctattcagggcccttacccatttttaacaggttatttgtatttttaatattgagttgtatgattttatatattggatattaacccctgtggatgtatagtttgaagattattttttctcatttcataggtgacctttcactttgttcattgtttcttttgctgtgcagaaggtttttagtttgatatagtcccacttgtctatttttgcttctgttgcctgtgcttttggtgttatatccagaaaatagttgccaagaccagtgtcaagaagtttttctttgtttacttctaggagttttacagtttccacttttgtgtttaaatgtttaatccatttgagttgatttttgtgtatggtgtgcacctttttgtctttccattcaccccgtacaatgtggtagttagtatatattttggaatctggaataaaatacttgggttcaaatatcttttctaccaatttctttatgactctgttttgtgatccatgagaaaagggtactatgttagattgaactacctcatggagctattttgagaataaagtgatttaagaacactcaaaccagtaactggtgaaaagtgaaaaactcagtcgatgttagcccttagaagttattgctgccttaattattctgtgtaaagggcatagtaggggataaaactagagaggatgaataaggctaggtaagtgggcacggggaggtggtctttggttgttaggttgagaagcttgtattattttcagtaaaccatctaaccagatggattcaggatcagttgtatttgatagggcctgttgataatagggataacagttaggttgatcacaatagcctgggtgaaaaagtaatagagataattggtggaatatggaattggtagagatcgcatcaaagatgattcgagagttttgaacctttctggttaggagcattatgttaatcagaaatggaaatcagaatggagatgaactagttttttgtttaagaatataaatgattcagttttagatttaaaactttaggctgcctttagggtactaatgaataagccagtgcctggcatacttttatttgggagaaagttaggacaaaagatgaagatttgggagtaattttcattgtaagtgtatttggagtcttagaggagtggatgctgtataatgtgtaacagtgaaaagacaaataatagattcttgaagaatgtgcgttcataattgattccattgttttactgtctctagtagcattactgtctaggatttctaaagttttctttaaaaataaatgctgtaataaaactaatattatagtaaggacagggatctttcttagcttcagatgtgatctttgtgaagaaggcattatgtctcaggttttactgtagaacctggtgataactactcacattttactagtggaaataatagaataacataagcctgcaaggtgtttttagatatctctggtctagatatcctgttttaggcaagcaaaatgctattattgcatttttacaaatgagatagataaagcccactttgaacttgcttaaaataattacgttagtagaggcaaagagggactaaatacgttgctcctttgccgttactaatgctagcttcatttacatcaggttttctcagccttggcaccattgacattttgggctagaattctttgttgtgggcagctgccctgtgctttgtaggatgtttagtagcatatctagcctttaaccactagatggcagtagcaccccctccccacctcttgttcaaccaaaaatgtctccacgcattgccaaatatcccttggaggcaaaatctcccctagttgagaaccagtgctttacaccacaaatatatatcatgtatacctccagttagcttcctgtccaccttagttttacagacttctctttggcatatggccatcttctacctctaagccaggttctgttctcatctggtcaacactttcttaagcatcttattttgctgcctgacgtttacatttattatgtttttgactttacaatggcaatggatatcttgggttatattggtaattacgtttacacctaacatatccccagtttttttttgacagctcacctcatacaatcagatttatttctataaactaagtattgtatttatcagttaactatagctctgataattattttaacctagatacatgctggtaaattgaattatattactctgactatacacgagaacatgtagaatggtgtttttatatccttgtttatagttcagcaagattctgtatttcaagtttgataaatcataaatatttatttctaaaaggcttattcagtttctgtatttgtaatatatttgctcttattattttggggatcatgaaaaagggattatttggtagtgatttatataatctttcataaatattgttagcttatttcataatctcagatatttcatttttaaattaagtgtacctgagacagatatttttgtagtaagttttgaaattctgtatttttaattattttattaaagtatttgagcattttactaggtgttttgtaggcacaaaattgatgtgattttttctgaagtagaattacattctaatgggtatttcaatatattttactcatagaatctgtgtcattgttgaatctacattcaataactgggagctacagtattcttaaaataccattttctagattaattaattaatttatttatttgagacagagtctcaccctattgcccaggctggcgtgcagtggtgtgatcttgactcactgcaacctctgcctttcaggttcaagcaattttcctgccttggcccccccaggtggctgggactacaaacatgcaccaccatgcctagctaatttttgcatttttagtagagatggtgtttcatcatgttggccaggctggtcttgaactcctgacctcaggtgatctgcccgccttggcttctcaaagtgctgggattacagacgtgagccactgcacctggccccattttctaaaattttataatcattaattttcataaaggtgctttgaaattcctaataatatcaagtctagtattccaaattaatatgaatgatttgatgtgcaatgagatgaggagttacttaagtttctgaattattgctgtgtaaaaacagaagagttgatacatgttgttttcttattagacaaaattgagtcttgatttccaggcaagagaatgtgaatgatatttaatatctgttatataaataaaattacatattaaagctttttagaatttatcattaggtacctattaggagatattttaaaactataccatcattcaacttttctagatttaataacttagattgatattggtttctaagtgttcttgtagtcacttactataaacaagtaggaaacggaactaaaggatgatttgcctgtaagtatgaaatttccttggcagaggttgcaaatgcggtgggatgtgcatagtgtgtttcaagctacacaaacttactctttttcttgggcctattctctcttgctgacactcctttctccccttactttttttgaccctttactactgtaatgagccactgttacttaaaggcctgtgacttttctgtcaaataagctttactaggaaaatgactatattttatcagattctcttcactaatgggttgacaatgggaaaatgttgcagtttcaacattccaaaaaaactttctaaagagatttatttgtgattatcctgaagcatgtatgttacctaaataaatctctcagggcaaatatatggaagaaaatttccactgaaaaattatatatttgattttatacttactcatgcttcaatacaaaacttgagggaaaataatgtgcattattttcttacacgtggcacagttaaaaggtgtttcctatcaattccaatgattttttctttcttagcaaaacttaaattatattgaatcgtcattgtatggacttccgtttgaagtaagcaatcctgtgattatgatttttgcagttttaaataatttataaaaatctgtttgagctgggtgcaatggattgcacccttcgtctcagctactcaggaggctgtggtgggagaattgcttaaactcaggagttcaaggctgcagtgctgtgactgcacctgtgaatagccactgcattctagcttgggcaagatagcaagactccatatctaattttaaaaattaaattaaaaatttgttagaatgcaatttgacttggataatttaaaaatactagtattggacacttagcaatttttccttcctaagtatttttcttataatatggccccaccctccataatgcacacactgaattgggagacttgcctctcctttagcacatcctatatttctctactcctgtttttttgcccatatttacttcatgctgcaaatctgcatgagtgaatattacccatccttcaaggcttacaatgttcattcctctataatcaattttaagacactcaggtaataccttttctttttttactttgtactcagaatacatttaaaatccccaagtgagatttatccctgggttacaaggttggtataaacatatgcagatcaatcaatatgatataccacagtaacagaataaaagctaaaaccacatgatcatctccacagattcatacaaagcatttggcaaagttcaacatcttttgggacaaaaacttccaataaaataggtatagaagaaaattttctcaacacaaaggccatttatgaaaaggccacagctagcatcacaattaatggggaagaactaaaagcttttcctgtaaaatccggtacaaggcaaggattccccatcttggtgcttctattcaacataatactggagctactagtaagagcaatcagacaagaaaaagaaacaacaggcatctaaaatggaaaacaagtagtagaattatctctgtttgcagatgacatgatcctatatgtagaaaaagactgttacatcaaaaaaacctgttaattcaataaagttgtgggatgcaaagttaacatacagaaatcagttacatttctttacaccaatcgataacagcctatctgaaaagagaatgaagaaaacaatctcatttacaatagcatcaaaaagaataaaatacctaggaataaatttaaccaagatggaagaaattgaagatgatacacataaatagaaagatattccatgttaatgaattggaagatttacattgttaagatgtccatactacccaaagtgatacacagatttggtgcaatccctatccaaataccaatgacattttttacagaactagagaaaaacaattctaaaatttgtaggggactaaaaaccctgaaaaagccaaagcaattttgagaaagaagaacaaagttggaagcatcacacttcctggtttcaagttatattgctaagctccagtaattaaaatggtgtagtactgaaatagaaacatacacatagaccagtggaccagaatagagggcccagaaataaacccaagcatgtatgttcaaatttttgacatgggcaccaagaatacacaatggggagaagataatcttttcagtaaatgatgttggggaagcttgaatatccatatacaaaagaatgaaattggacccttataccatacacaaaaatccacttaaaatagatcaaatacctaactgtaacacttgaaactgtaaaactcctagaagaaaacatagtggaaaagctccttgatgttggtcttggcaatgatctttttgatgttacatcaaaagctcagccaacaacagcaataatacacaactgggactacatgaaactaaaaagcttctgcacaacaggaaacaatcaacaaaatgaaaaggcagattgggagaaaatatttgcaaagcacatatctgataaggggatatctataatattaaaggaattcacaactcagtagcaaaaaacaaaacaaaaacaaataatccaaggacttgaatagacttttttttttttttttccaaagaagccatgaaagtggtcaacaggtggctgggcatggtggctcatgcctgtaatctcaacactttgggaggccaaggtgggtagatcacctgaggtcaggagtttgagaccagcctgaacaacatggagaaaccccatctctactaaaaaaaagaagaaaaaaaaatgcaaaattagctgggcctgctggcacatgcctgtaatctcagctacttgggaggctgaggcaggagaatcacttgaacctgggaggcggaggttgcggtgagctgagattgcgccactgcactccagcctgggcaacgagagggaaactccgtctcaaaaaaaaaaaaaaaggtcaaaaggtgtatgaaaaggtgctcaacatcaccagtcacagagaaatgaaaattaaaacgtcattgagatattacctcatgcatattaagatggctattatcgaaaatacaagataacatacaaaatagttggtgaaggtgtggagagtaagggtgtcccactgttggtaggaatgtaaattggtacaaccattatggaaaacagtatggaggctcctcaaacgattaaaaacaaaactaatatatgactcagcagttcctctgagtatataccaaaagaaatgaaattagtacctcatagagaaatgtatgcccccatgttcattacagcattatttccaacagcctacatatggaaaccacctaaatgtccttcagtgggtcaatgaattaagaaattatggtatatttatgcaacagaatattattcaggcttagaaaaaaagatcctgtcatttataacaacatggatggagctggagggcattgtactaagcaagatcagccagacacagaaagagaaatggtgtgtgatttcacttacatgtggaatctcaaaaagttgagtacacagaaacagaatgcaaaaaacacctattatgaagctacttggttaataagctcttttaaatgggggagaaacaaacccagttggtaactcattaataacaacttttgattataggtgataaactaattctgtacctccttattataattgaaacagatataaattactctgtcagttctaactgtaccgtcttctgtggttagaaatataaaaaaattagcaagctcaggtcagagggagagcatgctttttatcccccctctcagttgtgggtattcaaagggatttgttttgttgaaactagaagctactgttcaggactaggaagaaggttatcagtgctgaggatgggggagttggggagatgtaggttaaagagcacaaatttgcagttacgtaggctgaataaatctggaggtctaatgtacagcacaatgactgtacttaataatattgttttatatactggaagtttgccaagagagtagatttcagatgttcttgacacacatgtacacacatacaaggtaactgtgaggagatggataatgttaatttgctttaccatagtaatcatttcactgtgtatatcaaacattgtgttataatgttatatactttacatatcaaaaaatttcaattaatttttcattctgttgagtaaatgcattccaattaggatacctataaagtgaatatacaaatatattgattagtgtgatttatttatatttacatattatatacattaggaagttataatgcttaagaacacaattatttacaaagcttttgtttattaaaataatttttataatctctaattacatggacagtgttgtacaaccacctccactgtctatttccaaaaccttttcatcatcccaaacagaaatcatttaaccactaagcagtaacttccattttcttccatactgtagccctgggtgacctctaatctactttcggtcaccatgatttttttctattttaaatatttcatgtaagtggaatcatacaatattttccttttgtgtctggcttatttcgcttagcataatgcttttgaggttcatccgtttggcagcacgtatcaaaacttcattcctttttatatttggataatatatgtatatacaaccttttgtttatctactcacctgttgatggagacttgtattgtctttaccttttaatttttgtgaagaatgcttcaatgaacattgacatacaagtgtctgtttgagtagctgttttcaggtttttggagtgtgtacctagaaatggaccttccgggtcatgtggtaattctgtgtttggctttttgaggtactgttaaccttttatctatagtggctgcaccatttcacatttctatcagcaatgtgcatgttctgatttatccacattctcaccaacacttgttagtttctgtgtttttttttctaaattatagtcaccctagttagtatgaagtggtatctccatttgattttgattgcatttgtttaatgattaatgatagtgaacatcttttcatgtgcttattggccatttgtatatcttccttggagaaatgtttattcaagtcttttgacttttaaatttgggtttttttgttgttaagttgtatccattttaacaatatattctggatataaatagatacatatccaggtttatatcagatgtataatttgcaaacattttctcccattctgtaggttgtcttttcactttcttgataatgttctgtcatgcacaaaggtttttaattttgattaagcccaaactatgtagtttttcttttgttgcttatgcttttggtgtcaaaactaaaaatctactgccaaatctaagatcgcagagccttatgttttcttctaagacttctgtggttttacatgttacaggttgtttattcattttttgttaatctttgtatatggtatgaggtaggcattcaatttcatagttttacatgtggaaaaccagctgtcccacctctctttcttaaagagagtattctttccctcattgaatgggcttggcatccttgtggaaaagaaatcaatttgctatagatttatgactttatttatgtactcttaattctattctgttggtgtttttgtctatctttatgctagtaccacctgttttgattactgtagctttgtagtaagttttgaaaagtaaaaagtgtgactctttcaattcttttcttttttcaagatttttttttttttaccaataattttttatttatttattattattatactttaagttttagggtacatgtgcacaatgtgcaggttagttacatatgtatacatgtgccatgctggtgcgctgcacccactaactcgtcatctagcattaggtatatctcccgatgctatccctcccccctccccccaccccacaacagtccccagagtgtgatgttccccttcctgtgtccatgtgttctcattgttcaattcccacctatgagtgagaatatgcggtgtttgtttttttgttcttgcgatagtttactgagaatgatgatttccaatttcatccatgtccctacaaagggcatgaactcatcattttttatggctgcatagtattccatggtgtatatgtgccacattttcttaatccagtctatcattgttggacatttgggttggttccaagtctttgctattgtgaataatgccgcaataaacatacgtgtgcatgtgtctttatagcagcatgatttatagtcctttgggtatatacccagtaatgggatggctgggtcaaatggtatttctagttctagatccctgaagaatcaccacactgacttccacaatggttgaactagtttacagtcccaccaacagtgtaaaagtgttcctatttttccacatcctctccagcacctgttgtttcctgactttttaatgattgccattctaactggtgtgagatgatatctcattgtggttttgatttgcatttctctgatggccagtgatggtgagcattttttcatgtgttttttggctgcataaatatcttcttttgagaagtgtctgttcatgtccttcggccactttttgatggggtctttttttttcttgtaaatttgtttgagttcattgtagattctggatattagccctttgtcagatgaataggttgcgaaaattttctcccattttgtaggttgcctgttcactctgatggtagtttcttttgctgtgcagaagctctttagtttaattagatcccatttgtttgactctttaggtctgttgaaattttacttgaatttgaagagcacattttcatttctgtggaaaacgctgttggaattttcttagagattgcactgaatctgtagattgttctgggagtattgacatcttaacacattgagtcttcctatccatgaacatatgatgtctttccatctttttttttttttaaagaaatcagtgttcagtatacagatgattcaccttggttaaattaattcctacatattttgttcctctagatgctattgcacattttttttttttgagacagagtttcactctgttgctcaggctggagtgcagtggtatgatcatggctcactatagccttgacctcccaggctcaagcaatcctcccacctcagtctcctaaggagccgggactacaggcatgtgccactatatttggctaattattaaatttttttgtagagataaggtcttgctttcttgcccaggctgatctcgaactcctgggctcaagctgtcctcacacctctacctcccaaagtgctggaattacaggcgtgagccaccgtgcctaaccctactgtaagtttttaaaaatgtcctttccttttttttcttttgatttttattgctggtgtatagaagcaaaactgaatttttgcgttgataatttcaccaaaaatagtaaattattaggaatacatttaacaaaagccatgcaagatctctatactgaatactacagaacattgttaagattcatttaaggatgagtaaatggagagatttacagtgtttatgaatcagaaaattcaatttggttaagatgtcatttcttccctaacctattgattgattcagtgtaatcctcattaaaatctcagcaggcttatttttcatagaaattggcaagctgattttaaaatgtatgtggaaatgtaaatgctacattagctaaaagtgttttgaaaaaggagaataaaagtctgaggacttacacagcctgttttcaaaatgtataaagttatagtaattgagactattctattagcaggaagaaagacatatatgttaatgcaacagattagtgagaaaagaaattgtgtgtgtgtgtgtgtgtgtgtgtgtgtgtgtgtatatatatatacacacatacatacatacagtcctgtgcttcataccatagaaattaataagctgaagtagtttgtatacctaaaaataacagctgaaaccataaaacttgtctaagaaaacatagtagaaaattgtaatgactttaggaaaatattccttaaataggtcacaaaaagcacaaattatataatttttaaatggataattttgacattactaaaataaagaactttggtcttcaaaagaaattatttagaaaatgaaaaagccaaagacttgtagaaaatatttgtaatacatatatccaaccaagactatttatttacaatatgtaagtaacttcttacaaggcagtaatgagtcaaacagctcagtgcaaacaagagtaaaagatttgaacagacacttcaccaaagaaggtatacagatagcaataaacaaaagaaaagatcttcaccatctttgtgtcattagagaaatgccaattaaaatgatgagacacacactttagaaaggctaaattaagaagactgacaatgcctagtccaaggcggatatggagcaaatggacttctcattcatttctggtaggaatagaaaatgttacagtttgacagttcttacaaagctaaacatgcatttgccatgtgatacagtcattccactctcctagttatttacccaagagttaggaaaacatgtcaatacaaatgttcagagcagcatcattcatgatagccaaaaactggaaacaacccagatatccatcaccttgtaaatgtgtaaacaatttgtggtatatacatacaatggaatcctagtcagcaatgaaaaggaacatactactagtatatgcaccaggatagattcatctcaaaaatcttacataaagtgtttctttattttttatttttaaagtatttcttatgtagctagaaaaggtacaactgtagtcgtagaaagcagatcactgttgccagaatgctgacggagggaattgactgcaaatggtagcaagaaattttttcacatccttgaaatgttcaatatcatgattttggtcatggttacgtaactgtatatatttgtcaagatttgttggttaattttattcattataaattatccctccataaagctgaacaagaaaaaaaagcatttttaaaaatgaagcttcttttaagtcataggaaggttggatagaatcactggttttattctttttctggactttcacaaacaagggtctacatgtctttggtaggaaaagaagaaaggtcatcaataagaaggtagatatctagcctgacttgttggttgaagattaaaattatgtttagaaaagaagtaattttgcttaataaaaagttacattaggtttaatacattgaatgtttaatttttaacttcttagtaacgattgtcatcattttaattggctttagaaatacaaacctggtcgatgtgatgatattttgaaatggaagcctcccagtctgaattctgtggattttcgtctaaaaataacaagaatgggaggagaagggtaagtatgcacttttgtactttttgcatgaaataatactgtttgtgtaaggcttcaccttttacagggtatttcatatatactttacaatactttaaagaaagaaactaaaatactttattttacaagatattttacatatatacttatacaacaatttcgttttcagagattactcctttgacctgtgtcagctaacatatagcagtttcctttaaagtttactgatctttgttttaaaatcattttcattaatataattatattaataacaacaatataaaaggtaataataatattaaaaaacgaattttggctgggcgtggtggctcatgcctgtaatcctagcactttgggaggccaagataggcagattgcttgagcacaggagtttgagagtagcctgggcaacatgacgaaaccccctctctaccaaaaatagaaaaattagttgggcttgttggcacatacctgtggtcccagctactcgggaggctgaggtgggaggattgtttgagcctgggaggcagaggtagcagtgagctgagactgcaccctgctgcactccagcctgggtgacagagtgagaccacttcccccgccgcacacctccccccaaagaaaagaactttgttaaattgtaaagtgaaaattttactaaattttgagattttactgaaaaataattctcttatatgaattatagatctagatataagatatgatcattggtattataattaagcatatcgaaataagtcttttttactttgaaggaaattacttcatgtttgcatttgcagagcaaatattttctatacttttgtagggtaagttaactgttgactttcattaagattttttataatgtctattaagtgttaatttttaaatttattggttaatcttccttttatgactttttggttgctatcttagaataaaagatgctttagcatgaatattttcaacatttttccaaagccttgtttttatttcacttttgttctataactttttaagtatcttggctaagtaaatacattacaacaaaataagaaatccttaatcaaggaaatcagaaagagaaagtaaataagataatactagcaaagagattaaagcttaccagtgcatcctgtgaaatttttacttatcaaaggtaaagcacagatagcatttttgctagctgatggaacaggggatatatggagtccagactccaaaagattaaaatatattaagaaactatgcattatcaaagaaaggaaactgtgcattgtggtgaatcttaagtgaaaaggtgggtttaataaagcatgtgggtattcgttttcaaacaacagggtatttaacattttatttgaggctgggtgcagtggctcatgcctgtaattccagcactttgggaggccaaggtgggaggatcacttgaggccaggaatttgagaccagtctgggcaaaataaggaggccctgtttctaaaacaaacaaaaattagccgggtatggtggtgcatgcctgtggttccagctacttgggaggctgaggtggcaggattgcttgagcccagagcaagtctctgtctcaaaaaaaaaagaaagaaaaagaaacacacacacacacacacacactatccctaaatgtttgtggcttaatttacaattgggacttaatggcaaaaagttgttagaacaattatctggaacccccaagaatatattgagctctatatgagtctgattataatccaaggatagataaatttgaggctataggaatagctggaatacacacacaggaatgactttcaggatagtttcaaaaatgtctttctcttatctaaacattggataaatattgatatgttgaacattcaagattagtcttcctgacaaagtgcccagtgtacagattttctcagttgccagtcaaatgtgggattgtttatcactaatcatgcaagttgggtgtaggtttgatatgttcttctggaagtgccttacagaagaccatctcactattagaaaaattgaggctaagaaactaattctagtggggctacgctgtttttttttttttttttttttttttgacacaagtgaatatagttcttcgaaaaataagacttcaaagatgaagtaaaattttgttaaactgcttcattactaaatcttctatttttcttaatgctatatttgtatttggttaaagagtatagactctcggattgtttcattgggttttttaaaaacaacttacttttgccttttacagtcagttcttagtggcacttaaaggcttcctgaggctaaacatagaatactcatttctctagtagtaaaaaatgttattttttcttgcagtttcctattgtaattaaacatagcatgatgtaattcagtttagtagtttgtcatcctagttttgcctttattcatagtacgttttaaatatattttgttcttttaaaattttacctatttaatgtcttcttcctaaaaaatggaattacttttgagtctagtgcatctttaaaactcatccaaatgtttctctaaggtgattttcagataggaatatgcaatttacatcagtgtatgtacattatttgtgtaatgggagtcaattttcaaaaatagaatatttaatatgaaatataacatggtaactattacataaaacatattcggttagccagagtaatatgctttttctaaatgtaaagaatgttgtgcattatagcagtctttactgaataaatgagtttatatctaatgcttagcattaactcagtattttagagaacactgtaagaaatatgtctatactagttcgaaaggggagtagctatgtctctgaatcattaagcatgcactagtgaagtgggactaagctgttaaaacaccatgagagaagctcatatctttgattgtacttccaaatatttctacaaagcctaaaatggaatagaatatcttgaaggtataatataaataatagtctttgaaaatgactgcagtagttttctaagaaatgaagacttaggcattctaggtatgtttttgagtttgactttaatgaggtgctaatagtatagatttctgttagattgaaatttaatacaaatagaaaaatctgttctatgtgttgagtgccctgttgatggcaattaaaatccatactttgctcttcttatctcctattatcatttctgaaaatttgagatatattaacattgatttatcatggcctaatataacttttgtatatcttagcaatttatattgtgttgagttttatacacaatatagattttcatctgagagctatttgttgttttaaaaacatgatggctttatattaactaacttgtgacctaaaaccatggtcattgtcaaaagctagaattacaaaagtagtctgtactctggaaattgcaaactcttgagtacaatgtcagtgatatatagtgattggtataaacttattatttgtatagaatagtattttagagttcaggttttaaagctggactgcctaggttatctccttactgtctgtgtgattgagcacattacttttttctgtgtgtcaagttcttcatcaataaaataagttggcctcataagacgtctgtaaggattaaataagctaatgtatgtaaaatgtttagaacagaacctggtacatggtaaacgtttaaatatttgccattatttttattgttttaatcaaaacaaatttaaaagtgcatcttcccttcttgctgcctctgcaatactacctgttacttgctgcactaagtccaactttctgtgtgaatcatttcctatttgattccaatctctgttaattttctcttttaaaatgcatatatctttagcttttttgtgtaatttgtcataactgttaaacacctggagagcaagagcacagcaaagtcagtaacttttcattatagaggtttttgtaacaagtctcttaaaataaccttgacagtatatatactggtatatatagcatatagtggttaagaacataggttattggccaagtttgcccagaaccaaatccaagttccactacttatttgctgtgtggtcttgttaacttaacctacctaaccttcctcatctgtaaaatgtccacaggaataatgtttattttgtagattggttgtgctgaagatttatgtatactcaatatttaattgcatgggtaaacaaagtaaatataagtctgcctttatagaatttacaagctaatgggctaagatgaaaaaataatactactttatcaggttttgtggggattaaataaatgatgcatgtaaattcagcataaaactcaataaataaatgtttgctttaaaaaatggttataattattaattgaacctcagcagaatgtatggttaagtcatggattaaaaacataactctgtattatcaagtggaaaaaaagtgccctgaatgaagaagcctcactttgctgtgaaaatataaaaatttttgtccttctaataaaaaatatacattctaaaacaagaatgaaatgtaatttttttttttttttttgagatggagtctcactctgtctcccaggctggagtgcagtggtgggatctcagctcactgcaagctctgcctcctgggttcaggccattctcctgcctcagcctccctagtagctttgactacaggcgcctgccaccatgcccggctaattttttgtatttttagtagagacggggtttcaccgtgttagccaggatggtctcgatctcctgacctgatgatccacctgccttggcctcccaaagtgctgggattacaggtgtgagccaccgcacctggcccaaaatgtaattttttacctatcacattggaaataataacattgtcccttttggttagaatgtgagcaaataggtactctcctaaactgtttggtaggaacagaagttggtacaactctttcaatgggcattaaggtagtatatgtcctgagaaaatatgctccaattttgtgaaaggagagatgttgtttgtcttctacatagttgtattcttagtacatagcatggtgacttgtttatagtaggcactccagaaatattcagtgatggaatgtatatacaaacaaataagaatatgtaaaagtatgtgtataataattttattgaagcatcattacaatagtgagaaactggaaatattcaatgtctttttcactgtaaaagtcttttgtaaaatatagttgtatacatgtgtcttcctgtatgtgtttccaggaaagttgctaatagtattctaaaaatctctaatagtatcttttagaaattggtctagtctgttgagatacaagatttcctagagctttgaggttgaactcagacctagcatctacatttgttgtttgattttacattcacacatagttgtgtgatgttaatagacataccagtttggatttaattaaaaacagaaacacagcaaatattttaacagaatgaatttagttgaagaattgtctgttacgaaagaactgaagagatgaaaaagtcttgcagaggaagcaagcactgcaggaagcgtctaccatgcagcgaactggggtaatgaagaaatgagggtagattattaaaatttagaagattggaggaggccttatagggttcataagaagccagttgctgcccagctgtcattcttgccacaagatcttggaggaaggattcagaggctccagacaattgatatactgggttataaggcccaagtggcagagcagcttatactatagcatgaacttgctgcagagccatcttttgttctgatttcaacttaaaaatggtagcctaacaggttccttggtcaatgagttggagtactgcttcaaaatccacagtgattgttaatctttgtaacgtcctttttagtatccactgatagtgcaagtagagtaacttgtctctgacaccttggagaagctatcctgataggcttccaaccattggacccctagaaatcttacttaggcaatgggctcttaatttttgtgggttttatgtcttctgtcttacatgtgtcttagcaagatgtctaaagaactttatacttcctctttatcactcttaataagtacaaaatcatcagcattgttgatcagtgatttgttctgtgtagtgtcagagtgaccactgtctctgaaaaaaattagaaagacgataacaagtgagagacagaaattggagtccttacacatggatgttgagattgtaagttggtgcagccagtgtggcaaacagttacatagttcctcaaaatgtttaagatagacttaccatgtgactcagcaattccactctcaagtatatacccaagagaaatgaaaacatatgcccacacaaaacttgtacgtaaatcttcttatcagcattattcataatagccaaagggtggaaacaaccccaaatatttatcaactgacacatggataaatacgcaaacaaaataactcttccaccaggcacagtgcctcactcctgtagtcccagcactttgagatgtctgaggtgggcatagtgcttgagtccaggagtttgagaccagcctgggcaacctggtgaaaccccatttctaacaagaaatacaaaaaaaaaaaaaaaaaaaaaaaaaagctggccatgatggcacatgcctgtagtcccagctacttggaggctaaggtgggaggaacacctgagcctggggaggttggggctacagtgagctgtggtggggccactgcactccagcctgagtgacagagtgagacccttccttaaaaaaaaggaaaaagaaaatacctttcatttagacgactgtagtggatcctcttaagcaaagagactctggatattatgccagctggatttcaattcaagctctgccactctttactcaggttatctctctgttgcttgtgtttctgtaacttcattatgtggataatagtgcctaccttgtgtgggactttaatgacataatacatgtaagtcctttaaactactgcatgttacataataaatactaaatatatatttactattttttaaaaagaccactgtctctgtagattctactgtggcagagagcagaaaagcagtatgctgtggctgcaagatatactattggtcattctaggcaaaggcagatgtcttctgatagtaccacagattggtacagagagaaaagtatttgccaacttgtatataagattttagaggctacattgattggtttcgttaaagacagcacatctgaaatggcagctgcacttggtttaacatgattaaatttatgataatcaaaaatcattctaaatctctgatggtggtactaatttttgtatttcccttggagatatgttactgcttttggtttatttccctggtagggaaggctggttgaaggggcttttatttggcctttcctagcataatgacccttattccgtgggtcagacagccaatgtggaaattcgttttccaagtatttctcttccagttatacatccagtaactggaaaataaccgcaggttgtatttgtggacataccgtcacacttagatttaaacttgagccagtaatccatttatcacctgattaccctaagctctccatttaacttacggactgcagtggcattttgggttcctggcaattcgtgtctgtttaaagtaagtgtctggtaatcccctagtggtctgggtgttctttcttttggattataatttttttattagatttttcttttgaaagaaagaacatccgtaccactagggggttaccagacacttactttaaacagacacgaccactaggggattacccatcggggattaccagaacaatcactttagcaaatgctgctcatcctttgaaaaactgttggaagatttacagcaagggtcagcactttttttctatgaaaggccagatagtcaatattttagggtttgttgcctatgtatctcaactactcaagtctaccattgtggtgctaaatcaaagctagacaatatgtgtatgagtgagcatgactgtgtcacagtgaaactttatttacaaaaacaggtgtgaggccagatgtggcctgtagactatagtttgccaactgtggatttacagtactgtacatggttgtagtagtattgcaataccttctttaaggggatctggcctcccacttgtattgggaggcttaggtatttttgttgttgtttgtttgttttgagatagagacttactctgttgcccaggctggagtgcagtggtgcaatctcagctcactgtaccgtccacctcccgggttcaagcgattctcctgcttcagcctccagagtagctgggattacaggtgcctgccaccatgctgggctgattttttataattttaataggggtggggtttcacagtgttggccaggctggtcgcaaactcctgacctcaagtgatccacgtgcctcggcctcccaaagtgctgggattacaggtgtgagccaacatgcctggccagaaggttctggtttgttaaccaggtaaggtctgcacatttaaaactgagaaatgctagcttcctagcaagcagaatggaatatatagaattgactgcatggtctcctttacttcctatcggaaaagtctttttactctgctgactagagtgtatgtgtgtgtgtgtgtgtgtgtgtgtgtgtgtgtgtatttcttttgcttcaattcattaaaaaaaaaaatagaatgagctgggtttggaagctgaggcaggaggattgcttgagccctaggagtttgaatccagcctgtgcaatacagcaagatctcatctctgggaaaaaaaaaaaaaaatcgttttctcatgcttatttgaattagtgttactctttttgagaaggaaattgtggtggtaaaatatttttctgaatgttgaagaactgttcttatataaggaaggattaagtatgggggaaaaagtcttactactttgctgagcagcatttttctgttttctaccctctgcctctttcacaaaatgaaatgtttaattctttcatttatattttatttaaaaattattttaaagaaatagacataaaacactaatgtaatcactattattatagtatgcttaatgactaagctatttggtatgtagctggttgtatttttttatgtataatatagctatttttattatttagcaaatgacccatagtaactgctttcttatttgaaaatattctcatcacccaaacatattttaagacaaatgcttcgttggctttcagtctttgaatggttactactgttaacattcttgattatgttttacttccagtgtgcctaggagaggcaaggaggagctgtgactgaactcttttcagttcctttgcctggttatctcttgggtattagtaactcttgtttcctctgttatttcatccttcctgcattcagcagaaaatctttcccaggccgcttaccaaaaaccaacatcataatcaaagtgtctacaagtaactagtaggagaaaaggagcatgtggctttaaaacatctacttatgacctcactggagtcaaattacttatttttacttgttaatttactaaatagaagtatatatcacctttgttttataatttgattctttggaatttaattttcatattcattttaacactattctttacattagtacctttcgcttatgtgatttttctcaattaatatatattttcattaattgcaatttctctaagttaccttttatgttataaaaagcttgttacctggtggatattatatagattaaatattagttaaattcctactttgaatcacattgaagttggtgggggggaaaatgaagtaacttaggaacataggatttgaatgcagaccctcatgagagatgagatgggaagaactgcaaacaaatcttgaactccttttttattaggtttgttttttgctgtaattatggttgtgaaacgccaaactactttagaagtgttgtaggattgagcaaatgggtactgatgttgggagtcagggttctcagtgaggaaggagaaagatacaaatatgaaatggaggaaggcagtgaagaactctgtgagatggattagaatttttaaaatatttgaatatatatgttcacatgtatgtgcatgtatatgaatatatatacatgattgtgtttgtgtatgtaatatgtgatacacataaactcatttcctagctctgtccactgacaggacctataagcagaggcaccctggtaataataagcatatccagcacgaagattttggtgtctaacaccattcctcaccaaaaagaaccagagatcttcagagaaatgtcttattctagagccgggtagggaggatgcaggataggcatagaataccttcttatgccagaaagtaagaaagtacatccccaacccaacaaaaacaatgtatgtcgaaaggatgcaggagccaacttgaaggtgctcccactggccagatctgggatatagtgtggacaccagaaggacagtaatgaattatgaactttgctaaaaataggaatctatgagtccatactgccatactggtaataaatgagcagaagagatggtttagcttttagcagaatgctgattggtaaatgttctgagtcctggatttggaaaattattttgccaccaccatagtaaagatcagctctagtgagaataatcaatggagttaatgggtgaagcacaccaacatggcacatgtatacatatgtaacaaacctgcacattgtgcacatgtaccccagaacttaaagtataataaaaaaataaataaataaaatacagcaaaaataaataaaaaagaataatcaatggatgctaagtctgggagggaaatttttataagatattttcatggttgtaaatgtctttctgtggattgcttataacttgcaagggcaaaataatagactagagagttgagaaattggacaaccccttactagcttatcagagttaacatcagcagtgaggataaaatgaacattatgtactagttcagtactatacctagcattctgactatgggtatctagctctaatctgataatgaggaagcattaaacaaatcccaaatgtggaacattctgtgttttttaaagggtctctgtattattcaaatatgtcagtttcatcaaacaaaatctgaggaatttttacttaaaatatacataatttcagatggtcaaaaactacctggagcaatagacacctttcgacgaaagtataatagctctgaggcttgccttgtgtacttgactatccccttcttggttgagcgttagttcatttattcctttctgtgtaccgggcactggagtgtattcagtgattattttctaaattgaatttctgaattacaattatcacagcagttataaaattaattttggtaatttcttatcaaaaattgtaattattaaggaacaattcacaaacacttttgccaaacgttaatcacttaagggctttttgtttttctctctcttacgaggagggagcattgaccttttaaaatgaagcaatatagagacaaagactatcaaataagtaaaaacaatctgagataactgaatttgaagcacagaagaaaaaacagatatgaaatcatttaaaaatagttttgaaatcttttaaatcacttaaataaccatgtgtctgatgtatggtatactgaaacttaagataatgcttatatgacagatgaagattgcctaagactgttacttaaacatgtaacaataggagtaaaagttgctttttggaatctgaggttggaaaatttcaaagagtttagaattaactttcaaaaaatttagctacatggttggcctgtcaaaacttatagtgtgacttcaaatcttatagtgtgacttcaaaatatgtctttgtcttttcaaccaaatgtattttgttatgttttgttatttgttcctactttcattgaatttaatcagaaaatttagtctgtaaaatcttttgaaaacattttgttaatcttgtctataacatcatatgttgtcttttctggatatttcttagacataacaacagtgaaattatttttactatttaaagaatacaacattttctctttgattatgcaattaagtattaaagtttatattagtaaattcctttactctctttactagctctaccccatataagagatacttgaagccttacattataattaagtttgctttgcatatttaatacctttgtatttagatactaggtttgatttctccagatatacaattgatatttctgtcacccaaatcatgctttttgttattaaatcatgtacttctttttattgcttttaatcctaaattcatcctagcttgatactaatactacctgtcctgcttgcttttccttgaatttgttgtggatcttttctcccattcatgtatctccatcctttttgtttcactgtggtaggtcattgccaaaactatcatgctgagatcctctggttttcggacatagcaaatacatgatcacatatcctcagggaccagtaactgatatacatttatagtgtatcagtgtgtggttacgtgtttgatgactagtccttttgtgaaattagttggtaatgtagcagtgtggcatagtggatgttagttgttaaaactgaaaagtggttcattaaagacaatttgtttttttgtgataaaattgtgtaatttttttagggttttagtctgaggatacaagagtcataaaaagctaataaccttcactctcccaacctgtccatccagcgttttccttgaccttcactctggacagtttccccgacgttgctagcacttagctccaagtgaacaaactagagtaaaccccaaagccatgttttttgagttttcctgatttgatgctgtcttgttaaaacctggaggttatctattaagaatgtaattataaagcataatttgtatgtagtcaatatagtcattattttcaagcatcaaactcaatccttcattggaaaaattcctttactttctaagtgtgtacttgaaaatatagttggttttatttaactcagtctgtagcctcttatttttaacacaagaatttagtccattcaacatttgtatgctaaagtatgtcgctttattccttctactttgtttattaattttacctcttttttgtttgcttgagatggagtctcactctgtcacccaggctggcatgcagtggcatgatcttggctcactgcaacctccgccgccctggttcaagtgattctcctgcctcagtctcccgagtagctgggattacaggcgcgcaccgtcacgcctggctgatttttgtatttttagtagagatggggtttcaccgtgttggccaggctggtcttgaactcctgatcttgtgttccccctgcctcggcctcctaaagtgctgggattacagacatgagccaccaagcccggcctaattttacctctttaactttcctttttaaaaaattgtttctgtgtgataattggtattagttgcattttcctctttgttaacctgaactgtctattaacttttcattatattattggttacctttcctttccttatattcataatcagatatatttctctgttattacttgaaaataaagtaccaactctcccccaccaagatgttctttttttttttttttttttttttttgagacggagtctcactctgttggccaggctggagtgcagtggtgtaatcttggctcactgcaccctctgcctcccaggttcaagcagttctctgcctcagcctcctaagtagctgagattacaggtgcccgccaccatgcctggctaatttttgcatttttagtagagatggggtttcaccatcttgttcaggctcgtcttgagctcctgacctcgtgatgcacctgccttggcctcccaaagtcctgggattacaggtgtgatccactatgcccagcctcaagatgttcttttcatcctcccctcatcatatagaaattttagaatagtttctaataccttacctttcttcttactttagaagtctttggcatgcttttattctcaccacccattcccccctagcttttattggaaaattttactggaacattttccccaacccaatccctacaggtattactgaaaaaacttagtagtttttttttgtcgttgttgtttgtttgttttatgaatttctcttacagacatgaatgtcacttttatttcaagaatttttttgtttggatcttgttttgtttggatctaaattgtttggatctaaatttaaattgggttcaatttaaatttaatggcatttatatactgcaagatttgtcacctaccactttttccttttcttcattttctctttcttgttcacattcatttgttctttggagtaattttctcagatgggaatatatagatttttaatctgaattttttgcctaactgctaacgtcttcctttttccagacaggcaaatcatgtcttacctggatatagaattcttggggtgcagttcttttctccttctaattgccttttggctcctttacaggtttctgccaagaccagctcggtcatggagaccccaacccagtggcgctagagaaattaaagacacacacagaaatatagagtgtggagtggggaaatcaggggtctcataactttcagagctgagagcctcgaacagagatttacccatatatttattgacagcaagccagtgatgagcattgtttctatagattatagattaactaaaagtattccttatgggaaacaaaggaatgggccaaaataaagggatgggtctggctagttatctgcagcaggaacatgtccttaaggcacagatcactcatgatattgtttgtggtttaagaacgcctttaagtggttttcctccctgggtaggccaggtgttccttgacctcattccagtaaacccacagccttcagcgggggcatcatggccatcacgaacatgtcacagtgctgcagacattttgtttatggccagtttaggggccagtttatggccagatttgggtgcctgttcccaacaagttactttattcccattttccttattggctcactggggctcaaatctggtttttggagtgctctaagtggtggcagtctacacaagaaggaaatatatgtgttctttatcttggtggatcataactggagaaatgttccctacatcctctactctgtaaagtgtttcatcttaggcttcaaatatgttcagcccataggaaggtcaggcacatgacctggggccaatgttgacctgatctctagggtttttagatttcagtggcctgtactcttctcaggatttgctaattttccaatctttgtctttagggtcttctcaatcatttcccctgctaggaagccctcgaatttcatacctcactttactcagtagacacttggattcacaggctgatattttggagttgggtatgaggagaagtcagacatgtttagatttatcatcttcctaggatccttaatagtttatttttaatttccaagtagtctttgtcttctcttttttgactttattgtttcttttcttattttataaattatgacaagaatgttctgaacaattcccttctagggaggagatgggcagaataaagattttctttatggtctaatgccatatgttctattttaacttctatttgtaatcatccttacatttgtcaaggcctttttaacccgtactttctaaatatctgaatctagagtgaaaccctgtccctagtaagaagctcagagtattcagctactcctctgtttttgctgctctttgtcagtataatctatgattttagataaaatcatgtatattgtgtttttattttctttcaaaaagttttcttgcatttatattttaattatataattctatttttaacaattatttaaatcattactatttaaacggttgcattttgggtggattaatatttaacaattatttaaacttttctgtattttaattggaattggtattgacagtcatttcatacccagctttattcctttttcagaacttttctatcagttcaagtagttttatataattttttttttttttgagacaggggtctcactctgttgcctaggctagagtgcagtggtgtgaacacagctcactgcagcctcaacctcccaggctccagcagtcctcctgcctttgggctcctgagtagctgggactacaggcacatgccaccacacatggctaatttttaaatttttgtagagatagggtctcactgtgttgcctaggctgttctcaactcctaggctcaagcagtcctcctgcctcaacctcccaaagtgctaggtgtgagccactgtgcctggccttagattatgttggtaaggagtaagtttattattttttcataaccattatttcttcttatgtcttcctaaacaggaatgtttccattatggtgtaatttgcaaaaatatataattaccttaattttagggggaaataaaagataacattacagcagctttcactgatttgtttttttaaaagttaatttgaaatattaattctatttatatttatttttacaagaagctttttctccaaagagtatataaagacattttttgcttttagaatcttgataatatctgtaggatcatcagaaacgtttagattatgaaatctttttttattttttaaaatttttgtgggtacatagtaggtgtttatatttatgaggtacatgagatgttttgatacaggcatgcaatatgaaataagtacatcatggagaatggggtgtccatcccctcaagcattcctttggtttacagataatccagttacattctttaagttattttaaaatgtacaattaagtttagatggtgaaatcttgaaatgtggagaattcccacttctaaaaacatatttgtcttcctaagtttgtattgtatatatattcaaaaagagtatttttcatgacattgctttagtctactacaagaacaattgtttatagtaaaaatattactaagccttggtaaaatgaagcagttatattgtagtctggtggcttatatttgatataattgtaggtggaatttttaaaattagcaatttgttatagtttgctctattaagatttagcctaaagtatttatgaaattcctatatttttattgctagacactccaagttcaaatacttgtttatatcctcaggataaagaaggaaagatttgagctttttagccactgtacatttcttaattaaaaccagtgaggaataaattaaatagctctgattattaaaataattgtgaaataattagtaatagaattatatttctttaacttgcacagtctgttttgaaccaagtcatttaatttggtttaaagagttaattatgatgagaggatatttaatatcctctagcatatgacagcttcaaaatataaatatggtaatttattataaaatgaagaaagctagggcacatcattgttaatgcagtccttttatctctggaaaatggaactcatattaagctttgactctcaagggagagaatatggggggagggtatggaagaggttactctattctttgtgtacatcagaaaactatcttagcaaactagacttccaagtttggaatgatgggattataggaacaattatgacaaaagatttttgcagagctacatacatatagtggtggagctagtggttgattttgattttattatattggcacctattatctatgacctctgtttaaaaaaattaaccttaattgtaggaaatgctttttactgtataataacaatttaagctgtagattttttaaatgcccatataacataccagcattgcctaatataaacactacagatttaacagttgtatttatattaaattattaccatgtattctttcaatagaaacctcttaccaatgagagggtttcagtatttacagctcaaagatgctttatgttcatattgataaatggaagccactacaggtttcagaaacatgttttcagtcatcaaatgaagtccaggtaatgtggccttttgaacagtacactgtattttcatttaattgtttgaaattgatactctaaattactatagttaatatgttagtatcaagaatatttttactgaccactatgcagttacatgagttatttaaatattcatcaaatttacttctttttggtagtgttctaatatttataagtcaagctggaatatgtagtatttagatttaaaaattgcatgagcatttaagtgggttcattgtagaaggcatagaccatatcacatggtctcaagggagtgtagaataaattaactgtaaattacgtgaattcattactaaggaacaaagacctttattcatctttttcagaatctattttatggaaaagaaaaaaatggactggcttacttgtcttcaatttacttttaaactttcattgttctaagtagcagtgctagttataactgattcatcactattcagtaagcatttattgaaaaccatctatgtgcaaaccacattgttaggtgctgtgaataaaacgatggataagccctatcctggaggagtgaaaacctgactaggatggcagatataaataactattactgtgccaaatgctatactattagagtaagtaaggttagtgaaggagcctagacaattttatatattccacatataaaacagaaaaaatgtaaggtaaaatatgaaaacattgtcattgttagtaataggaccaagaaggttccagagaagatggttcacttgaataaaactttataaatatgtaggaatgacattcaagacagaaagcatagcctgaaagaaggcgtggaactcgggaatgtttatctaataactagagttaatggaagtaaataaatcaggccaggatcacactgtgatagatcaggaaagccagagtaaggaattaggacttaccctggagaggtagtgaacagtagtaaatggaattgatattatctgtattttagaaggaactggctaggagatagagactgtcaacatattccaaccagtttcataagccagaaacctgtggaccatctttgcctccctcacctgacgatccaatgaggtactgtcagttttgcttcctagatactgcttaaatctattgacttgcctctgttctgtagacatgatcgttattcaaacttgcattatattgcctggactaatgtggtagcctctaactggtcttaccatattacccttgctctcactagttactacattgtttgacattactagaacgctgctatctcccaccccaacccccttctttttcattaatatttagtatttgcctggtgtagtgggttgaattgtgtctctcagaaaggtatgttgaaatcctaacccctggtacctgtgaatgtgaccctatttggaaataggtttgttgcaggtgtaattaagatgtaagttaagatgagctcatactggagtaggatgggcctttaatccaatgactcatgtccttataaagaaggaagacacagagagattatacatgaggggagaatgtcttgtgactatggaggcagagactgaagtgctatagctgcacgtcaagaaacacaaaggattgccagtgaaccaccagtaattaggaagaggcaagaaagcattcttccctacaggtgttggagggaacatggtcctgtctacatcttgattatcagacatctggcctccagaactgtgacataataaatttttgttgttttaagccgtccactttgttgtggtttgctatgaaagttttggtaaactaatactcttggtatacattgttttattttttagctttcagtatttctctccttatatttagatctcttgtgaacagcatttatctggatttattttttattgttgttactcattgacagtcttcataaatggagcatttcatccatttacacttaattaatcataagtaatgaatttttgccatcttattttgtgttatttgtcctactttttctatacttttccctctttcttgccttttattttgatttttttccttatttttttttccctgctcaatttaaagtcatactttgaaatgttggagttttcttggtgattaccctagaaattttagcacgcacatctaactctttaaatctaaagttaacatttatacttttccaagaaatgtaatcctttccaagttacgtttgtatttcttctattatagcccacaataccttattatttttgttacatacagtcaatatttgattgcttttcctacatatttacaacttcttttgctgtgtgttccttctattacttcagattttctgccagtagttacattctttaacatttcttttggctctgctggtagcaagttcagttgttttagtgacagtctttattctatcctatttattggatattgaattctaagtaaacagttattttttcttcagcatatagacagttttattccagtatcttctgactttccttgttgctgtcgacaaatcagctgttcgtatagttgtcttcttaccccaaaagaaaggtaacctttcttttctttgttcttgtttttaagattcaatctttgtatttgatgtactgtagatttactatgatgagcctcggtatggattttttttttccccaactggaacttattaggcttgtggaaagtgcattacattgtttttcatcatttctgagcttttcctgctattatttcttcaaatattacttttccccattttttttcttctttgcttccggcatttcacttgattaattggttaaacaaataaatattttctgtatttgcagttactattttaggagcttgtgatatattcatgcaaaatcagatccctgattcatggaacttacattttatttaagagagacagacaataaacataacaaataagtaaattagataatatgttgaaagctaaatcagtatttgtaaaaaaattaagtataataaggggttgagtgttccagtttgaaggggaggagtgacaaattaaaatattttaagtcccattgataaagtaagatttgagcaaatagttgaagaaagtgagggagttagccaagcagatagtagatatgagggagaagcaccagatggaagaaatagctggagcaaaagatcctgtataggccttggagcctgtgtggcaagagatgactaagtgaaggagggagagagaagtagaagagatcgggccctgtattatctcatcttatggctactgttagggcttcagctcatactctgagggaagtaggaggcattgctgggtttcaggatgataactgacattcgatttgactttttttttcttttaatttccctttgagaatccctcttggataggaaagggtcaggaaagagttcattgtaggaatccaggcaagagttcttgtgactaggatggtaacattagtaatggtgagaaacagtcagattctggatcaaaagatccagaaggtgtagtgtagtgattttctttactgtgttagtttagttaaactaaaattgcgttttccagaattctcttccttgtgtggtactagatgatagctagccttgagaaatgtgtgatacttggaaggcaaaaataaaacagcagtcattacattcagatatatacataatcattgctctgttggcttacctgttagcttctgtgagtcatgggccaaatgaatgtatagctccataggaaagggaaacagattcttctgcaggtcatctacagcatcaggtttagataagattgaaaacagacttgggttccagtttgtctccatcagttccagtttgttctcaggcattgcagtttgtcctattttatgtccaggctttcttcccaactgtctgccctgctgtcatagactttaggctcaccatcaaacacggggatacaggcttttatagacttcttcacaagctcccattaatggtctctggttagaagtatttttctgatcctccaactatctccttcaggatctttactccctcgcttctaccacagtagtataaggcctaactcttataataaactcctgattctatatcactggatggttctgcttcctagattaaagcgtaagtggtatattgagctgacagatttgagaaagaggagccatgattaattccatagggaagaatgtgggatgagtggtttgggaaaaaggttgaggtttataattgttcacagccatttgagatttatatgatgtatgtatgtgcaggacggactgataattaaatgggaatgtgatagatatcaccattcctgcttctttcaaattttgatgcccaccccctgccccaacacaatattgcttttggattactattttgccaggcaaaggaagttcctagagcttttctttatctctttctactataatgacccttaacccatgtgtaagagagtgcctatggggattctgccggttattaagtatgtctattccaattatacattcaggaataggagaaagtaccacagggtgagtctgtggactgactgggtctgctatgggtcaaacttgtgttaagacttcacccatcacctgatttctttaagtcttcactttgatgtgttgtgtcatagtagcgtgttgtgccccaagagttggcatcacttccctggaatcagtatagagtatttctgaaaggtctggatattaatttttctccatgacataatcattctagtacaggggtgcccaacccccaggccagaccagtataggtctgtggcctgttagaaccaagctgcaacagcaggaggtaagtggcggaggagcaagcattaacacctgagctctacctcctgtcagatcagtggcggtattagattctcataggagcacaaaccccatcgtgaactgctcatgcaagggatctaagttgcgtgctccttatgagaatctaactaatgcctgatgatttgacatgaaattttccccaaagcattcccccacccacatttgtggaaaaatcatcttacataaaactggttcctggtgccaaaaaggttgaggaccgctgctctagtagatagcaataggcccttctggggatgatttggtacataatttaaagcatatacttgtggcaaaactacagggtctttctgcaaggggacctggcctccccttgcatcaggggcctttgggtgttgggactgacttatatctgaaaactgggtaagaggggagtggcaggccacagctggaccacagggagcagccagttggttgtgaagaaacttgctggaaaatgttggaaaatcagagttggtctgctagaagccactctttggtggtggggaaatttgccatagaataccggcaggctagagctggtctgctagagccttgcaggtgagtgccaccaggcttcccacacaatatttagctgacaactgcatcatagaaaaacatccaaaccagaacccaggctatgcccttgtagtgtcccttcactgctctgtactcacaaagcctgacatttgtacctgctggcaaaggagcagggttacagggtcctgatcttgtatcacaaagcagggcaagagggtagctttggaaataagaggcagtaaattgataacttccacaattaaaattgataactggtacagttatatttgaagtatataagggggccaagttattattttgaaagccagggcaagaatctagcctttttttcttctgctttttttttttaatacgacacatacttcagatagccaaatggtaagtttctttttatgaaagttttccagccatgtaatgaagaaggaataatagactatcaccattttgtaacttctaatgtatttagaccggcactcttctatagaaatatgtgagtcacacatgtaattaaatttttctagtaaccataataaaaagtagaaacaggtgaaattaattccaataacatattttatttaactcaatatatctaaaatgttgtcatttcaacatcagtgtaatatgtatcaccccatgtgtcttttccctttgctgattttctgtgcatccttttgttgtaataacttgtaactgtgagtgcaacatctgagtcctttgagttcttctagggaatcctcgaacttgattcccaatacctcgatttggctttgtctggtactttctcataattagattgaggttacgcactttttgcaagaataccacagaaatgatgtgctgttttcagtgtgtcatatcagagtagatgatatagatatgtctcattactggtaatgttaaccttcatcactgttaaaggtggtatatgcggagtttctcttctttaaagttgctgctttcctttttctagttaataggttcttggagagtgtatgcaaatattctgtttctcctcaaactttctcctactagttgtagcttctattagcagatcctgcgtgcaaaaattatcactgcagtgttccttatggtaattttttatttccaggaaaaatactttgttttaacctctaaactgattagaactatatatacttagaaacaataagttggttttatttgtaaccaaaaatattcataatttgatgaatttccttagcttgttatttatattaagcatcatatttgtaatgtttcgttaacttcccaaatacttgaaatttatctcattttaattgtcatgatagcagatgattataatcctgagattttaagctactttctcctaaattactcatcttgtttagtatatgttataataacaatgcattgaaattctttgtcttattaagaatcaacctcatatcatagcataaaaaactattcatatgtaatagcagaaatcaggttttctagaggaaaagagctaatgtaatgattagttttctcttcttctattgtcttctgtatttataaagagtagtaagaacaggccgggcacggtggctcatgcctgttataccagcactttgagaggttgaggtgcatagatcacaaggtcaggagatcgagaatatcttggccaacatggtgaaacctcatctctactaaaaatacaaaaattagccgggcgtgctggtgcgcgcctgtagtcttagctactctggaggctgaggtgggagaatcgcttaaacccgggaggtggaggttgcagtgagccaagatcaagccactgcactccagcctggatgacaagagcaaaactctgtctcaaaaaaataaataaataaataaaagaaaaataaaaaggagtaataagaacaatcctattcttaccaactattttagaatgattactagttgttgacaaagctgttttatttccttatgttaaatcatatagtcaggagatgatgaactcatgaaagcttgtttgataatgaaatttattgtatagtgacaaatgcaaatataaattcaacataaaatgtagcttaaatatggtatttttatttctttgggggaaaaaaggtgaagagtaccaacaaaatgtttttaggctttatactaagccatttttatttatcatttcaattcatcatactaaacctataaagtagatgttgttgctatcttcattaaaaataagtaaactattggcatggctgctgtggaaaacagtatggtcattcctcaaaaaattaaaaatagaattatcatatgatccagcaattctgcttctgaaaatgaggtttcaaagagatttataccctcatgtttatagcagcattattcacaatagctaaaatgtggaagggatatagtgtctgtagatgaatggttaagcaaaatgtggtatatacatacaatagaatattattcaaccttaaaaagataggaaattctgacatatgctacattgtgaatgaaccttcaggacattatgcaaaatgaaataagccagatacaaaaagacaagtactgtgtgattccatttatatgagatgcctagagacaggaagtagaatggtggtcaccaggggctggagggagtggggaatgggaagtcatttttcataggtgtagagtttcagttctacaaaacaaaacaaaacaaaacttatggagatgaatggtggtgatggttgtatgacattatgaatgtatttaataccaccgaactgttcacttaaaagtggttaagatgctacattttgttctgtatattttaccgtaataaaaaaaattggagaaaaaaacaagtaaacttctttaaagtggttcaggaacttgtctaaaatcacataagtcttaagtataggaattagtattcaaacaaatccttgttatactccaaaacttactccttttctatcatagtcatggttttcaaactgctccatgaacaatacagtgttttatttgagtgaagagtcttcactgcccttttgtgcatttttaatacaaaaattaatgtttacttcttatgttattatttcagatctagctttgggaaatatagcgtatcttcacatttggaaattgtaggactagccctgtaatgcctatttcttctgagacattgcttctgtaatccgtatctttttctccagatgaaaggtgacgtcttaaactgtgacttagcaagccacctatgcatttgccttgcatgtaaatataaataataggggtaacattctatttttcttccgaactataattctagaaaacttctctctaattgctactcataagcaccctttgaaaagtttttaaaatcacctttacactttaagtgaatgctgccaaacttcaacagttagctattgtaatgtaatctaatattggaattcatttagtgcttactggtaaattttctctcctacctgggactaactcttccaagccttgtcaatagatctgggtcacttagccacagcactctttgtcacaatcagagcatgccgtgacttctaacaagcctttctttcccccaacgtagtctcgcaacttttcctttgagattacaaaaggaaagatgaaagaagaacagattattgatggcaatgatttaaaaagctatcatgatatgttaacttgtcatgtaactgtatgtgtaaacttcaaataatttttgaaacagatatgatatgagctagttgttttaggtcttttaaaaacattcttaaaagaaatgcctttccattgcatattttaaatatatttgaacagaactgattagcttttaaacaaaaagtcatttcctctcagttgtctgtgatttctctctttgggctattgaccttccctcctttttggaaggtaaatgctcaactttctacctttatccgatacatgttaaagtattgtttgttttggctttgctgtgtatatgtcctatttgtctgaatcagcatttttgctttacaccatatgcccatagaattcaggacctcttgtttttacagtgcagtgtcatcatgctgtaaaagaaaatgcatttaataaatgttttttaacatcagttaatgaagtatgtatgtttcagctttcttcttgtaatgttttagatttaggttatttttatgatctagatccttatgaaaagaacacacgatcctactaatagcaacggaaagatcaggtcgtcctaccagtcgataattatttggggttatttgcaattataaagctagtatatatttatgaggagatggagaaagaaaacaaaagttcagagccatgaaaaggaaaagtctgccccctacccattacccacatataaccactattaataattttttgtatctaattactcattaaatctcttgaaaatgtgctttcgaagacttcattgctggatgttggattgtgatgtcacatcatctttcagctttgtaatatggagcagtttttcatttcatttattttaaatttaaaaatttttgaaaataattttaacttttattttacattcaggaggtaattgtgcaggtttgtaacatggggtatattgtgtgatgctgaggtttggggtataattgatcttgtcacccaggtactgagcatagtactcaacagttttgcatccctttcccctctttctcccttcccttgagtcccccattgtctatggttaccatctttatgtccatgagtacccagtgtttagctcccacttataagtgagaacacgtggtattcggttttctgttctcacatttagaataatggccttcagcaatatccatgtcgctgcaaaggacatgatttccttcttttttatggctgcgtagtattccatggtgtatgtgtaccacattttctttatcgaatccactgttgatgggcacctatgtcgattccatgtcattgttattgtgaatagtgccacgatgaacaagtgagtgcatgtgtctttttggtaaaacaatgtcttttctttagatatatacccagtaaggggattgctgggtcaaatgatgattctgttttaagttctttcagaaatctccaaactattttccatgatggtcaaactaatttacgttctcatcaacagtgtacaagtgttccattttctctgcagcctaaccagcatctcataccagtcagaatggctattactaaaaagtcatttcatttcttttttttaaaaattttactttaagttccggaatgcgtgtgcagaacgtgcaggtttgttacataggtatatgtgtgccatggtagtttgcagcacctattgacccatccttgcctacgttccctcccctcgtcctccacccctcaacaggccttggtgtgtgttgttcccctccttgtgtccatgtgttctcattgttcaccttccacttatgagtgagaacatgcagtgtttggttttctgttcctgtgttagtttgctgagggtgatggcttccagcttcatccatgtccctgcaaaggacatgatctcattcatttttatggctgcatcttattcttattcttttcttttttctctttctttcctttcttgtttttttgtttttttgagacagggtgtctgttacccaggctggagtgcagtgatttgatcacagctcactgcagccttgacctcccagactcaagtgatcctctttacctcagcctctcgagtagctgggaccacaggtgtgtgctactatgcttggctaattttttaattttttgtagagacgaggtcttactatgttgtccatgctggtctcaaattctgggctcaagcgattctcctgcctcggcccccccaaagtgctaggattaaaggcatgagccaccatgcctgatcccgttttcattttttgatcgcttttaattctgctgttccctttctgagcaggtgtaaactctagagtagccctcttgctttctcctgagtattctttcctacttgtttcacagaattcctttactttcttctcttagaattttctcttcctgcttctgaaaaaggaacattgtgattttaggaaaaatttgtttctctggaagaagagtaggatgatatctttggtgtcagcagaatggaagataactgataaatgaattttattgattcctctaagatggtattaattagtagacatattttatgtattactttaaaaaattaattctgctattccataaattatatctaaaggataaatcctcatgggagcttcatatagtagttcaaattttctatttgcttggtataataaaattaaacaatgttagtttagataaatggagcatgtgttaacatatatatatatatatatatatatatatatatatatatatatatatatatataatttttttcacaccagttacacgggagaaatatatcctaattccaaagtgtgaaatttgaactgacagaattataaacatttttaacattttaaagtattttcaatctgttctgtatgtgatgagatattttttgagcctgtctttgtcacatgttagaaaatagttcctaaaagcaaaagctctctaattactttcttgttttcatacataaacataagtttacttaaaatttttctgctctattattccagtgatgtttttctgtgtttctgtatttatttaatgatgcttttgaatttctttagtgttacaggaaagctgttttctcttagttttgccttctccctttgttcttcatttcccttgcttgcctcaaaaaaacacttaccagctggaagtgtttaaactgtgaattgctgggtattggcccaacatgaagaatcctctaatttaataagcttcttagaagagttcttggttccataaatttgcttcaccttttgtcttaccagcttgttaataataagaatagtatcatttgtgtgtttaatgcttctaatatgcttgatttcccttgtatgtagtttatatacattatctcatttaatcaagctttttaatgatttctgttggctacagtgaaaatttgagaaagtttttttatcttctttatataattgcatcacatacattaataacataaagtataaattggtgtcagttttctaaagtaaggaataattttaagatataattattttacattaagaattttaatttagtaattatttatacatcattcattttaaaatttcttttatgtgaatgcattatttcttcctgttttggaaggggggtgtgtgtgtgtgtgtgtgtgtgtgtgtattttatttatagactttagtttccagaacagttttaaatttacagaaaaattgagtagatattaatagaacagaaagttcccatatacacctcttgggccccccacaaacagtgtaccctattattaacatggcacatttattacaattaatgaaccaatattggtatgttattatttatttattaatgttttgagacggggtctcactctgtcacccaggctggagtacagtggtgccatcttggctcactgcaacctctgcctgccaggttcaagagattctcttgcctcagccttctgagtagctaggacttacaggcatgtgccaccatgcccagctaatttttgtattatttggtagagacagggtttcacatgtttgccagacttggtgtgttatttttaactaaggtctgtagcttattcagatttccttagtttttacttgatgtcctttttcttttccaggatcccatctagaatactgcattacatttagttgtcatatctccttagggtactcttggctgtgacattttctcatactttccgcgtttttaatgacattgccagttgtgagaagcactgctcaaatgtattataggatgctcctcatttagaatttgtctcttgtttttctcataatcagacttggggtatgggtttagggaaagaagatcacagatgaagtgcgatttctatcacactgtatcaagagtacatactatgaacatgattttatgatttttgatgttgaccttgaccacctggctaaagtagggtttgtgagttttctccattttaaagataacccatttcttcctccttttcatactgtactctttggaaggaaatcactatgtgaagcctacacttaaacactgaaaagttacactctccccttcttagggtactgtacaattctttttatacattgttggatttaacattggtaataatttgttgaggatatttgcattcatgtttgtcttagtctccttgagctaccataacaaaataccatagactgggtgccttaaacaacagaaatctattttcttatagttctagagactgaaatttcaagattacagcagggttggtgtttggcaagggttctgccccttgagtcgcggatgctctcttcttactgtgtattcacatggcacaaggggaggaggaaaacactctctgctgtcttttcttataagacttctaatcctattgtatcaggaccccacccttgtgacctcatttactcttaattacttcgtaagaggccgtattttcaaatatagctaagggcgttagggcttcaacatatgaatttggggaggggggacagacattcagccctgcctcccttcccccaatttatatcgttctcacatgaaaaatacattcattttatcccaagtcttaattcattccagcatcaaccctaaagttcaaagtctcatctaaatatcatctaaagtggaaaggggtaagactcgaggtatgattcgtcctgagacaaaattctctctagctgtgaatctgtgaaactagcaagtactactaaaatatggtggtgggacaggcataggataaacattcccattctaagaaggagaaatcagtctatggccataccaccctgaagtgcctaatctcgtctaagaaggagaaatcagaaggaagaaaggggtgttatgtcccaaacaagtccaaaacctatcgaggaaattccattagatcttgaggtttgaaaataatctctttgatttcatgctgtgcctttcagaacaactggctttgccttctggatccactgggatggcagccccacctccatagactcctgcctccaaggctcctgggtagcaataacctagcttgttgaaaccatgaaggaaatcatccttgccctttaagactgtggtgagaatggcagctctctgatgatctctaaatcacatttggtgttgttactttttcttgaaggataatgcatgttcaccacctgatggttgtatgtttccatcttgtagaatccatgaagtctgccttccttcattcagtcctttacagttcacactggcagtgtatctgctcagataatttcgtagtctctttactgagtggtagtacaggcacaaccttggtgttctcctcagaaagccctcatcttttgaaatatgaacagacagaatttgccacatctttaagttctggttcttttttgcctaacagtagctttatttctctttctcttgcattttactataagccataaggagtaaccaagcttctcttttaatactttgtttaggtatctcctcctaaatgatggagacacctaaacaaagtattagagaagttagttatcattctcctgagtgaatatccaatttcattgactgcgagttctacattgcacacattcagtttatgacaatgttcttgagagacactcatctgtagttttgctttatcatgtttatctgattttggtattaaggtaatgttctcatagaatgagttaggaagtatcctctctgcttctattttctgaaacagattatagaaaattgatgtcatttcttaaatgtttgtataatacacccagtgaaaatatctgggcctagtgctttatttttggaaaggttaattataggttcaatttttaaaataaatattggccttgttagattatctgtttctccttctatgacttttggtagcttgtgcctttcaaagaattgatccactttatctaaattatcaaattagtgagcatagagtgttcttagtgttcttttattatccttttaatatccatgtgattaatagtgatgtcccttctttcacttatggtattggtaaatgtatgccttctgtttttttcttcttgattagtctggctagagatttatcaatttataaaaatcttttcaaataaccaaggctttggttttattgatattctctgttgttcctgttttcaagttcattgatttctgccctaatttttattatttctttttttctgagtgctttaaggttaaattgctcgttctctagaattttcaaaaatagaagcttgtttctggttttagatcttttcaaataaatgccttcaatgctgtaaatttccctgaaatcactgctttgactgcatcccacaaattttggcaagtttgtattttcattttaatttagttcaaaatattttaacatttctcttgactgctttttctttttctttctttctttttttttttttttaacactcgtgttattctgaagtaagttgtttaatctccaaatattctgggattttccagcgtctttctgttactgacttctagttgaattccattatcatctgaaaaaaaccttaaatttgttatggtgtattttgtggcccagaatgtgtctgtcttttagaatgttccatgagagtttgagaaaaatatttattctgctattgttggatgaattattctataaatgtcagctgaattcagtcgattagtgttgctcatcaactcaacaacatttttactgctttcctgcctgttagatctatcagttactaaaaaggggatgttgagatttctagctacataacagtggatttgcttctcttttaattccattagtttttgcctcatatattttgatgttctatttttaggcacatgcatattaaggattgttatgtcttcttggagaattgacccgtttatcattaagtaatactccactttatccctggttatttcctattctgaagtctatttcatttgaaattaataaatacagatgctcctcagcttatggtggggttacttcccaatatacttattgtaagttgaaaatactgttaagtcaaaaatgcatttaatacacctaacctgtgtaaccaccacagcttagcctagcctgccttaaatgtgttcagagcacttgcattagcttatggtcaaaatcatctaacacaaaagcctgttttataatgtgtcgactatttcatgtagcttattgaatactgtagtgaaagtgaaacacagaatggttgtataggtactcaaagtatactttctgctgaatgcatgttgcttgtacgtcaccatagtgttgaaaaattgtcatttcaactgtcgttaagtcaggaaccatctgtactccaaccttcttttggttagttttaacttggtacgtatttctccatctcttttcacttacctgcatctttatgtctaaaatgggtttcttatagaaaatattagttgggtctttttaaaaaaaatcttctctgacagtctctgttttttaattaatatgtttaggtccttaacagttgaagtgaattttgatatcgttggattaatatcaaccatgtttatatctgttttttatttgttgtacttgttcttttcatttttaaaatcttctctttttctgacatctctggttgaaattgaacattttatattattccattttctctcttctcttaatatataaattatacttcagttttttttaagtggttgtcctagggtttgcaatatacatttacaagtaatctatatctgctttctaataacaatacagtgctttgtgggtagtgcttgtgccttgtaacagagtatctcagttcctccctttcatcccttataacattattgtcatttatttcactgaactatatgctgtaattgccccatacattatcactgttattactttgaatagacagttatttacttctgactaagaataagaaaagcaaaatattttatattaccgtcatttattccttctttaacattctgtttcattatgtagatttgagtttctgacctgtatcttttttttctctctgttaagaacttctttttaatacttttttcaggacaggtcttctggtaaggaattccttcagtttttgtctgagaaaatttttgtccttttgaaggttaattttgctggatacagaattcaaggttgttgggtttttttttttcctttcaacactttgaattttaagacactgtcttcttgtttgcatgatttctgagaagtctgatgcgattcttgttatgtactcttaccctctataggtgagaggagtttttcctctggtttcctttaaggttttctctttgtctttgattttttgtagtttaaatataatgtgcctgtgtgtagattttttcagtttttatcctgctcggtgattgttttttttcttttttagcttcctggatctgtagtttgatatttatcattaattttggaaaattcttggccattattacttatatttattctgcttcagtcgtttttcttctccttttggtattctagttacatttttaaaccttttaaaatcatcccacagttcttggaatatgctattcttttttttgctctttgcatttgggacatttcttttttcttttttttggagggggggtggggggtgaagacagagtctctctctgttgctcaagcttcagtggcacagattaggttcactgcagcctcaacctcctgggctcaaacaatccttccacctcagccttcttccaagtagctgggactacagggatgcaccacaacacctggctgatttttgtatttttcgtagagatggggttttgccatgttgcccaggctgatctcaaactcctgaggtcaagccatccccacccagcttggccttccaaagtgctgggattacaggtgtgaactgctgcaccctgccaagttctgttttcaacctactgatgagcctatcataggcattcttcatttctcttgcagtgaatttgacttactgtatttcctttcttcatttttttgttagtgtggtaaaatataaaaactgtaaaatttagtatcttaatcatttttaagtgtacaattcagtagtagtataaatacattcctaatattatgccaccatcacaaccatccatctctagaactttttttatcctgtgaaactgaaactctgtaacccattaaacattgacttcccattgcttcctcctccagcccctggctttctactttccatctatgattttgaattggcttatttcatttagcataatatcctcaaggttcattcatgatgtggtatatgtcagaatttccttcctttttaaggccaaataatattcaattatatctatataccacattttacttattcatttgtcaatgcacactcaggctgcttccacattttagctattgtgaataatgctattatgagcatgggtttacaaatatgtctttaacacacagtttttagttattttgggtaaatacccagaagtggaatctggatcataagccaattctatttttaattttttaaggaactgccatactgttttttgcagtggctgtaccattgtacattcccagcagcagtgcccatatccttgccaacatggttttctgttcttttgataatagccatcctaatgggtgtaaactgggatctcattgtagtttggatttgcatttccataatggtagtgattttgaacacttttcatgtgcttcttggcaatttgtatgtcttttttggagaaatgtttattcacatcctttgtccatttttggatcaggttttttgttattgctgttgagttttaaatgtctctatacagttgatccttgagcaacacaggtttgaactgtgtgagtctacttaacttggattttctcctgcctctgccacccctgagacagcaagaccaaccctcctcttcttccatctcctcagcctacttgacatgaagatgatgaggatgaagacctttatgatgactcacttccacttagtgaatagtaaatatatatatatgttctcttccttatgattttttaacattttctttcctttagcctactttattttaagaatatagtatataatacatatacaaaatatatgttaattgattatgttattggtaaggcttctggtcaacagcaggctattagtagttaagttttgggggaatcaaaagttacatgtggattttcagctgcatgggaggtcagtgcccctgacattgttcaaaggtcagctgtattcttgatgttaaacctttattggatatatgatttgcaattttttttccatctgtaggttgccttttgccctgtcgatggtatcttttggtgaatacatcttaaaatctttctgtgaagtccagtttgtttattttttattgttgtatattttcttttcattcattcttagagtttccatctctctgctgacattaacaatttgttcttgcatactatctatccattagagttcttgacatattaattgttgttactttaaaatcactatctcattccataatttatgttatatctgagtctggttcaggtgtttgctttgtctcttcagactgtggtttttcctgcctgttagcatacattgtgattattttgttgaatgctggacatagtgtataatattttggataataggaagtgaagtagattggcctttagtttgaggtttcttttagtctagctaagacctgtgggctgtgtttactgttttgctgcacatgtagatgccatcagctttttgttttttgttttgtccttgtttttatgtttttttgggggggcttttattctttcctttgttgtttttgggttctctaagaactttttcttaaatagagtctctgtgttgtagctctttcatttgtaatctattttaattcttctggagcccttttggtgtagtggtaaggtgtcagggaggggaggggaagtgttctacaatcctatgacaaaatatcagtcttttaggaggcttgcattcctgggctgtgaccttagtgtttcttaggttttttgtttgtttgttttggcctcttagatgagacagaagactagacagggctggaggtggttactttcccttccctcagatcagataagccattgttatattagtttcccttgagggcaggcctttgttatgttgaatgatctgggcacatttgtaaatacagtcatgctggtgggatgtccttaggagatttctccttgtgtgaacattatagagtgtcctagatgagggatccccaactcccaggccacagacccgtaccagtccatggcctgttaggaactgggctgcgcagcaggaggtgagcattaccgcctgagctccgcctgctgtcagatcagtggcagccttagattcttgttgtaagtaaagttttggtgccgcaagagaaataacacttgaatataaaattttctttttaattctgagcaaggcaaggtacttctatagaagggtgcgcccttacagatggagcaatggtgagcacacagttggacaagggatgggaagaggttcttatccctgactcatgtggcccctgctgctgtgtcattcacctattggctagggttagatggcacagactaaactaattccaattggctaatttaaagagagtgacagggtgagtggtttggcgggaaaaatggttattacagagcaggtaatgggaatgagtcagggtggagcaggtaatccaaaaaggttgctttttgaggaagttaagtttaaaagtagaaggcaaagaattttacatattgacatattgattatttgaaaagaaatttggaactcatatctaacaacccctcctcttgcatttcctaacaaactttttaacatgtcttggcttagttgttctgcttgattttccaaaagaagcttctctggataaggtggaggacagttaaggaaggttttagtaagtgccatttttatgagcctctgcaccaacccacagatgcatggtgtgacacagcacctgacaagaataaatacacccattacagctgcgagggaaggaagaattgaggatattattcttttccatttaccaaaccacttttctagccattctgtaaaggggtcatttacccctgagttgttggctaactcattggacagagcagtcagaccttgcaatgcctttgttatacttccatcaggggcggtgttgtttgggatgacggtataacattgagttttaatcatgacacaaactcctctttttgctaatatcatgtctaagcctatcacaattttcccaagccatctggctagtatcccctaattgctcagctattctttaacaacatctctagtgtagttaataaatcgctgttggttataatagatgtagtttatccaatctacatttttattaattgtcacccaccaagatattgactcaaatcctgcagctatttgatttcgggctttaaattgatctggtactccccttgggactctaattgtgtctaaatagatgtgagagtcaaaagacccataaggggcttcttttgctttatgatgtctttttttttttttttttctttttctggttgatgaaatgccagggtaaaagggatagccaattggactaaagcataagtgccactttagttacttgacagtgtccagtaaaggtccatcataataccactacacatctactcagggatgaataaggactgattggtaagcttttgaaaatttttaagctcactgcatcccttcaggtctccaaggaactctaagtttcctgcctgtcgtgagagacacaaagtgagcttagtgttgggagatggaagctggatggccctcagggctgacccgcagggtgtcggactttgacatatagcagagagcgagcttggcatgatgtgttactccaggcggtagaatcctggaaaagagctaccatgcagcccacgcccggtcgactggaggaccaccctagtggaaaggggacaatctgggcctctggcctgccatgcatacaagcataacaattgcttttgtttaacgtgcggagggaatatttgatctatttcaaccaggcatttgcatcttagtattgtctcaattgccaaagtttgttttaagtctttaacttctacaatagctattttggtcttgttgttagacagaggaggagaaattcttccgttgtaaaaggttttggaagaaggcttagaggaaggtacaggcagcgggggattaaagaaacacatttcaaagaatctaatagggtctgtccctgaaacctcagcccccatatcataaaactggcttaaagaagggaaccaacttagaaaaggggaagaactttgagggtttaagataataacctgtataggattacactggtttagcttacagttgggggatagctgtccctctagtaaaatgaatgtatggttttaggaaattacaaaaaccagttggagcagtctattcttgctctttagtggtccacagaactttggaccagctacagcataaaagctctacattggtgggacaagactcctggttgacactggggtctttatcaaaatctccccggattaaatggtcccaattctctaatgcccagtctgacgagagtcaggagggacagaggtacttttctgaagtagagagctgtctttgccttggcaagtccccacagggtataacaaggcaagcattaaatgcaaaagtttgaagcaaaattgacttggttatgttaataactagatggtcagcaatagagtgaggaaagaagaaagagtattagaatagaagaaagagagagagttaaatttttcttagctttagtttggtagggttttcccttgggactatggcccatgaccctggaggggacggtgctttcttgactcgggtgtgatgagtccatcccctttccactataggaacagcattatcggtggttagcagcacaaggtagggtccttcccgggctgactcgagttttccttctttccaccctttgatgagaacgtgatcctcaggctggtgctagtttaccggaaattctaggggtggtacctctgctaaaagatttttagttttgaggtaaaggccaagtggcagataaaccaagtatataatttctaagaaactgaccttttgttttaaatgtggggacatcagcagtggactttatagtccttggtgccttcttactgagaaatttcctttagcacctatttttattagtttttagaccaaaaaaagccaaacaccattttatatttgacaatgcttcctgtatgatttttataccagataagctaaatttcacctttatattagtgtgttattaatgttaaactcaattttaataaaaccttgtagacctatttatccaattttaatgtctgaccataaagtaagatttttatagactccttttaaccttttataatttttgttaaagagcaggttagtgctttaagaaaaacctgttgtgcttttattttaatgtccagttcacagaaaaactggatgatacacctttaactttagccaatatgtttacacacagaattaccttcacaattaacatttcaaaacttgcttaaacctttaaaagaaaaaattttttaaccttttaatgtatgtaaaaatccacattcttatgcctacttataatccttttaccaaagatgtattttactttccttatacaccttgcacattcactgtttcttcaatagttttacattcaggaggcctaattacttttaaattatgcaacattttttgcataaattccgttttataacttttttttcacgacttttacaattctttgacatgcctcaactttctgacttgttgcaaacatccctttctttaaacaaccagttattttaggacaaaaatttaccatataacattcctttttacataaattctccccccccacccctttttttccccagagatgataatcattcttttccaaagtgaacttccttcatgtctgtggactagaccgtctaaggccacaagattagaagttaggataatgcatgttacactgttaacttttagcaaactttacttttgttgaaaaccttgtaagtttgggatttcaattattctttgcttttaataagacctcattcagtccatattaacttagaattggtatagatgggtctttcctgattctgtagtactttaaggcttggctgagtgcaaatatgccacacatttgagcagactaattattaggcacttttcctaactctgcttctacaagagtttccttatcacttactgaatacccattgtgtctttttccttcagtcacccaggaggaaccatctatcctcctgtcctgaagggagttcctcctaggtttggtcggacctttgtatggtaattaagatttagatcccatgttaggaaacctgctgggttaagggaattttcagtggttaatgttaaatcatctttttctaatggaatagccttatactttaaagttcttaagtcagtaagctacctttttgcttttttttttttttttttttttttggacttaggatagttctgacctgatgtggtgtgctcacaatgaggtttcctctaaaagttgtttttctactttcttctgttaggagagcagttgccggtacagattgaatgcatttaggccatccgtgggttactgggttaaggatttttgataggaaggctatggattgtcagtggcctcagtgctttcgggctatgcccttatttacactgacaacaaggtggtattggagtgttacagggtcatagagaagaccttcaattatcaattataggttttaaatttaccctggcttttaaaggaataggatacactcttttctctttactacttctatctctctatctctctttgactctctgtctctctctctctctctgatttcctctttgtctttctctttatctctccgcctgtctctctctttctctctctctctccctctgactctctgtctctttctctctgtttctctctgatttcctctcccagtttctctttcctctttgctggtctttccctgcctgtgccagccgcttatgctgctgttctcccctctccttccccttcccctaggggagggactggctggagtggagctactctttcttcccctgagaagaaaggaaaggggggttctgaatatttttcttactaccggaggtttgtgtgaggttcaacccccactcatggggatttctcacctctttttgagattcaactccccctcatggggatttctcacctctttctgaggttcaacaccccgccccccatggggatttctcacctctttctgagtttcaaccccctcctgaatggagatctctcacctctttttaacctccaagacatcccaactgaggaatacttcaccaccccctgtggctttctttccctagtcctgactaaggaatgctttaccgcccctgcggtttctctctccttggtatgtcttaaccaaggaatgctttaccaccctgcagctttttcctcagtcccaaccaccaaggaaatacttcaccatctgcaacatccttccttggtctgtacacagaatcatcatggcagtatatgaggatcctttaagctaggtttctggccagtttctttccacgttgctgagggcttgggttattcctcacactgggtgggtcctgatttctcacccctgaggctgccacaagggggcgggccacgcctcctcacgagagacaaccagagaccgccccgggaagggaatgtaatccccggccagccccggaattgttataagtgaagttttggtgccacaaaagaaatagcacttgaatataaaattttctttttaattctcagcaaggcaaggtacttctatagaagggtgtgcccttacacatggagcaatggtgagcgcacacttgggcaagggaggggaaggggttcttatccgtgaccatgtggcccctgctgctgtgtccttcccctattggttagggttagatggcacaggctaaagtgattctgattggctaatttaaaaagagtgacaggatgagtggtttggcgggaaaaatggttatgacagagcaggtaatgggaatgagtcagggtggagcaggtaatcgaaaaaggttgctttacgaggaagttaagtttaaaagtagaagacgaggaattgaacatactgacatattgattctttgaaaagaaatttagaactcatgcctgacaattctcaaaagagcaggaactctattatgaactgcacgtgtgagggatctaggtcatgtgctccttatgatctgaggtggaagagtttcatccagaaaccatctcccccttcccctgtctgtggaaaaattttcttccatgaaactagtgcctggtgccaaaaaggttggggatcactgtcctagatggtataacctaccacacacctaggctatatggcatagcggattgctcctaggctacaaatgtgtacagcatattactatactaaatattgtaggcaattgtaacacaattgtatttacatattataacatatctaaacaagaaatcgtacagtaaaaataaggtacaaaagattttttaaaatggtacacctgtatcaggcacctaatagaacttgcaggactggaagttgctctgggtaagtcagtgagtggtgagtgagtgtgaaggcctatgacattactacatactcctgtagattttataaacacagcacacttcggctacactaaatttatttaaaagttttcttcaacaataaattaaccttagctcactataacttttttactttacaaacttttaggatttttttttaaaccttttgactcttttgtaaaaagagttaggttaaaacccaaacacggctgagcgcggtggctcacgcctgtaatcttatcactttgggaggctgaggcaggcggatcacctgaggccaggagcttgagaccagcctggccaacatggtgaaatcccgtctctactaaaaatacaaaaattagccgggcatggtggggcgtgcttgtaatcccagctactggggaggctgaggcaggagaatcgcttgaacctgggaggcggaggttgcaatgagcccacattgcaccactgcactccagtctgggtgacagagcgagactctgcctcaaaagacaaaaaacaaaacccaaacacattgtagaactgtataaaaatattttctttcttgatatccttattctataagatttttatattttcaaaatttttaatttttaatgctttttaatttttcaattttacttttttgttaaaaactaagatgttgcaggtagtgactatctggggctggtgacacaggtggtaaaggaatttatcaggacaactgtaggtaaagaaaggtagatttattagagaaagtatgaaaataatgttgcaaagtagcaacgggcagcacagcagagaaggggctgtctgcaaagaggcaggggctgtagagaagttttatagggttgtactgagggggctgcatgggtcattgagttatcaggttgtttgtgattagccatctgtcagaagaattgttcgttgttctttcctacctggggctccttcctcattgttgcttacttatcagaactccacataagacacaaacacacacattagcctaggctatatagggtcaggataatcagtttcactgtttgtcacctccacatcatgtttggtttggaggtcttcagggccagtaacacacgtggaactgaaatctataacaatgccatgttctggaatacctcctgaaggacctgtctgagttaatctctaagttaactttttgttgttgctgttaaataagtagaaggaatacattctaaaataacaatacaaatacactattgtaaatacaaaagctagtaacattttcattactatcaagtgttaggtactgtacataattatatatgctgtacttttgtacagctggcagcccagtaggtttgtttataccagcgttaccacaaacatgtgaataatgcattgcactatgatgttatgatgtcactagatgataggaatttttcagcttcattataatcttatgggaccacctttgataaccgtatatcgttgttccaaacattgttatgaggctcatgactatagttacttttcttctcccactttcttatatgtgaggggatttttcttggatctttcatgtgaaaaccttgtcaaaagcctggaaataaaacccgtcaaaatattaaggttgccctaagactaggtcaccagcaactttttactaccaagtaatccatactcacttccagtaatttgtcaaaattatcatgtaagtgttcttaccatttattatgactccagcagcttttgttcaagatacgctgatctgtgctgttcttggctatgattctttctcttctcctgtgtctttagattttagggtgacagtgtgccctgtgatctgaattctctgatgagtcttagaaaagtcatgtatttttggtttatctttttttcttgttttagagtgggaatgatgacttgcacactctgttacatgttgtagctgaaaaccaaagtctgtgttcttaaaatttgtatatatttgttctgtatttcctaatgatcacctctttaattgcttaatgaaaaaatacaagtgactagatggtagatctgagttttacaataacttgaatttactctaaacattttgctaatgacattggcctatttaaacgcagtcttagaattgttttttccttggtataatctagtatgatagatactaggtgatggaattcttgtgaatccattttaagtatataatttaataaatatttttgaggcatgtgtatgccaacctttgtgctaggtgcttaggatacaaggtggcttagacatagccaatgtcttagttgttcctaagtctaatagagagaaaacaagatttaaaaaggtagcattgtagaaatgataatgatagaaaactccactttagtgtggagaaggaagcattagagaatatttacatgagagctgaattttgaaggagaaataggaatttatcagacagacttggtaggaaggtatgtccaggcagactagaatatttaaaggcagtggagacttgaaacaacatggagtaatttgaagattgtaggtggcttgttatttttggaccttagactgtaaggaaggttgttataatgagatataaacagtaggtagaggccagatcattctgaagagtttagccattatcttttagatttgggggattcagtgaaagatttgagcaggtaaggaaagcaatcagatttgtgtacagtcaagttaaggacattgtagagtgtgggctgaaagcatgataaagcaaaggacagagaagggatgatgagaacttggaaaaaatgttactatatataaaaaaagaggatgaatttggaagaccaaaaacaaacaaaaaattagatttagtggttagttgtgggggcaaggaggaaccccagcttccttctttagagaggctgggatcatcaaccaaaatgtaataaatattataagagtagattactaatttgatttttgacaggaatgtatcagtacaattgcccaccaagtggtggaatgtattaatctggaatcgagagtgtagtttggatttaaggtagagatttggaagtgatcaattcatatgtgttaaaaccataccagtgaattaaattgcttaggataaatataaaaattaggtacctttctagataaaactctgggtaacacctatatttaaggggtgttaggagaagaacagccaataaaatgcctatattgaatggaaacttccaaagagggaaagaggttcagaagagaatgtgtcttgggaccacaagagaggaaagaagtagagaagtaattttttaaaataccatccaaagtttgaactaacataaaaaacatggtttgacgtcattatttgtgtgatgatttccttaacatttgcaattttttatccaacagtttttaccactccagaagcttttctcagctagaacgtgccttaacccttaatgaatgttaaatactcatcatatactcagatttacctttttttccttataaatagtacttttgtatttgcataagtggtagaccagattcctaatctgttcgatagtacttttctttaaaagtgatcagaaaaattctttttttgaaattataatttcattaatgacatagcaaataccatattcacaacctgggcaattaacatctctggagctttagggatcaaatttaatgaaacagtaataagtactaggtaattaaggatgattgggagggtaagttttttgtcgttctttctaattaagtccagggtttggatgagaacactagactcaggagaatgttcccagagaggtggtataacttgtatgaaaaattagagtctgatgtgtgtattgtggtgtgtgtttaggtgagggtaaagggattgtggctagaaaataataaaaggctgaagactatagaaatttgttatcattgtaaagtttaggtagggcagaaaaaatatgtgaaggtcttgaaatctgaaaagtatagatttaataataattttatctcataggaactgtaacatattgataatgcccaaagtctttaataggtagtggaaaagtttaacttttttacttaggatattctatctaattaatggcaccattaaatattactagcatgcaccattggagaatgaatgctttgtaagtgaattctgactataaccaatgcaatggaaacatgttagactaggagttgagctcaaccaaggttttagttctcctctaaaccgctagccacagagtagggatgtgtttttattctttactgtgcaccaaatgccagcctggagatgctcaacacttcttggacgatgaaatgagtagatgtactgacaggtgaatcattaaacacgaatggctttttgtttcttcatatgtaaagtaagaaagatgacaaggaattctgttaggtcatctttgaatttcttacctatttttatgataatatgtactttggtacaagtaccctgagaacttcaaattaaattcttttgaaagaaataaaacattttgttaaatacacatcttttaaatgcaaattgaaaaccaagtgtccttgtatttcagaggctttttaatatagataaaatttaaattgagttctttagccaagctgaataaatgtacaaggtaaaaatgcaatctcttcataagtttcacagagtaaacactggaagttgcaataataaatatgtaaagtatttgtttttattacaaatgtaaaggattagaggtagtttaacatttggaatgcaggtattaaagtactgtaatcaagttggaagaagcagtataaatctgaaattttctcagtaaccagttgaatacatttagactagagagtgaatcatttatttcagttcaaagttgcagtgtctgagttgaaccacagaaggaataaaaaagtccacatttgtttaagaatagcagataactgaattccaagtgatagcctgtgattttcgaggcagtcagaaaagtttcacggaagctaagtgaagggaaagccaaatgtcaaatgtggcattccttcattaagtaagcatttattgataccttgcagtattctaggcagagggattgaagaaggctaaccatgatgacctctctaaggctattgaatttgccagtaatacacttacactaagtggtcctagtgaacctaaatctcaagtctgctattttcttaatgcccattttcttatccaaataacttgtacattaggcttgaaactgctttacttagatgtttattttttgtaactctaaatatgtatcattgcttttaaccatttttatactatgaaaagggatagccttctgttgcaatgagatttgtgaacgtatattttaaaagaaatatatcaactaaacatctggttttggatactctgtatcctctcttccactaatttttaaaggttttcctcatataatctacttcttcgctgtggttcatttatttttttcctaattggaagatagcaaaagagttggcagcatacatttctatgtgactttaagcatatacagaaatgttgcaacttcagtctgattaggaataataataaaataatataaatacaaataagaaataaaatagaaggggctccaaacctctttaaagtatttttcttttgttatacccatttttttcttatatgaactcatttttatgatatagtcttgtcattagggcaaatcataggcttgaattaaaagatcagtagacactactttattttttttaatttttgtcagcccccatctattaacatatctttccttccatttctccagcctagtgccttgtaacaataggagctctataaacagtacttttttttcctttctttttttttttttttgagagacagtctcactctgttgcctaggccggagtgcagtggcacaatcttggctcactataacctccacctcctgggttcaagtgattctcgtgcctcagcctcctaagtagctaggattacaggcatgtgccactacgcccggctgatttttgtgtttttagtagagatgaggtttccccatgttggctaggctggtctcgaactcctggcctcaagtaatccgcctgcctcccaaagtgctaagattacaggcatgagtcaccacacctagctataaacagtacttaaatggcgagttagcactttcttgtgaatttctgtaatacactctattcttgccctactttgcctcctggccagattaattcagtagcagctactattgaagagaattaacctaggagtgaagttgaatggtctcctcttggtcttcactgatatctttgtgggtggctcccccactcagccttctctgtttctaccccagcagaagattgggacttctttttacagcctacagaggatggacatctagcttcaccacttggcctttgctggcagggttggtgggggtgggctgctgtttttttctgtggtggttagctagagtggagtggttattgtcgaaaagcttctgtcttgctaggctgcccgcttcctggatagagagggcatgcttttcttggggcttttcttttctgggtctcctccattggcgtttttgcgttgctggtgtctccagtatccagtctgaaatacatgagacaaaaagaaaacccaaagtattgatcatcattttgttccttggatcctgagctcccttgtcagactgccaccttctctccttcttctgaaaacagttttgcaggaacatataatttaatttacaaaagttatattatgcataacctaagaagagttgacactgtagttgctcactaattacttgttgaattgaaatcaaaaataggtgcgtatttcttgagatatttgtatccatctgagatctttgtgatttgagaaaggaagaggtgagtaaaataaacacctaaagcagttctaccaaattaattttcaaatcaacaatttctacacctttagtaaacaatttataatttagaggaggaaagataaaaagtattatattgaacaataacctcagtcttttaggattgttacatgaaattcattttggatgatcatttatcttttaattcttctagtgctgtagattaaatgagtctggtgttgtattactacactatagctcctttgtggagccagtggaggctttctattctaaaccataagttctcacttattttgaggctgtcccacaccctgaaagataaagtttcaaatgagtcaggtgatcttttcacaaatggaatgagtgctcagtttacattttttttaattatactttaagttttagggtacatgtgcacaacatgcaggttagttacatatgtatacatgtgccaagttggtgtgctgcacccagtaactcgtcatttaacattaggtatatctcctaatgctgtccctccctgctccccccaccccacaacaggcctcggtgtgtgatgttccccttcctgtgtccatgtgttctcattgttcagttcccatctatgagtgagaacatgcagtgtttggttttttgtccttgcgatagtttgctgagaatgatggtttccagcttcatccatgtccctacaaaggacatgaactcatcattttttatggctgcatagtattccatggtgtatatgtgccacattttcttaatccagtctatcattgttggacttttggcttggttccaagtctttgctattgtaaatagtgctgcaataaacataggtgtgcatgtgtctttatagcagcatgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnctctgtttgtctattattggtgtataagaatgcttatgatttttgtacattgattttgtatcctgagactttgctgaagttgcctgtcagcttaaggagattttgggctgagacaatggggttttctagatatacagtcatgtcatctgcaaacagggacaatttgacttcttcttttcctaattgaataccctttatttccttctcctggctaattgccctggccagaacttcaacactatgttgaataggagtggtgagagagggcatccctgtcttgtgccagttttcaaagggaatgcttccagtttttgcccattcagtatgatattggctgtgggtttgtcatagatagctcttattgttttgagatacgtcatttcacaaatgcaattggagtgttcagtttacatttttaaaagtacttttaaaaagtacttttaggccgggcgcggtggctcacgcctgtaatcccagcactttgggaggccgaggcgggcggatcacgaggtcaggagatcgagaccatcccggctaaaacggtgaaaccccgtctctactaaaaatacaaaaaattagccgggcgtagtggcgggcgcctgtagtcccagctacttgggaggctgaggcaggagaatggcgtgaacccgggaggcggagcttgcagtgagccgagatcccgccactgcactccagcctgggcgacagagcgagactccgtctcaaaaaaaaaaaaaaaaaagtacttttactttcagcttgagtcactcttcccaggctttatccaggtggcttaggttagctagggctgtgtcccgtgatgtacagtccctttacacaatgttggagataaaacttggcctcatgtcttgcttcatattcccacagcctctcagagtcctgtggacaatgactagggagacaaaccatgcaagcaacatattttttaaaaggtcagtttcaataatgacttaattttaagttataatttcatggaacactttcatcactttctttttcacagtattttacccagttattaattaatctaagtagtgtatcttcgggaggtaagacagttatttccattttatagatgaggaaatcaagaaaagtcatttagtttatgacttatccaagagcattcagtgcattgagattggaagtggaacaacagaccaagattggaactctaaatgttttctttaaccaccatcctgtgcttagcccaatagaccgtgcccgtaaccaaattaaatttatatatctttcacaatgagagcaagggggaagaaaagattatccaattagaattttgttatagacatggtctgtaaatatctaatttttcagtctgatgcatcaagaatgttaaatcattatcatatctcctgtttcatatgtagcgtaataaaaagcccgtaatacaagacaataattttaaaaaaatattttcttgttaagaaatatggcggttatttgaaaataaacaattccatttaattttttacaatgtaaagaaaaatgtgatacgtatataacaaacataaatatagtacatatacttgtcattagatatattctatatctgcactttatatatacatacacaatataagacactgaaaatttgggataggtttataaactatcgatgctaccatgtgaaagaatactgttgtgtgaaataattggaatttgggaacaggcttatttaattttcatttcatctttgccttcccccttagtttaaatgcatttaaatatttatctaaatacagtgtcagattgggctgctataataagaataccatagactgggtaacttaaacaacagatacctacttttcatagttttagaggatgggaagttcaaaattagggtgccagcatggtcaggttctggtcctggtttccatatggcagccttcttgttgtaccctcacatggcagagagaaaggaagcaagtgttattgagtctcatataaaggcattaatcccatcatgaggattctactctcatgacttaattgcatcacaaaggccccaccacctcataccatctctttgagggttagggtttgaacacatgacttgagggaacacaaacatgcagcccataacatatagatatagtttctttttagagtagtttgttatatgttggggaaaagttaccactcaaaattaagggcctgaattctagattcatctcttattctgctaaatatgttgattatggaagcacatttgcaggattgtctttgagagttagcatcctgatgtagcaattcatttgtattgtaacatcatggagatttcttttgtgatttttctttttcacactttctcctattcctgagattctctttttgcactctattaaaattcaagtcaacatcagataaagctgggtcataatgtattgctttttcagtcagcggcttctgtttttcacattgagtattttctttaaaatgactcagtttgaggtgatactaaagaagtttaaaattagagaccatagctcagttatctaagattagcaatgcctataataaaactaaagtattatcaggcacaccagcttgtgcttacagtcctagcattttgggaggccaaggtaggaggatcacatgaggacaggaatttgaggccagcctggtgggcaacatggtgagaccctatctctacaaaaagtaaccagaaaattagctggacatggtgatatgtgcctgtagtcctagctacttggaaggctgaggtgggaggatcgctggagtccaggaattcaaagctgcagtgagctatgatcacaccactgcattccagtctggatgacagagtgggactctatttttaaaaaacaacacaacctatttattataccttttatttcccgagtccaaattaattcttcctatgtttgaagtcccatagtatttgattattagcatttattttattttgccttatatgagctgtttacttgatcctcacagtgtgtaatgaagtgttttacactttgcctattctcaagtacatgttttagattaaatttatccccctaaaggaaagatcaacatgtgacccctttctgatatctggtcctttggtgtggatatgttgattttgtttttattccagcttgcttctctttagactatcaaattatagattcatttttagttttactttctattaatagtgtacttcacctagttagattgttttcccagtagtcttaatttctcatggtaaaaatagattatcatttctcaattacttctaaatataaattccattctaataaatgccatttagatatccaatccaactataacagtgcctaccacacaataggtgctcaaaaaatgagtaaatgggtgaatgagtgaactaacaaatgctccttactgcctgtccatttaatagtttatccgtgtaggtatttatcagtatggttgctatgttcatgtatttgcagttactaaaaattcttaaactccttagcggtaaaggctgactctctgcaagtgggcgtgaacatgctacctcaaacctattaatttaagatgtagcaagttaatattatccaaagtacattgatagtctaagacccactaagcagaattgcatggaattgttatatagattaaatgaggtataatgtgtgtttgtaaagggagtctatataactgtaaagtactacaccaagattagtttggttaagaacacttttattaatatggaactaataatacatgttatataatattactgaacagtaactacatttcttagaatatgcagtgtatgtttgagcaaatagactggattgtataaattgtcaagattggaactaagctcttcacgagtatctaattcttggtaaggtgtcttcaggtgttcctaaataattggaagatgtaattatgagaaaagttataaatgaataataactaagtatgtactgttgacagatcattattgaaaagcaaatttctagatgtcagcactacaatttaaaagtgaagctttttattttgaatgaaatattagtagtttgggtttatttgcacaaaatattcaaagactggatgttgaaagattaaatttgtctctagagattatttaagaacaagactagattttctgttcatttgaaattagaaatgaaggaaacaagtaaaatggtttatagttgaaaacatattgtgaattggaaaggatttccagttccactcaagaaaacatttaagtccattagtaatgtctggccttttaattttaagccaagaacaatttactaaggatagtctaactttaaaaaaaatcactgtgaaatatgtttcttggtttacaattttgagtgtttggaaagctatataatttttttcttacctcatacaaaaagagagcatttgtcatttttctataaaattttattttcactgatgtcattttgttatgctccttacatttgtacaataggatagtacaaagtactgtggtcttattattcaatggaaatgtggcctttcagggatcatttgctttctagaactctatttaccagtagttatgaacaggttgtgcttcaccgttaggttgatgtggttgcaaggcagcattttaaaaagagaagagttttaaatatcatgcttggaaaagatctgaaggacagttaaaatctaatgtctaataaataaccattttaatgcagatatcatttttaaattgttatatttcgttccctttctttagtataataagtccattagtcatgatttcttttaagaactacttaggattttaggcagataaaggcaattgtcttaactgctagacaacatacagtatatttaaatacatatgtatgataaaaccttacacttttagatcagacccttttggaagtccaaatgtggtgtgcacactggttgaatagaaattcactattttttgtttgtttgtttgagagacagggacttgctatgttgcccagggatcctccagcctcagcttccggagtagctgggactataggtgcactctactgcacccagctccaaagttcacctctgtattgactttgtggagcaacttgcttaacaaatcaataattatacatacatttcaaaaaatatgtttagccttgctaagagaaaaacaaaatctttcaaagaatcattaagcaatttcaattgcatttgtttatatacaaacaatacactacttacagtttctagcataacttctttgtatatgctcatttctgtaacagtacaaggctgaatgagggaaacatataatagagaaatggcaagctgactgaaagatagagttaaaatagtttcttaattctgtttgtactttccaatatggtagccactaatgatgtgtagctgttgagcacttgaaatgtgactagactgtagtgagatgtgctgtaagcataaaataacacaccacattttgaagatttgatgcaaaaagaaagaatgtaaaatatctcactgataactgatatgtattgctatgttgaaataatgttttagaacatacagttaaatacaatgtattattaaaattcatcttttttaatatgactactacaaaatctaaaattatatatgtgcttgtatttctagatagcactattaaacagcactgatctgtatgatcttaaacattacaatacaattatatattggataactgcagctttagcttgcgttctaaaaggagttcagatgttgtacctgttttggcctcattttccttctttatattctctctctcagcctcggtccagtttgagagctgttagtgttccagcataagattcttttcttaatcctccttttttttttttgaagactgagtctcactctgtcacccaggctggaatgcagtggtgcaatcttggctcactgcaacctcctccttccgggttcaagtggttctcctgcctcagcctcctcagtagctgggattacaggcgcatgccagcatgcctggctactttttgtatttttagagacagggtttcaccatgttcgtcagactggtctcgaactcctgacctcatgatccctccgcctcagcctcccaaagtgctgggattacaggtgtgagccactgcacctggccaatcctcataatattttaagatgatttcatcttccttcctctagaggtcacagacattggaaagtcattccctaagtgaatatgaataatactatgtgtttcgaagaggtgaaatgtgtggtctagctacctttcagattctccttttctctcagaggaaggcttttgcctgcatggttgtattgtcacaatctgtaacttatagttcagattcaaaaaccccttttcttactggaaaacgtatacaacaacagggaaaattaaaaaattaaaaaaaatagcataaatgccatttttagaaggcagaaaaaagtctgcaaaccccaaagtgctacttaaagtgattgaaacccagcagagccatgggtaaaacagcactgccgggcagagagctgagaggccagcgtggtgacagatttcagaaagcaccagcactaagggactacctaaaggcctggcaccagccctaaagaccaaaggctggagctggagctaccatggtcaaagctgagatctggcattaggcaatagccacttagtcaggggaaggaggagagagaaacagaaggtgtgggaaagtatctagtaggatcagacttcagccagcaaacagagatacattttctgaagttcaggggtcatcttgtagagtagggctgttactcttgggacaatggtcagtgagctaactaggcaaccccggggagctaagctggctgcagaagccctcctggacctagtgatgcaaaaaactaatttgaaaaagatagtttcacctgtggcatggaaaagagagcccttgaagattggaaaaggctgcctttatccctcctttccccagcccttccctctctggaacctcctacctggtccaggaaaatctaatcttttcagccagctttgtaaccataagttacaaagtgtattcatatggcatcagttcaagcatactattaaaacagaagaaaaacacatgagaaagaagcatactggcagatgaattcttctctggtccactcctcgaaactgagtgcgctagtgcttctgcttgtctacttagatcttgatttttttggtttcttttattaaaacataatattttgaagagtagaatctgttgttccagcacaaaatgtagtatctacatcctagaaggccttttgtactttagagatcgtgtgaatgctttgggtaatagcatttatcatgattggaaaaggattgccatcagtctctctagattaggaaaaagtggtctcagaatggtggattttttacagtttgccttttttttttttttttaatgttagggaagctatgaagtgtgcttattattgccaaattcacctactcaaggctactttatgcatagtgtgtggcattcacccatgagtttcaggcagggaaacaggcactgacattaaggatcccagacagtttgctactttgaagcattaaatgggtagttacctgttcaattttttctgcctttttacttaggagacttttcatatgttgaaagcacaaagaaccaagtgtaatagtgttcacatcttttctagatagcatgttcctttcaggtgaaggctcaagacctgtatactccctcccccgccccacccctccacccccaaaagaataaaaacatactccaaattgcatgtgattttaggtggtttgaagatcctttaaagcttctccatgggccctgagttaatagctcccattttaaagagtatactttttttttcttcacacagtggaatcttttggacttcttgtttctagagggtcagaaaggcaggctctggatttctgatgtcatcttttcagttagttgttatatttaaaattggatttacaatttactcatcttattgactgatacaataaaatgtaaatgattattagtgttttgcttataaattgcttgactaatttttgcctactatctaaaacatttgccaaaatttctcaaataatcaatgctaagcttaattcatcactgttaagtttaattcatcaccttcttcctctttaaaggaattgacttctctttgtgtagtcatattaacaacaggtattttaatgtcttcgtcgtttgatgaaggattggcagacctaaatatataccagtttggtattatttagttttaaagtaatgattcgtgtgataggttcttgctggtttttaaagtgtgtatctaaaaccatttatgagtaaatttttatataggtaatttaattccaaaaactatgtcaagctaagttaaagaagttataaaacatttatttgtgtcttttagacatagaaagttgtttcactttattttaagcttccttgatatttgcttaagttacatttttaccttgtgaaatagttggaaacaagcatgccattttcaggtattacagtagaattctatttgaaaaagtgctagtcgaaagagttttttttctaactttcagattgctgcttggaaccctttaaattacagaatcatattaatgtgcctatgttacctgatatctgacaaggaatctattagtgctcttccttatagtgccagttctttgtatccctaagttatttatataaaatagataaatttacagtgtctttttttcttcccactagtcatgtgttttatctaatagtaaagattataccttgaaaaataaaatacagagggacctctattttcttgtaaaatttatctgatctcagagacaacaccttgctttacctcattttaccaccaaatacagagttatttcttttctaccaaaaaaaagcacttcaatgcattgatgacatacttatctcattgatgcatattcattctaagacttgtctcatgatgcttgcttgctgctgctgatttgcttatcttaattttttcttaaagtcatgagaacaatttttgtgtttttggactcaaggaatattggcaaattcagtttttgcttggcttcttaactgaagtctctttattgttgggatctcttatggtattctactcatttctctttccttctctactctccattcttcctactgccccaaataattcacatataatcacattagactcctgacacagaagtgttagtcttagagaggctcttttacatatcaaccccattttgagtatcacctgctagaaagtgaaaggaggctctgagtttttgagttccataataataacaaccaaacttcagaaaatgaagtggaaaatttcagtttgaccacagcaataaattcactttatctgtgctgaccatagtcagaacatttgcaaagtgatgtttcttgactcttataccacagatgacttcagatgtgttagtaccagctaaggatgtaataccacagcatttaaaaattttgcatgaatacctctggtttctttttcttgaactaaattaaggaagaattttaggaagctgttaagcttcttcattacatatttctatttatgcttcatctgtcatctcatttataggaatccttccttaaatttccctaagaccaggtaatctttatcttgttcagatcatgtcagaactttagctgtcagttttggttttgcataccaaaatattttagggaaaagtaatctacatataagtttgcttcatattctttcactaaaaaatctgtattacatttctcaagtatgttttagactgacattataccactggttagtttttctacaaggagatatgtgtcattttttgtttgtgttgctttttcttatctaccgagcaaccattgatcacctgccatgtgtcacacactatgcttagaggcttgggattatgatataaaatgtcttatgatgacacttgacagcttttgataagagactcttaaaatatgaaatttttatcagtggtttcaatgttgagtcatagtgcatctaaaggaattccataaaaccagcaatttagtgttagggttgagaagtctttagtaatgagaagactactttactacatggttcatgtgagcctgtaatcaaatttaccagtttttttttttaggtttcttcaaacttgctgccctttaagatgatgagctcccatgagttgggggagctctacctggtccagagtctgacatatcctataagtaatatataatatgatcaattaatggatgactcaaagagggtgaagatgggaaagagccaagatgaatagaagtttggcctagttttcctcccctgttgttgcctttctctttttttctctatttccctttttgagaagcagaccatgttgaatgaagataccctctgaagaggttggatagagcttttcaggcccaaactgattttatcacttagatttgattatgttctgggagattatccttaaccaaacttcttaattattatttgttaatgaatttggggagtatccatgatttattaagtggaaaaaaattaagatgctaaatgaaacatttcatatcttctcattaggttaacacacacttagataaaagtttcatgtctctttgatcataaaggagagtgaaatgattcactcctgtcttgatcatattgaatatcataggaaggaaaaagagaagattattaatagttgcatgacataccttttattgtttggcttgttatgggcaggtattactctggtaattaaacaaaatcaataaaatacataaaatttaaacaaatcacagcaacaaaacaaaggattgaagtctgtctttttttttttttttttttttttttttgagacagagtctcgctctgtcacccagggtaaagtgcagtggtgctatctcggctcactgcaagctccacctcctgggttcatgccattctcctgcctcagcctcccgagtagctgggattacaggcgcccgccaccacgcctggctaatttttttgtatttttagtagagtcggagtttcaccacgttagccagcatggtcttgatctcctgacctcgtgatccgcccgcctaagcctcccaaagtgctgggattacaggcgtgagccaccgcacccggcctgaagtctctcttttaatataagcagtcacactggcctctatgcaagtttgcctatgtacaacacaatattagatatattagaaagaggccaaagcttgccaagcttaaggtgggtcctggtatatccttccttgaaacaaggtacctaataatctacattagctaaactgagagataccacattagtgattctttccagataaagtggttcatcagcttcccctggaaagaattgtggcattactcatgcttgtttacttatttatttatattttatttttcaaacttttattttagattcaggatgtacatgtgtaggtttattacctgggtatattgtatgatgctgaggtttgagatatggacaatcccatcacccaggtactgagcatagtacccaacagtttttcaacccttgcctgcctcccttcctccttcctttagtagtccccgttgtctgttgttgccatctttatgtctatgagtacccagtgtttagctctcacttaggagaacctgcgttttctgttcctgcgttaattctcataggacaatggcctccagctatatccatattgctacaaaggacatgattttgtcctttttatggctgtgtagtattccatggtgtatgtgtaccacatgttctttatctagtccaccattgatggacacctaggttgattccatgtctttggtattgtgaatagtgtcacagtgaacatgcaagtatgtgtgtctttttggtagaatgatttgttttctttggatacatccccagtaatgggattgctggatcaaatggtagttctgttttacgttctttgagaaattgccaaactgcttcctacagtggctgagctactttacattcctcccaagtgtagaagcatttccttttctccatagacttgccagtatctgttgttttttgactttttaaataatagttgttcttactggtgtgagatggtatttcattttggttttgatttgcatttccctgatgagtagtgatgtggagcattttttcatatgtttgttggctgtttatgtgtcgaattttgagagatctctactcatatcttttgcctatttcttaatgggattatttggtttttgcttgttcagttgtttcagttactgatagattccggatattagacctttgttggatgcatagtttgcaatatattcttctattctgtaggttgtttactctgttgataatttcttttgctttgcagaagctctttaattaggtcccgcttgtcaatttttgtttttgttgcaattgcttttgaggacttaatcataaattctttcccaaggccagtatctagaattgtgtttcctaggttttcttctaggattcttatagtttgaggtcttacatttaagtctttaattcatctcgagttaatttttgtttatggtaaaagataggggtctagtttcattcttctgcatatggctagccagctatcccaggacaatatattgaatagggagtcctttcctcattgcttatttttgtcaactttgtcaaagattagatggctgtaggtgtgcagctttatttgagttttctattctgtttcaccagtttatgtgtctgtttttgtaccagtatcatgtggtttggctactgtagccttgtagtatagtttgaagttggataatgtaaagccttcatctttgttcttttgcctaggattgctttagctattcaggttcttttttggttccatatgaagtttagaatagtttttttctaattctgtgaaaaatgatggtagtttgataggaatagcattgaatctgtagattattttgggcagtatggccattttaatgatattgattctttcaacctgtgagcatggaatgttttctatttgtttgtgtcatctgtgatttcttttagtcatgttttatagatctccttgtaaagacctgtcacctccttagttagatgtattcataggtttttttgtgtgtgttttttgtggctatcgtaaatgagattttgttcttgatttggctctcatctcgagcattgttggtgtatagaaatgctactgattttaataccttgatttgtatcctgaaacttcactgaagcccaaacttattaaaacaatgtctctacagcatgagaattagaaacaaagagccagagaaagtgaagtttgattaccagttgtacttacaatctgtgtgcctttagataaattggtcatttccattagcttccatatctattaaatgaatataatcatgggacctaattcatggcattctttaaaaagattaaatgacaatcctaaattcataatactaaaagaatattcaaattaaattaatagcagagagaaaagcaatgtaatataaaattatacttaacacagagccttgcatattgaaattctcaataaataattttttgttgttgcatttgtaattatcagtactaatttacagaaacatatgcttactaatatatgctatatatataaatatacacacgcatatataggataaagtacacacatacacatacatgctcagggctgccatttagaccatcttatttgtaatctaactactcaggaaacttaattagttatcagaagttggctttgtgaaaatgtgatcaaagaaaaagagttagatgatcctggaggatagttcatccaggctttagtagagcttggaaaattaggccttccacattactacatacctttccagcattcatgttactcatctttgctaattatatcagtgagtctctgccttcccctctatccatctaccttcttcttcttcttctttattctttcttcttcttctcttctttcttcttcttcttccacttcttcctcttcttccatacgtaacattcatacatacattcttctttcatgcatataccatttgaactctgacagatttatatttttgaactcttgtttgtcattaaccatgaacttcaatatttcatgcaaggcaattaatttttgcttccctttttaatatcatgtattttccaaatatgtataccatggttttttaatgcatgcaactaatttaaacatcaagtaagcatgtatattatttcatttaatcttcaaaacatctttgtgaaataagtcatatctattcatccaacaaaaatactgaggctaaataggagttaaatgagttgcctgaagttacatagttaataagcaccacagttaggaatcctgtctactccatgatttcaggcccacctttccacagcttcaccacaacctgaacagaaaggtcctagaaatccccatttatgaatcatctctcttaggatggattacttctataaatatgttcattttgtagtggtttttacttgactcaacttcataataacctttcctgaccttgtaactgcccccccttattaactggcataatggaagaaaataagagattacagatccttgagaaaagaaagaaaaaagaatgtcgcaggtgggacggtatctaataattggaggacagctttagcaaggaggagatgaggaaggaaaactgagaatatatgtctagaaataacaggtgaattaagggtggaaaaacctggagatcaagattggatgttctccattcaattagaaatgaaagtttggggaataaagaaagggatgaatatgagagataaggaaacttggaggaaggaggcagtctgtaacaatttctgtgggaacctcagcattgaatcaagcagagaagtgtgtttgaagttgttgataaccttgtgctttaggaatagatttttctggccatttttttattgtgataagatccgtgaaccatgaaatttaccattttaaccaccttttttctgtcatgacagcctactattcagcattgaaaccattttcaaatgtacaaatcagtggcattaagtgcattattaatttcctgccactattttcactttccatttccagaactttctcatcatcccaaacagaaactctgtagccattaaacagtaactcctcattcctctctcttcttcacccctggtaaccactattctattttctgaatttgtgagtttgcatattctgtataccttatatgattcaaaccatacaatatttgtctttttgtgtctgacttatgtcacttagcataatgttttcaagttttatccatattataacatgtcagaatgtcattccttttaaggctgaataatgttccattgtaggtgcataccacgttaaaaaaatccattgtgtttttttgtttgtttgttgagacagggccttgctctgttgcccagacctgagtacagtggcactatcatggctcactgcagcctcagcctcctaggctcaagtgatccttttactgggactacaggcgtgtgccaccatgcctgggtaattttttattttttgtagagacgaggtctcactgtgttatcaggctgaacttaaactcctggcctcaagcaatcttcttaattcagcctccaaaaatgttaggattacaggcatgagccaccgtgaaaaatttattattgatgggcatatgggttgtttctgccttttggctactgtgaataatgctacagtgaacattggtgtacaaaataatcaattttaaaactacagtaaaaatcttttatgaaattgctgttttaattattgtttcatactatttaagtcattcggaaagtctgataaatttgtgtgaggaaaagagagtattatatgactacttttcacatttttgctgagcatattctaaggttgtgatgaccataaactgcttcagaagttcatcatctaatagaatggaaaaatattattattattagatctctgtctcactttttgggaataatctaattaatttcaccacgagggtaagtgagactttaagtcacttataaagagtgatcctagtcagctatgtaattgtttatactcatcattttaagacattttagagttatgcgtactacataacattgccagcgctgtgcactgagagttactttattaatggacatctcatgctttctcctgttatcagctcagcacatgagattctagaactttgccttgaatgcttagaatagaacttagtcatgctacggaggttgaactccctcatactttatgttaacttttaacttttagttgaacaatgcatatatctaggataagtgtagttatttataaacaaaaaacttaagactgacaatatagccttctagttaatcgcttttaaatttgaagttattaaaatagttttagtatatattattagtataaatgtgtttagagctgatatcaaaagaaaagataaaataaattgtaatagctgaaattattttacatgagatactcagctaagtaaaaagtttgttcaaggccttttacaaatgatagctagccagtagttactctgtttgaacacaagaatataatgactcagttaaggtaagtactgtctgttaaactaactcagtaggctgattcatatttatacagtcatgaaaatgataaggaattaattacttaaaaatcaagatagctagcaatttttcatttctaataatgataattcaatacctaccaaaattcatatatatttcatatatatatttcatatatatatcatatatatgaaatatatatatcatatatatatgaaatatatatcatatatatatttatatatatatatttcatatatatatttcatatatatgctatatatatttcatatatatagcatatatatttcatatatatatcatatatatatttcatatatatatcatatatatgtcatatatatatcatatgtatttcatatatatatcatatatatgtattatatatatatcatatatatgtatttcatatatatcatatatatgtatttcatatatatatcatatatatatttcctatatatcatatatatgtatttcatatatatatcatatatatatcatatatatatatatgtatgtatgtatatatatttttttccaagacagggtctcactctgtcacccaggctggagtgcagtggtgcagtctcggcttactgcaacctctgccccctgggctcaagttatccttccacctcagcctcctgagtagctgagaccacaggcatgcaccaccacacctggcttgttttgttttgttttttgtatttttagtagagacagtgtctcatcatggtgcccaggctgatgtcaaactcctgagctcaatctgccgacttcgacctccaaagtgctgggattacaggtgtgagccacagcacccagcccagaattcatatttatttttattttattttttttgagacagtcttgctttgtcacccatgctggagtgcagtggcataatctctgctcactacaagctccgcctcccaggttcatgccattctcctgcctcagcctcctgagcagctgggactataggtgcccgccaccacgcctggctaattttttttatttttagtagagacagggtttcaccgtgttagccaggatggtcttgatctcctgacctcgtgatccacccaccgcggcctcccaaagtgctgggattacaggggcaaaattcatattttaataaaagggatgcatatctaatgtttactaatgaattattcaagttaaaattaatagtcactatagtaaagaccaatttaacttatattctgtaagtgagactgaggtgattctttgtattttgattatagttcatgtttctgtcagcattttgtagagagttctatgaagctgaactcatccttgaaatttagaattgccataattctttttaatgtggaatataacagtcagtctttctgggatctgtaatttcaaaaacaacaacatttttctttttgattgatcatagctattattggaacagctggtaacatgtgacatagtactataatttagactgaaaaaaattgatttgtgaattatatccactcagcttaaatttctctgtttctagtctccagagcatcttttgtacttctttttctgcagaaacggcttcctaacataatgttcttacattttcccaggggaagaggaaaactccatagtcaattttcttacttgtctgaagtataaaaaaagaaactctttacacaaaaatagagggaaaaacaaagtaagattcagaatttcccaacacaggaaataaaagatttattccatttaaccttttaacaaatgcactttacacattttgtgtgtgtgtgtgtgtgtgtgtgtgtgtgtgtacttcaggatttctgttcatcctgcagtcaatgtcaaggagatgagaatttatgaatatgatgattcagatgatttcagatttgagactaattcccacataaatcattctcccctctcatcttttgtaggtaaaagtaagccatagaatagtttgtaggatcattagataacaagttaggtagggaactattttgtatttaatgatttccctgttaaaattcacttttcaactatttacttaagtattcaaataataaatcaactatccatttagaatgatcaggaaggatcaatttagagatttttttattgtaaattgacaaattgtcattacgattacaatatttatgaggtacaaagtgatgttatatgtatacaaagtagaattattaaaccaagctaattgacattcttcacttcacataattacacttttttgtggtgagcacgtttgaaatttgctgtcttagcaattttgaagtgtagactacactgttattaactgtagtcattatgctgtgcagtgtatcccaaaaacctttttcttcttgtctaattgaaactgtacgctttgatcaacatctccctgtttcccccatcccctaacctttggtcaccaccaaccattcaactctcgtctataagttagattcttttcaatttcacatgtaagtgagaacatcatgcagtatttgtctttctgtgcctgcgttatttcacttagcataacatcctcaagattcttccatgttgtcacaaatgacagaatatctttctttaaaggctaaatagtattccatttgtttatgtataccacattttctttatccattcatctgtcaatgaacatttaggttgattccataacttggctattgtgaatagtgctgcagtaaacacaagagtgcagatatctctttgtcatactgatttcaaatcctttagatatatacccagaagtgggattgctggatcatatcataattctacttttagtttttggaggaacctctatatagttttccatatggatgtactaacttacattcccaccaatagtatacaaaaggtttcttttttccttgcaaaaactggttatcttttgtcattttgaaaatgtggtggtaggtatgaggtggtatctcattgtgattctaatttacatttccctaatgcttagtgatattgaacaatttttcatatacctgttggccatttgtatgttgtcttttgagaaatgtctattcaagttctttgcccatttttcaatcagattgttttcttgcttttgagtttttttgagttccttatatattttgggtattaatcccttatcaaatgtctcgcttacagatattttctccaaatctgtaggttgtctcttcactttgttgtttttttgctgtgcagaaggtttttagtttgatgtaaatccatttgtctatttttgcttttgttgcctgaacttttagggtcaaattcaaaaaatcattgcccagaccaatgttatgtagtttttgatctattttttttccagtagttttacagtttcagatcttacatttaagtctttgtcttagtttgtttgtgcgctataacaaaataccacagactgggcaatttataatgaacacaaatgtatttctcagagttccagaggctgagaagtccagagcagggggctggtgtgttaatcaaggggctagtatgtgattagggcctttgtgctgggccatgctgtggtggaaggtggaagggaggagagagagggagagaacctctgtcaaaaatcaattgaccataaatatgtggattcatttctgagctgtctattctcttccattggtcagcgtatctatttttatggcagtaccatgctgttttaattactatagctttgtaatacagtttgaaattagtagtagtgtgatacctcccactttattctttttgctcaaaattgccttggctattcagggttttttgtagtcccataggaattttagaatttttttttctatttttgtgaaaaatgtcattgtaatttcgatagggattgtattgaatctgtaatcactgggtagtatggactttttaacaatattaattcttctaatccatgaacaaggagtatctttccatttacttgtgtcttctgtttctttcatcagtgttttataatttttcgtgtgtaggcctttcactttctaaatttatttctaagcattttattcattttttaactattataaatgggattgttgatttcatttttggatagtttgttgttaggatatagaaatgctactgatttttgtgtgttgattttatattctacaacttgactgtatttgtttattagttctaataggtttttgtttttgtttttgtttggtagaatctttatagctctctccatataagatcagcaagtatcgacaatttcactacttcctttcctatttggatgccttttctttctttctcttgcctacttgctccagcaaggacttccagtactgtgttgaagagaagtggtgagagtagtggtctttgctttgttcctgatcttagaagagaaggtttcaactttttattgttgaatataatgttatctgttggcctgtcatatgtggtctttagtatgttgaggtacattttattcgtacctatttgagaattttttctatcatgaaaggatgttgaattttgtcagattcttttgccatagctaatgagatgatcacttgagttttgttcttcattttgttaatgtggcttatcacatttatagacttgtgtatgtttaactgtcctttcattccggggataaatcctactgattgtggtgtatgatccttttaatgtgctattgaatttgatttgctagtatttcattgaggagctttgcatttacgttcatcaaggatattggtccatagttttcttgtaatgttctgtctggcattggtatcagggtaatgctggctttgttaaaagaatttggaagtattttctcctcttggatttttgggaagagtttggtagtatattagttctttaaatgtttggtcaaaatcagcctgaagccatcaggttctgggattttctttgatgagagactttttattacagattcaatctccttacttgtaattggtttgttctaattttctatttcgttatgattcagttctgataggttatgtatgtccaggaatttacccgtttcttctattatctaatttattggcatatagttgttcataataatctcttatgatcctttgtatttctaaggtatccgttgtaatatctcttctttcatttctgatttcatttatttgaatctttttttctcagtctaggtaagggtttgccaattttgtttatcttttcagaaaatcaattcttagtttcattgatttattcttctattttctagtcactaatttttaaatttctgctttgatctttattgtttccttctttctgctaactttgggctttttctttttctgtttccttaagatgtaatattaggttgtttgagatcttttttgctctaggtgtttattgtgtttatttgtataaatttccctcttagaactgcttttgctgcatctcatcagttttggtgtgttgctttttgtttgtctcaaggtaattttttgattgccctttttatttagaattatttgcagacttatttcgctgtatggtctgtgaacagctgtagattttcttttatatatatatattttaaacaaaatttgagagatgaagtctgtattgtttacaggtttgaggaataattgatttataataaactgcacatatttaaagtttgcaagttaatcagtttttacatatgaaatcactgttcccaggataagatgataaacatgtccatcacccccaaaattttccttctgtctttttctaatccttccctcttttccttcttcccttttttcatatcctcactcccttctctggcaatcatctgctgtttagtattcattttctataaatttatatcagtggaaacatacaatatgtgttttattgaggtagtgtgtctggcttctttcaatattacattcatccatgctgtcacatttatcaatagccctttttttttttgctgagtattattttgttgtatgactatatcaccatttacttatccatttactagttgatggacatttgagatatttctaatttttggctattatgaataaattgctttgaaacttgggtacagcctctttgtggacatacaatttcatttatttagggcaggggctggcaaataaccagagagcaaatattttagggtgtataggcttgcattcttctttcttgcactgtggtctgaaagctccaggtagtaagccagagtagtcatgggctgcacttcatttgcctcctctctttcagttatcactggcttgctctacctgttgttcagtttctgaaaaccatcattttgttgtgtttgtggtcttgtaactctatcttggctgagtctgtacattttaatgtagttatgtttctttttaaaagtttaatgtatttgtatttaaaatcattatgccaagattatgtgagatttttgtttctatattatgtttatgcagttctttactaagaaagggatgaatgacttcagggtttcctggaagctcatctcttaacatattcatctatcactattaaaatatgttaatatatcaattaatattataccccttgtttaggagtcaatctgtctctcttactgattgcttatgttggttttttctttgtgctttttgtattatgtattacaaccttttatattatgaaatacaatacccatgtaggaagttcataaaacataaatatacagcttaatgaaattttatgtaactaacacccatttaataactacttagggcaataaaaataatattgccagcatcctagaggccctaacatgccttttttcaatcacagctttctcccacccaaagatagccagtatcccaacctctgtggtttttacttctttgctcttctttacacttttactacttaggtagtcatctgtaaaattagtgtttgctgttgcgtgattttgatccttacataaatataactgtattagtttgttcttgcacttaactgtattggttcgttcttgcattgctataaagaactacctaagactgggtaatttataaagaaagaggtgtaattgactcacagttgtgcagacggtacaggaagcatgcctaaggagggctcagaaaacttacaatcatggtggaaggcaaacaggaaggaggcacatcttacatggccagagcaggaggaagagagcgcaaagggggaggtgctacacacttttaaacaaccatgtctcgtgagaactcattcactattatgagaacagcaagggggaaatccattcccatgagctggtcacctcccaccaggcccctcctccaacattggggattacaatttgacatgagatttgggcggggacacaaatccaaaccacactttgctctttgacatgtagcttcttttgttcagtattaggattttgaaattcattcatgatgttgtatggaattcattccttttcattggtgtataatattatatataggcacttgatggatagcagtttgaggtgcttaccagtaatagtcaaacataatgcacatgtactttaggacacatgtattcacacaaaattggaattgccagatcctagagtagtcatatgttcaacttaggagataatgtgtgttataaatttcatctactcagtggcttctttcagtctctaaatgatctcattttaactttttaaaatgttatttatttatttttgagatggggtgtctcactctgtcaccgaggctggactgcagtagtgtgatcatagcttattgcagtctcaaattcctgggatcaagcaatcctctcacctcagcctcaggtagctgagactacaggtacgtgccaccatacctgactaacttaaaaaaaaaaatcattgtagacataaggtcttgctacattgcccaggccagtcttgagctcctggcttcaagtgatcctcccaccttggtctcctcaagcgctaggattataggtgtgagccactgccctcgaccaatttttttttttttaattttaaaataattctagacttacagaaaagttgcaaaaatatttcatagagtattcctgtatatctttcacgtggtttcccccatttttaatatcttacataaccataggacatttattaaaatctgaaaataaacattggtacaatgctatcaacttatgtacatttattgttctaattttgccagtttccccaataatatactttttctcatctaggatccactctaagatcctatattacatttagttgtcatggctctttcatccaatctgtgataatactttcttcttgtttttcatgaccttgatacttttaaaagaatactggtcagttattttgtagactgtcacttagttgggtcttttgcattttttggcaagaacttatgaaaatagtgcttttctcagtgcattatatgttggtagtgaagggggtgtgttgataagctttaatactggtgatagttaaccataattacttggttaaggttatttgcagtgtttctctaaagttgctattttttttttttttgtaattgttacgtgtttttctggggagaaactttgagactatgcaatataatgtttctcactaaactttcattttctaattttaataccttttgatgttttttgcttgcaacaattattactgtggtggttttaaatttcagtttggtaaatattttaaatattggtgaatttaaatttttctcattattttttcatgtattaagataaattttactgtaaacaagaactgtctcttctcataaatttatttatattggtatagactttttttttttttttgagacagagtctcactctgttgccccaggctggagtgcaatggcgcgatctcggctcactgcaacctccgcctcctgggttcaagtgattctcctgcttcaacttcctgagtaactgggattacaggcacctgccaccatgcctggctaatttttgtatttttagtagagacggggtttcgccacatcggtcaggctggtctcgaaccgctgaccttaggtgatctgcccacctcccaaagtgctgggattataggtgtgagccaccacacctggcctggtatagactttttaaaaaatgtacttgtttattttttatagagacaagttctcactatgttgactaggctggtcttgaactcctggcctcaagcagtcctcctgccttggcctcccaaagtgctgggattatagatgtgagccaccacacctggcctattggtatggacttaagaataaagttgacccatgaataatgcaagggcactgactcccttgcagtagaaaatctgcatataatttttgactcccccccaaacctaactactaatagcttactgttgactggaagccttaccaataacatacacagtcaattaacatgtattttgtagttacatgtgttatacactatattcttataataaagctagagaaaagaaaatattaagaaaataacaaggaagagaacataaatatgctattcattagacttgagtggatcatcctaaaagtcttcatccttgtcatcattgtgaaggctgaggaagaggaggggttgttcttgctgtctcagtgaggacagaggtggaagaaatctgcgtataagtggacctacgtggttcaaacccatgttattcaagggtcagagctgtattttattttatgggttataatccaatactataattttattttagtgttttgattttgaccattgggaactctttcaagttggcttctgtgtctttttgacatgctttccatcatttttcagtacttccttactttctagtaccataagatgttacagaatcttctattttctttcctcggcccaggaattagctgtttctctaaggagccctggtttcttttattggtgaatgatagttagaaataaaaatctaatcctaggtgtggtcattgcttctggttgtcattctaagccctctctgttgacagagctaggaatgtatcatatactaacaagcacctacgtgtatatttgtatttatttcttcttccatctgtcagtatattaaaaggcatgaggccttactgatagtccttatccaacatcaaaatgttaattctgtcctttctccttttcttatttgtaactctttgtacagtgagaaacctgcatctctttatccatgatatatttgtttgttaaatcctagtatatattttcataattactaaccagtacccatatgagaaacaagtttattgacttaagtacagtgtttgtctacatttctttttgttggtagccttagagaatatagtcaaaatactattttctgaagttacttaaattagctccttttcgtccccatcccccttcatgtgtattattcatttgtaaatataattattttcattcctttttaggttctctcaacatactgattgattttaattgatcgtttggtatatgaaacattgtaatggttctaagtcctaactgtataaaaagatactctcatagatatgtcactcttcactcatcctgctgccctatttctattcccccatgatttctacctgttttcacctatccctcatgggaaaccagtctctttagtttctgttttagccttcctgtaattcctttgtacaaagaaacagacacatgaatgttattgtactttttctttaccaaaggatagcatactatatatcctctcttgcgccttctttttttcacttaacacagtaaatatatcctggaaatcatttcctattggtaagtagagattgtcctcattttttaccgctgcatattattccactgtgtggatttaaccgtagcttatttaaccactctgccatgtctgagcgtttgggttgtccttaacattttgcaactgcaaacagtgctgcaataaatagccttgtgtatatgtattttttagtttttggaggtacatcttcaaggacattgtcagaaggaagatgactgggtcaaaagctaagtgcatgtgtagttttgccaaatttccctccagacgggttatactagtttgcatttccaatagtagtatacgagagtgtctgttttccacagcctggccagcagaatgtgtggtccataccttttaattttgccaatctggtaagtgggaattgtatctcagtgttgttttaatttgcatttttctagttacaagtgagtttgaatatttttacatacgcttaatgtccatgttttatatttttgaattatctttttaatgtgtttttcccatttcttctcaatgtttaagagttctttatatattaaagttagtagtcccttttctgtggtatatgttacaaatattttctcccagtttgtcagttatcttttgactttgtttatggtgtttttttgccatgccatttaaaaaaatttttacatagtatgatttaccaacattttctcttatttccttgttatatcaagattgaagaggaatttactcaggttttcttttaatacttgtaaggtttctcctttttttgtacttagattcccaatccatttggagtttattcttgtgacttgtgcgaagtttggatcttagtctatctcttgataaacataaattattaattttaatgtagacagatataccagtattttcctgtatggcattattttcatctgtgtggatagccagttatccctgcactatttattagaaagattatcctttcacttctgctctgcagtgccacctttgttataaattcagtgcctatgcgtaggtctgtttctaggttctctgttctattctactgacgtacttgtttgtccttacgtcaatcacattttcattattgctaaagcttcatgagaagaagtcttgatatctagtaagcaagtcctcctactttgttcttctttaggatgatttttaatatttttgttgttttgcttttcctcatatattttcgaatgagcttataaagtttctcatacaaattctgtcaggagtttttagattgcatttaatatataaattgggttgtgaacattttatgtggtaacagtgttgtaatttcctacctatgaacatgttgtattctttcatttacttaggttttcttaaatttcttgcaataatgtttgatacttttattaattaaggtctttcacttcttttgttagttttattcctagattaaaaatattttttatcatttcattttgaattggatcatccatagtttcattttttaactgcatgttgctggtaatacaactgctatttttctctaattgatctagtatccaggaatcttattataaattcattgattaatcctaataatttttctgcattttggggggaatacatatgtatatatattatgtttatgaataatgtgagcttttttccctctaaaccttagatcatgtttttccttgccttaatagactggctaggacctctagtacattgttaaacaaaaatggtgatagaaggtgtttttgcattcttctccatctaaaattttaaaatttccccattaagtgtgtttcctctaggatttgatttatttatttacttagatcatttagataaaattgaaaaagttagcttctcttccttatttgctgagagtacttatacaagggtgtttagttttttcaaataccttttctgccattataacaatacagtctttccccccatcctgtttctcaggtagttacaatggtgagttatttaatattaaatgatttttagaataaacccaatttgatggttttctttgcttcttttttcttccctttccccttcccttccctctttcctccttttccctcctcatcctccccccttctcccctctcctctctgaagttggcctatattgtatgtttcctttcttttacttcaacattgcattttttaaaaaaattaatgacattttcataggtctttttccacatttatggaaaattaaacaaagtgcagagatttcctagataccctttctctttcggcatacagtttcccttatcatgttgcactagtgtggtacatttgttacaattgatggacaaattggttatattactaactaaagtccatagtttccattgggtttagctgtgttttatagtgctatggatttagacagattcatgatgtacagatgatatcaaccattacagtattatacagactagttttctgctctgaaaatttcctgtgcaacatccatttgttccttttttcctccccctgatctcctggcaatcactgatcttgccgctatagttttgcctcttccgaatgtcatatagctagaatcatatagtatgtagtctttttagataggcttcattcacttagtgatattcatttagatttcttccgtgtctttctgtagcttcataggtcatttctttctttaaatagacttgatcttttagagcagttttaggttcatagcaaaagttgagcagaaagtacagacagttctcatatgctacctgccccacacatgcatggccctcccccactatcagtactctgcatcagagtgctacatttattagagttgatgaacctatgttgacatgtaattatcactaaagtctgtagtttgcattaaggtttactcttggtggtgttttgacaaatgtataatgacatatatctagcattatagtatcatacagaatggtttcactgccttaaaaaaatccttttgcctttctcagaatatcatatagttggatcatacaatgtttaggcttttaagattgacttcttatactgttactttcctctgtgtcttttcatggcttgatagctcatttatttttggcattgaataatattgcattgcctgtgtgtaccatcatttattttcacctattcaaggacatcttggttgcttccaagttttggcaataatgaataaagccgctataaacacccatgtgcaggttttttgtatggacatacattttctatttatttgagtaaataccaaggaagatgattattgggtcatgtggtaagggtatattcagttttgtaagaaaccactaaactgtcttccaaaggggctatgctattttgcattcccaccagcaatgctcgcgagttcctgttgctccacatccttgccggcattggtggtgtcagtgttctggattttggccattctcataggtgtgttgtagtatcttagtgttacttcagtttgtatttccctaatgacatatgagacttgagcatcttttcatataaccacttgctatctgcatatcttcttttgtgaggtttctgttccagtcttttgctcatttttaaatcagattattatttttttctttttctaaatttttgtttttagagacgggtttttgctgtcactcaggctggagtacagtggtgcattcatgactcactgtaacctttaactcatggactcatgagatcctcctgcatcagcttcctgagtagctgggactacagacacatgccaccgtgcccagctactttttatactttttgtagagacgaagtcttgctatgttgcccaggctggtctggaactcttggcctcaagtgatcctccaaccttgtcctctcagagtgctgggattacaggcatgagccaccatgccaagcaaacttgtttattttcttactgttaagttttaatagtttgttgaatattttggatgaaacttatttttcacatgtcttttgaaaatatttttttcccagtctgtggcttgttttcttattctctgaatccacattgcattttgtgtccatgtcaaagttatgctaactttataaaattaattgggaaatattcttttctattttctggaaaaatttgtgtgtaattagaattaattttggtagaatttgctggtgaatttgctagaccttttgcttgctttgtggagtaatttaaaattgtttatgggagacatctaagattttctatttttttcttgtgtcaattttagtgcattatatttttctaggagtgtctctattctgacttttgaaacttgttgggataaaagtatttataatatcctcttattatttattactacatttaggctgttttcttttttctttgtcctactgattatttgtgtgttttctttgtcagcctcattcagaatcaattcaattattgtcttagaaggaatagtttttagtgtttttgatactctccagtgtgttttccgtttcatgaatttctgctaattgttatctctttgcttctatttttgttgggtttcagttactgtcatttttctaatttcttgaggtggatacttaactcatcaatttctataaagcatttcttctttttcatatatatattttggattgtaaatttctttataacttggatttaactgcaacctacaagttttgatatattgttattttgctatttggttgaagacatttcataatttcaattatgattttacctctgatctatgggttatttataagtacacttctgtctttacagacatggagatttttctggttacttatatgttattgatttctagctgagttatgttctgaggctatgatctgcattattttatttgttcaaaatttgctttatgtgggaggaaggagaggatcaggaagagtagctagtggatgctgggcttaatacctgggtgatgggatgatctttgcagcacaccatcatggcacatgtgtactgatgtaacaaacttgcacattctgcacacgtaccccggaacttaaaataaaagttggaaattttaaaaaaaggaaaaaaaatttgctttatggaatacactttttaaatttacatcccactagaagattcaaagagtaatgtagaccttatcaatgatatgcattttcttaagttgaagatggcactactgatcctatattcagtgtatttgctttctatttgtttggttgtttgttttctaatagtagatgtattggatgtagtctggtctttggataacttcctaagcagtggaattttatgtaagtcagtattcaaggtgctataagttgtttcaaggtattttgttgcaatttaaaaatatatctgataacgggtactatagttatggcttgtagatagaacagttaattttgagttatttagcttatttttagaaagaatcccttgctccttttaaacttttaatttgaaataattacagactcaatttacttttaaagcagtttttctgtgtttgatgtatcatcaatattgggtgagtgaagttcttttaaatgtttattctattacctgacaagttctactttcttttatgagaaacttttctggaaacaattttggggctttcttttcagaatagatattggttaatgtttgtgtttggaaaattgaaagcaaaatggatattagtcttgcctattaacttctaaagctgtgataaattgtttttgtccaacaatgcctccttattgctactttccaaaacatcctctttggtagccacagtatagaagtatttagttgcaagcaaatatcttacagttgttagcatttgtataaaggttatggtaatgttcgcctaacttaagggcaaaacaattacctggtaccaagtgagtcagggtttctattttaaaatatacatataaatgtgtttattagtgctgaattaatgctttactctgggaatttaaaatgtgtgattgctatattgtatataagcaccgtgcatgatgaagtggtacatattacttgactataattacatatacaatttgttaaaataatttttgaaagttaaaagtatttaaagaaatccattttaaaagtgagaatttgtgttctcaaagtattatcttatgcatagcaggcctttaaattatgacacatgttaaaatccactcaaacaaaggtggtaatataatatatggtaagggataatgaataagaaagaagtatatgaataagaaagaacagtgttttttaaaagtgaaatatacatacatacatatatatgtgccaactgatatatttaagaaatttcttatttagggaaaggtagttattaggcaagttggagggagggacacactaaatagtatattggcaaacttcctgaaatgcatatgcatagtaatttagaggcatattgatttttaaatatcaggcagcttttattcttttccttttctagcatctatttgtatgaacagtgactgttcctgctgctaaaggaggttttatcaagctttctgtgaacatttgttatataggaaataaattaaactactgctatatataactaacattcaatttatgataccagcaatgatttgggagcgatttaaagttttgttggttaatttcttatttgtcaaatgatgggccaagaaattctccatttcttagattaggggacatttcctatttgaatctactaaacaaatgcctttagtcgtgtttgtaaccatcaacagtatgtttcaaattatgatgtcatcacttacattccaaatgtaagaaaaactttttgctaagttggcttaattcagaattgtatttagcagctataaatattctcttagtgaccctttaatactttgtaggcttttttttttttttttgagatagagttttgctcttcttgcccgggctggagtgcaatggcgtgatctcggctcactgcaacctctgcctcctgagttcaagcgattcttctgcctaagcctcctgagtagctgggattacaagcatgcgccaccacgcctggctaatttttgtatttttagtagagacggggtttctccacgttggtcaggctggtctcaaactcctgacctcaggtgatcccccctcctcggcttcccaaagtgctgggattacaggtgtgagccaccacgcctggcctgtaggctcttatagaacgtaggggacaggggatattcccaggagactaaatatctaccttatttcatagaatctaagttgctttgagactgctttcgtggtcttagtagaccatgtcaatgaagggtaatcacacaactacctcacaacaatcacctggttattattattataccacctagcatcacagacatttcaatttcagagaagttaaattatgaataaatgtatatcctggaattgttgaagtagggttttgaaatcactaacagaatttaaaagagatggttacgataatcttgtgttctaattttctatgattatatcagtatggcatgccgagaactttttgattgttttgagtttgcagttgttgtttagttttttgttttgactctagataccacacagtgttccattctcagattcatgcaatggaatttatagtcatcctagagatcattagaattctattatgttaaaaggccattaacttttaatgttgagactctgagaagtgacgttgcatagttcctctgggcaaggaatatgggcagtttttttcttcttctttatgtgtaatcgtgttcagactggagttgtatccatttattcacaatgtccattatgaaaagatttgtgataaaagaaagatgagatatatctacatttaggtcagttaaacacaagaatatttaattatgtccttcctataccctgtaccactaccagttccttacatactccacaagcacagttataatgatagtatttcttcattctcaatgtttcattgcatttaagagagatgggcatattagaactgtgggaataagaaggaagggataatgcagagaccataaccattaccatttttttatattagacctctatttggtttgatttttattttcatgtttattgttttataagaaataagtacatctttcaatatgactccatattgcgtgcaaaataaaatatatgccatttgaaattcttcatggttaatttgaaacttcgagttctcatctccaactaaattatttcttactctgtccatacttgtgccctctttatctcaaatctttttctcaggacattgtgtaagtttctccctttgtgtacccactctttgagtgaggctaatcccaaatcccatctattcaaacttttccagatcccttcatagcaaatacctttattccgctactttccaatggtgagtttctctgttataccccttattggagggtaccttttgttaaggttataggtatttgtcaggttttcctgttagattttggtacgatatatttaggtttatattatctcctgtacagtgcatagtggtggtgcatcatcatacaggtcttcatccttgttatcttcacgttgactaggctgagaaggaggaggaagaggggttagtcttgctgtctccgtggtggcagaggcagaagaggtggaagaggtggaaggggaggcaggagaggcaggcacactcagtgtaacttttattgaaaaacgatccctgtataagtggactcatgctgttcaaacttgtgttattcaagggccctctgtaattttgttagaattactaatatattagagtgttctacatttttcattctcaacattttactgatcattattattatttgagatggggtctcgttatattgcccagactaaagggagtggctattcacaggtgcagtcatagcacactacaaccttggactcctggagtcaagcaatcctcctgcttcagtctgtcgaggtactaggactataggcacacacaaccacacttggctcccattattttctgaaatataaaattatttattttctggttactatctcatagtgtgaaagataagaataattacacagttattacttttctcacagcatccatctaatatattttatagtatatctatattatatctattattcaaattttgataattatacaaccttatttataagaaggagtattttataaataatgcttttttttctttgtaggttacttcctcagaatgttggcctcctgtatgttggaggttatgaaagaccctttgcacaaatcaaggtatgtttgttcattttcagtgtacttttcctggatgttctcttatctggaatccatcaaaaccttgctaataataatcaacatataaaaatatcgtgttccagcactttgggaggctaagacaggtggatcacttgagcccaggaggttgagaccatgctgggaaccctgtctctacaaaaagaaaaattttttgtcattagccaagttcagtggcatgtgcctatagtcccagctactctggaggctgaggtgggaagatcacttaagccccatgagtttgaggctgcagtgagccgtgatcacaccactgtactccagcctgggtgacagagtgagaccctgtctcaaaaaaaaaaaaaaaaaaaaaaagtgaatgtgaggtgataatttcataagcttttgcatatttctgctgaagaaatctttcagcttttcaaaggaattgattattttaatattcttgccatagtaaaattgactttgaccgaaacagttcagtgattcatttagaagagtacatttagagattaatctttgagatcatcccttttgccattaaaaaaatgtttacaagtcgggtacggtggctcatgcctgcactaccagtgctttttgaggccgaggtgggagggtcagggctggaagattgcttgggcccagaagttcgagactagcctgggcaacatagtgaaacctcatctctacaaaatagtaaaaaaaaaaatttcgctggccatggcagttgtcccaggtttttggaaggctgaggcaagaggatcgcctgaacctgggaggtcaaggttgcagtgagccatgatcacaccactgcattccagcctgggtgacagagtgagactctgccttgaaaaacaaaaatgtttttaacagcttttttgagatctaattgaagaacaataaactgtacaatttgataaattatgacatgcttgtagttgtgaaaccatcactgcaatcaagataattaacattcatcacttcagaaagtttccttgtgcccctttgaaatttccccctcctgcccttcctttttttttttttttttcctggtctccaggcaaccagtaatctgatttttgttattatagattaatttgcattttctggagctttatataagtgaaatcatatagtgtatattcacttgttctcttttttgccttcgttcactcagcataattattttgagattcatccacattattgcacttatcgctagtttattattttttgttgccaagtatcaggttggtgtaaaagtaattgtgtttttttgccattagtagtatggctatagcactgtttgattatcctttcacctgctgatgggcatttgcattgtttctagcttggggctattacaaataaagctgctgtgagcatttgtgtacgagttttgcatagacttatgctttcctttctcttgggtaaatatctaggaggggaatggctgggtcacgtggtagttgtattacatttccgtaatgactgagattcttcgtgtactttttttccatctgaatctagtgaaatggatgttcatatcttctctagtgaagtatttcttcaaatcttgttattttaaaattgggttttttgttttcttactgagttttgaacattttttatatcttctggatataagtcctttatcagatttgtgatttgcagttattttctcccagctatcgttgtcttttcatctcttaacagtgtcctcaaagagcagttcttagtattgatgaagttcagttgatttttctttcatggctcatgcttttgttgttgtatctaagaaatattttcctaacccaaagtcacaaagatttttctcgtatgtattctgctagaagttttatacttttaagttatacatttaggtttattgtccatttgaggtaatttttatagaagagtcaagtatggattgatgttctttttttttgtcatcttttttttccagaatgttactctcaaacatatttttttccaagacgtggatatatagatgttccaaaaagcactttcgaaaagaataaagaccttacagctttgttgaaaatcagtttatccatatatgtgtgaatctatttctggactcttccattccattgacctatgtgtttattcctctaccaataaccacactatattgattactgtagctttataacaaatcatgaagtcaagtagtataaatcctccaactttgttctttttctatgttgtttggctaatctaggttcctttcatttccatatgaatttttataatcatcttgtcagtttctataaaaatgcctgttcggattgtgattgggattgtgttgaatgtatagatcagtttgcagagaactgaaattttagcaatatcgaatattccaattcattaaggccacattgctctctagttatttaggtctcccagcaatatttcgttgctttcagtatattggtcttagacattttccaagcaaatttatctattttgtattttttatgctattataaaagttttcttttaaatttttttttactcaccctgacacttgggcaggatttaattttaatttctgattgtttaatggtagttgctagtctgtaaaaagctgattgtttttttttttcttttcatgtattggctttaaactctatgatcttatactcgattattagttcagtagcttttatgtagatttcataggattatctacataaatgattgttctctactaataaggacagttctcctttctgatcttgatgccttttattgcttttccttttttaaaattttcttttttatacagacagggtcttgctctgttggccaggttggtcttgaactcctggcctcaagcaatcctcccgccttggcctcccaaagtagtaggattacaggcatgagccaccacccctggcctgctttttctttattgcactgactaaatcctacaatacagagttgagtagaaatggcaagaacagacatacttgtcttgcttcttatcttagtgggaaagcattatttaatcttttatcaaaaattgtttttatagtaatattagttgagggttggttaattgattccattaagctttgttataagaaatgaaaaaatattagcattcaaggcaatttataaaaaggaaagagttgagacactcagtttttttttgtaactttctgttaatgttttctgagaaacctataattttttttttttttttcttctgagacggagtctcactctgtcacccaggctggagtgcagtggcacaatctcggctcactgcaacctctgcctcccgagttcaagtgattctcctgcctcagcctcccgagtagctgagattacaggctcgcaccaccacgcctggctaattttttgtatttttagtagagctgtggtttcgccatgttggccagactggtcttgaactcctgacctcaggcagtccgcccacttcagcctcccacagtactgggattacaggcatgagccactgcacctggccagaagccaatacatttgttttgtgatttttttgttgttgttacatagttttctgattttttttttcacatttgtttcttggctccatgtgttatttttcttctatccgtttgagagttgtgagttaaaactcctttccacctgcttatatgacatatttttatgttttgaaaaataaggatttttcagagtagactaaggctaaatagaatatgcaagatacttaatactgaagatgttcagtcatcatatcaacatcttttttttgagacagagtctcactctgttacccaggctggagtgcagtggcacaatcacaactcactgcagcttactgcagcgttggcctctcaggctcaggtgatcctctcacctgagtctcccaggtagctggaactacaggtgcatgctacatgcctggctaattttttgtggagatggggtttcaccatgttgtccaggctggtctcaaactcctggactcaaatgatccacccatctcagcctccgaaagtgccgggattacaggtgtgagccaccatgcctggccaccacaatatcaacatttttaaatgaaaaatcttatcttagttaccatagcattagcacctctttaaataactccattaatttaacctaaatctaaacattctctaaagttcatcattaggatcttgaattatggaacctcttgacttttctagttccttaaataatgacaagtattcaagtacatttttgtcttccatttttaatatccctgtaacatgaggggaattggcaagattctcttcataaacccccctcgctatcccattcaccgaattcatcagtatagccaggaatcctaataggtttcagcaggaacatttctgacagctcaatatttttctgtccaatgatttggaaaatcctgtttctctttattagagctgaagtaactaaaaagagagaagcttatctgatatatttcagtaaggagagaattttttgtgtgcatggtgtgagttacatggtgtctcaaaagcacagtctcagagttatgtgtatcagagtggtagttgccctaccacttacctgatttattaacataacattttctttatctgcacatttcctaacaagctcggtgacaaaagtcaatcttttgtcaatcctttatgcctggataatcaatcctgtagaaaaaagttcatgattttagggtgtccttttcttttgatgttgttgtgggaaaggtttctttcattcactgttaaaagattcttatccttattaattgttgaagttctttcataattcctatggctccaccaaattacatgcatattaattagaatgtaagttaatgggataacaattttaaaatcatagttcaaatgtttgacattagattataaaagtaaggttcatttcctatgttggcttgtacctgacttgtgaatatgaaataccagtatttgttatgttcacttttttcccattaagctaaatgtgatgataatatgttgtgtcataaatatgagatataaccttttaaaaatggagactgctttgcttttcttaagaacatattggttgttgatttttaaaattaaatcaggatatgaaattgttcacttgatcatggaggaaaagacattctcattcattaacatcacaggacttaagttcctcagtgtgggtggcttggtgttggaggcagtgtttgctagagatattttacaactatatttctaaaaacgagctccattttataaaggtcagaaagagaaaagaaagaacacaaaaagataatagatatttggccacatgttaaatgaattcagaaatttgctatagcatgccaataagtatctgtacatctgtactgttagtattaaatatataaaatggagcattacaattattcctacagctgaacacacacacactcttccattatttactcatcttttagttttagttttctatctaagccctacataaagatataaatatgtgtaaacttgggacttcagcatagtcttagactggtgcatcttcatgctagtttcagatttcattgtggttaggggaagttatttcaactttttttgaaaaattattactttaataggttttgggaaacaggtggtgtttagttacatagataagttctttagtggtgatttctgaaattttggtggaccccatcaccagagcagtgtacaatgtacccaatgtgtagtcttttatccctcaccctcatcccacacttccccctgagtccccagagtccattatatcattcttatggctttgcattctcacagcttagctcctacttatgagtgagaacatacagtgtttggttttccattcctgagttacttcacttagaataatggtctccaacttcatccaggttgctgcaaatgccattattttgttcctttttatagctgagtagtatttcatcatatacatatatatggagcattacatttatacatatatgtgtatacatttatatatatgtgtatatatatgtgtatacatttatatatatgtgtgtgtgtgtgtatatatagtgtgtgtgtgtatatatatatatatgtatatacattttctcctactctgtgggttgtctgttaattctgttgattatttcttttgttgtacagaaactttttagtttaattaagttccttctgtttatttttgtttttgttgcatttgcttttgggttcctggtcatgaactctacctaaaccaatgtctagaagagtttttccagtgttattttttagaatgtttatggtttcaggtcttaaatttaagtctttaatctgtcttgagttgatttttttataaggtgagagaagaggatccagtttcatttttctacctgtggcttgccaattatcccagcactgtttgttgaattaggtgaatctcagcactttttcccactctgttttcatttgttttgtcaaagatcagttggcagtaagtatgtggcgttatttctaggttctctgttctgttccattggtctacctgcctgtttttataccaggaccatgctgttttggcaactatatccttgtagtatagtttgccgttgggtaatgtgatgcctccagatttgttgtttttgcttaggcttgctttggctttgcaggctcttttttttattccatatgacttttaggattggcttttctagttctgtgaagaatgatgatggtatttttatgggaattgcattgaatttatagattgcttttggcagtgtggtcattttcacagtattgattctactcatccatgatcatgggatgtgtttccatttgtttttgtcatgtgtgatttctttcagcaatgttttgtagttttccttgtagaggtctttcacctcctttgttaggtatattcctaagtattttattttatttgcagctgttttaaaagggttgacttctttatttgattctcagcttggtcactgttggtgtatagcagtgctactgatttgtgtacattagttttgtatcctgaaactttactgaattcatttatcagatctaggagctttttggataagtctttagggttttctaggtatacaatcatatcatcagcaaaaagtgacagtttgacttcctctttactgatttggatgccctttatttatttcccatgtctgattgccctggctaggacttccattactgtaatgaatagaagtggtgaaagtgggcatcattgtcttattccagttctcagggggaatgttttcaacttttccctgttcagtataatgttggctgtgggtttgtcattgatggcttttagtacctgaaggtgtagcaggaacagtcacagacaaaacctcttagacaccggttctatgaaggaagaggctttaatcagctgggagcattggtagactcgcgtctcaagatccgagctccccaaagtaaagattcctgtcccttttaagagcttacaactctgaggggtccacgtgaaagggtcatgatacattgtgcaagtgggggctacatgactgagagctacatgcatcagtgatgggggctagcagaacagaacagaaagtttcacaagtcttcctcatacaatatctggaatctatggatagcacaagcggttaggtcaggagttgatgtttaactaccaggcctggttcttggcactaaaccatctggccattgatctcacttctgcttctttttttaactttttgctttctcatgaaacaggagacaatgggagaggtggtctccttccttattccccccttttagaatctcacttattagtgggaattttcactttcatcctcactatctaggtctttttgcgagacagaccgatagtgattcatgtaatacacttgtgctgaactattttggtgaattaaagtagtgacaaagcttctcattatttgaaggagcaaaggcagcaagcaggggagcaacaagcaggttcctaatactgttattactcctattataagagttttaaatcctaatgctgggaaccattttccaaatacagacccaggatcaaatccatgccaaacctgcacaggcatatgtgctagctttgtcatgtctctgacgatgttttcgactacttggccttggtcatctatatgcagacagcaattggtcaggttgaattttccacagacccctctttccactgctagcaagtagtctagggccaatctattttgataaatagcatttcttatctgggtttcttgccgggctaacagtcaaagttctgccagtttcattagtgattatttctaagacagcttggaaccatataatccagttgagcatgtaaatgggggtttggtatccccacgaaccatcttgtgcccagttggcaggcccatagtactatatgattctttcacgggaccactcatcatctttccaattgcctatggctatgcttctgttttctcaggaagcatagacagggaagcctaggagctcatcacctgtttttatgggcagcaggaaaaaggatggcttaatggtgccaatgacacaactgcctgcccattgatcaggtagcttggcataggctctatgtccacatatccagtatagtctagctggagccgtccagtcccggtgagactctggatgggcccaaacagtttgcaacttagtaaacttactaaatgggttcttctcaatatggtttagaccccaccaggtgactgttcttcttgtgccgttatacagcttttgccctaggcaattgagcttcctacggggatggtgaagtcttttccttctctagctaagcagtattgcccaataattgaggtttttaagacccaaaagttaccagtgtgggccttctggactggaattatatcaggaactggatccatgggcactaattctcgggcctcccaaggccattggtctcccatagtagttcccctgcatacataacaggaagtaatgttgagggaatgggctatattttctgctaactgcaggaacaaatcttttgtcttccctggcagttctggtattggcacatttagttcatcataaaaggtctggaacactggtttgggggagcgcttgtggatctccccttggattaaaaggttgactcgggggtcaagcccagttccatcaattcctaggtttacattttctcctgtcttccagtggggatcctgggggttagtaattattaattctaatgggttacagttaccggaggtgcaagatgaattactttttcctttttgtaggcaaacagggtctttttcatcctttttccaggtggcccaaatgacataggaccaataactacattcaataataccatatagtcctaattcatgacaaatgtacttattttctgccatatatagctttttttttcaccccgactgagagaaccacatcccatccctagcttgttactattaatgactgcacaggcatcaaatcttaaggtgacttgtttgggagctcctttttcttctgttctggtattactttacttgtatctttcatgagtccccaccagtcctcagttcttaatcttatttcaaaaactgtggtcataggaggctcagacaggttgtaagacacatgaggttggtcattccctgggctacacacattatactgagtggcattatataagcagatccctttcaaaattcctagacattcataataactataaaacagaaaggttattttaacttgttgccctacctctgtaacctgatgaatacactgggtacagtcctccatgtggggaaaatcagctgaagttcttattgaacaagtccaaattttgagaaaaatgagtcccacgatgagtttccttatgctttggctgtgcatagaccagtcagcttccaggtgtgactggagcagggcttgttgtctttttcagagtcactttgtagggattgtccgggcttggtctcacctcccaggtctcaggtgctgtgggtttcacgtggctgtggtggatccaggccggaattccttctaccttcatggtggtgggagtggtcaggatgatggtctggcatcctttccaccgtggccacaaaggggctatgttccagtctttgatccacactcgatcacctggggagaaagggtaaactggggagaataagctaatggggcatctctcatttacccaagctgaaattgtttgtgtaactttttctaaagcctgtagctgtcattgcagctcaatttctcctagctcctgaggagtgcctggaagtcctcgtaatatgggagggggtctatgatacaatatctcataaggggaatatcctgttcttttagaaggagtacacctgattttaaacaatactgtggggagagcctgtacccatttcttgacacactttccctaagcctaatcctgtttcttgacacactttccctaagctattttttatagtccgattcattcactccacctttccggaactccaaggttggtagttggcatgcagtttccatgtgatccccaatacctttgccgtcttctgtaccaagtcagccacaaatgccggcccattgtctgagccaatccgtaagggcagtccaaacctagggatgagatctcgaagaagcacacgggttacttcacgagctttctcagttcgtgttggataagcctctacccacccagagtatgtacacactagaaccagcagatacttgttacctccacatttgggcatctcggtgaagtctacttggagatcttcaaagggggctgctccataagcttgtatgctgagcgggatggttggaccctgcctagcattttgctgctggcaggtgacacattgctgttactgttttggcaagggccgacaagacatgaaatgtagaagtgccagcctaacaacttttcaagtgactcttggcctagatgggtggtctcatgcacagccagcacaactgtggcccctagtagctgtggcatggctactcttctgtctggtaaccagatccatccttcctttatcacttgccccccttctgccttgaaaaagtctctttcctctttagaataagtaggcactagatgcggtgcctgagagagcagaggggccgtgactgatgctcggaagggagtggatgctgctctgcgagcttaggagtctgctccagaattccctaaggcaacagaagtggtgactcactgatgtcctttacaatgcattactgccaccctccgaggcttccatactgcttctaataactgtaaaatttcttgctgatactaaatgtcctttccccctgagttcaataggcctttttctttgtataatgccccatgcacttggagggttaaaaaggcataccgagagtcagtataaatgtttacagtcttaccttcacttagctctaaggcctgagttaaagcaatgagttcggccttctgggctgaagttccctgaggcagcgatttggcttcaataacagtgtccaaggtttaccactgcatatccagcggacatctctctctgtgggttaatgaagctgcttccgtccacatacagctcccagtctacagacatccaaggtttgtcccggaggtccggtctgctagaataaacttagtccaacacctctacacagttatgttcaactgggctctctgataccagaagcagtggcggggttcattgttacaaacttcagtggttatatggggattttcacagagcaggctttggtacttggttagtctggcatttgtcagccagtgatgtcctttggtattcattaaagtcaccactgcatgaggggcctttatgtttaagttttgcctaagagttagtttatccacttcttgtgttagcagggcagttggtgctaagaccctcaaacacgggggccaacctttagaaactctgtctagctgtttagagaggtaggccacaggcctcagccacggccttacgtcttgggttaaaactccgactgctattttttttctttctgacacatacaatgtaaatggctttgtcaggtcaggtagacccagggctggggctgacatgagtttttcttttaactcatgaaaagcctgttgctgttgggacccccattcaaatggttccatgtcacccccctttgtaacttggtaccagaggtttggccagtactgcaaaatttgggatccataacctgcagaaccccacagctcctaataattctctcaactgccttctggtcttaggctccagtaggttgcaaatgacctgctttctttctgatcctaggctgcactcccgctgtcggatagtaaatcccaggtagcgtacctgctgtctgcagatctgagctttcttcttggacaccttatacccatagtcctccaggtgctgaagcagggcgtctgttcctttgacgcacccgactgccatggggcgtcccagcaggaggttgtcgatgtactggaacaacacgcagcctaggtctctggcaggaaacttttggaggtctcgagccagtgcctccccaaagatggtgggggaagttcttgaacccctggggaagccgggtccaagtgtaatgagtggtgacacctgaccccggatcctcccactgaaaggcaaacagtttctggctctctggagctaatctgatgctaaagaaggcgtccttcaggtctaggcaggtgaaccagctgtccttagctggcaataaccccaacaatgtgtacgggttaggtactgttggatggaaagtcactgtggcttgattgaccaatcgcaagtcctgtactggcctgtagtccttggtccctggcttgggaacaggtaggaggggggtgttccatggagactgacaaggcactataattccaaaagtcctcaggtgcttaagatgaacctggataccttccagggcttctctggggactggatactggttttgcctgactggctgggcctctggcttaacttccctgagtacaggagcttgattgactgccaatccaggagggttgtcttctgcgcatacttttggccaccactgggccagagctggccctatctctttgcctggtttggttaggaagagtcgctactcttcctctcggggaactgtcagggccatgataactcctgttccaggcaacttcagttgtaaagagccttgcttggtaaaggaagatagctctcagcttgctaagcaggtcccttcctaacaaaggcaaggggcagtcagggatgtacaggaactggtgaatcacttcatgtccccccaccgagcaggtccggggcaaacagaaagcctgctttgtcaaaactcctgttgctccaattatatcaatagcctttttagacaagggggcgaccggggtggtcactactgaatgttcagcaccagtattgaccagaaacttaatgtccttgcccccaactgtcattctgaccatgggctccttgggggcacgtgagcctggtccccttcggtccaataacccctcagccagattgaacaaggctccttcgtccttgtctggggtcttttgctctgaaccaccttgcttttctttcagctgagggcacttatctttccaatgtcctgtctctttacaataggcgcactggttacgttgcaagcgtggacggtcagactgggtatttttcctggagcccccattcccttgtcctttcagggggacccctctaatagctgcagctagtaggtcagcatttcaccgggttggcattcaccttctttgcggctctctctgcggcttgctgcatctgtatttacaaacacttggttggctatttccagtaattggcgacgtattcatacctgcaaacccagcccgtttcttcagctttctcctaatatcctctgcgctttgactaactaaggccatgttaatcatgcgctgattttcagggctgtctgggtcaaagggagtgtacatgcgataggcctcacacagtctctcataaaattgcactggactttcttgctttccttggataacctcggagaccttgtttacgtttgtggccttttgggctcctctcctcaacccttctaagagtgcttccctataccgcattagcctttgcataccctctgtctcgtttggatcctattaagggtcagttcctggtagctggatcctcacatactcttgggggttctgataatcagctggaacatgctcttccagccacttagttgctacctcgagcactctcctccctcatccgtgttaaagaggtacatgagcaactggtggcaatcagcccaagtggggttatgagtttggataatagtttggagcaagtcaatcagagcttgcagcttttctgtataggatgggatgttatttttccagttgaggagatcggcagaggtaaaaggttggtacacaaaggcacccctaccatatgcccctcctcatttaccccagtataccgttgctctcttaggggcatttgtgtcccagttttaggttgcaagcaagctgccaagggaggggtttctcccaagcttcatatcctcttttgtctattttaggtggccttggggtgtgcacaccttgcagaggctcaggggctgtgggcttcgatgtggggagcctctcttcttggtaaggaggggcaccattggtgccatttctgccatgcatcctctgatgtggggtcggacagaaccgtaggagctgacttccctcggcgggtggagcaagacttttccttggctatctgtccctttgctactagtactgctgcagcctgtcctcttagccactgtgaggggtctaaaactagctgcaaccaagtatctatgtatggtaactggtctgggtgtcctgatttatcagttactttgtgccatacctttgaaactagggacctgtctaggcttccttctgatggccatctcacctctaatgctggatagtctatctcacataaagccttaagctttccaggtgtcatagcaattccatagtccccattgaatcctttcttgaaattctttaacatagttcctaacagggtaggcttactttgtattttacacattttcctctctcaggagacaaaacaacactcttaccacaaagggggaagggaaaaaggggcaaaaggtcactcactcaccaagcaattcacactaaaatcaaagtatggataaggaattactcattcatcaagcagtttgagccaagtcagagccgaaatcatagccagaacagttcaaatccaaaagtcaatagtgaaatctaaaccaaaacagttcaaatctagtcaaaatgaaaaccaaaaccaaagtgccaagaaagccatgctgtgggtgatcagcccacacttccactcagatggagtgggcaagttccaaggccagtcttaccatgttccagatgtccagactccaatcgccgattccttcccggtgttcaaccgctgtgttaattctccacgggggtctgccgcacactgctgtggcaaggcatttgaccagggcaattgcctacgcgagagtgctcccaggatctgctttgcttaagctcgccggagtcctccccagggatgctccacagggcaggcctaagccgcctaagaggctgcctcaactgtccactaatcacctcgcttccaggtcagggaaccaagaaatgtagcaggaatggttgcagacaaaacctctcggacactggttttatgaaggaagaggctttaatcagctgggagcattggtagactcgcatctcatgatctgagctccccaaagtaaagattcctgtcccttttaagggcttacaactctgaggggtccatgtgaaagggtcatgatacattgtgcaagtgggggctacgtgactgagagctacatgcatcagtgatgggggctagcagaacagaacagaaagtttcacaagtcttcctcatacaatgtctggaatccacaagcggttaggtcaggagttgatgtttaactaccaggcacggttcttggcaccaagccatctggctattgatctcacttcttcttttaaccttttgctttctcatgaaataggagacaatgggagaggtggtctacttccttaaaggtgtgtttcctctatgccgattttgcctagggttgtaatcacaaggaatgctagattttgtcaaatgctttttctggatccattgatatggtttttgtttttaattctgtttatgtggtgtatcacatttattaacttgcatatgttaaaccaaccctgcatctctggtatgaaagccacttgaaagtgatgtattaccttttaaatatgctgttggattcagttacacagtattttgttgaggattttttgcatctgtgttcatcagagatattggtctatagttttcttttttgttatgtccttccctggttttaatattagggcaataatggtttcagggaatgatttagggaggattccctctttatcttttggaatagtttcagtaggattggtaccaactctttgaatatgtgatagaatttagctgtgaatccatctggtcctggactttttttgttggcaattttttttattactatatcaatctcactacttgttattggtctgttcagagtttctgtttcttcctggtttaatctaggagggttgtatatttccaggaatttatccctctcctctaggttttctagtttgtgtgcctgaagttattcatagtagcattgaatgatttttttgtatttctgtggtatcagttgtagtatctcccatttcatttctacttgagcttgtttgattcttctctctttcttcttttttggttaatctcactaacggtctgtcaattttttttaaccttttcaaggaaccagcatttcgttttatttatcttttgtattgctttttgtttgtttcaatttcgtttagttctgctctgatctttgttatttcttttctgcagggtttgggtttggtttgttgttgtttctctagtttcttggggtgcgagtttagattgtctgtttgtgctctttcagactttttgatgtaggcgtttaatgctatgaactttcctcttagtaccgcttttgctgtatcccagaggttttgataggttgtgtcactatcatcattcaattcaaagaactttttaatttccatcttgatttcattgttgacccaaagatcattcaggagtagataatttaatttctatgtatttgtatggtttggagggttccttttggagttaattttcaattttattccactgtggtctgagaaagtacttgatataatttcagttatcttaaatttattgagacttgttttgtgacctatcttatggtctgtcttggagaatgttacatgtgctgatgaaaagaatgtatattctgcagttgttgggtagaatgttgtgtaaatatctgttaagtccatttgttctagggtatagtttaagtccattgtttctttgttgactttctgtcttgatgacctgtccagtgctgtcaatggagtattgaagtcccccactattatggtgttgccatctatctcatttcttaggtctagtagtaattgttgtataaatttgggagctccagtgctaggtgcatgtatttaggattgtgatattttcctgttggagactaatccttttatcattgtataatgtctctccttttctttctttttttttaccattgttgctttaaagtctgttttgtctaatataagaatagccactcctgctcacttttggtgttcatttgcatggaatatcttttttcacctctttacctggagtttatttgagtccttatgtgttagttgagtctcttgaagacaacagataggatacttggttggtggatttttatccattctgctattctgtatcttttaagtggagcattttggccatttacattcaatgttagtactgagatgtgaggtactgttctattcatcatgctagttgttgcctgaataccttgggcttttgttttgttttcattgtgttgttttataggccctgtgagatttatgctttaaggaggttctattttggtgcatttcgaggttttaagatttagaacttttttagcatttcttgtagtgctggcttagtagtggcaaattatctcagcatttgtttgtctaaaacagactatctcgccttcatttatgaagcttaattttgctggatacaaacttttttcctgacagttattttgtttcaggagagtaaagataggaccccaatgcctgctggtttgtaaggtttctgctgagaaatgagctgttaatctgataggttttcctttataggttacctgatgcttttgtctcatagctgttaagattatttcctttatcttgactttagataacctgatgactatgtgcctaggcaatcatctttttgtgatgaacttcccgggtgttctttgagcatcctgtatttggatgtctagatctctagcaagaccagggaagtttttattgactattccctcaaataagttttctaaatttctagatttctcttcttcctcaggaacaccagttattcttatgtttggtcattttaacataatcccaaatttcttggaggctttgttcattttttttttttaattctttttctctttgtctttgtctgattgggttaattcaaaagcctgtcttcaagctctgaaattctttcttctacttgttctagtctattgttgaaactttccagtgtattttgcatttctctaagtgtgtcttttacttccagaagttgtaattgtcctttctttgtggtacctatttctgtggagactttttcaaccatatcctgtatttttaaaaaatttctttaagttgatttttacctttctctggtacctccttgagtagcttaataatcaaccttctaaattctttatcagacaattcagatttcttcttggcttggatccattgctggggagctagtgtgatctttagtgggtgttataagaaccttgtttcatcataccagaatcacttttttggttccttctcatttgagtagactgtttcagtggatagatctggacttcaagggctgctgttcagattcttttatcccacagagtaatcccttgatgtgttgctctccccctgtatgtcagggttctctagatggacagaactcataggatagatgtatatatgaaggggagtttattaggagaattgactcacacgatcacagtgaagtcccacaataggccgtctgcaagctgaggaaccaggaagccagtctgagttctaaaacctcaaaagtagggaagctgacagtgcagccttcagtctgtggccgaaggcccgagagcccctgacaaatcactggtgtaagtccaagagtctaaaagctgaagaatctgggagtctgatgtttgagggcaggaagcatccagcacaggagaaacatggaggccagaagacttagcctgtctagtctttccatgttcctctgcctgcttttattctggttgtgctggcagctgattagattgtgcccacttgaattgagggtaggtctgcctttcccagtccacagactcaaatgttaatgtcctttggcaacaccttcacagatacacccaggaacaatactttgcatccttcaatccaatcaagttgacactcaatattaaccatcacaccatcatccccaagggattgggcttcctgagagccagattgcaatgattactattgcccttctaggtctagccacccagcggggctacctggcccctggctagtgctggggagtgtctacaaagagtcctgtgatgtgaaccatcttcagatcttccagctgtggataccagcacctgccccggtgaaggtgacaggggactgaagtgaactctgtaggaatcattggttgttgttttgtttagtgtgctggttttcttgaatgtggttatgctagtggtgacgttgtcatatggacagactctggacttctggttggccaaggtgttgcaggtggtggaattagctgttgttttctgcttcctcagtacaggattgttctgctatgagctgctgtaatggcttgagttggctggcctccagacaggaggtggcgctttcaagagaccagctgtggtagtaggaggggaatataatcttgccctacattggccaggataagtacttgggtttctcaggtgatcgcggggtcatagaggtcccaagagtttatgtcttttgtctttgcctaccagggcgggtagagaaaaaccatcaggtggggcaggattgggcagatctgagctcagactctccttgagcagggcttaatgcagacactgtgggacatagcaggtgattcttaggccagtggatttatgttccaaggggaattatggctgcctctgctgcatcatacaggtcaccaggcaagtggggaaagctggcagtgacaggctttatccagttcccatgcagccagcaatgccagtcttcctcccactgtgccccaccgacagcaccaagtttatattcatggagcgggaagcagaactgagatcttgacccaagctacaagtctctccactgagaaagcaagcagggctctcaggcctcgccccttcccacctgcctgcaccatcagctgcagtttctgtgctcatatctgtattttccatttgcctccccaccccctgattctgtttaggaaaacttgtgctcatttgaaattattacagagttcatctaggagcttctttcactctgtggctccttcccaattctgctggctgccttccccaaggacctctctcagataaggctaacaatggcttccctgggctcaagctggagaccaggagtgcctacagggctcttcctgctgcttcttctactttagtattttcctcagctctctaaatccatttcagctctaagtgaggttaaatccttctcccatgatctggattttcaggttttccagtggggatatatgttcagaagcagacttttcccctgtcatactttgggaactcacagttttttggctgtctcatggagtttgcagcagcaagccacttctttcaaagggtctgtgacttcttttggttttcctggtatgtttctttggtggttcttgaagcaagagttcacagtgtgagtcttcacacactgttctgttcatccaagtgggagatacacataagtcctgtctcctagccaccattttctgcagctcagcctctcgagtagctgggattacaggcatgttgccaccatgttcagctaatttttaaattttttatagagatgaggtctcacattgttgcccaggctggtctggaactcctgggctcaagcaagtctcctgcctcagcctcccaaagtgttgggattacagatatgagccactgtgcctggccttcctcaacttactttttttttttttttaatctcttaacatcttcagtaagtcatggggaaggttctttttcaaagaagctcagtcctcaactttcacccaaggcagagactctactcccagatgactgacccctttcaaaatcctgtgaaaaccatgaaccctctccctagaaaagtttacatacatagacatacttttgcttataatttcagaggtttcatgaaccccactggagtgcattcaaggaccccaaattgtgaaccataataagtgaataaaatgttctctcaagttttctattaaccaaagagatactagattcataaaaaattaagttttcagagaaaattttttatttgaacttgattttaaacatgcttgattatcctcttgtttatcctaaaatataagctacataaaacaccaatcattttataatgagtggtaacatggagtaagaaaggacatgcttaacatatccacaactgtagttttatactataaatgaagcagatttcatcctcatccaagacggtaactcctttgactttattgagattaaatttctaaatgtactgggatgtatgccacttaggattttattaagtaagcgatatagttcattatacctttatatgcagtctttgaaattaaaaagggaagtttttcagaagtcctttatgtgaggattggggactgggtatttctatatatcttttcataatacctttatcttaatatatatattctatttttcacatcttatttttgtagatatgttctagtttaatagtttacattttacaccagttactctgtgttgttttctagagcatgtcaaagtctagtaaaaatcttaatgctaattctttaggtttctcattatgaaagcttcacttaccagccagaatccataaaaaccaagaaggattgaagcctctcaagatcacatttaatcagccaaagggttgttaatggagagacacaaagctacagggccatctcttgatattagttgtcttttccagttctgatagtccaagaattgtgagtggctgtaaggctgagtcagacccaagtttccactttgacactgcagaaaggcttgaaaaaagtcttctatattttaagtaggaattttttgcagcaaccatatgtggaaagtaaggactataaccattatatgggatttttttttaaggcagttatttttcagtcagtacagcaacattattccctgcctcagtctggttctgtccctgctgagtaactgggtgccattagtcacagtcagatactctaagctttctgaacttgaattttaaaaaatctctaccaccaaggaaacgtaagagtgatgtttgtattcgtgtgcatatgcaatagatgcaaagaaatacttatctcttcatttttgaagtcaaaattgaaaatctatcaaaccatccacttggacatcatttctattttttttaaagtagcatatttttcctttaaggtatttcaagctcagattgttatttgatatgttaaaaatatttttaagattattaacaagtaaatgttaatatttagcctaaattaaatttaagagtaaagtatttatttggaatctttctattataaaagactgaaatatgctaggaaacctattagtaatgatttggtttgtttgctgactgatgatcttttagaaaatatctggcttattagatcaatacttatttttactaaaagaaactaacgttcatattttaaacctctaaaatatctgaagaataactgaatgttctagttcgatgacttccaaacttttgttcataacctgcacaaaatatatttccttcaggttctagtatatgcacacatacgtgtatttatatacatgtaatgtgagctgaagtttcaaaatatgtgtgatgccattttgttttgtttctttttcttttgatttagtttttagatgctggtctcaacccactaaattaatttctgtattggaaaatgggtcacgactcacagtttggcaaacactgcttcagggtaggacttgtccagctaatgctgccatatgcttctggcaggagagtgccacattttgtgatacagatgatagggaggaggcttacctgtccctgaactcatgattaccctcagaatgtctttggaggggaagaaaaagatgagatctcatagttactgggaagagggaggaaggaaaagatgaatgagaaatgaatttaaatgttttatggagccaagtaaaaccattttctgtttcaaaagtacgaattctcaagaacagaggggagccttgcacatctactctgtctcccaagtgatttcatgttttttgaggatagagaaagaaataaaggtaagatcttccttagatgaaaaaattagaaagaaaaggaggtaggtgaaaacttgagagaaaggaatgaaatcaggtctagatctgtgtgacatagtcgttgaataatggctaaattttctgtaatactcttaatgatgaggaaaattttcagtgtttcatattacagtaataaaagatgaagtatttatccctttgttgaaaatagcttcaaaaagtaaacgaaggttaaaggaaaaccttatggatactaaattctccctacttccatgcaatagctattaagttgctgacagagcattttgggattactgctgagtgtcgagcaaccctacactgtaactttctggatgttaaaaatcatgcagtgattactaacgagtcatacagtagttgtagataaaagttctaaaagatagtctataatggttgttctcctacccaggtgcttttggtagcattattgacaaaacagaatgccacataagtcctaaaatacacacgtttcaatctcaatattatctttatgtccttagacaacttatcaaaagactaagccctatgaggctgagctgtttcttgtccacttctgtatcctcagcatttagcccagttgctggtatatgaaagcactaataaatatttcttaacattataattgaagaatgactggaaagccaagtgggctttgttttttgttttctgttgtttttaacattaagtatataccatggagttcatcaaactatttaaaagctctggttctaattacatacatatttactgcattgaaaattttaatttctaatctctgttacatcttgggcttagtatatctttgtggcaatataaatcaattttattttctaatttaaattgtggttgtaagttattattaacatcaactttatttggaatgtagattttgtgaatacattcttctgagaacactttaaatatagccctcaaattgtttttcaattaagaaatttagcatttttcttagctggaaatttcgatgacttttgagctagacattttgtagaaaactgtgggaaatattttggcatattctagtgttttttaaaacattataccactatattaaggtgagttcttgttaaacatggcttgaacaaagaataaacaattttattttgtatctttgaaaagttttccaaaaaaggaaatgcaatactttacctacttaggtatttacagtgcagtcagtggacctcctattttgatgaaaggaactagcatggtacttcttatcctgttgttttctttaaccagtattttgcttctaaaaagaagtagttctcttacttgaatttcagagacactaataaccatgtaaatataaaagattatgtaaaaatccctattgctgaagtcatgtctgataaataatgccacagtttcggatctagattcatattaaatgtctagaagttatgcattttacttattacagaaaggagaaaaatcattccttcagcgaatactaatccattataaaagagtgttctcttgtcctcttgcctaataaagtctcaaaaaacaaaataactctccctccatccttaccctaaatgcaggcacaacagtaaagacccatttcaagtggtgtgtggttgtaattcatgcatttaggaaagctccagacctgcgcttgttttggttgactcttcttacaacatgcacattgtgaacaaccccaagcaaaacaagacccattttcctgataattctctctccgcctccaccccaaagagcactaacaaactccaagtctagatcatagaaatccacacgttccccaaatttgtaataggaagtattaacttggtatgtgagcaccttcagaagtttgagattgctgctgtaagtgacatcttgtcattaatgttgtggtgtgtggattggagggatctttaattttctaaaacaggaataaagagatgtattccagtaaatctaataatctcttaaaatagttttttttctaaattgtgaactaaatatttgtcttctccatgtcctcaaattttattatctacagaattaattgcctataaataaaatgacaagtttgcagttcagaagatttgcaaactatgctaaatgcaatgaagtatgagatttggagaaacttgtaaatttgtaacattgaaaatagaagtcagcattaagttaccatttggatattgacagttttactaaaatatgttaaatatttaactgtatatttaaattatttttacagtgtcacaagatcagagcatttccagtactcaggaaatagcttcacaagtgatcattcatctgctaaaataatatgttgcttctgattagttgactcagttaataatagtgaaaaattataagatatttaagttttttgctgagatttaagtttggtaatttgcaaaatattaacagtgaacacacattttatttacatgtatatatacatatttacatacatactcttttaaaaattaatctatccaccgcctatgtgcacagacataaaatgacattttaggttgtttgatgatccataatttcttcttaatagattttagtattttacatcagatttgctttctaagtgttattagccagtaaaagcaattatctagtggaaatttggtttaaaataaaaatttgggggggcaagaaggctgaaacatagggaaatgaataatataaaaggatatttaaatttaatgtatttatatatagtaatttttacatcttattgtgaaatgttacaaccatattgatatatttttggaaatctgatcctttttttctttgtcagcattttataactttaatatgaaaaagaaaaacaggataatttatttgtttaaagccaaaaacatgaataattatgtttttaacttttaaagttagtgcttttatcaaatagaaaaatagccaacatttgttgagtattatatgcccagcaggcactattctaattaattctcaaacaacctgtaaaagtgtaggtactttaaacattccagttacagatggggaagatgacaacatagttacattatgttgccttgtatgcagagttatttttctgtatactattttgaagtaattagttactgtttctattgcattattgtcatatatagtatattattatagttcttgaaccctttctgagttctgcttgtatgccaaaattatcctagtccactgactggactaagtgacttgaccaaagggatgtggttttaacgacaaagaccaaaatagagaatcgttgtgttgttgttgttgttttttttttaacataaaaagagatgggagtataaagagagctcaaagttataatctcacctctgctgctcatttagtcatgttgagtgtttatcttccttagttgttaatagcaaaagctgagaattcttgcattgggaataattgtgaatctctgagatattaaagggcttcttattataatattatctgatatcactatgaagtattttctgttcccagagcatcctgtttggaagtttactatgtcatgtatttctcctacctgtcatttttagaagggtcagccctacttgttgtttttcttttacttttagttgattacttcttcatgtccacaagatttgggtaacagtattatatagttattaatttgaaatagtctctagaagtctattttatttctttaagaactagctggtaggagatcacttatgtaaataaatcacctatgcattttgagtgccctgattagctcagaaagataaagataatatctcattttcacgattttttttcaagtaggttttgccatcacgctagattcagtgaaaacagtttctcatttttttgcccaaagttgagtatgccttgtgtgagcatagctggaattaaaacattctaatgtttttcaagatcagtctttcttggaggcattttgatgactcagggctgatttcagctgcaaaaagaattgtagcagaattgcagggagaaggaacagatgtttttaagtttcggaatgagtaggttggttgcatagcacatggttaattgggtgatgtaaaaggcagtgactgtgagaataatcaagaaaaggttcccagggtggttatagtttagcaaaagaatgaatgaagtaaagtaacatgcacgtaatataggtcattagatgtcactaaatggagatatgcagagaggaatagccacacaaggaaaaagtagaaattatattagtgaggaaaagttactattagtgatgaactcttccatgctattccgtgcaggctcccagacccttttaggagtcattcttatccataataagtaaaaatcttaagcaaagtctgacaatgattttcaggtgcttttactggtttgaacgatctaatcagtaaaatcatgaaaaattatagtttgggagaaaaaaagtaaagacaattctgttcatttgaattctattcattcgtgttagagtactaggaatacccttacttggtccactctccttgaggcctggtctctccttcagtcagcactgttggccaggacagttaacatccacctcttctgaatgccctgggctgggtccacatcactttcctcctgaaaaccttacactctatagtctttattttgggtatcttgatactctagcacaaattcattctcctatttatggcttttagaacctttttttttttgagacttagtctcgctctttcacccaggcgggagtgcagtggcgcgatctcggctcactgcaagctccacctcccgggttcacgccattctcctgcctcagcctcccgagtagctgggactacaggtgcccgccaccacgcccagctaattttttgtatttttattaaagacgtggtttcaccgtgttagccaggctggtctcgatctcctgacctcgtgatccaccgcctcggcctcccaaagtgctgggattacaggcgtgagccaccgcgcccggctagaacctttttatgctgcattaattcgattttggccacttttacattaaaatgaactgttgcccactgtagcaaacataaattcctttcatcatgttttcccctcccatcatacccttattttacctaacacccacttctgtctaatgcatgaaatgtgtttacagtccctctttctgtgactatacatactattttcttgtctgttacatgtctcaaaatttacctgctagtcaaaaacaaacatacaaacattaaatatacagtaagtcctcacttaacatcgatgataggttcttggaaactgtgactttaagagaaatgacatataacaaagccaagtttttttccttgcccacattttaacaaaatgatgttattcaaggacctgctgtacattgctttgcttaaggtcgcagtttccaagaacctattgatggtaagttaggacttactgcatatgtacaagacactttggtggagactgggcatataaagattagtaacattttatctgccttcaacttactcatagctgatttacaaagaaatcgctctgtaaaaaggtaattataacacaaagttggatgtgatgtgtcagatgcctagaattggttataaatgtcaaaagctgaggaaaacctgtggactgaggcagttgaggtaggattcacaaaggaagcaagaactgttttgcactaccaattaggagaatggtaggttgtgagtgaatgcatgcatgcgtgtttttatctttctctgcctctgtagaaataaaaggatggacagataatttaggaaaatagaaagcaaagtgtggagctttgttcgcctggggtacaagaggcatagttgggtaggtgcagaggtttgtatagggagataataggatgtgaagaggtaaattggtgttagaattttttattattattattattattattataatactttaagttttagggtacatgtgcacaatgtgcaagtttgttacatatgtatacatgtgccatgttggtgtactgcatccattaactcgtcatttaatatgttgacaacaatgcagactgccataagaatttctaaattaatattgggggtactgatattttcttggtaattcataccaataattcagatggcttctttaggccccagcttaaaaaactagtaataaatggtcattgccatggatgataacagaagggtcctggattcctaagtcttacagtcttactacctgtcaggtagcaaaatatttttatatcttcttcacattatttgaagtaatggttcctaagagaaagaaatggaactcatataaaaatagttgaagttagtgtttctgtttgttgtttctgatgttctgttactgctcaagttgagctattatttgtgacaggaagtgaatgcaaacgtagagatcctttcttaatgtgactgattatatctttgaatctgacaggtcaagccatggaagattcttcttttccgtagttgttatttcaggtattttcatcgttgttttgtgtcttaagagtttaaaatcaagcctaagtctgttagacttacttttcataagaggatttgattcaggaaaaatagaacagattgattggttaagtttgttcagggcatgtttttcgttccctcccctcctccctctctcccttcctcccttccttcttttcttcttcttctttttttttttttttttaacagggtgtcggttctgtcacccaggctggagtgcaggtacaatcactgcagcctcaaactttcaggctcaagtgatcctcctacctcagcctcctgagtagctgggactacaggtgcatgccaccatgcccagctaatttttatagagacaggacctccctatgttgcccaggctggtctcaaattcctggcttcaagtgtcacctgtcttggcctcccaaagtgctggcattacaggcatgagccactgtacccatcttgttcagtacatattttcattgtgaaagagaaatcagatcattgcacccttttccccattgaagatggtaattaccctttgttattacattcacagctttttcagaaacttcacaattttgaaaacatagcatcaagagtttgtgttgaaaataaataattattatttataaactataagtaacatataaatctaaaagtcgagcttctgtagcatactattaccattaaacacttctttcagtgtgtctccatgttaatctggaagaagaaacctgtactctggtgttagctgccctataatagaatttgcatatatctggttcaatatataatactgatggtccctgacctcaatggttcaacttatgatttttcaatttatttatttactttattttcatatacatatttttattatgctttaagttctagggtacatgtgcacaacgtgcaggtttgttacatatgtatacatgtgccatgttggtgcacattaactcctcatttacattaggtatatctgcacccattaactcctcatttacattaggtatatctcctaatgctatccctccccactccccccaccccacaacaggccctggtgtgtgatgttccccttcctgtgtccaagtgttctcattgttcgattcccacctatgagtgagaacatgcggtgtttggttttttgtccttgtgatagtttgctgagaatgatggtttccagcttcaaccatgtccctacaaaggacatgaactcatcattttttatggctgcatagtattccatggtgtatatgtgccacattttcttaatccagtctatcattggtggacatttgggttggttccaagtctttgctactgtgagtagtgccacaataaacataggtgtgcatgtgtctttatagcagcatgatttatattcctttgggtatatacccagtaatgggatggctgggtcaaatggtatttttagttctagatccctgaggaatcaccacactgacttccacaatggttgaactagtttacagtcccaccaacagtgtaaaaatgttcctgtttctccacatcctctccagcacctattgtttcctgactttttaatgatcgccattctaactggtgtgagatgatatatcattgtggttttgatttgcatttctctgattgccagtgatgagcatgtttccatgtgtctgctggctgcataaatgtcttcttttgagaagtgtctgttcatatcctttgcccactttttgatggggttgtttgtttttttcttgtaaatttgtttgagttctttgtagattctggatattagccctttgtcagatgagtagattgcaaaaattttctttaggttgcctgttcgctctgatggtagtttcttttgctgtgcagaagctctttagtttaattagatcccatttgtcaattttggcttttgttgccattgcttttggtgttttagacgtgaagtccttgcccatgcctatgtcctgaatggcaatgcctaggttttcttctagggtttttatggttttaggtctaacgtttaagtctttaatccatcttgactaatttttgtataaggtgtaaggaagggatccagtttcagctttctacatatggctagccagttttcccagcaccatttgttaaatagggaatcctttcctcatttcttgtttttgtcaggtttgtcaaagatcagatggttgtagatgtgtggtattatttctgagggctctgttctgttccattggtctgtatctctgttttggtaccagtaccatgctgttttggttactgtagccttgtagtatactttggagtcaggtagcgtgatgcctccagctttgttcttttggctgaggattgtcttgacaatgcaggctcttttttggttccatatgaactttaaagtagttttttccaattctgtgaagaaagtcattggtagcttgatggggatggcattgaatctataaattactttgggcagtatggccattttcacgatattgattcttcctacccatgagcatggaatgttcttccatttgtttgtatcctcttttatttcattgaagagtggtttgtagttctcctttaagaggtccttcacatcccttgtaagttggattcctaggtattttattctcttgaagcaattgtgaatgggagttcactcatgatttggctctctgtttgtctgttattggtgtataagaatgcttgtgatttttgcacgttgattttgtatcctgagactttgctgaagttgcctgtcagcttaaggagattttgggctgaagacaatggggttttctagatatacaatcatgtcatctgcaaacagggacaatttgacttcctcttttcctaattgaataccctttatttctttctcctgcctgattgccctggccagaacttccaacactatgttgaataggagtggtgagagagggcatccctgtcttgtgccagttttcaaagggaatgcttccagtttttgcccattcagtatgatattggctgtggctttgtcataaatagctcttattgttttgagatacgccccatcaatagctaatttattgagaatttttagcatgaagcgctgttgaattttgtcaaaggccttttctgcatctattgagataatcatgtggtttttgtctttggttctgtttatatgctggattatgtttattgattagcgtatgttgaaccagccttgcatcccagggatgaagcccacttgatcatgatggataagctttttgatgtgctgctggattcagtttgccagtattttattgaggatttttgcatcagtgttcatcagggatattggtctaaaattctctttttttgttgtgtctctgccaggctttggtatgaggatgatgctggcctcataaaatgagttagggaggattccctctttttctattgattggaatagtttcagaaggaatggtaccagctcctccttgtacctctggtagaattcggctgtgaatccatctggtcctggactttttttggttggtaagctattaattattgcctcaatttcagagcctgttattggtctattcagagattcaacttcttcctggtttagtcttgggagagtgtatgtgtcgaggaatttatccatttcttctagattttctagtttattttcatagaggtatttatagtattttctgatggtagtttgtatttctgtgggatcggtggtgatatcccctttgtcattttttattgtgtctatttgattcttctctcttttcttctttattagtcttcctagtggtctgtcaattttgttgatcttttcaaaaaaccagctcctggattcattgatttttttgaagggttttttgtctctatctccttcagttctgctctgatcttacttatttcttgccttctgctagcttttgaatgtgtttgctcttgcttctctagttcttttaattgtgatgttagggtgtcaattttagatctttcctgctttctcttgtgggcatttagtgccatacatttccctctacacaccgctttaaatgtgtcccagagattctggtatgttgtgtctttgttcgcgttggtttcaaagaacatctttatttctgccttcatttcgttatgtaccccagtagtcattcaggagcaggttgttcagtttcccatgtagttgagcagttttgagtgagtttcttaatcctgagttctagtttgattgcactgtggtctgagagacaggttgttataatttctgttcttttacatttgctgaggagtgctttacttccaactatgtggccaattttggaataggtgtggtgtggtgatgagaagaatgtatattctgttgatttggggtggagagttatgtagatgtctattaggtccacttggtgcagagctgaattcaattcctggacatccttgttaactttctgtctcgttgatctgtctaatgttgacagtggggtgttaaagtctcccattattattgtgtggagatttttcagtttgtgatggtgtgaaagtaatatacattcagtagaactgtgctttcagtgcccatacaatcgttctttccctttcagtactatattcagtaaactatatgagacattcaacactttgttataaaataggatttatgctctcttttgtgtgtgtcctttttttttcagacctggtcaacaggaagtataaattagggtttatattagatgattttttttcccaaatgtaagctaatgtaagtgtcttaagcacacttaaggtaggctatgctaagctgtgaggttaggtaggttaggtgtattaaatgcatttttgacttaatgatattttcaacttacagtgggctaagcaggatgtaactgtattgtaagtcaaggcgcatttgtacttcccttttggaaataataatctttgacattattttcaaggttagacatttgcgttgagatcaaagataattttttcaaacttagctctggcataaacaattacatgactttaattgtactaggtatagaagaaaaagtatttttataaataggcaaaataaatcatttttattgagcacatattatgtgcctaagacatattataccttctagtgtttatagcagtcttactaagtaaatattgcttttattttcatgtgagaaaatggaaactcagagaggttaaataacttgcccatggtcataaattcagcaaatgatggaattgagattagaactcaggtttttctgcctttccaaccccaccctttttgttcttatgacactgttcttgtataaatattgctgacttacatttgagaatgtcaggtatttcacgggagccagcacatgcaagagtgcattttaaagaagaacctctatagaaatgtcagactgtatatacttacttcagttatccaacatcatcatttaatgaagtattttccctgtagctttttaaagcaagcatttatgtaaaattttccctttgatatgttagaagtatccctaccttcttaaagtgttctgtaatttatataacatttatttggggtatcatattaggctcttgctgtgtgctttaataaggcagtggcctcaggatttgttaaatgtccttaagtcagttactgccttgaaaagtggtccatgattagtatatttttgtagttagtgatttgctgtcagctgtcatttctcaaggtcaaattctggcagttccttgcatcctattatatacatccataagctttgacctgtgagcctaaaggtatctctacaccctcctggagaaagatatagtactttgattcactgacattacattcctattttctctctctctctctctctctcaaatgacaaggtagctaattcttctgtgtgttccttaaggcactattaacactctagtagtgccagtgtttgtatgtttaaaagacctacagacttactttttatttcttttaaatacatatacttctcctgtgatcgtaaatatttgaatgtgatgctactgtatactggctgtgtatgtgtgaatacagccaagatgacaaaaagcagctgcagttatgctcagaaagagtgttgtttcatttacagtggtttcttttcttcaatgagtctgctgcctttactcaaaaatctccctttcttcactgtggcagcagctggagtctttgttactgtcactcacagccataccaagtgatgaaaaacaggtttgaaacttaaaatacttctctttccaacttagcttgtactcattgtaaattcaagtctctccacccaaatgactgaatcagttctgctttctattttgtctgtcagtgctttactggaattttcacttttgtcttagcagtaatagtgtagtgtgatttataatccacattcctctattaagtcattctgcagatttagatcctttgcttgtctctacagcacggagctcatctgtggtacctgagtgtttatggtatataatcatgcttacagtatatttcagcttcaccatggttaattttttttttttttttttttaagacagagtctcactctgttgcccaagctagagtgcagtggcgccatctcagctcactgcaacctccgcctcatgggttcaagtgattctcctgcctcagcttcctgagtagctgggattacaggcgcccgccaccgtgcctggctaatttttgtatttttagtagagacagggtttcactatcttggccactctggtctcagactcctgaccttgtgatccacccgccttggcctcccaaagtactgggattacaggcatgagccaccgcacccggccggtcgtcttaacacagcagtattaatatgaactgggagctttttatccaactggaaacatggtaatggcagattctagggagtctcatagaagaaatacattattaggtatgaaaataacccaagcagcttattatactatgcagaggaatctcttaaagaatagtttcatctacttctttccattaatagggaccttatccaaatttttattttgggagcttacaacataaatatatagtgttaagttctcctgaatatacatgtaatacatattcagaaataggtgaactgtaatgtcacagctttgtcatggtcatttgtaactggaataataatatgcagatgactcttaattcttcacctctaatcctcaatcctcattcttttttaaaacctcagttttgaatcttcagctgcctactgggcagttaaattgacaatttcaacatcacctcagatccagttatttttgttgctcttttttttttttcttttcttttttttttttttgagacaaggtctcactctgtcacccaggctggagtgcagtggtgtgatcatagttcactgcactatctcccaggctcaagagatcttcctaccttagcctctcgagtagctgggactacaggcacatgccaccatgcctggatttttttttttttttttgtagagacagggtctcggtatgctgcctatgttggtctcaaactcctgagctgaagttatcctcccaccttggcctcccaaagtgctgggattacaggcatgagccactgcactggcctttattgctcgataaatgacatttaattaatacctaccacatgttatgcatcattcactcattaaactgacattcattaagcatctttatgtgccaagtactttgataggcactgggattcaagtggtgaataagactgaaatggtccctgcctttatggagtttaatgtctacagcataggggctgctaattgaataaatacttcaggattgactaatacaatgataaggaaaataaggggactcttcagatggagagcaagggtagctagccctgtctaatgagtcacagaaggcctccctgattgaagtcatttttaagccacgaattgaagggtgtgaaggagttagatgattgggggcaaactatttttttctctctatgccttagtttcctcatttgtagagataaaaagagaaaacaaatgaataaattccttaatgcatgtgaaggtacttagaacagtacctggctctgagtgtggctgctgtcttcatcatctgtatcgtcatcattaatcattcattcaggttttcaaataaacatctattgagcacttacaaagtactaggcatttttcagtattgtggtgggattcagaaatgaaaatcataaaaatctatccttccaaggagatatgtatacaaatagctacaaagcagagagtaatacagcaagaactataagggaagtatgagccaatttctgggcaggagcattcctttttatttgggagtggtgtatgatttgtgccacttacttggcaagtgcttgtaaactgcctgtgaaatcttattttttcttgttttcttatttactttttgagattttgcctgtgtatatctttacttgccactgaaatttttcatgttgaagtgaggaagtatatatctcacagactgagatatatgaatagtaggtgctctgtatgctgatgagtagtcttaaaagcctattaaacttttaatagtaacccagtaccatttaatagtaaaataagtaacccaaaagggttacttactttaaaagcctcgtaactgcttaaggcctttattataatagtgtcacatgctttagagggactcagtgtagatgaagaaatagacgttacctcctctaaaataaaaaaagttattcatggatgcatcatctgttgattctaccaaatgtctgttctaatatttgctgtagtaaagtgacatctttgacatcatttttgaaatgtattaccatatttaactgaaaaaaacagagtaacagtcaaaattggtaataattttaaattttgtttaacattaccaaaagtcgtataattcagtttggctgatacaaaatatgaggcttagcagacagttacatatttcaacaaattgaagttttcaaatgttgcttacatttctgtcttgagagaaaacagttattgtgtggcaaataacttattgcagtttttgaggaaagtgtatattaaaaacatctgtaaagatagtaaagtacctctgtttaactggtaagagatcagagttaacgtctcactttttgtagccaataatattctagctctgatttactaaaagaaaataaaaataacgaatattttattttctagaatcttttgttttatgtcttaatgtgttacattcatgattaagatgccagctttgttttcgtctaaactttaaagcataaaactgttctttctaaattttctttacaattaggtagaacattgaacttatcacaacaaagataccttctgtcttagagataatagatcatccataaaagctaattaatggatttcttagttaagagtagacttcagaaatgccatggtaataggtctttgtagtggcttttaatctcttaaaacatgaggcttgcatgggatgaggcatgaattaattttccagcttttgacggaattgaattctaaaaccatccacatacatatgacaatcacgtctaaaaagtaattagcttgctataaatacaagagatttcctgtgagaaaattgctcatactatctaaccaatagagaaatttggcagattagagaaaaactatatgttatctgaaagaatagaacccttcagttttttagtttgttttggctcttgtgcttttttgcttagattccattgtgagagaggtggcaggctggtttgacacaggtttatgtccaaaatcttcatggaaattttctaatgaatctattaaaatgcacaagggtgatttgtcatccaattgaaaagcagtctaatccttaggacaaactttagaactagaaaaacctggtggggttctcattcaactaagtagtagtgggtatgccttggctttttgtccataatgggaatggcaatatgcacttcttagaattactttttgaattgtatggagttgtgtggataaagcacctagcacaataccaggctcataaaagtcatttttaaaaatagtatttctttaccacaatcatccctctcccctaaagcagttacaaaccattgcagatggggccttattttatcatcttgggattcagatcattaggattctcagatgcactttctttttacgtgtttctttcccatgagaaattatgacatgacacgagaaaccgagcaagcaaataactaaaaccatagggtgttcctttgaatatttgtttcagggactctggctctctggaatttggtatacatttccagaaagcgtaggttgcatggggcactgctcaggagttacatctgtgacacagatatctaacttgagacattttgagatcaaagcgttctgtttcaaagccatgttttactttggttttagttcataagtaacctcatggaaaagccagccttttccaattcagtctgaactggaacaacagaatgaaaataaaccaaatagtttattatttttcttcatttactgccattaatagttttatgctaaagaatatattgaataagagtgaaccgaatggcatttatttcttcagtttagttctgttttcttgttgtttagttgaaggagagggaatggaagaaaattcttctgtttatgtgatatatcatcatacttttctacataaattgagtgcagaataactccaggaaataacaggaaagcaaactaaccaagttgagaccccccatgtctaccaaatggtttgtatgtgttaactcattcagtcccagcagccaccatctggcagattctgagcactgtgcttcaggttacattgcttaaaaattgaataacataaggattgtgaagtatggagcccagtgcacatttatcaaaagcatctgattcaagattttaatctagttccacctttttcaaagttctttatattctcttgtagtattctttcctaaattttctcagtaatgtagcaagatgaggaagatactagatagaattgtccttaaactgcctgctatatagttatctgtgaagaagcaaaagggaagcagtgtggtatgttgaaaggaactcaggattggaggtgagatttggggttcttgtctttgtcttaaaaaaaaaaagttgtgtttttgttttttataattaataatgtgttttttcattaaatcatgtccaggatcctttctagtttttttttttccccttaaaccaaaaccataataccatcattaataattatttgaccttaaagatctataaaagaaaggtgaaaatatttaaagccaaattaaattattgctttgagaatactattcagattatatggataagagctttggagtaagctttggagtaagaggaagtaagtttgaaaccttccatgactagctgcctgagttatacaaacactatctgtgacctcctggtaatatatatctgctcatttttataggtttgatctagtttactacaagggtgatatattagcaaaaataaattggaattactctaaaacagccttccttataccacagaattcagaataagttaaatctgcaggaggctataaccaaactggttttcctaaaggaactgcatcaaatccaaggtactcaacaaatgtatgtatcagagagagctttccaatgaagttccaggggtgggccttcctgctcattcaacagggaggtgctggagatattcttaatggtagaagaattgtagttggtttctttctgatataaatgcactcccaggtggtggtaagggaggttctgttgattcatcagaatatgactgcacagtagcaggagctgaagaaatacttgttgtataaatgacctatatctcttaaaaaggaggatatgctcccatttctgtaccaaagaagagaaggctgagaaccctccatgactagcaaacactatctgtgatctcatggtagcatatatctgctcatttttacaagtttgatctagtttatcataggagtgatatattaagtagcaaaaataaattggaattactctaaaacagccttccttataccacagaattcagaacaagttaaatccacaggagactacaaccaaactggcttccctaaaagaactgcatcaactccaaggtactcaacaaatgtatgaatctatgagcattttcagatgccagagtaaatattagaaaccacgattataaatctacatatctggaaattaagaataatcacatacatacaaatgatgaaattaagtatgtgttgggcagtgtgatatagaggagagactgcaggacaataatcaagaatgccagattctgttcctgaatctgtcatattttgactgtaagggcaattgtatatatgtgcattgagggactgggagttgttcatctttctaggacttggaaggttaaaagatgaaagatgagttttctgttcctgtccactcctcagttggaaggcctgatttattcctctgtgtaaattttagaatgttcgtgtaaccaaataacagctacatgttttctaaaatctctggattttgtattttcaaatatgtgtgaacacacataaacatcgcatatacatgtttatcatatacataatacatatacttgtaagcatacatacataagcacacacacagcccaaacacagaaaacaatacaaaggaatgattgcttctgtgtttatttttgccctgttattttatctaggcattttatagttttctgagtgaataaaaagaatggaaaaaggagtgagcctagcaaaccactactcaaatgtaacctcaattctccatccacaattattagctcattcaggaatgttttttcatcccttaagagtctttcctccaaaattcggtatcccattagagtaacataactctctctgttaaaaaagaaagaactattaataataacaataatgtataatacttcattttaaccttgtttggattttctatcatttttctctccacattgattacaacatttccattttcactcacatattaaatatttactagtacttcatcttttatattttttaagttatattttattttctgcagttattttttgcaaaaatatctcctctaagattctttcgttgtagtacttattctaatgaagattcaaaagaacctccgaatttgaattttggtcttatcagtaggctattcgttaagtcatctattggatgattaataaaatgatgaattttaagggactcgaagccaaccctttatacactcagggcagactcacagaggtttgtcatatgtcttttctctgtctgtagccttttagccctatgcattcttagtgaatattattactgaggccaatttgaactaatttggcaagtcatatttcatgagacaatttgctgatccttctctttgtagatttggtggaaaattattatggagatatttcttaagatttttattgtgggaaatacatggaaaattattttaagaaggaaatttaggctcattttagactggcagacagggaggcagaaacttactttaaatccatccttatttacatgtatcctaggtccactgtttaaaataagaatcttgtaaaactagcttataaaaatgtgaagagttaatatttataaaacctttgagttcctattagttgtgttgtataaatgcatttcttatttaaaatttgcatgtttaaagtatatattatccagtgcactggatacaaaagggaatgatgcatttatcttttttctatcataaacaatattgataagtgctggatggatgagtcattatctttcatattttaggaagcagaaaattattggtatgtgatgaatatgatgcaataggatgccttagctattttggttgtttgtttcccatctgacataaaaacacgtgtgagatggtttgcttgcttactttcttctctctgttcctccgctcccctctccccagtagatgatattgtatgtcctaattttatgtggcagcatggttttaagggacttcttaaaaacaaaaacaaaaacgtgcagttgatccaactactaattacccttatgatttggccattaggttgggctgattctgttttgatttggttttcagtcctaagtgtgtaactttttattaatatatatatgcagaattggaaagagactgtattttttaaatgttaaaaaaaaacattttagttgagcacttactgtgccaggccatttattaaagttccatcccgattgagcttattgtcaggttggagataaagcgcattcaacataccatctttccaagatgtgggaagaataagatattcttatcaatgaagcacaagaacctgtggaatcagaaagggctttccagagaaagtgatcctggtggaagaactggctatccagaggggaggatgcaatgccattcagggggaagagtaagaacagagtcctagagcaagagaccctggtccaaggatgaaagccatgtaatgttttaaaatctgatgtcatttctataattcctttgtataatgttcatcaagcttttttttttctacacatacttattgagcaccttttatgtattcagtggggggatctggcaatgaacaaaatgacttgttttgttcactcaaggagcttaccatctaatgggggtgcatgtaaatgaaaggaagggattataccctgcaataatatgtcatgatatttcaggatttgacaaaacagactcagttctgtagagaaaaatgctatctgaaatttaaattaaagccaagcatcaactatgctttggtagcaatgttataccagaaggactacagaagaaatgggtgagagcatttgcccagccaggacagcctctttacagtgtagtcattgttcgaaaagagacaatatgtgggaaaggaaggtggcagaagccatgagacggggtctgatttagcattctgagtaccaagactcctgtcctgagagttgtctacctttattgtttataaaattcaagattagaattatactagactagaattaacttccatgctagttgcttgaaatcaatccattattctgtttgatattctgtgagatttttttcccccctgactttgatggttggtttcgaaatccattaagtggatctcaatcaggtttgtttgtttgtttttgttttaatgaaataaagtagaagagaaaatagcacaaagaaaggaaataaattgctttatgaaatgtacgtgtgtgtgtgtgtgtgtgtgtgtgtgtgtgtgtctgtgtgtctgtgtgtctgtagttggttgctatataaactgtttttcttgcattagataaactggatcaaacttaaatgactgtaagtaaacatttgccctgcaaagttataccttttgtttatgaaggattgtcttatagatgactccatagtcagtgtgctggactgggatgctgcaagtctggaccctggtgctagttctgcacccaaagaggcatatgctttggataagttataggctttctgtgaaccttagtgttttccatctaaaaagagagttggggctgagcatggtggcttatgtctgtaatcacagcactttgggaggctaaggcagatgggttgcttcagcccgggtgtttgagaccagcctgggcaacatggtgaaactcccatctctacaaaaaatacaaaaattagccaagtgtggtggcacacgcctgtagttccagctgctagcaaagctgaggtgggagtatcacttgagcctgggaggttgaggctgcagtgagctgtgagcgtcccacaccactctagcttgggcgacagagcaagaccttgtctcaaaataataaataaagagttggcctaggtggacttggtactctttcagaagcagttggctataaaaaatcagttgtcttaaagttgattggacattttcacagttctctgttactaactcagagaagtgtttctaggaggttaaaaaaaaaacttgaaacaaaaaatatatatagcctactatcacatgattctggttcctgacggatgcttttctcccaacctccatccaaaagtatatggtccactgcaggcaaacagatcttctgaatgaaataaggggcataaaaacacatgggatggtacctgcatcatagggccttaaaaaaaaaatgtagagttgagaaaatgttgctcaagatctcagctcctgcactggccaccatcatatgggctacttgtcacaaaagcgaggaagtcatgagagggagggagggacacctctagagcctttattcatttccatttatcggatctgcatataagtgctcccttactcctttgtgagatgtcaaggtgatagaaggcatcttccaggtaccttttcaccactgcatgcagtagggaacatcaaataccagagggattctgcagtctcaacccctttggtgtaaagactacctaaaaagacaatccagccatataaaaagtaacagcccatttatctcattcatatgtttaaggtcagttttcctgtaggagatctctgagacagtagcaattaaactgagctgtatgtagcaacatagtacatgctacaaactaagttaaaattgtcaaagaacttttcgtttgtagcagtttcttaatgttatgaggcacagaactgtgtggccatcagaaagacagagctgctaacaactccatttggggcattgttaggcagttctgttgacacatgaatacatttcatatgattatcataaaattgtggcctggaaattgagcagccatggtgctgcattttagacttcacatttataataagctgtaataaagtaaacattttaaatggatataagaatagacattacttgcaatcacaaatgtatgttcaattgaagtgcttttgaagctcaatttaacaaagcaaacaaatttcctggcattattaacataattgttctcattgttgggttttgatttctaaaaaaatatttaagcaaaaaaacaagttactaaaaaacaaaattcacagaaggaaatgtaactaagaatgagttactttgcctttatcatgtcggattaaagttaaaaaaaaaaaaagtctcagatgttcattctgtcaccccctccccaccgacttgctgaactattgcttggcctgtttaactcagagctgtttaactcagagctcatatatcaggattaatttaaggttaaattcagctatttgctctgccatcagtaagctttgcagtgggcctactcaacatttatctactagtgaaactccaggctgtgtgatagttaaaacacggagcttacagaagaggactagaatatccattttacaccagagtggaggaagcatgactatatgcaaatttagcaccaattagatggtaggatttgaaggactgtggtccctggaatattccaaaagcaaaaatggaaatgatagtgataacatctgaagtgtggtggcaagacagttaaaacagtgctaatttggagcctctgggcacagaacagtaccaggaggcgatccactgtgtcttctttggcagctggcagctggcagacaaagcaaataatgagtctttggcttgttacttttcaccattccatagttttctccaattttgaataaacccccaaaacaaacatccttcctgcattgtcgttttactgtagcagaccctcatatagcaagtgtgctactggcccaacagtctaccacagtggaaaccacaggaactcagggttgccggtgtacttgcttaaaggttagcgtaggcacagcatggcattggtagggggcgcattcttcaaagactcacatggtgatttcttatagtcagggagttgagctgacttaatcaagattagaaggaggcatgctagtgtgagaatatcctgtaaaatactcaccacttgaaagcattcctggcaagcatatcatttacctgatatataatttcattaagcaccaagattgtgctagttactttctagagaaaagatgaaaagctacctaccttaattatcctcagacttaatttcatatacccagaaaacaactttccagaaaatagtggtaaccacagctacctaatttagaatagatcctctgaaaacttgctaagagcagttgagtggtgaacgtccaaaaatgtacaacttttttctttgcctgcgtaattttgttttttttctttattcccactagaacacattctccttaccctcactggaacaactgtagaacagaaacctaaggaaatataggaagtggggaaggagggaacaaaatgagaaatttaatgtgattccaaatgtaatctttaagaacgtgaattgtgaaaattctgatctcccaaagatcaggcaatcagatacttctaaatgtagaaatctttagataatagcacgtattttacctgcaggctgaattttatgtttgcatcttttttccccctgcatctttgaaagtgaaagccggtaaaccagttgccagaacggaaaagactgttttaatcactggagcctgctaaaaatgtaaataatgctgataaatcagtaaaatttttgtatattactcaaccgaattgcacttaatccccatttcacagacccagtttaggacacttagaactttcttcgtcttcttgtccacaccttttccctacccacttttgagatttctcctactttgtttgtcctatcttctttccagaccccttttctccaaactagtattgaccaacacatggcacttgaggctcatggttttgggattttttttcttcacatgcagcctatgtttcttatttctattctagaagattatattacattaaactcagcatgacctatgagagttcacatgtctctcctttagtttatggtgactgcaaaggatgctccattagctgaactcccttagctctttaactgttagtcatttcttgatttggagtaaacaataataaaattttccttttcctctagtgtgttgaatttcccagttagtaccaagaggtagtgcgatgtagagctctagatccaaatgctgtcttgaagaaactatttaaatattctcattcttaatttcctcattattataaaaaggataacagtgtatgtaaagtgctcagctacatcacaggtagttaataaatgttagtctctccccttcctttccctatgaaggaaaaaatcttagtcaataatttaaaaagtaaatatctatgatgaatataaatatattggctataaaccttaaattaattttgagtacaagttaccaaagtaatgaatttgctatttcctctggttttataacaccccaatatgtgaatgttcacacatacacaccaattaatacagataattggggagggcactttagtacttgaatatttcagaataaaagggttttatttgatgattttaaagtttcctgcttggagtttcagctctaa

SEQ ID NO: 12288 - DNA, 76164 bp, Human
agtttaacacatttcttaagctcatttaaccacaggaccatttatttcgaagcgaccctcccaatctgcattctgtcaaatctactttagaaaatactttgtggaagccaggctcatgcctgtaatcccagcactttgggaggccaaggcaggcggatcacctgaggtcgggagttcgagaccagcctgaccaacatggtgaaaccccgtctctattaaaaatacaaaattagctgggcctggtggcacatgcctgtaatcccagctactcgggaggctgaggcaggaaaatcgcttgaacccacaaggcggaggttgtggtgggcggaggtcgcgccattgcaatccagcctgggcaacaagagcaaaactctgtctcaaaaaaaaaaaagaaagaaagagaaagaaagagagagaaagaaagaaaggaacgaaagaaggaaggaaggaaggagggagggagggagggaaggaaggaaggaaggaaggaaggaaggaaggaaggaaggaagagaaaatactttgtggaagtcctatctctacctgctcctcctctggtctaaaattcactttgattaatgcaaactatcttttggaaatgccctacctacatgaaattctacccactggagactgattaaggaaactttgattcaacaaacactgattatatacaatttaaacagatcacactgtattgcagtaaatggctctaacttctacatatacagttgttcctacatagtcaaacatcacttatattttagcaaaaaataaaaaaactcctaagtaactataattgtcacaaagtccacgtattttcattagaacccactagagctgcactcagaacttatttactcttactttagcctgatcttaattttgtaatctctttcccaatcaataatacaaaatcaggctagtaaagacaaacttaccacagaaagaaattatacctgagaggctggccatgaaggcaaagacagaaaatctaaaaagtaaggccaagtgtggtggctcacacttgtaatcccagcattttgggaggccgaggcgggaggatcacttgaggtcaggagttcgaaaccaccctggccaacatggtgaaaccctgtctctactaaaaatataaaaattagctgggcgattatagcacatgcctatatataacacatgggattatagcacatgcctataatcccaactacttgggaggctgagacaagagaattgcttgaacctgggaaatggagtttgcagcgaaccaagatcacgccactgcactccagcctagaggagagagcaagactctgtttcgataataataataataataaataaaagtatacaccaaaattcacagcaggaacaattagtgcaggcatgatccactaagaaccagatccttgatgactttattatatcatctcccagacccccagagtgatcaagaaaaacttaaattctattcaagatagtaggttacacagagcaggataatgtaaaatacattttggaaagcttttcttccagtagatttttaaacaaacaaatacataaataagactggatgtgttaaaaggtcaaccttaaatttccagagatttctgagacgagaagcacaccatcccataccaatgctgggtaaatgaggtgtagttactgtccacactactgatcacccattgcttgacaaagcatcctgtggttctgcccttcagtgaccttcttagcacactctgctccagttccactcagcccctaggactctctaagtctcaaagatctgtgtccaacgtcaaaatccctatgcagctgacttggcattatgcagcctccactggtcatttatccaagtaacttaacaagagtgagagatcagggctacgacgcatttacatctaacaagtaaatggtgctcccccaaatatagccaagttagagtgctgggctggcagatttgggagtataaagagagctggggggtcacactcctgaaattgctgtgaccgcagcatctctaggtaagtgctcacaagtgctcacttttttgctccacgtagctatagttgcacctgatcaggttaccagtcaaggggggaagacaataaagtagcctttacggagggcctactaagtgcaaggtcttgtgttgagggcaaggttggagacaagatggaaagacaagacaactgcctttcaagaaacttttacaaggggtgaaaagacaagaatataagcaattataagacaaaaaatattcacctgcagaacaaaactgagtataatgcatgattcctcctctgattatttaggtcaatgttatactgttcagttagcaaattaacttggtaacttgtggtatctcttctgtgattgcttaagctattatttgaaatttttatgtttatttaatttgtttcccatgtcaggatttctgaaaaatggttgtgggaggaaataatcccaagcatcttacccatcttacaaagtgtcatagtctgatatgaattgactggtttgcagactgttctcacatggcatattttatggacttgggactggactgtgtctgacagtgcaatagcatccctcagagatttgtgatactttgaattcaggccaccatctctacggagaactgtctgttatagactcatagggctgaaaggaatcttggagattttctggtgcatctgattcattttacggaaggaaacagaaacccaaagaaatcataccagctacttaacagaactgatattagaatttctgtagctctgcctccatatttttttaaattgaggattcagaatatagtatgtaatactttaattttttaagaaattgtgagaattttaggatataactggagattatttaagatgcattaaagacggagaaggaaggaggcaacaaggatagtaaaccaaatcctaagtgtctgttcctgcctaaatagggcttcatgaaatattcccctggctccataaaagcactgaatggtaattgggaagtttgcttagattacatttgatattgaaaatttttcagacactcatgcctccttgagatagccacgtagtttataaactcctagagctgagattccttagtcccaggtgacttttcagctgccctaccttcatcatctgcaggaggaatttagagcattgaagagaataaagaagtctttgtccacaatttataacttttctcctattgccaaaaaaaggtgactgcccctaagcatccaagctgcaatctggagcattcccctccctactttctttcttccctgacccctcacagccccccagtcagaagcggtttctctaagttcccatagtactttgtttagactccttaaaaatttgtcttaatcctgttcaaagacttacttgagcattctcttatcccttactaacttttgcattcctatagggcagatactgtactttcctcttcatacccccttaaggagctgacacagtacattgtacacacagaagtttctcaagagagtattaattaaatgttgtaattaaccaactatttaaagaataatgattttaatcaaaagtaaaaattcaaaacagcaaatttatttcattccacaccatctactgtgtatctatttaaggtagataaactggaacaaacatggtttctatatttatttaaactctttgtagctcatttgggtttttttggtttgttttttgtttctcaaattatccccaggaagacgctttattcctgaaggacactgactgtcacttgggaaccaagaaggtaagggttattttcagcttgatcatgaatgcaatcattgaaattagcaaacatcattttacacgttctcattcttgccacactcataagaagacgaaattgatgagtttgaaaccaataacttaactattcttaaaggcagattttaaaatatatacaggttttaccaaaggaagaatggcttctcctatttgctcattacactgaaatgtacgaaatataatgcagaattttgacatacaagctccaagtcaatacacagtacttagttggcacagaacatgatgttcatagggtccaaatgcagtcttcacacaaaggctaactttgctgctccttgagcagagtctgcacccatgaatccacacagctgcaccttccctcacgtgtaatactgaaggaatggggagggatccgttcaatcctatgcccggtgcggtaataaaaaccctatccccttaaaacgtgtgtttattagaggtagttctagatgaattgggaccaaaaaagccaagctgtcattgaatcatgagcacatcattgctgacaagacacagtagtggtgaaattcccaggagagggatgaaagttgagagtagtgtcatggtacacagagggtaaacagagagagaggagccctcacaagtgggtgatggagattaggcaggcgggggtagtcatctcaattagaaggcccttaaagacaggaacagagtggttgaaggggcacagctatgcaacgttggaagcaggtcctgctcttggaacagagaagaggctaattaaggaaactctagagggtggtgctcagtgggcagcatgagtcatgcctagagacttgggtcagatctaacaaggtgaagtttatcagtcaaaaatgaatggtcttcccctgggtcccaactcacagttgcacaaatatagggagaagatctgacttagcaactgcatgcacggagaggattgaggggctttgctcgacacggagtggtgcgtcagcagtgtgagacgtggctgccaacaggcaatcaccacctcaagcatgacacctaggtcaagagaggtgagggcacactccagtggagggtgacatgtggtttggatatcacactttaaaagattaacaggagtgggttcagggaagagtgactgagatggtaagggattcaaaagcacatcatagaagaaccagtggaagttgaggctatttagcatggagaagataaagctaagcagaacacagaacagccatcaaaagggtgaagagttgtcacgtaggaaggtttgaactctttctgctgttcaaatggagaacaaatggagagccagattttaatttaaagcaagaagaatctttggcctatcaaagggaaaagagttgtgcctaaaagtatccaactaggttagatgcaccattgcaggaatatggagggataactcaaacatcatctaggtaatactactaggagatactgggttctgagtcacggttagagtaaatgaagggagaaaaaatctctacttgaaaactgtcagtgaggcccacagggaaaagccttgtttttccaggaggactaaaaatatggctcaactatcagctatggcagcctttccctgacttcagactttattctcctattgccatcacaagttttgcaatagccatgttaacaccaatactgtcaatttacttaatatttgtatttacattgattcattttcttttcttatttgtttttaaagttaccttatattcttgctgtatcagcattagctgagaaatttgtaagatatttaaaagctcaaacccaactccagacctagtgaatattcacagtaggattcatatgcccatttaagtttgacaaacactgatttatatcatagaacacatggatgtagcacgcttcctaagtgttaaacaaatattaccctatttccatcaattctgatttttttatattttttacaaatttatccctgaaatgaggatgcatattacaatctatgaaagaagcattgcagtttaaattagctgcatttttttatttgtggaagttataattgatggcaaattttgataaaataaggtaataggctttaaaataagcatacaaatattaaattaagaaatatttgcctaaaattattttgtgtacaagcaatgagactgtgccatggttttggctttagaaaaacagagtagtttcatacaagcaaagtaatgctttaaatcagtagttcccaaacatctctctgaggaccttatcaaaaaatcagattccctggtcccagccatagagattatgttgcagagggttttgaagtaaatcatcttccaacacttttgggtatcatgcttaacgctaagtcaagctacatattataaggtcgtaaacctgtaaccagtcaggattcccttatgcaatagggcagccattctcaaagtgtggtctgtgggttcttgtagagtcccaagaactttttaggaggcacttgaggctaaaactctttcacaataatacccagctgttatttgccattttcactgcatgagtgatgcaaaagcaaggatgaataaatggctggtaccttattacaaatcaaggcaccgcaccaaactgtattagtaattactgtattcttcactaccatacacttgcactaaaaagtttcattaacaattttatgtgatgaaatgggaagtccaccaaagtttgatggttgtctcctggaaaagcacatgtgcatttgtgtgagttgcaagctgaactggccattttattcataaagcaccatttttatttaaaagaccaactagcagacaagctatggttattcagacttggatatttggcaaacatgttctccaaaaggaacaatgtggttgttgtctcgaggaaaaaactgacagcatttgttataaatcacaactttgagccttcaagtataaatgagaatgcatacaggaaaacatgtatttgccaccattagcttgacaacttcctagtactgaaagaattttcaaatgatatcacagtggtgatattgatgattgtaatttttttaatattgtgtaagaaaatgtgtccacatttggaagtactatataattcagtgaaccagtattttccaaacaaccactgtatgaaattcacatatgggaaaagaagatccactcaaaatgcaagacagactagtggattataatgtaacagagtacaaaatgtttattgatatggcttcagattccgcattgcaactagcctttaagaaactaccacttgtcaagttttggtagagtatctgagaagaaaattcacaattatttgaaaaggtgactaaaatactctttccttttctgaattacatagctaaatattttatatttactttcaccaaacatacagcaatggcatgaatacagaagcagatatgagaatccaacagtcttccattaaggagacattaaagagatttgcaaaaaatgaaaacactacccttctcactagtctttttgttttggaaaatatggtaatttttattaaaatatttatgttggccaggcacggtggctcatgcctttaatcccagcactttgggaagctgaggcgggaggatcacttgaggtcaggagttcaagaccagcctggccaacatggtgaaaacccgtctgtactaaaaatacaaaaattagctgggcatggtggtgggcacctataatcccagctactcaggaggctgaggcaggagaatcacttgaacccgggaggtggaggttgcagtgagctgagattgcgccactatactctagcctggatgacacattgagactccatctcaataaaataataaaataaaatgtttatgttaatgtaatgaatttgacagtaatttttagttaatgaataaatattttttaatttctcaattttaattttcaatatggtaaatatcaatagatatgacttacataaaccaaatcttatggggctttcagtcatttagttttaagagtgcgaaggcgtcctgaaaccacaaagtttgagaaccgctgctgtagcgaaatccacctaagccattacattagggactatcttcaaagaaatgagagaagaaagccatgtggatgaattctttctcatcctccaggtggtaactgagagactctaaaccagcatgatggctgcaggccaagagtcttatttgtgggtgctgcatttgaattccagtcccttactatgaaaacctaaccatgaacccacagatggttcagcagagccactgaacaaagtataactaaaatgcaacttatctgaataaggccccatgggaagtggatgcttttctttctgtaagacagaaccccacagaatcacaggaaaggatatttcaacaatggccagttaccaataaagagagcaatttcataaaggctaagatgggggagagaactataacatgttcaactttcccactataaaaagaggacataaaagaccttattcaaaaaatatgacgtatttcaggcggggcatggaggcttacacctgtaatcccagcactttgggaggccaaggtgggcggatcacctgaggtcaggagttcaagaccagcctgactaacatggcaaaaccccatctctactaagaatacaaaaattagccgggtgtggtggtgggcgcctgtaatcccaactactcaagagactgaggcaggagaattgctcgaacccgggaggtggaggttgcagtgaaccgagattgtgccattacactccagcctgggagacagagcaagactccatctcaaaaaaaaaaaaaaaaaaaaaaaaaaaaaacagatttatttcttaagagagatatggagagatatgtgtgggtgtgcgtgtgtgtgtgtatgacttgactccattttatgtcagttatagaattaagtgggaaggaaaagaggagagaagggaaggaaagaggaaagagacttgaggaaaataggtagtggagtagagggaagaggtgccgagggggaatgagagaagcaaattctgagaagaggaacagtccacacaggacttacgggaaccttagacaggagtgaggctggcttctcccttataagtgggaagaggctgtggaccagagagcttaagtggtttgatcagtgctaggactttaagatgaattttctgcattctaagcagggacaatacattacataaaagaaggaaaaaatacataaagagaagagcaagaaaggcagcaaagggagatagtttaggagaaagtgatacaagggatgagagagaccaataccccctacacacacacagccccatacacacacacacacacacacacacacacacacacacacacacacacaccatgcagcaagttctaaggtgggtattaatctaactaaacaatatttgtcacaccctgacaccgccacgcacaaagtttagagaccgcgtttagagtttagaggcccagtacttccccatctcctatgcatagaaattacctggggatcttgttaaaaagcaggtgctgatcccattatcttgggtgggtctgagattctgcatttcttaatgaagtcctgcatgaagctgctgcatttcaaggaccaccctgggaacaggaaggcactatgccagccatcctcagtgtggtccctggatcagcagcatctgcatcacctgggaacttgctagaaatgcccatttttgggccccacttcaggcctactgaatcagaaaccatggggatagggcccgtaatctgtgctttaacaacccctcaaggggattctggcatgttaaagtttgggaccattgccctgggccattttgcctcccatcatcttgttatttaaacaaatgtgacaaatcttcatgttcaagtcattcacttttcacggggctaaccaaaatgtctattaagaattatcagcattccagtgacgattttcaaatattcttaagattttaaactgacactgagatcacaggctcaaacacgatgagcgatttagaaagtgcttcctaggatggaggcggtggctcacgcctgtaatcccagcactttgggaggtcaaggcgggcagattacctgaggtcaggagttcaagaccagcctggccaacatggttaaaccctctctctactaaaaatataaaaaaaatagctgggtgtggtggtgggcacctgtgatcccagctactcaggaggggagggaggagaatcgcttgaacctgggaggcggaggttgcagagccgagatcgagccattgcactccagcctgggtgacaggagcaaaactctgtctcaaaagaaagaaagaaagacagtgcttcctgaagcctcttttattgagttcaccatggctctaattgattcagacatgcacacatgggactgaactaaaatattcccaaaatcgacactcagaggataaaaaaaaaaaaccttcatacttttttgttagaataaaatatcccctttagcttattcccacttgcacactttaagctcctagacctggccatagatccctcaggacctatgttcaatctaggagcctttgaatctggccccctgttttaatagaataagggtaggggccctgcagcttcagcagtcacccaagcacaagactcagcagtccctctggtcttcccagccctctgcagtcatgagctctgacgcagaaatggccatttttggagaagcagctccctacctccggaaaccagagaaggagagaatcgaggctcaaaatcgtccattcgattccaagaaagcctgctttgtagcggataataaggaaatgtatgtgaaaggcatgatccagactagggaaaatgacaaagtcatagtcaagaccctcgatgaccgggtgagtgttgattacagatgtctttgataatatgggcatgctcatttttctttggagtagaatattagaaattgcatgctggtccttcggaatctgaagacagaacaaaacttagtttatctgttctgcggtgaagtagcagatgaaagctgctattacatgcaccttcactcttgcctctttccttctccaaggacttgggctttgaggggttttgtggtgtttgctttagaggaaagcagcaggtgagggcagaaaatgttggtctatttaaggaagaggctgatactggatgggccgaccaattatacctctctgggctgcagagtggctgctacagaggaagctcaggagccattgactcacttaatgtggagaattatcatgtaccattcagtacttaccggacatccaccaggtctaggtcatagcattgatcactttgcaaatataagcatacctctgcacctgctttcccaaagtttcccaaagatgtatatggcaggtatgaatctcatttcacaaactcaggcatatgagagagaccttgcttttattttttgttattaaacttaacctctaattccagtcctttttcagtgggctggggaaaaatgtgttcagtcactcttggggtgccctcaccactgcctcaggaatatgtcacattttcagaaccttacacagcactacacgggggactcacagcctccctggaggatttattcagaaacaagtcccagtccttaaagattcaggatacatagacttttctacctcccctttggctaccttgggtgtctgtttctctttttctagtcttgggtggtggagtggaaggcctttccttcctcaaaaaatttggtctataccagcaaaactccttccttttatcttttctgtgaaaccctcaaagttttcctaaggacttaggtttttggaaaacaaaatccaggaagtattacaagctctttttcttttcttgccctatttttttttttttttttttttgagacggagtctcactgtgtcgcccaggctggagtgcagtggcgtgatctcggctcactgcaagctccgcctcccggattcacgccattctcctgcctcagcctccctagtagctgttcttgccctattttctgtctctcctgagccatggagtgcagagccagcttgaatgggggagagaggtgggaaaaaaacagagggaaaaaaaattaaataatattctgaaaatattcagcaaagaaccatgatgcacccccaaatgtttgaactattagagcagaggtacaaataattatgggagccttgaagcaataggggagagaggagatgggtcgtggaagagttggtgctggagctgagctttgaaggtttctaaacaaaattttcatgaagacattccagctgaaggaaacctcatgagcagagattttgaggtggaaaaacacagaacactttggagcagttctttgtaaccttccaacctttgtctcatcacagcactcacaacaaatagggtaaacagaggcaaagggctccaaagctctgcacacctgtaacccactcctggtacacacgacagcaggatgactgaggggcatcagaccagaattggttacatagtttgaccagaatcagattcttcaagaactgttatttatggatcatgttggggcatggaaatgatccatgaaattatccatcacaatgcggtaattcctccacaatatctcactacttccaccacaccagtaaagtgcaatgtgggcacttggctcaccaatttattacctgcttttcctctcaatacccagatgctcactctgaacaatgaccaggtcttccccatgaaccctcccaaatttgacaagatcgaggacatggccatgatgactcacctgcatgaacctgctgttctgtacaacctcaaagagcgctatgcagcctggatgatctacgtgagtgtctgtaaacacctttttatttcatgtctctctctgagtaaaaacgagatccaaatgataaatgttctgatcttcccagacctactcaggcctcttctgtgtcaccgtcaacccctacaagtggctgccggtgtacaagcccgaggtggtggctgcctacagaggcaaaaagcgccaggaggccccgccccacatcttctccatctctgacaatgcctatcagttcatgctgactggtgagtaatttctttgattcatattttttgaagccatccttagttaatttttcaagcttttgatgggcgttggccatctgaatggtgcaataatcaaaggatcttcggagagtcagatgatttggggatgaaaagcaaagggtacaacatcttccattgccagtcacagtgcatgacaaggcctgtgattatggctgaagctacactgagctcttgcttatttgggagaatgtggaacacaaggagatgccctacctttgtccccagggaacccccaatccaggtgtactttgaagagaaaccatatcagtagccactcagggaatgctacgttggagaaatgggtaaagcagtgttcctgcgttcttccccaaactcaggctccccttcacctcctttaatttccagaatgacctggggagtaaggacatggtaacactgtcatgccatgatgcctaatatcaagtctgtctgttcaaccttcacctgacttgacttggaacagatgctagaagtagaagcaaggctgggtgcggtggctcacacctgtaatcccagcactttgggaggccaaggcaggtggatcacctgaggtcaggagttcggggccagcctggccaacatgatgaaaccctctctctagtaaaaatacaaaaaaattagccagtcatggtagtgggtgcctgtaatcccagctactcaggaggctgaggcaggacaattgcttgcacctgggaggaggaggttgcggtgagctgagatctcgccactgcacttcagcctgggcaaaaagagcaaaactccgtctcaaaaaaaaaaaaaaaagagtctagcatctgaatctgagacctgtagatgcttaaaaatcatctaatgcaatggcgtccaaacttctgtcatttctgtctcacaatcacaatccttgccatgtctgcaaacttaatatttttcttgaaattagttcatgttacattaattttaaagggaagactaataccacaatttctattagtttgctatggctgctccagtatcacagactggggggcttacacaatagaaatgtactttcccacagttctagaggattgaagtccgaagtcaaggtgtcatcaggattggttagtctgaggacgctgagagagaatctggcccatgtctctctctcctagcttctatggtttgctagcagaaatctttgttgttttttatttgtagaagcatcaccctgatccctgccttaatcttcatatggcattctccccatgtgcttgtgtgtctccaaatttcttctgtttataaggataccagtcatattagatcaggggcttgccctactccagcatgacctcatcttgagtaattacccctgcatcttgtttacatcttatttccaaataaggtcatattctgaggtactaggggttagaaattcaatatgtgaattttaggaggacacagttcaatccatgctctattgtaaatgaaaaaccagtatcacttttcacaagtagaaggtaaaggtaaaagaaaaatgcaatgaaaccaaccagcatctataaatgctgatgaaaagctgtggccccacaagctctgaacctgacacttgctttctttatggaaaagggcgatgggaaaggactagcagggagttaaagatctataaacatgagtaacttctacactgtgggattcactacagtgagtagagaatcattcacctcccaggctggtcatgttgcacatcccacatttgagaaatctgcctaaattgtcccaaagaagattagacatgcccaaatcataccagtggttaatggcaaagacattaactagagcctatgttctccaaccacccccaaagttactttattttaacattctgtttgttgtttatttgttttgttttgcttccctctgcatttctagatcgagacaaccagtctatcctcatcacgtgagtaacacctctttgtaccatcatgacttggaaaccagtgccctcccttccactctcctttatcccgtttacttttaaattggcagcggagaatccggggctgggaagactgtgaacaccaagcgtgtcatccagtattttgcaacaattgcagttaccggggacaagaagaaggagacacagccaggcaaaatgcaggtgagcagccccacctgcatccggaggcttactggaataagtatactttaaagcgtggatgagcaccaagtgtatgcagggtatgcgctcagtagaaacggcaaataggaaaaattctttctttcctctctgtatcctcacacagaacgtgtctgccatcaaatgtatggggtttttccatgccaaacaattctctaattctctgcagacaccaactgggtgtcctacaattcaattcaattctgatactaactacctagagaaagcatcaaatcacacaagttaagggctcagtcctgcaaaactgaccccactttggataccagggaccagtccgggcctcctgaacttctaagcaagcagctattaattgggaggagctcacgacccccgtctcaggtttggtaattacctagagtgcttcacagaactcagagaaacactttgcttacatttgccagtttgttataaaggctgttacaaaggatgcagaggaaaagccaagtggaaaagatgtctagggcaaggtatgggggaggggcagggtctctgcaggtgacatcctcccagtacctctaggtgttcatcaacctggaacctctctgaagccttctgtgtagggtttttatagaggttgcattacatgagcatgattaattaaatcactggccattgatgattgactcaacctccagcccttctttccttcccaggggtcaggaatagggctgaaagttccaactctctaatcacgcggttggttccctggcagccagcccccatcctgagctgtccaggaccccgaagccaccaatcatctcattagcacacaaaaagacatttatcacttcagatattccaagggttttaggagctgcgtaccaggaaactggaaaaagaccaaaatataccattcctattacatcacagtatcacatggagcaaagcaggaagtggttccaccagaatggacttgagttctagcaccagctccatcacctacagttgagggaccttgaccaactccacatcctcctctggagaaggaatgtttacaccagtggttttcaaactggagtacacatcagaatcaacaggagagattcttaacaaagggcggcagaacccaggcccagaattcctgattgtgtagatctagggtgggacctcatagtttgcatctttttttcctttttattttggagagacagggtctcactctgtcacccaggctggagtacagtggcacaccatcatagctcactgtgacttcaaactcctgggctcaagcgatcatccttcagccttccaagtagctaagactacaggaaccaccatgcctggctagtttttttttaattttttgtagagatggagtctcactatctttcctaggctggtatcagaccgttggcctcaagtaatcctcctgcctcagccttccaaagtgctaattacgagtgtgaactaccatacctggcatttctcatatattcccaggtagtgttcatgctgctggtccagggaccacactttgagaaccactaggtttgacagtagtttctaaattgctctggacccagaaggataaagcagtcatggaggtgaaggtgaaaactctgctttctgtagtggatttctgaataatcattctcataagtttttgctacataaaaaacctttttgagaaccactgttgttattgtatcatcccctgggtcgcttgctttgctcacattctatttctccttctgaagacaaatatctatattaggtgggtcatattacatgcaataacagaggtgcatgttataaaaatccatgatttataatgaaatgttatcagaaaggcagtctggatgttctgatggagggagtaatattcctgcctagaacctggcatgaccagaagtcacttcaatgctatgctaataagaacctgtctaagatggtaccttgaagacgcctcaggtctggtgggggtgggggcgtgggtgctgcactgaccaccaggtggagctggtcgacatctctacctgaacctgcccagagtacccaccgttttagtcatcaaggggctactttagaaaaccatccaaagtcctctttttcctcttcttgtttattattagggaaccctagaggatcagatcatccaggccaacccactgctggaggcctttggaaatgccaagactgtgaggaatgacaactcctcaagatttgtaagatccggcccaattttcaagtatcctcccaaaagcataccctctcctgaaatgctggatatgaaaaactgccccataaactggaatatatgggggcctttttctacccccaagtgattgagatcaatctacccacctggaatattgtgatacactttgaggaaggtgttggcttggtcctggcagagggaggatttgccgtcctaccctaactaggcaatgtcacctcacagcatcctgaagtcactcacatgattcaaatcccacaattagagatcaactttatgctaaaatgggtctctctgtgtggaaacattttaaaatgttaacgtccattaagccatatctattggtctagccacggaaaccttagtgtgaattaagttagcagatttgacctcttccaactcagtagggactgggagcagggaaaacctagtgaaggcagaagagctcaaaaatttgaaatagtctgggcgcggtggctcacgcctgtaatcccagcactttgggaggctgaggggggcggatcacttgagaccaggagtttgagacgagcctgaccagcatgacgaaaccccatctctactaaaaatacaaaaaattagctgggcatggtggcacatgcctgtaatcccagctacttgggaggctgaggcaggagaatcgcttgaacccgggaggtggaggttgcagggagccgaagttgcaacactgcactccagcctgggcaacagagggcaactctgtctcaaaaaaaagaaaaaaatattggaatagattcatactgaagatattgaaggatatatgccatccttcaactttttacttaggtttggcttaatcaaaaagacatttacttcccatcggaaataaacacacatccagccctctatttcatttcactggccagtggagcaagtactcagaggcaaagccatcatttgtgcctatggttgcaaaagtacattaaaacttcacacatcttaatagttggatagtctcaaacttgtatttcgtcgcctgaaagataaaatggttatcaatgaggaagtaggtaatccatcaaggaccatggctctgagccttgacttttgtttccttggatatgttctttgtaccctgtgcactgccagtttgcacctgtatcctccccagtgcccaaataaactcctcttccttgtggaagatctgggcacatgttacatggcagaggtatgttacccatgcctggaccaagttagttattgcactggcctgacaccagcttaaagtgaaagacaataccttcaggcactccctcttctcattcccatttacttagttcatgggcctctactcttagccctgacccagaagtcacaatcattctaattattttgtcctctttccaccctccaaatatttgcaggctagggatgacttccattgtcttctgttaagccgctaaatatactgaagacacagcacttacagtgcacatgtgcctttactgatccttcactaacttttcctggggttcattcagaaaatattgaggctagtactaagtaccatccacatttcagacactgtgggtgaaaaagcaagaaaacattttttgtcctcgaatttgcgcacagtgtcgttgaggaccaattaagcagataatgtatgaagcaggtgcatacacacaaacacgcatatgaaattttacctcccactccccagaaagtgggccacctagaccctgagttgttcttttggcagccagggagccaggcctgagcctgagcccgggcctctgagccagatttgtctgtagtcagccatatgtgaaactcaggcaagaaatctcagaagtagcatctattaagatacaagcaaaaaaaaaaaaaaaaaaaaaagtcagacagaacaatccaaccagttacaattaaaaggtgttatgaagatttaagaatccaggtataagagaacaggatgaaaaccaggcaggcagtcaagaatggagtagtcccaagaagagagctggagaaggagcctgtgggcatcccctgagttgtgggaagagggacaggtgcttgggtagagctacctgagtccttgctgacccagcttgggagcactgggcacccggtggagaggtgcccatgttctggcatcccttccttctgagccaaggagaggtcatggtggccaatatcaatgacagtgaagaattgttggcgacagatgtaagcatgccatttatttgtttgtttacggacagaattattgagtttatgaactgagagacatgttagtgagctaatgggaaaactgaaatccagggatactaagtgattagactcaagatctcagacatcaagggctcagagaatcagcacagattggcccctccctactcagctcctcctcacagcattccaaaatgcaaatccagaaggttcaccaaagcaggccttcagttctgttctctagcatttttgcatttataatttatctgtggcagcacctatctaaggccagccacaaaaccatataaatcaaataaccgtaacatttgtccacctgttattggacaggggaagttcattcggattcattttggagccacaggaaagctggcatcggcagacatcgaaacttgtgagtccaaacactctataaatccgttggtgttttggccacaaaagcatctcttgggagcctgaaatcacgttatttttgttaccttagatctgttagaaaaatccagagtgacgtttcaattatccagtgagagaagctatcatattttctaccaaattatgtcaaacaagaagccagaactaattggtaagctcttggaatacctttcttatgttccaaatcggtgacgttgggaaaaaaaagcaacccagagtaagttatgcataagccattaaagggatatctgtgtttcacagacctgcttctgatctccaccaaccccttcgacttccccttcgtgagccaaggagaggtcacggtagccagtatcgatgacagtgaagaactgctggcgacagatgtaagcatgccatttatttgtctgtttatgcacagaattattgagtttatgaactgagagacacgttagtgagctaatgggaaagctgaaatccagggatactaagtgattagactcaagatctcagagatcaagagctcagagaattagcacagattggcccctccctactcagctccacctcacagcattccaaaatggaaatccagaaggttcaccaaagcaggccttcagttctgttctctaacattttaactggaatgcatttttgcatttataagatctttaacctaacattcgttgaaagttttcatgttgcaaaaccatctacatggttcttcaagaaaatttagaaaatataaaaaagtataaagcagaaaaccaagcccactctgtaatagcctctccatttttctttctgcctttcactttaggctcaccttagacactcagctcctcagtacacctgtcaggcctgtggtgtttattttggggaagtacctgtaggattaataatcttaataacaataataaccaaatatattgagcacttacatgtgccaggcactgagataagtggctttacctgcattgtctcattatagtctcaaaattatgtcattattgtctccattttacaaatgtggaagctgattcttaaaatatatataattttctggaagacacaattcgtcaatgacagagtctttcccttccttccttccttccttccttccttccttccttccttccttccttctttccttccttcctctctctctctttctttcttctcttcttttcttttctttcttttttcagacagagtctcgctctgtcgcccaggctggagtgcaatggcatgatctcagctcacggcaacctccgcctcctgggttcaagagattctcttgcctcagcctcccaagtagctggaactacaaggcatgcaccaccatgcctggctaattttgtgtgtgtgtatttttagtagaattggggtttcaccatgttggccaggctggtctcaaactcctgatctctggtgatccacccagctcagcctcccaaagtgctgggattacaagcatgagccactgcaccaggcccaatgacagagtatttaaacacaggtctgcctaactacagagcttacatttttaattaaagtataccgtctgtgagcaattcatctccacccttgttggctccacccatacaaaagcttcaagagcttgcgaaaaggggtcttgtccatcatcctagagacactgccccatgaccagcttcttagccttcatttggtgacatttccagctgataataattgttttaacacaaatagaaaaattttcatgatcaaataaacttgttatcttaggtctaatagtgttaaaagaaaaatttgagacaaattaaatttagcagagtttatttgtgcaaagaatgattcatgagttggaccacactcagcacctggagaggctcagagagctccacccagcaacatggcaggcagtatttataggcagaaaaaggaagtgacatacagaaacagcttgattaggtacaggtctgcctttgccttatctgcaggtggtgtgatgaagcatttgtgttatatgcacaatggcccatcagtttggcagcctgtgattggctgaagctcagctgctgtgattggctgagactcagctgctgtgattggctgaagctcagctgctgtgattggctgaagctcagctgctgtgactggctgagactcagctatttgttacaagaatatactcttaggttgcagtttgtttacatactaatttaggttatagtttgctatgtatggaggcagttttagaccaaatttaatttaagttgttatatatttttaatgaggtttccccagtcttcactaacttgtaagcacagaaagggccaggctaatgactgctacaaggcccccatccactgagaaaggcccacctaaggaattctaaaagtcaccttacctaagtcatgtcctcaccaagatgccttctgccagatgcggctgttgctccttcctctcacggagcctttttttggttttttgttttttgttttttttgagatggagtctcgctctgtccccaggctggagtgcagtggtgcgatctcggctcactgcaacttctgcctcccaggttcaagcaattctctgcctcagcctcccaagtagctgggatgacaggcacctgtcaccacgctcggctaatttttgtatttttagtagagaaggggtttccccatgttggccaggctggtcttgaactcctagccttgtgatccacccacctcggccttccaaagtgctgggattacagatgtgagctaccgcgcctggcctcacggagcttttatagcctgcctggtatagtctccctttttatgaactcaaagtcaactgattggtaacttcataatgggagtgacatcccatcatatacccaggttccacctgcacccctttggagatgacattctccaaaagggtccccaggcagtgacgctttcacctgctccttttagtgtttttgaaagagttctttctcttttaacctacaacgacccttccctaggacagagatatgcaaccctgaaatgggatatggattcaagggatggccatcatggcctcggaatctctcctccccatatatcccagctcctggcataggctcattctccactaaagggggtgccactccaagaatgcttgactctccaatatcatcctgctggtgttggcctattgggtctatcctacgtgctcaccaaacacgtccaaacatgtttcaatcctaccaatggacactctacaggctcaggctgcaaaccctactgcataatcaatatgtgtaccccagagaaggatttctttttgttgaaacctttgtggtggaagacaggcaacatgattataaaaccaaaccagcaatgaccctaggttttgaagggacgaagacctaactccagtcccagtcttatcacaccctccctgtatgacaggctacttaccaactagaccctcaattcttcatccagaaatctggaaaaacctgcacagctaaaggggcttcatggggatttaataacatacagatgatgcctacccaatgtctagcacatagaaagagctctgcaaaagcttgcccctttctcatttgggaaatgatgatgccatctttgatgatcttcccttccagatctaatattccataatgcatattgtcttgagtctgaacaatgctggaactcctggattacaatgccaaactcttaagccattaaacattatttcccagtcattctccatgacattcccagctctcagtatcatacaatggttcccaatcgcctcatccagaaaactgctcccccaaatctatgtacagtgagaaaagatcataatcagttctctttttttttttttttttttttttttttgagatggagtctcactctgtctcccaggctggagtgcaatggtacaatcttggctcactccaacctccgcctcccaggttcaagtgattctcctgcctcagcatcctgagtagctgggactacaggtgccagccaccatgcctggctaattttttgtatttttagtagagatggagcgtcaccatgttggccaggatggtctcaaactcctgacctcgtaatctgcctgccctggcctctcaaagtgctgggattacaggcgtgagccaccgcgcccgactgtaatcagttcttatttgatggaaggaaacagacaattcacatctttttcccatagtctccacccacccacacaaacacgtgaaacaaatggtttctaatttaccacatccccacctgtcatccacttatttgggcaaatgctgtctcatatgctatacaaaaaagaggtaaggtctttgccaagaaaaggctgcatatggatccctgattcctgctatgacagttgtcctttttttctttccagaatgccattgacatcctgggcttcagctcagaggagaaagtcgggatctacaaactgacgggagccgtgatgcattatgggaacatgaagttcaagcagaagcagcgtgaggagcaggcggagccagacggcaccgaaggtaactgcatctgggaaagggatgcgattgggtccatctatgttcatgtgcgggcgaggccgtgtgagataaactgcattcatttcaagagctgttcttccaaaactgcataaatcaaatctgggtttcctgaagctcattgtagcatgcactaggaagtctgctcactcagtcaaggactcccagagtagtgaattcttgaaaaacaaaaagcatcattcttgtaaatgaataatcaccacgcactccactatctttcaccatctaaatgtgcctgttttttttaaggtggacttttttgagacaatattgttaggtgaacttctcttctctccaccagaatgcagtcttaattactcaggcctaaaatgaggcctttggtaaagtgggagccaagttttgttcctcccatcgcctccaccccagcgtctgttgaacttgaccctgaaccaagaatggtgaacggttcttcctccccataactctcacctagctgatcctactgccaccctctgccccatccctaagaggcctggaactagagcacagggcagcaggaagggctgagcagtgactgactccccaccatacgtcctgctcattagacttcttagctctcacgatgcttcttacaagttccttgaattaaagcctggcaacatggatcgttcttgataattctgccttttgattacagccccacagtatgtgaagcagtgcgctttaaactctcaagtaataaaaaggaagtgcagccataaattaaagggtgggaaaatctacataaccttatcagtgtcccataaatgcttaccaaccttctatcctaggcctgcctgggataattctccctttttgttaactcaaagtcaactgattggtcaccgcatcatgggagttgtacaggttccactgcactcaagtaaaggaggttatacaaggcatgtacaccagggggcacaccttgggtgccatcctagaatcctgcccatcacagtggaggggactccaagtcttcacacaggaaacacttctgactggggcaatcagggaaggcttcctgatagaaggggcactgacttggactttgagggatgaataggattctgaaaaattgggggagagatcagttcaagcagaagaaatgtcatgagcaggctgggcacagcagctcacgcctgtaatcccagcactttgggaggccgaggtgggtggatcatctgaggttataggtcaagaccagtctggccaacatggtaaaaccccttctttactaaaaatacaaattagctgggcataatggtgcctgcctgtattcccagctactcgggagactgaggcaggagaatcacttgatcccgggaggtggaggttgcagtgagccaagattgtaccactgcacttcagcctgggtgaaaatcgtgaaactccatgaaataaagagaaagaaagaaagagaaagagagagagagggggagaagggaagggaagggaaaggaagggaagggaagggaagggagaaggaagggagaaggaagggaagggaagggaagggagaaggaaggaagggtcatgtgcaaaggggcagaggatgaactgtgatggggatggaggcacagtgagtggtccactttggctacagaacaggatataagcagtggatttgtaagaaatgagaattttaaagtaacaatttttgcatcagtttgggaagatcttgagtgtcaggatgaatggtttagaatatatggcaggccacggaagccgctgtccaagtagcaggggaagtacatgcagacaacctgaaattaatctgtcagcagccaggctcaccaaaagtgggaaaacttgagaagaaaaaaaaaagagtatcaggctcctcagcaacagtggactgcattgatacacgtattgatatacctcagtagggtcccaggccctcttccagccctagcagctgtgtgtgtgcagtgcttaggagcagaaagtggaggactataatcaaggccagtgctccaatgatatcaatgacgataccaacccaagctaatatttgctgggcgctcactagtcaccaggcatgcttcacgacaaccgtataacatgagtattgtcactgtctcccattttacagacaaaactgaggcacaaagaagcaaaaccaaaacctaaacctaaacctaaacctagagcagtccgactctagagcccaggctcttggccactataactgctggaagcagtggagaggccaggcattttgagagtgaaataagcaggacttggtgcctgtctgaacaaaggaatgtcaggggcaagagagagaaggatgtatcacccctttcaagtttaaatgacaagaagaagaataatggtaccatctacctgaatgggcaaagcaagaaaaggagataattcgaggagagagtaaagcacgcatctggcctctgattaagtacttaacatagactgccctagatttttattaactcatctccccacccagcaatgaagcaagggtcccaaccaagaagttgtccctgggggctgggcaaggtggctcacacctgtaatcccagcactttgggaggtgggcagatcacaaggtcaggagatcaagaccatcctggccaacatggtgaaaccccatctctactaaaataaaaaaaaattagccgggcgtggtggtgggtgcctgtaatcccagctactcgggaggtgaggcaggagaatggcgtgaacccaggaggcggagcttgcagtgagctgagatcgcgccactgcactccagcctgggcaacattgcgaaactctgtctccaaaaaaaaaaaaaaaaaaaaaagaagtagtccctggggagcagcatttctctgcctttttgatgagctcaatgcaggccaccaggtccttctcaaagtcaatgaacgtctgctgaaatatatgaaaatatataacccatgaactgtaggaaacagccaaaagtcaagtgcttttgaccatctccaaacatttgaagggagggtcaagttttgtacttctctttcaactatgagcatggtactttgcttaaattaggaaggtgcctcatgtatattgtcaactgtccaagtggtggctcctttactcatataacattttaacgtattgtcagactccaacataactatgtaattaattaattttttttttgagtcggagtcttgctcttgtcacccaggctggagttcaatggcacgatcttggctcactgcaacctctgcctcctaggttcaagtgattctccttcctcagcctcccaagtagctgggactacaggcgcttgccacaatgcttggctaatttttgtatttttagtagagacagggccatattggccaggctgatctcgaactcctgacctcaggtgatccacccgccttagcctcccaaaacgctgggattacaggcatgaaccaccgtgcctggcctgtaatcaacattcttttatgaaatcgaaatatcagtaggtcaaaattggccacggagtatcttattgttaaaactgcatctaggaggcaaattggaagttcctgagaaccatgggcccctggatatgggattaaagcttcagtgaacaagtccagacctggtacagatatgacaacatgaaaacatttaagaaaattacagaaaacacttctgggagaagccaggggctgactggacactttagcagctactgtttttgcatgatgccatttttttctcttccttcagtggctgacaaagccggatacctgatgggactgaattctgcagaaatgctgaagggcctgtgctgtccaagggtgaaggttggcaatgaatatgtcactaaagggcaaaatgtccagcaggtaatggagatgctctgaatccagttgattgagatcttttgctatttgagccattatcttaaagctccttcagttgcaggtatcagaaatgcacatgaaatcagcttttcacattaagaggaagttcatttttaggcttcagaggcaactgaaggaatgcaaatcattaagtgcccattggacgccatgaggacctggaattagaaagtgaagagccctctggagccaggcagcctccctccagctcctctgggattcatgggctgttgagtctctcctctgttgtgtccttgctaggcagataagtttcctggacctctcttgcccgtggccaccccatagctcccaagtttatatctctgtgtttccagcctcaccctgagactgagaccagtgtcttttgatccctattccaaattcttaggagagatactcaattaatccaatctggatcaagtgttcacctctggtctaattaagtgtggccaggggctggagtcatgtgctataaccatgttgttagaaaaatatctttgtgaataggatagttctcaaagaaaggtgaacagcatgagctgggcaaacacctcataaaatatttaatattgcattgaatgatctgaaattgccaatattcaactgcttttgattttctttttttcttttgttttttttttttttttttttgagacagagtctcgctatgtcaccaggctggagtgcagtggcacgatcttggctcactgcaacctccacctcccaagttcaagtgattctcctgcctcagcctcccgaatagctgggactacaggcgcctgccaccacacctggctaatttttgtatttttagtagagacggggtttcaccatgttggccaggatggtcttgaactcctgacctcgtgatccgcccgccttggcctcccaaagtgctgggattacaggtgtgagccaccacgcctagccaacagcttttgattttcgagtcaatttcatatgtttcaacttaatgcagccatagaaacactaactcaagggttgagtgggtgatcctttttcaaggtgaccaattcggtgggtgctctggccaaagccgtctacgagaagatgttcctgtggatggtcacccgcatcaaccagcagctggacaccaagcagcccaggcagtacttcatcggggtcttggacattgctggctttgagatctttgatgtgagttgtgaccttctactttcttgtctgctttgctgaatctccaatgtattttccaagctcactcaaattctttggtatttgaatcacccagttcaacagcctggagcagctgtgcatcaacttcaccaatgagaaactgcaacagtttttcaaccaccacatgttcgtgctggagcaggaagagtacaagaaggaaggcatcgagtgggagttcattgacttcggaatggacctggctgcctgcatcgagctcatcgagaaggtagagagatactgctgcctgggacagctcctccttattgggggccctccccttcttgctctgattcttttctgctcacagattggggcccctagcccccaggctgcaagccttcagatagataactgaatgcctatttgcaaagagaatgaatgtcctaaatctgttctgacacttaaagaggtttacgggtcattaaaatccaagggctcagttatctccaagaatgtgatggaaccccagtaaggactgtggcatttcttacctatttgacttacccaaagacccaaggaggcggaaccatggagcagtgtggctcttggagggatgttaatatgaaaacaggaatagatattaacttttttttttttttttttttttgagacggagtcttgctctgtcacccaggctggagtgcagtggtgcagtctcggctcactgcaacctccacctcccaggttcaagcgatcctcctgcctccacctcctgaatagttgggactacaggtgcccgccaccacgcccagataattttttttttcttttttttgtagagacggggtttcaccatgttggccaggctggtctcaaactcctgaccttgtgatccacccacctcagcctcccaaagtactgggattacagacgtgaaccaccacgcccggccgacattaactttttaaaaaggaattcccataatatttgagcactgctcatgttggaatgagtatatcttcctaaggtggctactgagaaattgggacattattgttcaaaatattactcacattactttatggctatatatgaaactttacttttttgtacacctattgaaaaaagtatgctaggtttatacacacataattttatcctatattcttttgttcagcaaatattaattaagcacatactctatgcctagcactttctggtcatcccccaaacagaccaagagtcttgctctcaccgagcgtacatgccagcattcctggtaccagagtgaaagcaccaaagaaggttttttggcttctccagaccatgaagcatgggtatgcactattatatgtagactctgttatcctctttccagcctatgggcatcttctccatcctggaagaggagtgcatgttccccaaggcaacagacacctccttcaagaacaagctgtatgaccagcatcttggaaaatccaacaacttccagaagcccaagcctgccaaaggcaaggctgaggctcacttctcgctggtgcactatgccggcaccgtggactacaacatcgccggctggctggacaaaaacaaggaccccctgaatgagactgtggtggggctgtaccagaagtcttcgctgaagcttctctccttccttttttccaactatgctggtgcagagacaggtaaaattctatcatttctttccctctgtgggatgttctatgtaatgactcctaacccagagctgcttgtgaagaaccagtaatcagacatgagcttcagctgagtatgatgtttctctttcagctccatttttcttcctcctgctcttattcttcctcttctgtaagagactgggctctatggaggtaaacaggacctctcagtggccaagatagtcaacatcacattgtttaatagttttctactgaggtataattcacatataataaaattcacccttaaatctatttagtggttttggccaggcatggtggctcaggcctgtaatcccagctctttgggaggccaaggcgggggccgatcacttgaggtcaggagtttgagaccagcctggccaacatggtgaaaccccatctctactaaaaatacaaaaattagccgagtgtggtggcacatacctgtagtcccagatactcaggcagctgaggccggagaattgctttaacctaggaagcagaggttacagtgaatggagtttgcatcactgccctccagcctgggtgacagagtgagactctattaaaaaaaaaaaaatttagtggtttttaggatattcacaatgttgtgtgaccatcaccactgtggaatttgagaacatttttcgcacccctgtaacccatgagcagattttttttttttttttgagacagagtcttgctctgtctccaggctggagtgcagtggtgcaatctcggctcactgcaggctctgcctcctgggttcaagcgattcccctgcctcaggctcccaagtagctgggactacaggcgcacgccaccacgcccggctaattttttgtatttttagtagagacagggttccatcatggtggccaggatggtctcgatctcctgaccttgtgatccacccgcctcgacctcccaaagtgctgggattataggcatgagccatcatgcctgtccccatgagcagatttctatccctagcctctggcaaccactcatcaactttctgtccctgtagatttgcctatctgggcatttcatgtgaatggaattatatactggatgctcttttgtgtctggcttctttctctcaggttactgttctcaaggtctggccctgttgtagcatgtatcaggactttgttctttcttatggacaaataatagttcattgtatgaatatatcacattttgtctgcacattcatcagccgatgaactttttggctactgtgcatgatgttgctatgaacatttgtatagaagtttatatgtgaacatatattggcaattcttttgggtatacacggtatatatatacggtacctaggagtagagttgctgggtcatatgataactgtgttcaaaattttgagtaacttctgaactcttttccagagtggttacacaggggccaggcgtggtggctcacacctgtaatcccaacactttgggacgctgaggcagaaggatcatttgaggccaggagttcaagaccagtgtgggcaacatagagatcctgtctctaaaacaaaataaaataagataaaataaaataattagccaaaagtggtggtgcacacctgtagtccagctacttgggagcctgagctgggaggatcacatgagattgggtggctgaaattgcagcgagccatgattgggccactgtactccagcccggatgacagagtgagaccctatctcaaacaaataaataagtaacacaagccagtaacactttttaagattaccagtaaatatacttttaaatagtagccaacatagagttttaacattatatgccattttaaatgcatacatttaataaattaataaaatatatgaaatataattattcattagataatgagatcattttttaaaaatgaaagcctaatgtcctctgggccagggaatgtaataaataggaaatgggcacatgcgtaaacttcaatgatgaaaatcattttctttgaatctaatcacaatgtctctgtaactacattgcataacctcgcctagagataacatcaactctaacataagaccctgtgtggatgcggatttgggaaagcgactttcctgccttcccttccccaatccaaacacacagtcatgctagaccccggggacaaagtgggatgaagggaaaggaacatgggagagactgggacatgacattttcccccaaggctgcatcttgattaagtatcagagaaaattgagtcattcagaaaaagcagactccaaattaagatggcaaattgggttgtttcctgtaggaaagaaaaagaaatcaacttataaaatattgttgagaaaattccgttttattactttcagttacttactctttagagataagcagggattaaagaatgaaaggaggtaaattcatgaaagaaactacaaacattgccaggcacggtggctcacgcctgtaatcccagcactttgagaggccaaggtgggcggatcccttgaggtcaggagttcaagaccagcctggccaatatggtgaaactctctactaaacatctctactaaaaatacaaaaattagccaggcatggtgacgctcgcctgtagtcccagatacttggggggctgaggcaggagaattgcttaaacctgggaaacgaaggttgcagtgagccaagattgcaccattgcactccagcctgggcatcgcagcgagactccatcttaaaacaaacaaacaacaacaacaaaaagaatgaaaaaaaaaaaagaaactacaaacattaagagggacatctcaatcttgcaaattattcagtttgctttcagctctgatttctaaaggaaaggactccccttttctactgagagtttaagttatactcccagttaaatgctatccacaccccattcccaccccattcccacaatgataaagctgagggttcttaatcctgggtagtttgggggcattttaaaaacaaacaggccaggcacggtggctcatgcctataatcccaggactttgggaggacaaagtcaggagttcgagactagcctggccaacatggtgaaacctcatctctactaaaaatacaaaaattagccaggcatggtagcacacgcctgtagtctcagctacttgggaggctgaggcaagagaatggcttgaacccgggaggtggaggttgcagtgagttgagatggtgccattgcactccagcctggacaacagagcaacactccatctaaaacaaacaaacaaaacctcaagtctcttatgtcaaaaggaaaccagaactcggggctgggaacgggtggttcaggaagcccactgctgggtcctctgggatgcatctaacacgctcttctgtgtctgtctccaggtgactccggaggaagcaagaagggcgggaagaagaagggctcctctttccagaccgtgtcggccgtgttcagggttggtgttttggcagcttccatattcacttgtttttctccccagtgaaatggcatttgctaaatgtgcttgttttggtttatgtcccaggaaaatttaaacaaattgatgactaacttaaggagcacccaccctcactttgtacgatgtctgattcccaatgagaccaagactcctggtgagtaccagcagatcttgccaagtatttgaacagaacaggacgccctgagataaatgcaaaattctgtgggtgtgcgtttggaaagagtgatggtctgtatcacttctgaaagtagtctctgaaatagggttgccagatttagcagataaaaataccggatgtacccaacacaaagaaatgataaatgtttgaggtgacagatatcccaattatgcagatatgatctttgcacatttcacgcttgtatcaaaatatcatgtgtaccccataaatatgttcaactattatgtaaccacaaaaatgctaaaaaccaaatgccatattaaatgttattaaatttcaatttcagttaaacaatgaaaaatgtctaagtgtgacctatgcaatatttggaatatacttcctctaaaaaagtattcattgtttatctgaaattcacattcagcagggcatctgtatcttatctggcacccctactatgaaatcatattcaaaatattgtgtgtatgtatataggcacatcagagccacagctttcataagataaaggctctgtttaccccaaagttaaataccactacatttggcaaataatcatcttgggtatcccataatcaaaatagcatcaataacaactgtttgaagccatactgcatgtcaatcactttgttatattacctcgaatccttgcaacagttctctgcaagatacgcgtattgatctccagtttataaatgagaaaactgagaatcagagactatatataaatacagaaccctgtgcaatacagactatatataaatatagaaccctgtgcaatagaggactcctttaactgtcacttcatcctgatttgcgaatattcttggagtctagctttttcagtgtcatttgtcacaaaaaggaaaacaaactgtcacacggagctgtggctatggggtagctaactcaccagctgagctgttctatgcccaacacgggcctcccagctcaggattaaacattctgcctctgcaacattatgagtgaacagaggtatacgttgtcggggggttgggggggaaaagttcacctattaccacgtgatcctaagcagagtatttgagcactttctgcctcagctttcttgtccataaaacaaggataggccgggcacagtggctcacgcctgtaatcccagcactttgggaggccgagtcgggtggatcccgaggtcaggagatcgagaccatcctggctaacatggtgaaaccccgtctctactaaaaatgcaaacaaattagctgggcgtggtggcaggcgcctgtagtcccagctattcgggaggctgaggcaggagaatggcgtgaacccgggagacggagcttgcagtgagccgagatcgtgccactgcattccagcctgggcgacagagcgaaactccgtctcaaaaaaaacaaacaaacaaaaaaaaaaaaaaacaaggataaaagtggcattttaatctattatttacttctttaataagcactcataaagtggttactcactttgcaaatattagctcatttaacccaccttagagggttgtcgtgagggttcaatgagtaagtgcaagtcaagcatttacaacagggctgagcacattgtgaacacccagcaaatgttggatgctaattattattattattattatcactcagaactagaaagtttaaatccccaatagccaggtgtgttatagttagtgaaactgcatcttccatgaaagttaggttctaaagtctaagtcaaaagcaataaccaactacatcattgtgatatgcattatctggggcatcctgcagcctcctgaccaatgagccggcttctccagtgttgggaagagtggtttctttggttaagaatcacacgaaatcactggcttgtatgtaggtcttggaaaatatccatttctgttactgtcgtcattgagtacatgcttgcataaatcaaacatgcttgtggcctgactcctctctaagcagatggcctgcaagatggtgggggatggcttcaaactgtgcctctgggaggaatgcttttggtaatccactggcttacttttttttcttttttgagacagactctcgctctgtcgccaggccggagtgtagtggcacgatctcggctcactgcaacctccaactccctggttcaagctattctcctgcctcagccttcctgagtagctgggactacaggcacacatcatcatgcccagctaatttttgtacttttagtagagatggggtttcaccatgttagccaggatggtctcgatctcctgacctcgtgatatgcccacctcagccttccaaagtgctgggattacaggcgtgagccaccgcgcccggccctacattttctttgggaaggtaaatgttgctgaaatgtctgtcctttcctgttgcatttgcttctccttagctctggcacctacctctctgttttcatgtcaatttctgggaatagcccaacactgatacagaagcctggtgacaccttagaaagcacctagtgtgccctctttattttctagaagactagagactatggagatttccatgccttaccccagggcacctagagcaggggctgggagtcacgatccatgatcaaatctcaagtccctccccacccacaggcacatacggggcttgctagttgttctcctgaatcctctagggcttcatgggcacaggtcctctgctcgcctgctgaacaagggcccctcgggagcaggctccagcctctactcctctcgttctcctcttgcagcaaacctggagcctgctaagtctgtgctgctgactcaccaaaagctggcttgctgctgtttttaaatgtaggttttattattgttaagggatggtgaggccaacagaccagaagatggttaccattaaaaagacagtcacggccgggcatggtggctcacgcctgtaatcccaacattttgggaggctgaggtgggtggatcacctgaggtcaggagtttgagaccagcctaacatggcgaaaccctgtctcaactaaaaatacaaaaattagcctggcgtggtggtgcatgcctgtaatcccagctacttgggaggctgaagcagaattgcttgtacccaggaggcggtgggtgcagtgagccgagactgcaccactgcactccagcctcagtgacagagggagactccttctcaaaaaaaaaaaaagacacagtgctcaagaggagggggcctgccacagagggccacgaggggaagcaccagagctaggtttggggttgggggagtaaggagaaatcacaggccagagccttgagggtcattcccatgggatggagcaggcgaggtagcatgaacaggccaagcaggttcagcattgccaagtttgaatggtttcagcaggcttcaaaatgtagggactttctcaagttggccggtacccggggccctgaggtgaccaggacagggaagtattggcccagagtgtaagagccctgtgagagcctgataaaggtaggggtcgggggttaagggctttggatggctggtttgcatgtgaaagacgtgcttgcaggaggcttttttgccatctcctggaatggctagccccgggaagggcagtctctcctgagccagcgaggaggccccatgatgccggatcatcataagatacagcatatttcaaaagcatggctaataccactgcccacagaggccaagatggctggagaaaggagtgggatggaagtgatacacttggagaaataaagaggaaaaacccttcagcggctggagcagaaggatgagagaatagctcaggggaatttttagaagttttacgcattggtacaaaagcaaaggaggccctttacgtggacctgatagaaaacatctcaggccgggtttaaggaaaaacaaagcaagccctaagagaactcagctcaggattctgagtctgcacaaaccagaggggccctgtgagagagaagagtggcgtctcggctctgctacagctttgcaaagcccttcacctctctgggcctcagtctcccccagtgccccgccaccccataggatgcctctgcgggaattagaaaagatctcccagtccaagtcggacacgacccctaacaggatggacagcctggcaagcatggtggcatctctggcctccccactgtaaaatgatggtcctttcagctttcttctggctctagaagcttcaattctcttgtaactatgcctttttctctctgctcccggtgcttaagaagaaagaggcctcagccacatggttaaagcaagtgttaatcatgcctgctttcaccattttaacctttgtactcatcttttctctctctctctttttttttcaagacagggtctcactctgtcgctcaggctggagtgcagtggcgccatctcagctcactgcaacctctgcctccccagtttaagcaatcctcctgcctcagcctcccgagtaactgggatttacagggacgcaccaccacacccagctacgttttcatatttttagtagagaagaggtttcaccatgttggccagggtggtctcgaactcctgacctcaggcgatccgcccacctcggcctcccaaagtgctgggattacaagcgtgagccatcgcaccgggcctgtactcatcttaactcatgtaatcctcaaccacctgatgaagcagatactacaggttgattatccctttatctgaaatgcttgggaccacgagtgttgtgaattttaaatttctgtggatattggaatatttgtatgtgcctaatgagctatcttggggatgggaccaagtctaaacacaaaattcatctgtttcatatgggtcttatacacatagccctaaggtaattttatacaatattttaaataattttgtacgtgaaacagttttggctgcgacctgcctcatgaggtcagtcgtggaattctccacttgtggcatcaggttggagctcaaaagttttcaggttttgagttttctgaatcgggatgctcaacctacattattatccttattttacaaataaagaaattgaggcagagacaggccaagtccgcgaagctagtaaacagcatagctgggatcttaaccactcagaatcatcatctgagagctcatgggagtcgaattagaccattgctaaggttctctccacatcggcggttctatgaattttttaattattgtatttatttatttatttatttatttgagactgagtcttgctctgtcacccaggttggagtgcagtggcacaatctcggctcactgcaacctccgcctcctgggttcaagcgattctcttgacgcagcctcccgagtagctgagactacaggcacctgccaccacgcccggctaatttttgtatttttagtagagatggagtttcaccatgttggccaggctggtcttgaactcctgacctcaggtgatccacccacctcgacctcccaagtgcggtgattacaggcatgagccactgcacctggccagttctctgaatgtctgagacattttctccttgctctcaaccatgttttctctagagaatcaccacctgataggactttcagaaatgattaaatgccccatgtctgcactgttcaatagggtggccaccgttacatgaaatgtttacatttacatgaaaagttttaaaatgttaattaatttttaattttaatgaatttaaatgtaaatagccacatgtggctggtcactacggtatctgacagtgcagctctaccaaagccttaaaaatcatctaattgtatagtgatgtctccccacagctaccagggaaccacgtgggcattctagaagcttccctaaggttaagtcaaagccagccttggccccaccactcccaccccggcaacttagggagcccacaaagagaagccatcaggttgccgtagcccctgtcctctaacccctcacgcagacctgagacagaattttctccatcctagtttgatttgtgcctgacccaggctggttaccacgagcacccacattacctccccaaaggggcttgcccctctagctcctctccttccagccaagctccatttctcccccaattcctatagcaggggctgagtggtcagcagatgaccgccgccctaccttcaacccccttctgggtcccctcccacggcctcttctttttttttttttgaggtgcagtttcactcttcttgcctagactggagtgcagtggctcaatctcagctcactgcaacccccgcctcctgtgttcaagtgattctgctgcctcagcctcccaagtagctgggattacaagtgtgtgccaccacatctggctaatttttgtatttttctgtagagactgggtttcaccatgttggccaggctggtctcgagctcctgacctcaggcgatacacccacctcggcctcccaaagtgctgggattataggcatgagccaccgcgcccagccggcctcctcttctttgctgggttactcttctgcagccacagcctgcagatttttccatccccatctttgtgtagatgcaagaagacatctcgggttatcccatgggaagcccaagtgcaccctgtactcactctgcagcttttgcagccttgctgcagagtcagggctgaggacagaaagcacaatgctttggctcttactgccacggttatggggtgctagcatctccccaagagggtgggattatttcactgcgggacctgcaggcaggctctagccacccccagccctctaccttggagctggcactgactctcccactcactgactctcccactcaagtgtggatgtgttggagggtctcatggtgcctcagaccatcaacaacaaatgaaggggtcacaggcacacccccgggacgttctctctccaggtgtgatggaccactacttggtcatgcaccagctgcgctgtaatggggtcctcgagggcatccggatttgcaggaagggattccccagccggatcctctatgctgacttcaagcagcggtaggttccctctctcctgtgcatctctctccttccgagggcaccttttgcatttccctaagacatttcttgacctgggtatttggtgagctcccaagtcccccagagtttccacagacttcatctcttgctagaggaactgatcccatgcccacagtgagtgggccagcccaagtggttccaaattcagatcccagaccctctagcctgattgtgactctagaccaggatgtctcaacttctgtactatggacactcaggctagatcatcctttattgtggaggctgtgctgggtgtgggaggattttagcagtaaccctgccctctactcaagagatgtggtagcaaaccacacccctccccactgagctgtgacaatcaaaactctctagacattgccaaatcacacccagctgaggcccgcagctctagactaactctctcctctgagccaccattgggttgcacaagtccgggccttgtccaggatggaggacaggagaggaccttccagaagtaggagaaccacggcctacaggtcacggttgatttcaaggcctcttttaagccagagaagaaccatttcctctgaaagcaaacttcccgccatgcactcagctgggctcccttctttcatgcttctctcccacccaccttgcttctctcccaagggggctgattcaagcccccttgctagaatcagtccctagctattcccatctcccagaccagctgtacagtattccacttcctcctaaggcttgagcaggagaagattctagaaggctggtctcagctatgaagcctttcggggattggaatccatttgggaaatgtcctctctccttaggtaccggatcctcaatgccagtgctatccctgaagggcagttcattgacagcaaaaatgcctcagagaagctcctcaactccatcgatgtggaccgggagcagttcaggttcggcaacaccaaggtgagcacaggcaaggctgggactcccctagtaaccccacagccctgggctgcttgttagctgatcagaaaaagggtccccttctccttttggtccacctgaccgtccttgcccagtcgcccaggtaaggggagctctgtgtctaggtagacagagcttgtctccctgttggtttgtaagtggctgaaagcttagattggaagcctgagccccaccatgcagcaaggataggaaaagccaatggggaactctagtgtcccagaggtaagaaagagctgaagagagaggagaacatagagaggactccagggacactgaggccttgaggagaatgactataaacaataaaatcagctaccaagcggggcgcagtggttcatgcctttaatcccatgcttttgggaggctgaagtaggatttcttgaggccaggagatggaggctgcagtgcgattgatcatactactgcactccagcctgggcaacaaagtgaagccctgtctcaaaaaaacaaaaacaaagacaaactagctgccatttattgagcacgtgagtatcagccctgtgagaagcctcctgcacatacttcactgactcctcactaaccagcgaggtgggagtgatggtgataagggtggcacttactcatcaggttcttgggaggtcgagaaacttactcaaggtcacacatggatagatagtaagtggcaaaggtcagcttcaaatcctggcctgcctccaaagatccacatctcagaaacgggcaggctgggggtctccagcaaggaagagcctgctggccccagagggtgcttagtttccctggaatgttatggagggagtgggcaaagtgggcctgagcgtgggaccaaccttcccagatggacagaagaagagggtgaagccaacgcatctgtgaatctctctgatctgggcacaattgcgtcccatggtttctttctggactcatctttgtttcctgtatgtgagctctgtcagaactgatctctgtgggttggtggggcctggaacacacgttgtttttgtcgttgttgttgttgttttgtttgtttgttttgttttgagacagagtcttgctctgtcacccaggctggagtgcaatggtgcaatctctgctcactgcaacctccacctcccaggctcaagtgatgctcctgcctcagcctcctgagtatctgggattacaggtccccaccaccacgcccggataatttttgtatttttagtagagatagggtttcaccatgttggccaggctggtctcgaactcctgacctcaaatgatcacctgcctcggcctcccaaagagctgggattacaggcatgagccaccatgaccagcttggaacagactctggaccaggctgcctcactgcccaggaggagccactgaggagaccagagccaccgagaagcaagtcctggaaacagaattgctgcccctgccgtgctctgagagttgagcctcagagttgagcagaaacaggccccctcaagggcccggctgaacgcctgctggggaaaaagatcaaggctcctctgtcttttaatgcaggtgtttttcaaagctgggctcctgggacttttggaggagatgagagatgagaagctggtgacgctgatgacaagcacgcaggcggtgtgcagggggtacctgatgcgggtggagttcaagaagatgatggagaggaggtgacacagaccctcacctccaccttatcctgccctctctgcttagcagctgattgtcacttcctgcttttagtcttgggatttccatgtgcttgctctctttccttcatttgtttaacccacatctactgagcggcaatcctgggctgggtgctctgcatggcgctggggagacagaaatgaaccctccctcacagggtcacaaaggagtgggaagcagacgcatgtatggctggttttaatgcctgtgacaagctcaatgttcgagttatagtcgggggatagggaactggcaagaataagcccccagcctgattagggggttggagttggcatgaaggtgtcagcaagaagaaagcactttcttttttcctttttttttttttttagacagagtcttgctctgtcatccaggctggagtgcagtggcacaatctcggctcactgcaatctccagcttccaggttcaagcgattctcccgcctcagcctccctagtagctgggattacaggcatgcaccaccacgcccggctattttgttttttgtttgtttgttttgttttgttttagagatggggtttcaccatgttggccaggctggtcttgaactcctgacctcaggtgatccgcccgccttggcctcccacattgctgggattacaggcgtaagccactgcgcccagctgacgaaagcactttctgaagcaagctctacacaacctgagagtgggtggtctgggaggaagcccgacaagcaggtggctgtcattggaatagagagcaagaggcaggtagtggaggtccctatgtgtcacattcagaaacccaggctgcaccctgtcattgatggagagctgtagaaggtgtgtgcagagacaaggggtaggattgcatcactctggcagctaggagagtgaacacaaaggctatgacggggcaaggccacagtgtggtagaagtccaagtaagggatgacaaggacctgaagtaggacatagttgatgggtgagagaggagggcatggattaaaggaatgtttaagtctttttcctttgataattcaagagaaggaatagcagcattgatgactagtcacctgcagggattggagggagaggggagtgtgggagggagcctgttctccctggttccctgatcccctgtgtggctctaactgtcagagccataatgaaccgccaccatgtatgcgtcaggaatcactcccaggcatcgagcttggtgaagcacatggaagccagcacggagatgaaaagaatctcaagaagggaaagagaagccagtgttcaggaatccataagctatgtaaatataaagctgtggagggtgaaggggaggagatcatgtgggtgacactgggatgaaaacagcagtagaaattaggaatacaggctggttgtggtggctcacgcttgtaaccctagcactttgggaggccaaggcgggcagatcacctgaggtcaggagttcaagaccagcctgaccaacatggtgaaacccagtctttactaaaaatacaaaaattagccaggcgtggtggcgcatacctgtaatcccagctacttgggaggctgagccagaagaattgcttgaacctaggaggcggaggttgcagtgagccgagattgcaccattgcactctagcttgggcaacagagcaagactccatctcaaaaaaaaaaaaaaacgaatagaaaagaaagaaattgggaagacagatcaactctaccagggcaagagactgggaaatgaccaaggacaagtcctgggtttctccagcaggaagaggaaccccatatggcaaaatacagtgaaacagggaaaatgtggatggaatttaaggcagagaaagtttcaaaagttaagagctgattaatacatcaaacatgggagaaagacccaatagaataggaatgaaagctattccttgcattgagcattaggaggtcacggacgccctcaggcagggcactctcagtagggtggtgggaagggcagccaggtgaccaggagcccgcaggtagctccacgccctctcctaccttccaacctgtgcacgtacctctgtttcctctgcccctcatttgcagacctactctggatccagaggatctgccaagcttggctgcacctccttcccacctaaccgagaaagacggaggatggggtccgtcggggacaggtggggggtgcagagaccagaccttgctggatttattaatttgagtcctaatgggtgtacagggactccatcttctgcatccagtacaacatccgctcttttatgaacgtcaagcactggccctggatgaacctgttcttcaaaatcaagcccctgctgaagagtgcagaggccgagaaggagatggccaccatgaaggaagactttgagaggaccaaggaagaactggcccgatctgaggctcgccggaaggagctggaggagaaaatggtctccctcctgcaggagaagaatgacctccaattgcaggtccagtctgtaagtaccttctacttgagaacgcaaaacacagactctggaggacagaaaagggggaggaacattgagggcgccatcaggtgtctattcgagagacagtggtgccacccagtggtcatgtggagtattgcagcaccaccttgctcgtaaaaggatgcctggtcccgggcttagcaaagcagtgaatgccggaaattatgtctgcaaagagaatttgtgctctccctgatttctccccgtcatcgcagagttagatatattttgctgtgggcatgagggatatatatgtgtcatatgtatatgcaccacagcttttaaaaatcaataaaaataaaaataatcaaaattaaataacccaattcaaagtagcaagagtaattttctatatattatttacaataatatgtaaaaagtgctttaggccgggcgtggtagctcacgcctgtaagcccaacactttgggaggctgaggtgggaggatcgcttgagcccaggagttcaagaccagcctgggtatcatggcaaaaccccatctctgtaaaaaaatttttaaaaactagcaggcggccgggcgcggtggctcacgcctgtaatcccagcactttgggaggccgaggcgggaggatcacgaggtcaggagatcgagaccatcccggctaaaacggtgaaaccccgtctctactaaaaatacaaaaaattagccgggcgtagtggcgggcgcctgtagtcccagctacttgggaggctgaggcaggagaatggcgtgaacccgggaggcggagcttgcagtgagctgagatcgcgccactgcactccagcctgggcgacagagcgagactccgtctcaaaaaaaaaaaaaaaaaaaaaaaaaaaaaaaaaaaaaactagtaggcatggtggtgcatgtctctagtccaagatactcagaaggctgaggtgggaggatcacctgagcccaggtagtcgaggttgcagtgagctgagaacatgccactgcactccagcctgggcaacacagtgagaccccgatctcaaaaaaaaaaagtgctttaaagatacatagttttatcaaagaaatggggcagtataggctggacacggtggctcacacctgtaatcccagcactgtgggagaccgaggcgggcagatcacaaggtcaggagattaaggccatcttggctaacatggtgaaactccgtctctactaaaaatacaaaaaaaaaaaattagccaggtgtggtggcacacgctggtagtgccagctactcaggaggctgaggcaggagaatcacttgaacccaggaggtggaggttgcagtgagccgagatcgtgccactgcactccagcctgacaacagagcaagactccgtctcaaaaaaaaagaaaaaagaaagaaagaaagaaaaagaaaagaaatggggcagtataattgtctctttcacagagtgaaggcatttataattttccctttttaataaatccccaaatacttttaccttttgtttttatacagagcattttccgctccccttttcactttcccaatcactatagtgagttaataggagcactttcccaggtacagcggacaagagaacagctcttggaacaagataactgggtttctatcccagatgctccacctgatagctgtgtgaccttggatgagctacatatcctctttgtgcttctgttatctcgtctgtaaaatgggcatagtcagagtactcacctcatccagctattgaaaaatcagagtggttaatgcctgtaaaatgcctggcacacagctcatgtttatagatgttcagcaaacattagcatgcaggcttgccagtctcctcccatgcattaccctgcagtgtgtgtcttaaaatactcttatatgggccgggcgtggtggctcacgcctgtaatcccagcactttgggaggccgaggcgggcggatcatgagatcaagagatcgaaaccatcctggccaacatggtgaaaccccctctcttctaaaaataccaaaattagctgggcgtggtggtgggcacctgtagtcccagctactcaggaggctgaggcaggagaatcacttgaacccaggaggcagaggttgcagtgagccgagatcgcgccactgcactccagcctggcaacagagtgagactccgtctcaataaataaacaaatatataaataaatattcttatatgggaagatatagcccgatttagaacagaagtagctgatcttggtctgtccaagagactcactgcagcatcttctgggacatatgtattcaatcacgaattcttgggtgtttttaattttctgttctgtggttcgaggagacacagctaaggagacataggcagaacttttctgttgaaaggaccaggcctggtggctcatgcctataatcccaacacttttagaagccaaggcaggaggatcacttgagctcagaagctcgagaccagcctgggcaacatagtgataccttatctctagaaaataaataaatccatatatttaaaaataaatttaatgaaagttaaaagatagtaatgttttgaaactattttgtcagcttgagataacatagagtagatgagtcattttccaactggtggtagcaggaagagtgagataaccagctgttcaaatgtggcaaatttctagaggcttcattctttaaaatgaacttgtaatttcacaaactcctctgtttgaaattattataagtgaggccaggcatggtggctcacacttgtagtcccagcactttgggaggctgaggcaggaggatcacttgaggctcaaagtttgagacaagctgggaaacacatggaggccccatctgtacacacaccaaaaaagaagccagtcatggtggcacataccttgtagttccagctacttgggaggctgaggtgggaggatcacttgagcacaggagtgtgaggatgcagtgggctacactcacaccactgcactttagcttgggcaacagagcaagcccttgtctctaaagaaataaatgaacaaattattatatgcaaatttctataagcaatgttcttgctagttaaaaaaaaaaaaaaaaaaaaaaaaaaaacatgtatatggaccaggtgcagtgactcatgcctgtaatcccagcactttgggaggccgaggcggaaggatcacctgaggtcaggcgtttggagaccagcctggccaacatggtgaaatcccatctctacaaaaaaatacaaagattagccaggcatggtagcacatgcctgtaatcccagcaactcgggaggctgaggcagggaatcgctagaacctgggaggcagaggttgcagtgagcaaagatcatgccgctacactccagcctgggccacagagagaaactccatctaaaaagaaaaaatgtgtttatgggtgatatctaagtttatgtacacgtgtgtgtgcagtgtgtgcacatgtgcatgcatgtgtgtgcatgacccatttcttggcttaggtgtagataataagcttttagagggtgataccctttctttgtagcattttcaaagaggccaatcaaaacataaaatgacctggttctttcaggaaacagaaaatctgatggacgctgaggaacggtgtgaaggactcatcaaaagcaagatcctactggaagcaaaagtcaaggagctgacggagagattggaagaggaagaggagatgaattctgaattggttgccaagaagaggaatctggaagataaatgctcctctctcaagagagacattgatgacctggagctgaccttgacgaaagttgaaaaggagaagcatgccacagagaacaaggtgagcaaacccaagggactcccacagtgtcttaacaggcttcactctctctctctgtaaggaggagaaagggtggcgtaggagtccagtcaatataacattgcccagaaatgagaggctggcgtcaaggtgaagggtagttaagtcccaacaagttctgtcctctggtgtcttttctacccatagactcttcttcttcttcttcttcttcttcttcttcttcttcttcttctttttttttttttttttttttttttgtgagatggagtcttgctctgttgcccaggcagatctcgctacagtggtgccatctcagctcactgcaacctccgcctcccaggttcaagcaattctcctgcctcagcctcccaagtagctgggattacaggcacacaccaccatgcccagctaattttttgtatttttagtagagacggagtttcaccatgttggccaagctggtctcgaactccttacctcaggtgatccacccacctcggcctctcaaagtgcttggattacaggtgtgagcccggccccataggctcttctcaaccctccctggctgtatcacaaacttctagcatttctttgagaggaaggactgtttcatattcttcttcagttcccatagcaccaagcacagggattgcaaacaagaaggcctacaggggtcaggcagatagtgaaggaggcagaagactggataacaccaaggattgactgagaggagcaggtaccggcaggacagagactgatgcagcctttgggaaagttatttggaattactcagtcaaattaagaatccagataccctacgacccagcaattctgctcctgggtgtatagatcaaggaattcttccacctgtccataaggcgacatgtcctagggtgtttgtagtggcattgcttgcgggagacagctggaggcagtgccagggtccaccacggggaaaacggagaactaaaatgtagtagataacacagcagggagcactacgtagccattaggagcaatggcgtgtgcacaccaaatattaaatacctactgctaaatggtggaaaaatgtaagaaaatgaaatatagggccaggtgcggtggcttatgcctgtaatcccagcactttgggaggccaaggtgggcagaccacgaggtcaggagatcgagaccatcctggctaacatggtgaaaccccgtctctactaaaaatacaaaaaattagccgggcgtggtggcggacgcctgtagtcccagctactcaggaggctgaggccggagaatggcgtgaacccgggaggcggagcttgcagtgagctgagactgcgccactgcactccagcctgggcgacagagtgagactccgtctcaaaaaaaaaaaaaaaaaaaaacaactgtaacattgtaaatgataacattgtaaaccactatgtggactaaagaaaatatggccagattcagcccatagattaggagttagcaacttctgatctggaagcctgttggatgtggaaaaaggtttcacttacttccttcaagttccgtgttgggtgccctcctcctgcttcctgataacacagcactcccgttctgaattttctttctttctttctgtctttatttttgagacggagtctcgctctgtcaccaggctagagtgcagtggtgcaatctcagctcactgcaacctctgcctcctgttttcaagcgattctcctgtttcagcctcctgagtagctgggactacaggtgcccaccaccatgcctggctaattttttttttttgtatttttagtagagacgaggtttcacgatgttagtcaggatggtctcgatctcctgacctcatgatccgtccgcctcggcctcccaaagtgctgggattacaggcgtgagccaccgcgcccggcgtgaattttcttgcgtaggacctcacgcctctcctccccttcctgcctcattctaaaccctattcagccaacctaacaaacacatttccacagacatattatgagcgaatatagattgatgttttacccttcagaggtagcacatttgcattttaaaagcgcccttccttgtaaaatataatgccctccttaaatgaataatcctaatgggagaatttgaggcaccatgatagaccgttaaggaagataaagaactgagagtctgtcaattctaggaggtaaaaaagtagtagccaaaaagaaaagggaaaaaggaaaaatgagcaaagaagcaatagcttttgttgatggaagcttctggcataatcgtttccatattaaatcggtgttaatattgtcccaggtaaagaatctttccgaagaaatgacagcacttgaagaaaacatttccaaattgaccaaagaaaagaaatctctacaggaggcccatcagcaaacactggatgatcttcaggtggaagaagataaagtcaatggtctaatcaaaataaatgccaagcttgaacagcaaacagatgatgtgaggatattttactactatgctttagcatttatcacttgtggaagcacagacaagagacagtctaactaggacacagggcttgagaggtcagactctggaatcagcatccctaaattcagatctcagccccaccctgaccctgaaggagtctgggatactgagcaagctgcttacccttgcaaagcctcagtttgtgccttgtgaaatggcgatgtaaatagctccatctcagagggttttcacagaaagctcagcacacagaaagtgttcagtaaaacatagctgctactattgctatcatcaccatcatcattattattagcatccacttgtaggtcctttgggttccaaaacctccaatcctgttgtaacgttactaaagatgagttccatttgtggccatgaaaattactatttctgcccccgtcacatgacattattgttcttgatgtaagagccacgtttgaagttttcaggttttactcactattgtggctagagattttctagataactttaatgtttctgagcccagggtaggtgtgctcctcctctacacccttttcctgttcctatgtatgcatgtgtgtatgtgcacacacatacacacacacgaattccttgcctcccatggttgcataatgttagcaggcaaggcgtgatggtgtgtagcacagaccttcacagtgctgtccacagaagcccccatttgtattgtctgtgcaagagtgtgcacccatgggtaccatacccctacagggaacatagtctgggccaggccaggtgggaatcagctgagagaggcaccaggaggcccctgagggatccagccccaccctgggtagtcttttctggaagacagaagagaggggaggtaggggcaagacttgcttcctcctggggccagaggcttgcagccagcaccctacaggagccccaggaagccccaggccacgtgtatggctacactggataaacggggcaaacacttccccagcaggggcttaattttctacctgtgtgtcttctcagcttgagggttccttagagcaggagaagaaactgcgggcggacttggaaagggcgaagaggaagctggaaggagatctgaaaatgtcccaggaatccattatggatctagaaaatgacaagcagcaaatagaagagaaattgaaaaagtagatatttcttttaccacctctgtgtctcagcctaaaagccaactttcaccccctccaagaggcttgtatttcatgttctttatttttttttaatctatttgcaggaaggagtttgaactcagtcagttacaagccaaaatagatgacgaacaagtccacagtttgcagtttcaaaagaagattaaagaactgcaagtaaaagcatcaaaaccttcccaatcatgacaatccctttgcaagagcgcccctcctcactccttcccccttgtttctttagctgcttctttccttcctcctgctaaagctagagaagatgtcctgtcatttcctttagtttttgaaaataatattttaatgttctgaataacccataaacatacttccttgcaaaggctcaaaataggcccagtaaagctaaatattattgttaagggtgctttgatcgccatccctaagcccagtgccctccccgtcttctgagaattaattgccaatttcactgggatgtgcatctttctgcctcttttgctatgtgtttttgtacacatttaagactccccaaaaaatatatagtacacatgcagaaaaggttcttgtttcttcatattcttagcatatcacactgagagtatcactctgcaatttgctcctttcttttggcaacatgatctgcagagctatccatgatagacgtggatttgtgtctacctgctccatagacttctagaacaagtctccatcacaatcgatttgtgcattctcttatccatggacacttaggttgtttccaagttttttcaccaatttaatgttataatgtattcttcttttttttttttgagaccgagtcttgctctgtcacccaggctggagcacagtggcacaatctcagctcactgcaacctccacctcccaggttcaagctattctcctgcctcggcctcccgagtagctgggactacaggcgcccgccaccacacccggctaatttttgtatttttagtagaggcggagtttcaccatgttggccaggctggtttcaaactcctgacctcaaatgacccacccacctcatgctgcctacccgcaattcctcaacacccagcccctctcaaagggggctgccccctcctccacaataacattcctgatagagtaatcctttcaggcccgcatagaagagctggaggaggaaattgaagcggaacacacgctcagagccaagattgagaagcagcgctcagatctggccagggaactggaggagatcagcgagaggctggaagaagccagtggggccacttcagcccagattgagatgaacaagaagagggaggctgagttccagaaaatgcgcagggacctggaggaggccaccctgcagcacgaagccacagcagccaccctgaggaagaagcaagcagatagtgtggccgagcttggggagcagattgacaacctgcagcgggtgaagcagaagctggagaaggagaagagcgagctgaagatggagattgacgacatggccagcaacatcgaggctctctccaagtcaaaggtacctgactggcccttctgctcttggagaatgcaaggcagccgacggccacctgcccctgggcacgtgtaatttgatgcctccaaaccactgcatgttctacactgaaaccctcttccctatttctgcctgtttctagttcctcaaatttactcacgtcctttgtcttatccatttgtgcttctgtaacaaaatattttagactgggtaatttataaacaacagaaatttatcactcacaattttggaggctgggaagtccaagatcaaagtgccagcaaattcggtgtctgtcggaggcctgttcctcacagatggtgccttctcattgcatcctcatgtggtagaaggggtgaacaagttctctcaggcctctattataagaacactaatcccattcataagggctccacccccacgaccttatcacctcccaaaagccccaccccccaacaccactggactggaaattatgaattttggggggacacaaactttcagaccaaagcatcaagatcacttgattcaagcacaattggatgatctggcaccactgtttcgctcttgttccccaggctggattgcagtggcgccatctcagctcactgcaacctctacctcccaggttcaagcaattctcctgcctcagcctcccaagtagctgggattacaggcacacgccaccaggcctggctaatttttgtatttttggtagagttggggtttcaccatgttggccaggctggtcttgaactcctggcctcaggtgatccacccacctcagcctcccaaagtgctgggattacaggcatgagccactgtgcctggccgattggggctctttaagaaaaaagtatacaaacttataaaaattaggcatgaaagttgatatttaaaatgagacaaaaaagtcgcaggttaccttgaagactcaagttcttttctcctgaggcctctttgggccatttgccagaaatgccttctagaatattctgcttgtgatggctcctcttcccttgaaccttctgcagctcccagactctctgtggcccatgcaaatgcgggccctgaagcttatttcacaagcttcatagtgaacccacctctgtgcatggcctcaaagcaaagaattcctcgtggagcatgtgtgctcctcgatttaacacgtgccctccttgcagggtgctctgagctgtactaggagctgtttggctagactggaagaagcagtggtgaccctagaagcgaggctgtgggcctctcaccgagggtttcccggaaggtcagggcatctgtccagaaaaggaagggagatatgaatcagagaactagagtggtctctccagcgccccctgctgccagtgtttagggtctgcgtccacgcagccctgtgcctccttgattgcttcttcactccgcgactgcagcctctggctccggctgatgactccttttctctttctttcctgctttcccatgtgtttgccctttttcccttggttttctttcttcctctaagaacttggttctgtaaatgttcccctcccacacctctctctcggcgagccaggccagcctgcaggggtagctgggtaggaagggcctccagcatcccccatacactatgcctataaacagcccccactccagcctccctatctccagaattgccgtgtgctgctctctgttctcaattttaacatccaggggaagcagcacgtcatgtctcttaacgctttttcagttgtcccctttgacgattctccttgcaagctgccatcgcgtttcaactctccctgctttgattccttcatgtttgcgtgtcatcttctcaaagagatcctaagctcctccaggacgcccgtggaattagtgtccctgcttcctccactgccatctcatacttaccattctaaagaaaaacatatgctctatacattttattttctattttatggagcagcaggaggagagaaaggtcaacacacacaagggttttgaacaaacttcacaaaaatacaggccaactggaagccagagaggtgaatctcttcatacggcctgcaccatggggaaccttctgtgttattgaatgaaatgcttaacactgtcatctgaatatattgcttgcaaatattcacaggcttgtattgcttgcaattattcacgaatcacttatattacaagaggatcccaaagatccacttaaaagtgacatcttctcaaagggttgtttacaaatcattaaatacttatctacctgatgttccaagtgattggtgattgagctgcattcacaaatctgaaataattatgatttttttttttgagacggagtttcactcttgccgccaaggctagagtgcaatggcatgatctcggctcactgcaacctccgcctcccgagttcaagcgattctcctgcctcagcctcccgagtagctgggattacaggcatgcaccaccacgcctggctaatttctgtatttttagtagagataaggtttcaccatgttggtcaggctagtctcaaactcctgacctcaggtgatccaccctcctcggcctcccaaagtgctgggattataggcgtgagccactgcgcctggccgattatgatttttttgaaactgaacttttttttgttctgtacttttatttttattttacctgacaagaaactaaatgattacactgttcagttcaatgctgggcactaggaatccatttcttcccattcatgttgactttctgtttgttaaagagtaacatagaaagaacgtgccggacggtagaagatcaatttagtgaaatcaaagccaaggacgagcaacagacacagttgatccatgatctgaacatgcagaaagcaagactgcagacccaaaatggtgagaatgggcagggctctgggtccagccgggccatgggagagggtggtcagtaacactgacgtgggggccacatctgtttggtaggggagctgagccaccgagtggaagagaaggagtctctgatttcacagctgaccaaaagcaagcaggccctcacccagcagctggaggagcttaagaggcaaatggaagaagaaaccaaggtaaagatatagagtcagattgaacctgagaagccaggctatatgaccacttcacccgtgaagctggtcagagcagtgctacatcaagaaatctgctgcagctgggcacggtgactcacacctgtaatcccagcactttgggaggccaaggcagatggatcacgagatcaggagttcaagaccagcctggccaagatggcgaaaccccgtctccactaaaaatacaaaaaaaaattagctgggtgtactggcaggtgcccgtaatcccagctactcgggaggctgaggcagacaattccttgaacccagggggcggaggtggcagtgagctgagatcacgccactgcactccagcctggaagacagagcgagactccattaaagaaagaaagaaagaaacctgttgcttctcctgtctgccttgcagcatggtgggaacctgtcctttaaggttagaggaccttggcactggatctccttcttcaggaatagaaaaccgtacctatggtggtccatcccctggcctcctctgtcccccgcagggtggtctgagaaactcccctttccagccagggcacctcctccccatcactgcacacacttgatcattctgcccagcaattcatcctggccacctgaaatccccctcctctttcttcttcattattcctgatgtgtcacctcctataccacctgattttaagctcccctcctccaagaaggctccatggttttgggagcacccttgagacagtcgcataaacatgaacatcatcaccttcttgatttcaatgtctagatattgtgtttataatacatgtctccccacagatctataaactcatggagggcaagaatagtttgtccccactgtacctactgtgcctagcagaacagtgcacacagtaggtacttggtgctgccaattcatattcaagtatcagaataggggactaagagtccaaaaaactgcatgaatggaattccgaggttgctgtacgctggctaagacttatagggcaatcttttggaattttcccaagctccacctttttcttctgaaaaaggacaagcgccatatttgtctcccatctttctgttgtatggtaaagatctttggtagatgaggggaaaggggaagtggtgagaacccaagcctgaacaagtactgagaagagccactgcaggagcgggctgtcctttggcaagaatacagcaacagctgagttttccttcttaggcaaagtgtgtcatttattgcctttttttttttttttgagatggagtttcactcttgttgcccaggctggagtgcaatggctcgatcttggctcaccacaacctctgcctcctgggttcaagtgattctcctgcctcagcctcccaagtagctgggattacgtgcatgtgccaccatgcccggttttgtatttttagtagtgacagggtttctccatgttgatcaggctggtctcaaactcctggcctcaggtgatccgcccatctcggcctcccaaactgctaggattacaggcatgagccaccacgcttggtctattgcatttttaaaaagatgaaaatgtacaaattactgaagtgggctgacagaactctctctttgatggtggcaccagagggcgtcttgtggccattatagtcggagctaaactgttgcccttacatccctccaatgggagggagtgagggatggaggcctctaggcatgtcttctctgcctaggaggaggaagtccagccgtggaaacagcgaagctcacatcagcaatccccagtgtggggacatagcccagtggtgacatcaaaagatgctttcaggcttctcctggtcacagcattccataccattgcatcaagtagtgagaaaattattccctttttaattgttccaatccttctgattatatcaaggaaaaggcctcagtgtgaaccacacttccttagcatttgcttatttaccctattaagaaatagagggtagaccccaggcatggagtcccagcaggcaacagtacctagctagacatgataacattgctttatttccattgcacttatggttaccttctgtttatggcaaatgtcaatggttttccacttactttcctgtgacagtttactcttttgttaaatatatttaaatataattaaggagtccacttgaaaaaaaattaaataaaccaggtgatatgctgatatggcaaaattggtgaagacagcatagggataattcaagttgggggaaagcgatttaaatgaaaatacctgaacttggaaaagggtcaaatgtttttgcaatttgtcactgctgtcattcccaggccaagaacgccatggcgcacgccctgcagtcctcccgccacgactgtgacctgctgcgggaacagtatgaggaggagcaggaagccaaggccgagctgcagagggcgctgtccaaggccaacagtgaggttgcccagtggaggaccaaatacgagacggacgccattcagcgcacagaggagctggaggaggccaagtaggggctccagggtggcaatagcagagggggcccgaggacacaagccaagggaccaggagtcttcatatcttgagagattctttcctgcccacgcctttgtggtttctgaaacactcggattgtaccccccaccctctgggggtctccctgtccttcttctcgggaactgtccattccacctagctccctggaggtgctccttagggacctgctttgccaccaagcattttgagaatctctcggtgacacttggatcctccccactcaccaaatcctaggtcttggtctcatcaaacaccagtcccttccacgctattcatttctcttcccatctgacagttacctactgaaatattccacctttgcgaaggggaaaaaaaaaatctggttttcgtaggaaaaaactggcccagaggctccaggaagcagaggagaacacggagacggcgaactccaagtgcgcatcgttggagaaaaccaagcagaggctgcagggagaggtggaggatctgatgcgggatctggagcgctcccacaccgcctgtgccacactggacaagaagcagaggaacttcgacaaggtccttccccagccgctttctttgtgaagatggcatgaggataattcaagttggggaaatgctatttacatgaaaatacctgaatttggaaaagggacaaatgttttgcagtggcagtggtgaaaacaacagtttcacgcttagatgtgtgagatacctgcacatcctagaaggcccccagttggagcatcatttcccagtttcagggacttgaggtgtcttcttgactactgtgacagtccctccaaaggcaattttatttttagtgaaagctaattccgttccactgagattataatgtctgtgagaatgcagcagagggtctgcagggatatcacagtttggggtccctgatctagaacagtgctcctcctccttcttcagtccctaaggatggaagggcaaaacgttggtgttactgacagcccttgtttgcatgaactcttctgagtcacccctgctttctgcttctcccatgtccctttgtcatctcccaggtccttgcagagtggaagcaaaagctggacgaaagccaggctgagttggaagctgctcagaaggagtccaggtcactcagcactgaactcttcaagatgaggaatgcctatgaggaggtggtggaccagttagagacactgaggcgagagaacaaaaatctgcaaggtgagctgtctccaccactggtgtgtgctatgtccccctctcctcctgccaaccccttccccatttggccacagccatctccagacacctccttcccactgccccacacgatcctcacccatcatgcctcacattgactcagtttgccccaaggcccagacctttttaatgtaaggcacggcagcagctaagtctcatttttgagaactgaaggaacagtgggttgctgagcccactgctccgttagagaagacccttcagtgattctgtctctaggtggctttgtattcttgcacatgccactgaatcccttaggacctcagatttctgatctacaaaatcagaagaccacacccaacactttccaaagccccttctggttctgcagactatgattctatgcgttttccccacagttgttttctctggtcttctctatgaccgttttgtatatggtacttttgaagttttaagtttctattctttacttgtggttcctgtctgcctagtgcaggtgaggcaacacatccctgtcttgccaacacctcatctgaacggctgccctgtattctctcctgtataaatgtcatgaatgaatcgcccatccctgaattgcctggcaaatgcctatactataaactggagcctgttgaaacagcctaaatcaagcctgtcctttgcagaagagatttccgacttaactgagcagattgcagaaactggcaagaatcttcaggaagcggaaaagaccaagaagctagtggagcaggaaaagtcagatctgcaggtcgccttagaagaagtggaggtaagtgtctaggatatgacattcagaaattcaggaggacagggaactgaaagaggctgcccttcaccaccccatggggcctttcctgccaggagaccctgagtctccattgggagtaacattcagccatcccaggggctgaaacatccacgggctgctactttatctcctaggcgttctctggcacagttcccctttgaaaataaataaatgtgttcattatgttcttcaatgtcttcctctcaggaagcagaaaatcaatcacctaacatcctgagagcagcgcagaatctctcagttatgtttaacatagaggcacagacaatcatttttggctatcaagaatcctgtataatccaaacacacccagcatctcctgatgcagtaatcggtggtggtcaggatggctggtggtttctagggaaatacgaaccgacacaggataacaggagagcagttgccctgtcattttagagaataggttgactcctgatttatggtcactattataatagataccctcaataaaattttcactaattaagaaagatactctatctcaagtcataaaataatttgttcatgagcgatgcaaagttttagtcccagtttcatcactattagggatatttgggagcaagccaaatactcagacctctctgaatattgttctcttcatctataaaatgggtataagaatacctatttgcagccgggcatggtggctcacaactgtaatcctagtactttgggaggccgaggcaggcagatcacctggaaggtcaggagttcgagaccagcctaggcaacatggtgaaaccctgtctttaccaaaaatacgaaaattagccaggcacagtggtgggcacctgtaatcccaactactcgggaggctgaggcaggagaatcgcttgaacccagggggtggaggttgcattgagccgagattgtgccactgcactccagcctgggcaacagaatgagactctgtccaaaaaaaaaaaaaaacacaaaacctatttgggctctgggcaccatggctcacacctgtaatcccaacactttaggaggccaaggagagaggatcactggagcccaggagttcaggaccagcctgggcaacacagaccctgtctctaccaaaaaaaaaaaaaaatttaaatttaatttttttaaaaaaacgcatacccatttgatcgtatggggatgaaaatacccattcatgaaggtggatgtccacggcactctcaatcactcctttgctttcgtcagggttccttggaacacgaggagagcaagatcttgcgcgtgcagctagagctgagccaggtgaaatccgagctagaccgcaaggtcattgagaaggatgaagaaatcgagcagctaaaaagaaacagccagcgggcagcagaggccctgcagagcgtgctggatgctgaaatccgcagccggaacgacgccctgaggctaaagaagaagatggagggagaccttaatgagatggagattcagctgggccactccaaccgccagatggcagagacccagaagcatctgcgcacggtccagggccagctcaaggtgagcacggtggccgcctctgcgtacctggacgggccccagcctgccaggcggctctggcctcactctgggtctcccctgcaggactcccagctgcatctcgatgacgccctgaggagcaatgaggacctcaaggagcagctggccatcgtggagcgcaggaatggcctcctgctggaggagctggaggaaatgaaggtggccctggaacagacggagcggacccgcaggctgtcagagcaggagctgctggacgccagcgaccgcgtgcagctcctgcactcccaggtgcgtcggccctcactcctccgctgaaggtccaccctggggcagatagcgcctcctgcaccgtgcagctgcttccgctatccctccactcagggcccacgccgtgggaaggagcacccggtttctcccagactagtggtcaagacaaattttcttttaagcttgcttcttggaataactgactcttgattgacagatttctgagctttctctcatccaaacattaaacatcttgcacgttgtggggaaatcagagcaacgaaggattaattattacgtaaggcacctggaagtactatttaagtggaaaccttagaatattaagattttatttcaaaataattatttttgacccggctcagcgccacacctataatcccagcactttgggaggccaaggtgggaggtttgctttagcccaggagttgaagctgcaatgaactatgatcatgccactgcactccagcctgggcaacagagggagaccctgccaaaaaaataaacaaacaaacaacaacaacaaaaacacaaaataattatttttataaaagtttttaaaactcctttgtttaaaaaaatagaaaaaacaagtaaatacatggaagaaaaaagtcaagcatattattaacattctggggtctctcattcttaggcccattgtgaattatataaatattatatttttgcctctaatcccaggaatttgggattgtttgatctcaggagtctgagaccagcgtgggcaatatggcaaaaccttgtctctacaaaaaaaaaaaaaaaaaaaaaagttttaattaaaaataaatacatatatatatagtcaaagtatgagcaatcttttgcaacctcttttttgaatttaacaatcatgaacatattttgacatcttttttttttttttttgagacagagcagagtctctttctgtcgccaggctggagtgcagtggtgcgatctcagttcactgcaatctctgcctcctaggttcaagcgattctcctgcctcagcctcctgagtagctgggattacaggtgcttgtcaccacacccagctaatttttgtatttttgtagagacggggtttcaccatgttggccaggattgtctcgatctcctgacttcaggtgatccgcccgcctcagcctcccaaagctctgggattacaggcatgagccactgtgcccagcttcgacatctttaaatagtcttctatatgatttttaatgacagaaaagtaggctattctacttgtatattatggccctttcatttaatcagtcttctgtggttattttagattgttctcaataaaaattttacttttagaaagactattttgatgaacttcctcataactaaattttcatatacttctatgattactataatcttaatatttctagaagtaaataaatttctaaaaatgaaatttcaaggtccaaacagcaaaagtatttgtaatataaattgttctttaacaaggttgtcccaatttttatttccactggggaaacgtgtgagagttctcttctataaattctcaaatactctagctcttattttaaaaatcttcaccaattttattgctgaaacatacctcactgagtttttagtattttttttattgctaatgaggtggaacattttatcacatttgttggccatttgaatttcttctagtattttacccatttgtagtttttgccctttttttaattgatttgccttatttgtatgttaagaaagggaatattttcttctgtaatgtacattgcaaatgttttccagtttgtcgtcaccccttacaattctatttatggcatattttgattatttaaattatttttcatttcatatagtatgtctatcatcatttccttgttccaagactttttactgaataatctatccatcctcaaatatttgaaattctacttttatcatttactgaattctttcatgtacaattcttgggtctgtttcaggactttctgttcagttaagaataaagaaagaatgtacagtactgtacccagcaggtcacccatgtgaaaaataagaaatggaacaggatcacaatttacttccctccccagccaaccctctcccaatttttttaagcgccccaatagaacccacacccctgatatctaattcttcttgtagaacacaagcctgataaataccaagaaaaaactggaggctgacatagctcagtgccaggcagaggtggagaactcgatccaggagtccaggaacgcagaggagaaggccaagaaggccatcacggatgtgagctctgttcttccttttcagagatggggtttggaactgagaaagtggggcctctgagccagggtgtggcaagtatgtttcatctcttatgacaacaatcggttagtggtggcttcccagacagatgtaatgaggtacagtctcagcagtggcaaagtgggaggggaggctgtggggaatcagcaatgactggccccagtcagacaggggaggctcagcaccatgatcccagccttcgcctcttctgcaagctctgggtagggatgggcggacagggcctctgatgtgtcctgtgaacttaaccaggctgccatgatggctgaggagctaaagaaggaacaggacaccagcgcccacctggagcggatgaagaagaacctggagcagacggtgaaggacctgcagcaccgtctagatgaggctgaacaactggcgctgaagggcgggaagaagcagatccagaaactggagaaccgggtagagtttttgagaggactgttactctgaaagtgacagcctcggacagaaccacagtccagaaactgagatggtgggaaaaggccactgaatgaatagattgcaaattcagtttcaggactgcttgaaaaattccctgtgagcttcatttctcacctctttctgtttcacctgttcctatgccccaaaacacacacacacacacacacacacacacacacacacacacacacacacatctattttggtatgctcacacctcagtaaatgtaatataatgatgtatgttaatgttcacattccatttgctatgcagattcagatgcacgcacatacatggaaaaaactattaacatatactctacagtcataaaattactcattttgatgcatttacattttggaccaagcttcactttgatcaacacggcccatcctacataaaatctgcagtttccgttttctcccaatctcaggtttccttccctccccagcttttctcatctgtcagtgcaggctgcaattctggcacaggtatgtctcttgctccagccccaaaagagggcgatcggggcttcttcctttagcttgatgcaccagcaaagttcaaccccccgacacctggacatccctgctctttctttatctgggagcgtatcctgcagttattattcagtttctttgctgactgttccctttgtttcctgtctcccttgcttttccttttagacccatgtggtttatttcaatcattttaaaatgggctccactagtggttgacattttggaggagggctctgcggaggaggctgttcgaatgtctcttgtcccagggagacaggaaatgaaagagagggaggaaaggaggatgaggaggaggaaaagagaaggagacaacttttcccagcaggaaagcctccaaatactgtcattctttatgcaaaccacccgaggatatcctccccaggcacatggtcccattaaatgtgaaaggattttttttagggaggtgctaaaaacaacaaggccatagactttttgaataacaaaagtaaacaccagggaagttagaacttcccccaaaattctttaatgtttattttcaattatccccagtcctattccactacaatgagtttaggcctgttcttctcatggatccctcctatgggaaaaggattagatctcatgacaccttctgccatactttgattcctgggttggcggggagccctcggccaccctccccctcccatggtgaggcaccttgactgtcctcccatcccctgcccggttatgtgacttccataaaccttacagaagcctagaaagaattcccaggaaaacaaatgttttgtagaacctgatggaagacatttcctgggtccaggaggtggagggtggggaggttttgggaacagcacccagagtaagcctgtccgattagtagttttcaaggctgatctagtgagtctccaagcccagagttggccctgctctgcagccactgggattcccagtggagtggagcatgcagctggctgctgcccctccctggcttcaatctctggattgtggagttgggaccacagttggtgacttatgtcctcagtggctgccctttcccctcaagacttcaagaaaggcagaagcaactatgaaattaacaacacctgtgtagtgctttgtcattctaacaatactttcacatactttcatttgatctccacatttgaggtaggctgggcaggaaatattatctccatcctaaatatacagaaactcatgctcagtggtggcgactgacttgctttgggtctatcaagtgggcctggagagtgctttgactactcctggcccaggttctcttcgtgatccctgctgccttacttgatctgtaagttcaagttacttgatctgctgtaagttcaatgaacagttgggcaggtttcacctgcaaggacaagtcaggttagcttttgctgcccttgccaaacgacctggctccacaaaagggagcatctaagcaaatcctgacccaccagctatgctctgtgcacctgaggctgcctctgcccagtaagggcatcttattctcacttgctcaaagcacctgcattgtcaataaaatgtggctcctaagacctaggaggagacatcttggcaaaatcccattaggggatcgttttttgttctaactttaagttctggggtacatgtgcagaacgtgcaggtttattacataggtataaacgtgctatgttggtttgctgcacccatcaacccatcatttacattaggtattactcctaatgctatccctcccctagccccctgccccctgacaggtcccagtgtatgatcttccctttactgtgaccatgtgttctcattgttcaactcccacttatgagtgagaatatgtggtgtttggttttctgttccttagtttgctgagaatgatggtttccagcttcatccatgtccctgaaaaggacatgaactcatccttttttatggctgcatagtattccatgatgtatatgtgccatattttctttatccagtctatcatttatgggcatttgggttggttccaaggctttgctattgtgaacggtgcctcagtaaacatatatgtgcatgtgtcttcatagaatgatttataatcctttgggaatatacccaatattgggattactgggtcaaatggtatttctagttctacatccttgaggaattgccacactgtcttccacaatggttgaactaatttacactcccaccaacagtgtaaaagtgttcctatttctccacatcctctccagcatctgttgtttcctgactttttaatgaccattaggggatcttgagttcactctagaatgattggcccatgagtccatgagagaagcctgggagaggagatttgaattctgtgttcctttcatcctactcaggtgcgggagctggaaaatgagcttgatgtggaacagaagaggggagctgaagccctgaagggagcccacaagtacgaacgcaaagtcaaggagatgacttaccaggtaggggtcccaaaaacctcctcagtgaatgctgtatggaccaagccccatcagaagtgaccataggtttgcgggcccctgccacgtgtactctgtttgcaggctgaggaggaccacaagaatatccttaggctccaggacctggtggacaagctgcaggccaaagtgaagtcttacaagaggcaggctgaggaggcggtaagcacaggaggtccccggcagtgcccacagacagacagtccctggggcatcctgggtgtccccgccatcctggttggtaaagtcccctgagcctcaggcctgagtttgtatttgcaggctataaacacagagacaactgccctcttcctctcctggtccatgttaagccttcacgaccttcaccatctctgtgccctcttgcctcaccctacttggccagccccctccatccccttcatcctgcccaccgtgactcacttgacaccccctagagcatgttagcctactctgctggcgttggatcaccctgactctcccgaaccaccccagtctaccctcaaagccattcctgctcccatgacctgacctgagatacctcatcctaattcccaccatcccaccacagcccaccctcctaggcatctccagccttcctcagccctccctaactccctccactccatcccatcctttttcatccaccctttgatcaaataggtgaaatcaataggaaagaaatggaatgggctaaaatcagtgtttcccaaagtgtcttctgaggacactggttctgagggatgttaatagcaggaaggtggggctgccatggggaggagcttatccttttatagaaaagagatcgtttgggaaaatctgagttaaacaaagttaccctggttgctttacttcaaggatatctcagattttgtagatgttgtagagtttgatatgtcatcaactctacaaagtggaagaagggttccagaatataccatttctcactcttcattgactttagaaccttcttattgtatgcagagcatccctcagggctactgttctgaggaccaaaatttaggggagtctgccctggacaaatgactgagcttctcccattgctctttttcctcccttccctggagcctggttggttcaatcctgacctcagggaagcagatttgaactggttcaatattgagagcaattcacgcacatgggatgagtacagtcccagcaggatcggcaggctagagggtgcccaggaggacattttagtcaggaatccttgacattcccccaaatagaccagtacagtggcctggccttagacagatggtgctgggcagaggcacaggacgagggagacttgggccattggtctctataccttcaggtgccttgggagagctctggacttaggtctcccccgaagatctctatggagcagataccatatagaagagattcaagggaacatgtggaggtcctagaagggacagtagcacctgcaaggtgatccgaggcagtacacatggtcgtgagctgggagccttgtcctcacacgctggagaaagcttccctgccctctctgccatcagggaatccagggccctggttgcttaactcctcagaggccttcagagacagggcacctcataatcagactgagaggctctacagcgtcataccccctctgtctcctgtgcaggaggagcaggccaacacgcagctgtccagatgccggagagtccagcatgagctagaggaggccgcggagagggcggacatcgctgagtcccaggtcaacaagctgagggccaagagccgagacgtgggcagccaggtaagagcaggtacctgagatataggggccagctaagaacagatattgaatatgggggccaggtaagagcgaatgcctgagtgtgggaggccagataagggcaggtacctgagatgtggggaccaggtaagagcaggtacctgagatgtagggggccagggaagagcaagtacctgagtatggcttcttcccaagaaatcccaagccccgggggagtcccatggaccacccagggagagcttggaagatgactgttgatcctctccttcctgctgctggttgcacactcccaaatgctactgtttgagcaaagactcctgtggttccaggctcttgaaagaatgagcagtgaggcacgacactgtcatccctgtctgtccctgttgctacagatgctgcccatgaagcccctgttttgcagggcgtttgtcctgtcgccagtagctagattgatttgcttttacaatgttcaaagggaaacaacgccattccttaatattcctctgaagttccagattttccagctgcttcacttcaagatgatgttcagtctcccatttagttgactcatttcctatgtacaattatttttttctcccacagaagatggaagaatgaggctcacctgatgctcgttgccatgggacacctccgagagagtggagggaaaatgtgtgagaaataaattctcctaaatactcggattcccggctctgctgtgtttattatcatggtccattcctcttctatgaagctgatatttagattcttgctgctctatcgtaaatataaaataaggaatgtgaaagtggaggatctttgctccaagtagaaaacatggaaatccaacccatggccaggtaaatcactagcttccacaaacatttaaaaataaagaccctatatcactctacatctctcagaatagctattatcagaaagacaaaagtgttggtgaggacgtggagaaaagggaactcttgtgcactgctggtgggaatgcaaattggtacaacctaatagcagtttttcaaaaacttaaaaatggaactaccatatgatccagccatcccactactgggcatatatccaaaggaaattgaatcaggatcttgaagagatatctacacttccatgtttattgcatcactcttcacaatagccacaatgtggaaacaaactaaatgtccatcaatggataaatggataaagaaaatgtgtatatacatatatatgtatatatatatacacgtatatatctcgtatatatgtatatatatacacgtatatatccatatatacgtatatatatgtatatatctcgtatatatgtatatatcaccacaatgtgcatatatatgcaaatgtacatatatatgcaaatttgaatatatatattcatatactattgggaatactattgggccataaaaaagaaggaaatcctgcaatttgtgacaacataggtgaacttgggggacattatgctaagtgaaataagccagatgcagaaagacaaacactgcatgacctcacttctatgtggaatctaagatagtcaaactcatagaggcaaagagtagaataatggttgccagaggctgggagtaggaggaagtgggaagatgtttatcaaagggtacacattttcagttatacaagatgaatacattctggagatctacagcaccaggcctatctatagttaataatgtatgcatgtattaaaacatcaatttgtgtaccttaaatatatacaattccttttgtcaattatacttcaataaagctgaaaacatccaaaaggaaggaagaagagaaggaaggaaagaaaataaagattctttcagataactgtagtacattttcctcctaggaactcataattcttgcaatttacttcctcattttctctctgaatttacagatagggacactggggcccagatggattaagcactgtgactatagttgtctagggcagagtggaaattacaccctggagatcctagacttgcaggctgccaagcaactctgcttttccatcccatcccttttaaaggctttgtcgtacaattctctcatgcccacccacagttccccttaacatctgagaaggtagtaggtactgtcaaactcattcactcctaggaagacagatgctttagaaaaggttggataggggctcaggtaccaccttgctcctccttccagctagggtaactcctccccacctgcatggagcctcctcagggtgttcagggccaaaaggaaaagggagcagctgggtccaaagagatgttaactttccaagtccaggacgagactggacccaggcaccattctccctccccaatgggaaagaaaactactgctagtttcacatctctctctcggatcttaaggatctcatccattctgattatgttgatttgcttaccctgaaggggcacagtaaaatggaataaggacacttatgggtggattaggagccaagtctaaatgtgagcctcatcctgaccacttaatagctgtagctgtgtggccttgggttgatcacatatattctctgaacctgagtttcctcattggtcaaactgacctgtgtggacagaagcacaggctttaggttctggcaaacctagatggaatcccagtgctgtcacataccaactgtgtggtcatgggcaagttattctcatt

SEQ ID NO: 12289 - DNA, 7557 bp, Human
tactttaagttgagggtaggaattttggtggagaataattttatcagtcagaggccagagcctttgaattttgtccaagtgtgataagggtggttgaagagacatctaaaaatagtgtagtcagatattgcaggataaatgatttggtgttcatgttgtgggctgtggagaacaggaactctggtccttgtggtgcatgtgacttctgaggatggagtttctcaagaggaagcctttaggcaagcagtaaattctattaaagctcaggttcaatacggtaagtagatgtagggagctttctgtgaagaggtacaggatggagttggttctctctctctctccttttgtctttaaaggaagactccagaaagcacaagggaaggtataagaagagaatataaggaaacttgaatcagggcaaagaaagcattgattagaaatggattcaaaatccaggagatgattggtgttgggtcaggcatgttcatttttatatcttctgtgtaagtcctcttagattagcttgatttaagtgcttttcctttttgttcttataagaaatagcacctaccttcatcaatatgttgatcacagtcagaggtgaaattaagtttttgggcctgatgcacgtacaagatgaggggcccactttaagaaaaataataccaagttacaattgcagaaaataagtatgaaaatgaggatttatttagcataagaaagaagctgcaacaaattataaatattaaaaggttgaaaacaccataaacatcacaaaatttaatcccctcagtattacattaatcaacttcctaactcacttttatgataccttttccctatagtttttaaattgcttatttaattacctcccttaagagaattattttgttataatttctacggcaagaactgaaaggcatttgcctttccctagtatgtttaataaaaattcattttgtattattaatagtttagaaaagaaaattcagcttcacagcttgttattggtaatgagataaataattaaatttactattgtcaaattttagaaaacctctattaagtcttttatgtatgcgatgtaatatttcagggtgtttgagatttttcttgtatagtgactaattttgattactcataattatatgactttcataaagtccattgctgagccccttacagggtctttatagaggtctgtacagtgaggatccctgaagcataaactttgtctggttttgatcatattatattataattatctgttttttgtttgtttctacacatgctcagtgcttactagcctcacttttgacagtcatttgagactatgatgaaatatatggatactctcctcagcaaaaaaagtcatgaaatacataaaatattgaatacaatattactgacctcctaaagcttattcttgctcctgccacagtttctgcactaaattgataatttatttaatgctctgtattttgattttctttctctaatatctagcacaatgtcctgcactttgtatgctccaaacacataaagacttgtttaataaatagaaaaagaaatggataagtgttgccagccagactgtatgacaggtgcagaaattccccactttcaaaaactgttggtaaatatatttgagcaaacactcagactcttccctggcgatcctaaaatactagactctacaatggtttttgccctaataagaaaagagttccttttcggaagacctttaaactgcatagattctcattttctcttctgaaagcatttcgttttgtctttgggactctcctgtagctaactggagagaacaacattattctctccatacccttaaatgatgtcagtgtttcatgaattttcttttctaaaaattatactacaatatgaacacattttagtagcattcacttataatccaagacattttgcaatccctcctccgtttttccatttttcattgtacatagagctatatgaggcattacagaggatactaaaatgaacgaaaatcataaaccctgcagtcaagaatctttcagtctaatgaagttatgagtaaagatgaatacaatgaggaatagtaaataactttgagataaagaaactaaagtatatcataagactgatgcaacttgacacagaattgtgattatttttgatgtctccagttttgatagtcaaaggagacactatcaatagatattgcaagggcaacaggcataaactaatattatcttggacaatttgatatatagagtcaccctactcttaagtttctttacttttgcttttactttttattatggacattccatactgcctgtaaagactgagataactatttaagtacccatcttccaacttcaactattatcaccacgtggccaatgttgtctcctctataccccctaaatccccaccctcatttactaaaagcaaatccaaagcattttcttgattcatcaaccagtttttcactacttcattctttttctctcctgattccttacttatcacctttccaacccatctttttatttttacttccagcactgcagttctgatctaactctgccaggacacagatccacagggtcagccctgcatcctgagcagcttagagggagaagccagaccagcagtgcctcacaccttgtcctcttctgctctggacagatggctccataacgacagcttcataatggcagtggatgggaccctcgtgtacatcagagtcactcttctgctgctctggcttggggtatttttgtctatttccggctactgtcaggctgggccctcccagcatttcacttccccggaagtggtgatccccttgaaggtgatcagcaggggcagaagtgcaaaggctcctggatggctctcctatagtctgcggtttgggggccagaaacacgttgttcatatgagggtcaagaagctcttggtttctagacacctcccagtgttcacctacacagatgagcgtgcactcctggaggatcagctcttcatcccagatgactgttactatcatggttacgtggagggtgcccctgagtctctggttgtgttcagtgcttgttgtgggggctttcgaggagtattaaaaataaacggcctcactcatgaaattgaacccatcaggcactctgccacatttgaacacctggtttacaaagtaaacagtaatgagacacaattcccagctatgagatgtagcttaacagagaaggaagtagcacgccaacagttggaatttgaagaggctgagaactcagctctggaaccaaaatttgctggtgactggtggactcatgcatggtttctggagctcgttgttgtggtgaaccatgatttcttcatttactctcaaagcaacatctcaaaggtgcaagaggatgtatttcttgttgtcaacatagtggattccatgtatcagcagttaggtacttacataattttgattggaattgaaatttggaatcaaggaaatgttttcccaatgacaagcatagaacagatcctaaatgatttctctcaacggaaacaaatcagtcgttcccagctacaacatggtgctgcacatacgttcataaaaaattcacttataagtatacttggcctagcctacattgcaggaatatgtcgtccacctattgattgtggagttgataattttcaaggagatacctggtctctttttgccaacactgtggcccatgagttaggtcatacgttgggtatgcagcatgatgaagaattctgtttttgtggggaaagaggttgcatcatgaatacttttagagtgccagcagagaaattcaccaattgcagttacgctgattttatgaagaccaccttaaaccagggatcatgtctgcaaaatcctccaagattgggggaaatctttatgctaaagcgctgtgggaatggtgtggttgaaagagaagagcagtgtgactgtggatccgtacagcagtgtgaacaagatgcctgttgtccattgaactgcactctaaggcctggggctccctgtgcttttgggctttgttgcaaagactgcaaattcatgccatcaggggaactctgtagacaagaggtcaatgaatgtgaccttccagaatggtgcaatggaacatcccttcagtgtccagaagatagatatgtgcaggacgggatcccctgtagtgacagtgcctactgctatcaaaagaggtgtaataaccatgaccagcattgcagggagatttttggtaaagatgcaaaaagtgcatctcagaattgctataaagaaatcaactctcagggaaaccgttttggtcactgtggtataaatggcacaacatacctaaaatgtcatatctctgatgtcttttgtgggagagttcaatgtgagaatgtgagagacattcctcttctccaagatcattttactttgcagcacactcatatcaatggtgtcacctgctggggtattgactatcatttaaggatgaacatatctgacattggtgaagtgaaagatggtactgtgtgtggcccaggaaagatctgcatccataagaagtgtgtcagtctgtctgtcttgtcacatgtctgccttcctgagacctgcaatatgaaggggatctgcaataacaaacatcactgccactgtggctatgggtggtccccaccctactgccagcacagaggctatgggggcagtattgacagtggcccagcatctgcaaagagaggagtttttttgccgctgattgtgattccttctttgtctgttttgactttcctgtttactgtcgggcttcttatgtatctacgacaatgttctggtcccaaagaaactaaggctcattcatcaggttaagaaaatgtctctaacttaatattccatgcattagtacactttagtctcttggcagtagaaacattagtacatccctgaaactgagcacatttctgaccatttccagaaagctgcaaagatcttcccttacattagtaccacaaacattgtcattaagttcaagttattcttaacatgtttctatctattgtttattgttttaagcagcaaataaagctacatccttccctccctttagtccttgttgtgtttcttgtgcatagagatgacttatgggaaatgtatgagatgtttctgcctcagagtgtccaggggtgaggcttacctctctactgacatttatcaatgtgggaaaattacttaaattttctgatgttctgcttcaaaatctgaaaaggggtagggttcataataatatttgtcccacccaacttcttggttttatttggtaaccaaaagagagaaataagtgaatttttgttaagtataaacagattgttatctgatgaaatctcctgatcttgctccctgtgtgcttcctagctctttgtcttaatttggcagtttggatatccttttggagcatttgcttgcttcacataccaaaatataatctccatgagggtggggttgttttcatctgttttgctcatcattgtatccttgatagccggaacagtgcacagtgcttactacacaataaatacttaaatgaaatcatgaatctgaatggagtattaaataaatgaaattatgaaaagtaaaaataatattttgataccttgggatgtcattctgatcctcttttttaaactactggagctcttgctcaaaattaaactttgaatatttaaaatgctgctgtttgtacctggtgcagtttgctggtcttttcttcccccagtgtatcttctccgtctattctcagtgtttttggaaagcctgtctcttgaaaacacagagtgagtcagataccctttgtattgatcagttaacttctgaatggcactctgtaaattgagtcaaaataccttttgcatatcatttttcattatgctttgccaactttgcatcttctatctatttcatgtttagaatatatttggctgtgtcattctctgcatatttgtacatgaaatccccattcccaaaatgctgtttaccaccctgcccctactcccttgccctggaaaactcctattttctctcaatagaggttaaatgttatatcttcgtagaagcattccttatgaaatggtaagtgttccacttgtgtgccccatcactttgtggtcacccctttatgatttgatgtcctctaggaatagagatggagagggtccaacaatgtgctagcaaaaagaagcagaggacagctactggagccatacaaggagggaggagtgaatcaagaatacaatctggtcaaatcagagaaagctccacatgttgtaagtgtacacatccatatggagacaaaagatagctgctccagtttattggttcttttttgaaaagctttatggtaaaaagccattgaagttgattacggtaaaatttgtcagcctaatgttcttttatatttgccgagttttgtatttctgcttgagattacttttctgggattatgttggtttcagctcttatgcttaattgtggaatttattttgctataaggaatgagataggtatctaattgtatacttttccaaatgggtagcctgttgtcctgatacacttcatagaataaatcctttatcactgctttgctggtaaattggtatcctgtattgtattttaaagttaatttgttagagtcaccttattttacttgtaaatttttacaagaagcagtgcattttgcaatattcttattttaagaaaagctgcatagttattttatattcattgagttaattagagctatatcagtcaattatatcaggattggtgggtagaattaacctttttataagaagcatagagtcttaccacctgttttaatttggattgcccaaaaagcagacccagagacaaggatttaggtggagttagttttctggggaagcacaaaacagggcagactaatgaacaagttttctctgtgtactactggagtcatccctgtaggctttctgagaagtcatgtgaaacacacctttgattaatattccatggttcaggagaaagctgtaaggaaaagaatatctgagatataagcatgtgaagtagtaaactctcagagcatgaagattgtctactgtggctgcaagtgaactcaagtgggacaagaagatggagggtgggctttcagcatctactgtacccaggttccttagaaaacatatgctgaagcaaggaataaatctaaatggtttatttggaaaatacaatcctagggaaatgagagtaaaagtaaaggtatttagggctggaaagtatggtacagcagattctagtggtacctgcctgtatcctcttaggctgaaccttgaggttgtctgtagtactgatgacaactatgtacactaatggcattctactttatgggggtgagctcagcccattgatggagcaggctggaagcaagaaggagttaacgcatgtgaaagcaactctcaactgataagaaatgtgtgaatgagcatgacagcttccccagtcctcat

SEQ ID NO: 12290 - DNA, 150409 bp, Human
caacagcgtctcattgcaacctctgcctcccagttcaagcaattctcccgcctcagcctcccaagtagctgggattacaggagtgcaccatcacacccagctaatttttgcatttttagtagagatggaggtttcaccatgttggccaggctggtctcgaactcctgacctcaggtgatccgcctgccttggcttcccaaagtgctgggattacaggtgtgagccacccatgcccagcctaagaataataactttataactatgaaaaatgtgttacatattcaccattttgccagcattaatctcaaagcataagttttaccttttggggataaagagatagattgtgttttagccatatgaccaatgtagaaacaagctaaggttaactcctcatctaatgaataggcccgataaaaaagttggttgaccacaacatgaataaataaataaccataagcttggaaatgctacctgtagtatttcagagtgtcgatcacatttgtagtcatcacttaaagaattaatgtctgccaatgttatcatctaaaatgtatttacagaggtcagaagagctatgtctgtcctcctctatgcaaagaggtgatgacatcaaggggtatgtcacaagccaaagtttagttagcctaagttagttagctggtttgcagtttttatccactaagtctgatcttctgacccctcagttttacaactttccactctctgtgctgcatagcacctctccacttctgagttaatcatttctttgccattatctggcaagaattcttatctcttttgctgtcactttataacagggtcctcttatcaacctgcatagagtcatgtgatgagtcaaagcctatcaaaagtttccattcttctgattagaaaccatcatgaaactggatacatggtttacagcaggtcactaatgttggaaaaagtacagagtccagggaaagacttgcttgtaactttatgaattctggatttttttttttcctttgctttttcttaactttcactaagggttactgtagtctgatgtgtccttcccaaggccacgaaatttgacaagctgcacttttcttttgctcaatgatttctgctttaagccaaagaactgcctataatttcactaagaatgtcttctaattcagatactggggatttacaagagtctttaaagcacggacttacacctattggtaagtaggagtttctctattgatcatctatttattctgctactacatacatataatttaatcttgttgatggattttgcattttaagtcatggcttttcctattatgtttattaaaagcacacaataagcctatgtatatatatcacacatttatctttcttgcagttcaaaaaaagcaaatggatatttcaacatatgaatattattcattatatctagtgtttactggtgtcattctaataccctaatcagccagaaaatataatttatactttatcaatttcaactttaatattttctgataatttttaatcagaaataataagctaaaatttgaacaatttgaaacaagttaatcatattgagtgatcattgatcaaactttaacagatagctgtcaagtatttgttacttttcaacccacacaaaagtatggtgtcttattctctgcttataccgtaaaaaattttcattttattttcctggggaatgaaagtcatgcccccacctccaaaaaaaaaaaaaaaaaaccaaaaaaactagaccatcattagtaaaggatttgaagagctactgtttctcgcaacaattagtatattttgtttttacaaacagaaataagtaaataaagctactattcatttaaaaaatagagttacaaacttatgaattttatagcaagactacattcaattaattctaaaagtaaaggactgaagggaagtgattcccagtgatctgtaattatttgtctgttggaagtcaggcccttctgcctttccccagtttttgaaggacctgtgccttttctggcagcatttgcctaggctttcagactggaatttccctccgaatttgcaggggcctgtcatgagctctctgagtctcagctccattataacaagaaagaaaatcaaggcttgagtttttcctcttttttccttcctagtcagctgactccacagaatgcagtggagtcacagattgctttttttatgggccaactacaccctaaagtatatcacttgaggaaatgtttaccaaaaatgttctatacttacgaaaaagaaaacatggggaaggtaagcagggtgtaacacacaatcaattgttctgcagataacacagaaaatacaggcacaagaaagatgagagagcagcacacaaccatttcgcatctttttcgtcgggcagaaccgccgcggtgcgcaggcaaggagtccttcccggcagctccgcgcagctccggttccgcgtccggggccgcagctagagcgcgctcgggccggagacgcggactgcgcgcgcacgggggacgcgcgctcgggggctcgcgcccgcgcgggcggtcttgggctcctgctgcgcgcagccccagctggccgctgccaaaatagagttgagctgggtcgggagaccacgcacgccgatccctcacagtctcccccacaccccatgggtgaattaaagagggtaaggtaggggaaagagacgctgttgcacttttctctgcaaccctggaagaactgtgtttccagctaccgcacgcgcaactcacatcgcaagggaccgaggcggtacactctgagcgtaaacagagaacacctgcagctctggaatcggtcccaccgcagagggctgggaaccggaggactgtcggtccagcccataaggggctgctggggactaaacctcaagaaaagtaccgaagaaggctctcccctggcctcagcgagactaccccaacatcctaaacctgtgcaggcacttccgggcgccggattccgggataacaaaattccagtcaatttgccggtaaaagagacctctttcaggatcttgttcgcagccacccgccccttcccaacccaagcacatcccctccgcctcctggtattgcagccccgcaggtggttgtgaggtgtccgcacctgcaacatcttagtgaccctgaggcggctgtggcaccgggagacaatctgtttacctcgtagcctccacgagggtgctaacggtcgttcccagggtgaatggctggacggagccatccaaagggctgagggagaggaacagagggcggtgaggagccttcggactgaactattggattgaagggcctgacccgattcctgagggagagatgccccttgaatgggtctttctgattgcccagggtagccccactgggaagaacccacgggtgcagctgtagagagtgtctgagggtctcgagggtagctttcagatggcaaattgcaagttgggctgtgttgagtggttcacaaaaccgagcccggtgtatgtagacatcagtcagggtttacaattctatatttaattcagttgtgttgtactaggaaatgagcctccttttgtttaaaaagctgtctccatggtttttaactaggggctacatcttgtatgcacactgatggttacatgaaagttttgtatagatgtctgtgcttgtatagaaaagcagaattaagataaagttgttccttctgcctacctgcaagataatcattcattgtagtgtaaaagcagcacactcaggttataactagattgttcccttaaagttaactaactctgggacactggccagactcttggtttctggtcttggtttacttctttctcccaagtgggatgattctattgaataatatgcagtactaactttagaagctttttatacttacctatatcaagaaaagagccatatctgtgtggtaggaaatgttatacataaaacaaatatttattgaccactcccacagtgcccaatattatgctttgattcatattaaatttccataattcttcaaattaactgcatttgcagaatattttatgcactcagtataatattgcatattatccacagaaggttatgtctgcatacttaggggtacatgatacacagtgcaaacactgtattgagtctgtaatgtgagtcttgctatctggtcccctgaacactctgagtctgattttatttcagtgataacctccagcaagctctgtgctcataaggatctctgaaagtagacgtttcatcagcggaaagtgtgatagccattatgtcaccctaacctccagcgagctttatttagaatgccagccacacaagcccatgttctgattctcatagttggggcttaggctgccagtttcttctatgaagctaaactctagagcctcccttctttccatgcccgagtccatctccaaaacagtgcttctcagattcctcttttctggcctggatccacaggtagtgaccagagttaacagagttcttgggccaggcacagtgtctcaaactggtaatcccaatactttgggagactgaggatggaggatcacttgggcccaggagatccagaccagcctaggcaacatagtgagacccagtctctacaaaaaataaaaaaataaataattagctgggtgtgggtgtggtggcatgtgcctgtagtcctagtgactagggcttgggggttgaggtaggaagatcacttgagccagggaggttgaggatgctgtgattgtgccattgaactccagcctgggcaacaaagtgagaccctatctcaaaaaaacaaaacaaaacaaaacaaaacaaaaaaaggatttctttttctttaacaccttttttttttttttttttttttttgaggcagagtttcactcttgttgcccaagctggagtgcaatggcatgatcttggctcactgcagcctcagccttctgggttcaagagattctcctgcttcagcctcccaggcagctgggattacaggtgcacgccaccacgcctggctaattttttgtatttttagtagaaatggggtttcaccatgttagccaggctggtcccgaaatcctgacctcaggtgatccacccacctcagcctcccaaagtgctgggattacaaatgtgagccaccacacctggcatctttaacacctcttctaacaaaccaagagagatttatagaggaagggagaacagaggcttgttaatgcttctctcctttacttgacccctctaccagacacaatgtctaggattatcttggattcagccttgagcataagttgagctagagaagggcacattgtcagacttccacctacaggcccaacccaatccccacccccagggatgcactaggcaggcaagacaacttcactccgcagctctagagtctaccttaggatagaactagttctttgagttgcacttcctcacgcttcaccttattggaacagacttcttggaaaaatccagttggcttcaaggaacttcaggagggcattgtgctctggggaggccctggggaagtgttgaaatgtgaccaatatgatcttgagagatcaagcttgagaaaaccatgtgaactggaactgaccaggcaagctgataaaggttgtctcttctttagtcttttgggaagctgttatgtatgtttttgtgtggttgataagtaagaaaagatatttggagtgtaacttttaaacaccaaataacctgaatgcagatgaccatgagcacttatatgagcagttttatctggtgataatgtaattgtccccaaggactttgtcaagccctgcaagacaatcaagttagcaagcacatcccactggaaggtgatcctagaatggttagtgattccctttttactttccttacagaatgatgagtttgagtgaagctaaggggaaagacaaaggggaactgatatatatatatatatccagcgtaatatatttctttcctggcactgtctcatttaactataaagtttactttgttaacccaattttactgattaaaaaatggaatcagaggtcaagcaatttactcagcttgtcaagagaatgaactgtaaatagaacccaagaaatattctgaaatacatactctttctccaaagtggtaaccacttgttcttgttgatataaaggaattatgatttaatacaatgttggtctatgcagactttcctccaagagacatttcgagcttaagaaacatatttgtaagtggctttttaatcttcatttccattccacggtagaaaccatatttggatccttctagaattcagaagggtggcacagggagtggtgtatggaaagcagagtggaaatcacatctgggaggactgaggtctgagtggggtgggacaaaggcacttctggtcccctactctggagtttcctggaaaggatctctggagtttggatgaagtttagcttgtgaatttgtggtgtatggtaacaactcgcagggttaccaacagatggtgagaaggaactgagaggaaattcagagcatgtacttgttatagagtcagtgagtatgaggagggcagggaaatcactcaaactgagtgactgaattagatagcataaacaaacatactgttgtaccatgagaggaggggatagggaaagacaatttaggtgtcaattaaaaaaaaaagcacttttgacaaacccagctgtgcctcttgcagtgagatatgctagtcccacacccatgctagcatttttcacggtaagtgctggattccttgctcagggtttggatgcctgcagcctctgcttcccggccttctgcaagctccacctgctccagcggcctctacaggaatggaaagaaaattggtcggaatccactgctgggtcctggaatcaacttcccagtttccagacaagaaactctggagaaaacaagtgaatctctctcaagccttggcacacactgtacaccatctcgtaatcgcgaaagttatcaccatgttggaaaagcccacgcccttctaattgtgcaacctctgtaactgcccagaccataacactttccctagttccacgccccatgcttgagtgtgacggtaccactgttaagtcttgcctttccaagctcccactttctttgctgaccaagtgagacccaaattgctggactccgcacctctgcggtcccggcactctttgaccttaagaatcagaagctcaggcaggggcttttctgaaggaagaagtttggttggatccatcccctcgctgcaaaagccgaggaattctgaagcaatgcaggatgtttccccttccatcaagaagtttccagtatcgccggatacatttaaatggcagcctagaataatctcgtgctaaggattttgttcctgacccaggttgaagcggaggagagggtgtaaaggatgcaactgcaagtgttcagctagtttcacaaggtgctttgtggcctactagcgccgggatcgtcgttctgttggccccgaggctggacagaattgattccaatggatggagtcccaatagttttgaactggaactggctcaaatttccatttcaattacagagaggaagagatagattagaccacctacccgagattatttcccctgccccactcctttcttaagaccggatctccctgttacattcttctaagggcaccgactataccctggcggggcactccaggacccctgggttgggacaacgtgctgtaaagaaaataagtgaaaaggttcttcagtgaactctttttatacaaagagccgtagattccgatatccaggccaaactctccaaaaagccctcctttcctctggggcaagggtgggaggttgcccgggagggtgggtggggggtaggttggattacccagataattgcttcggctttcgttttcctccgcgataaaaaccgcgccacgccagatcgagatactctcatagtgattgtgaatcaatcgccatcctgctctaggggctgatgttgatgtcttaagtagttattcacacgtgcagcagaaaggctttttttttttttttttttttttttttttttaaacaaggcacgactgctcacctattcaggtttgcttttttaaagcttcgatcaacacgacgctccctggtaattcctatggctgtactgaaatttaacccgtctgtttctaatacaaagcgctcgggatgagggcgggtggagcctacgggcgtgggcgggtagcccagccctctgagccagggaatgaaactggagttctggctaaacttttcagagaaaggcaaaagcagcttctgatgggtttttcggctgggaggggcggaaaaattaggcagacccggagctcccgtaggctgaaaaacttgctcctcttccccctcgggctatcctggcctagtaatggagatctgaaaaaaatctagacttctttcggggtctaaaaggtagatatgtgggacgaaaaaagtaattgtcctggtttcttaaaaagcaccaaaaagtgggaatggaagagaagacgggagaaattgtttcgaaggaggaaggtattgcaagttttgtgcaagtttgggtgggtcatctacccaggcgcgcggggaaagatgtgtctgccacaccttttgcgagcccaggaaacttgaaccgctcctgaaaatcctgatattttttcccgctgcagcccgcacgggtcaagcgcgcgggggctgaccaacactttccaggtcaggtcgagttgattgctcccagctcacgctccgaaatgcggtgctgaaccacgggaaggagggggtggggaggaaggcaggcagttgcatcctcgcgagtggggagtgcgaggcctcctcagctccagccagctgggtgaatggggcgcgcacggccccgtaacgccgagcgtggataaaatatgctaggactgcgcttctccggctcatcaaggctgcgggagcctccccgagccatcatccttcgtaattgcaaccgtcaatcaacactttaagacaaagtcagaaccgggaagggcgagccctggagacctgtctcgtcggaaagaaggaggtggaggggaggtgggggaaaaggagagaagtttgccagaagttggcagagggagtgcaaagaaattgagaacgcgcaaggtagttgagcagagctgtcccccggtctcaccacagactcccaggcctcccgggttctagtctctggtctccgccaccagttacaattcccgcagcggtaagtacggggtgggttcctaagtgtgcttacactaagaggtacagtggcagttgctaagatgtccccggcggaggatgagatgcgtctgtccacccgcggtaggtgtatttatgggtcagtgcagaccaccgctggcgccggcgtttagaccacacagacccggttccacctacttacatctcaactgctttcccttcccgcagccacttggctgtcttcatattgtggcctcgggaacccagaaccattctcaaataacccatcttagacaccgcaaactcgggttcctcctcccacagcttcctttcggagagggctttctgggggacgcccagacccgtccaaggtcactgagctagcgggtccccggcttcaacaggggtcccttgcccagcagaattgaagggtcaaaggaccagagtgagtgctcagagggaggagggagttctgagggagaagaaagggtgcacttggagggcagtaatgagcttgacgctggaagcctggtgccgccgcccctgcctctgcctcttggatggagacccagctgcttccttaaatcccttgcagagctacctgaggaaggtttgtgtgccctcgggtctctggcaagaatcaattccagtggaagattccttgccttgtccactgctggcggggatcttgacatccttccaggggatctgaaatagggctgcccccagggagcgtttcccatcgtcgagttaaaggcctggagcgccgagggcttaggcttctgagctaggagttcccttggttcttaggaaaggtcgttttctctcgctcgagactttctgctctttcagtccccctccatttcgctgctacgcttaggttttggcctggactagactttcaaagcaaaggaaagggcttccctccgtgatacaagctcctgcgttaattttttaaagcatggatttttaaaacccagtccccagccaccgttccctcccgcacccctcccattttgtgaggatttttctttcctggaaagtccacctgtggagagataaatgagtgccagctggccttttgccaccaccactctccatctttcggggatgtggtgggagggtagactggcatggaccaagaagtcgctagtgtggcctaagcaagtcccttctggccctggcagctggcgttatgagcatggtcacaaagcttgtctcactaggtcagcctcagcctcaggttcagcctcaagccaaggcagggtttcttgatacactacaatttcaaggtcctgtcagaccctctttcaacttctttcaactctcctaacttcccccggcttcaccaagcagaggtgaaatcaccaccacacactaggggttggaggtttcctcttaggaccaagcgtttggagtcctgcatccttgccatgctagggtctgggaaaggtgctgtatcataagtgcacccataaattcttcgcattgctgtgggaggaggttcttcttaattaaggctttgaaataaactgattttcaaagttcacgagcaaagcagggcaaccactgcagtgagccctgaaactgactccctttctttattttcttagttctcagtgatacttaaaacaactaggaatactgaaatgtagtgacagtgatacttgatactatcacaaaaattggagcttttggcaacttcagcccacttctccatacaaactaatggacaggccttcataagtttaaatgtttccacgaaacctgaagttgctactaaagctgaagtctaaataactttgatcctgaatatatattgaagagcaaaatgacaaatcaattaagagtcagtagtacctgaattgccaggtgtgggtgggtgatgaacaacccattttatgtacattatgcactgcaaagattggaataatttccaagtcaccaaataccggattgggcagtttcaatgtgtaatctctataccattcaaatagaataaacttagatcttttgagattcaaattcacccccttgtgggtggactctgataattacttcgttgcacagcagattctaaatatgaggcatttcgcatgcagtcaggaggctggaaagaatgtttttcatcttgttgggaggagatctgaaaactttgaagatgcggctgggctggtggtcgaagagcttgcgtaacagatggttctttaaaacattttttaaatgctgggcctcggcctcaagtggatggtcccatcagacaacagaatgaaaaagtacagcctggactgatccttgtattccgtgtggaaacacaggtcactaaaactggaaagtctgtcgcttagatgatcttgggctccagtcgagggtcttttaaaagtgaacgaagggactagggagcagactggggaaagaggagtcgctgccccttcctctaattctatgagtgagctcttggcttgtggcccgcctctcattgagctgaccctcggccccttcagggcgccggggcccacgtgtcgcctcttcagggtctcagtgccctggggagttgaagctggaggacccttgaccgcagaccaactctgcatgtaagaacggtcagctaaattttctcctttcaatggtttaagtgggtgtttaactcccttcatctcctcatccgacacactagcaagggcacacgcccatccgcgcccccatcccttcttcttgcttcccctcagatcgaggaaattgccgctctggctgcttctccttcgccgccacgctcagacagaggtcgcttctgactagctgtaagacccggctgcatttacatccccccgccccgggccagggtggggtgggagggggtgaggcggggtgaagaggttggggcaggccgggggactggagcctgagcctcatccttattggctggcggctagtgtccgacctgagtccggaacccgcgtccgcattcactgtcttcacccctcaatccagccttcccccaacccctggccctacttacctccttctccccctcgtcttcccccctgtccttcccagcaccgtcaccctcggggctgggaagggccgttctcggtcccgcgcggggagtggaccaggcaggagagggaggttggaacttcacaactccacacttgcgatagtgagcaagagagaggcagagagagatagggggaaggggcggagaggaggggagagagaagggaggcgagagaaagaggagagagacccctgccgatcctgagccagagggcggtggagggaggggaaggagtcgcccgagccgtccgggagcagtggcagcggcacagccggggcggcaatagcagccccgcggtcgcctccgctgcccgccgggagctcggcggttcacggctccgcgccccgggcagctgcgtcctcgccaccgccgccgcctgcgcccttgcggagccgaaccagagggccgggacgctgtcttcctcgcctccttttttaaccctgacctcctcctcgcagcttgggggcggctccggagctgcgagaccggacagggctcagaggtcctgcccggcagccccgaggaggcggaggcacgctccggcgaggcgagagggttgggttagcaggcatcccggtcgccccttccttcttttcgccggagttgaatctgtgctgcccgtgtccaggtgctgggcttccggaccgacacggatcccccatccccgcccgcggtcgccttgtcatgctgcccaaagtggagacggaagccctgggactggctcgatcgcatggggaacagggccagatgccggaaaacatgcaaggtaaggaggcgccgcgcggcgctccggctcccgctgcttccccacccccgggctcgccctgcaggcttcagcctcccgccccgcgcgggcgcgggagtagccccgctgggcgctcgcagccgcgggagtcaagccccctccccaggtgcaggcataaaagtttatggctcttgaacaatgcggggcagaggtttttccaagcaacgtctaattggccgcttctaattaaggaaagagaggcttccagctctatggcaacccaagcagggcagcttcaggctaaaggtactttagaataataagatcattctaagaaatggaatgtctcactggacacccgaacaggttctctgtcattggaattggtgtgtactgtacttcaaccagtactcttgtgtggagggaggcgacccagtctaggaaagtcaactacagaaagaggtgacctccgaaaggattgtcttagcgctattagaatacatgtgaccacaccaaaagcccaggcggacacccgcagccagctcggatttggacaattcaacattgctggcagaactgaagggaacaagttaccccaaccccatcccctgtacgcgtagtgctgagtgagttgggggtgggaggacagcggttcgtttattgcccccttttaaaatctgagatctgaaaatatggaggtcccattcgttttcccagctcttgattgccaacaaaaaaacaaatcccgctggctacattttctcctcattccaaaatagcaaccctatggcttgtattaagcccttcagaagtttatctcatttgctctgggccagggagggaacaatgctaggaaaagtcaccggtgctcttccatcctcgccccttccagggtgcaggatgtgcgggccggcgggcctgtgatcccggaacgcttcctgccatccccttgcgcgaacttgaaaggactgggaggtgttgagagcagagttcagggctggtgcactctgcggtgctgagtgggcggcgcgcccgggcgctcaggccgggggacctgtagtcgccctaccgcggaggggaaaatacgtagctggagggcgtgcgccgtgcgggttgtgatccgttaccccatcggtcatcctggggtctccccaagcctctaggtagggctgtgagagtcccctagagctgaagccccggaggctgacctgtgggtctggctgctatgggaacccggttggtccaaagaagcctttcttccgggcacctggaattccagtttagtgtggggcatcggggaagtggcgctggggggctgggttgggggacctcagccggcagctccggagagggcctacccttggggtcgctgggtgaggccggcacgattcttggctccaaaaggaaagtttctgcttcttgttctggcgcgagaagccaaagacttaattttgagagcggagagagaaatgttattggtaacgttttctttggaaagttcgagaggggtcttctggacacactacctagtgcccccaaaccagagaagtagtttttctttggtgcctgggctcagaagtcgccactcactcagcccatggttcgaaatcagcatgggaagcgccggggcaaggcttcgtcggagactagaggcctgcctgtcgggaggagcccctgggggatggggaccccattctcctgcttgctctggttcccacctgggacgcctccgtaggagcccagaaagacgatccactacatggtcccgggacagagcagcgcgcccaactttgagggaactttgtgcgcctctctgaggccctagctttccaaggcaccgccgtccgttcttctttccctagaccgaaactggggaagagtgtgggcgcttctttgccccgatgagttcgcctccccaaacgcctacttcggctgcaccagagcatctgggaaactctgaaaggtgcccaggcctcacacagcagcgtctccctactcagcctctgtctttgggttttttcaagagagtctctacctcatgcctcggtctttcttcgatgtcgggtccccgaggtaggcacggagtccctctgaaagcagttgcctatctgtgcccctttggtgtaaagttagagtttactttgttgggggaaggggaggtagaaaagatcacagttgggaaagtgcgcttttcgccttgttcctaaaacatgcctcaagactgtcatcgcgattgttaggagagctatcaacgtctaggggctataaaggaatttctgaaccctcggcccttcccaaacccccaggttcctaaaaccctagtgggggtctcttggggctgggattcaggctggcaccgctgggaggacctcgcctagcatccctttattaatatttcacgaaggcaggctcctgccttctctggagcctcttttctcggaatgttcccaaactctggctaactcactcccctgtgagccatcctagggctctgtggcccgggaagagacgcgtcaactccgcgggtctgcgcgcagtccttagccgcaaagtgctgcaagtgacccccctgacggccctttccgaccgaagagctcgggaaccaaagagaaaaaaaataactttattttcaaaagaacaagtcatcactgcggcgatactgtggcggaggactttggcgatggggtgggggctatttctctttcctttttggtaaacaaatcagaggaaacttctgcccggccgtggctttccatcccccacctgccccaccccctgcaaacgccactgattaacttaaaacaaactcggctgcgtgtttgtgcgccgttgggtagcaggaggtagagcctaggcgagagcctggtgcgcccacgggtttcgccgaagagtgcccgggggagtgcgggcagggtcccggctgcgcagacctgcgggtgcccgcccacccgcgccccgcgctcccatacttgacctgtgtggatgtggagtctccgggaaataccggatcaggcacttcctggggtctcctggtcactgcccttcctgtgcatagtttgtcatctttttagctgcgaagacgccttcgtgggtctgcgtccggagcaaggcggttacccgatcccggcagtgagccgcgccgcgcgtcgtggcggcctgatttctgtttaactttaatagggcgatctcgaggtgtttatattttgctatgatgatcggaaacatgtgaggttcattacagggcttcaatactttgaaaccaaaacccttctgtgtgtcttttactcttctggtatttttccccgtacgggcgtcctctattttctttttccttctttttattttcacagattttcaaacgtaaggagatgaaagtatccagaatagaaaagtactgtcaatacggaactgaatgtttcgattatctaacagatctgaaagttgggagcctcaggctgtttagttaaagtgggctgctgctgagaagcgggtttctggggcttcagtttctctgtcggacagagtttgcaaattggtgctgctgtccctgtaagcaaggtgcacttgcagcaaaccacttcaagagggagggaataaagcctgcgcttgtttctctaccttaggcgaaggtgacattttggaatttaacttcatagggatttaaaagaaattctaaactgtcaccttatgcaattcatgtctctatttgttgctttgtggagttatgagacttgtgtttaaaagcggtcagtttaaaatgttaacaaaagaagttggaattgtttgtggcacatggaattatatgaggtccatgcttattgatgacaaaagatgttttacttgtaaaaatagttcagtaagaccttgctaaaaattgtttttattttatattttaccatgtgatatttgcccagcaatcaccaaaatgctttttgttgcaggattaacacctacatgtaaattaattgaatatgtgtatacatttctctttttgtttcagtgtctcaatttaaaatggtgaattactcctatgatgaagatctggaagagctttgtcccgtgtgtggagataaagtgtctgggtaccattatgggctcctcacctgtgaaagctgcaaggtttgctcacacattgctacctgaaaaatataatgtccaacaccaaaataaaccagtggattacttcttttaagctaaatttaggctccttttttaaagactcaactaaaaatgagggagaaagagagagtcttagggagatgattcttagaagtgtgtgtctgatttagttcaaaaggcaaagaaatttatgctgtttagaaaactttgccagtctcatggttctaaaatactttattgtagtaaagtgatatagctgtagaaagacttccatttctaacagtcctaaatattgattttgcttgacttatatatatttaaagcatcgttgttcttgaaagggaatatgacaaactatttcccaaatacattttaacttcagagtatttctgtgctataagtctaaacattctttatccacagacataaaagcctaaattcccaactgtgtgatttcatcttgatttattccaaaataattttaaggattttttgaaatttatatcataaagaccaagaaatcagattttagtttttaatataataatttttataaatatatgacctatttaagtgcatggattttaatatgtaaaatatgctatattgttaccaaaaatataaattatactttaagaatttatctcaggactttttaatacattcccagtaaattcaatattcactatttttcaaagttttttttgtttgtttgtttttgtttttaagtggaaaactcagtacaattacttaaaccaccaccaggaaaatccctccattctctataacaaagtaagaatgtttctctttgtggcaagtgggttaaatatgaatactatcctggtaaatctcatattataaagctacacattttatttttgattaattattttatataaaatataaggaaagctcataccctgtgtgctacaattcagctatctgtgatacatgctttttccttccattagttttgcctttttaagaacagttcccatacttgaatgtattccagtggaattatgagcattttcccattttactctttaaatccttttgcttttaactatccagtgttgacatttgttaaaaaaaaaaaaaaactgaggtgttttgctattcagttttttccactggcattttgcaatggtttatcactgaaattatatcagactacttaaaaacaatgccaggacttcatgagtacctctatcaggaacatgtgggataataggaaaatagattaaaaaaaaatttatctatatagagtgtattttttctgactgttgggataaaatggtgggtagccaaatctccccaggatttgacgtaattcttcaagaataaaactgatgccagaaaaatctccaccatggcctggcacagtttgggaaggttgatgttgctgaaatgtaaaataaaccacagaaccacataagggctcaaatagtgcaatgagaggatttactggtgattttcttaaaatgaaacaatggaaaagacgggtgttagatttataatacgtctcactattttctctgtcttatagggattttttaagcgaacagtccaaaataataaaaggtacacatgtatagaaaaccagaactgccaaattgacaaaacacagagaaagcgttgtccttactgtcgttttcaaaaatgtctaagtgttggaatgaagctagaaggtaagattcttctaaagactactgcctattaaaactctccaaggacatggactgtaaaacaacattgtacttatagcgtggtaacattattttcccagcattttaacactaccgacaatactgtaagatctttctatgtttcatctgcagaatagtctgagtctcatttaatcatggtgaaatctactaggaaaaaaatttaaaatattagttgtctttcccctgcccacccccttttttttagtctggggagcagatgcattagacacaaaaaagggaaaaagatcaggttatgaaaataagactaaagcaatccaactgaaaacaagaataatttgtaaaactattaaaagtaaaatattctttgagtttttaaatcaagatacccttggaaaagtttgatttcaattctttttaaaagaggtgtgcttgtcacaagtgttaactactaatttcatgattcttaagagttaaagcctttaatggtgaaaaggagtttctcatgtaggatattacctttgatagtgtagaaatgtatttttttaaaagataatgactgaggctgcaaaataaaaaattgagaatcaggaaacatgaaaaataacgaactattaaatcattagcaaaggtctgaaaagaacaagaaagtggctcctgaaaagccacacttgaactttgttgaaagagcagaccctatactacaatgtacagattggcaggcagtaaagttaatatgtgactgctgtaaataatttgtagttcatggactactatggtatgttgctgctttctagcctctgacctgcttgctttccatggattaaatatactgcaaataaagcaataacagggatacatatcaccgatggtgctagatacaagagtgcattttatttgatcaatgaggcacaggctatttttatttggaacttttctgttatatggaactcatacttgatagaaatactaaaaaaaaaaatcatataaatctgctgaatagctaacacgcttcttccgaacagaggtagccactttggttattatgaggactgttaatgtcagtatcatttttaagagatcatgaaaggaaataattgatgcttattaattttcttattaccaatcactattatttcccaaatagcaaaatattgtggtagatgcttactacatacagtaagagactcagaagataagtaaatgttgtgattttgcatgatgtcatttaattccttttcaacaaaaataataaggctgcatttctttaccttaaataattaaactttcttttttttaagttaagctttcacaattgtaaatcacttgtggtacatgctcatgcttccttaggagtgatatgaaacaactgaatattcaataaattatcatccagatgaaaaactctttataatcttgtgcaatattctgtatacctagaatttacaataaatttttaatgtgatactaatccaagataaaaagctcaaaaacttaacctccagcaagttcaatatgtcacaagctatcagaggtctctagtttctgtctaattgccattggccactatggacttagagggaactgctaactaacttattagtcatggccgcagactccacacaccactgtcgcagaagactctcttgacagcttctgaaatgaatttgttttaattatgtccaattctacttaaattaaaagcagtaactggtggtcatctgatgtgggctcatcaagtccaggtgaacatgattttccaagaacatgtccccaccccttttgttattgcaacaaggtggccaaaatggctttcagggaggaaggtatcttgtgggaaagtattcacaatttaatccaaaattgggtaactcagttccacacccctgcaaaagaaaaccccaaagcagtttgggtttccataaggaactggcataataaaagcatatactcttagtagaacgactgatactctttcttagcaatgtgaaatatttcttttctttttttttttgagacaggggtttcactcttgttgcccaggctggagtgcagtggtgtgatcttggctcactgcaacctccacttcccgggttcaagcgattctcctgtctcagcctcctgaatagctgggattacaggcacccaccactacgcctggctaattttttgtatctttagtagagatggggtttcatcatgttggccaggctggtcttgaactcctgacctcaggtgatccacccgccttggcctcccaaagtgcagggattacaggtgtgagccaccgcaccacgcctatgtgaaatatttctatgtctaacaaaaattatgaactctcctccatccacaaaagggttaatatgtccctatgtggccaaagtatttttttgatgacgacacacacttggaggaaggaattcataaataaagaggacatggttttttgggaaatctttgtgggctattgtaacgaaaacaaccacacacataccacttcttgtcgatttacatttctaaatatctgaagaatgctaataatttgcaccttatttatacctttccttccttccccccaccccacccccaacagctgtaagggccgaccgaatgcgtggaggaaggaataagtttgggccaatgtacaagagagacagggccctgaagcaacagaaaaaagccctcatccgagccaatggacttaagctagaagccatgtctcaggtgatccaagctatgccctctgacctgaccatttcctctgcaattcaaaacatccactctgcctccaaaggcctacctctgaaccatgctgccttgcctcctacagactatgacagaagtccctttgtaacatcccccattagcatgacaatgccgcctcacggcagcctgcaaggttaccaaacatatggccactttcctagccgggccatcaagtctgagtacccagacccctataccagctcacccgagtccataatgggctattcatatatggatagttaccagacgagctctccagcaagcatcccacatctgatactggaacttttgaagtgtgagccagatgagcctcaagtccaggctaaaatcatggcctatttgcagcaagagcaggctaaccgaagcaagcacgaaaagctgagcacctttgggcttatgtgcaaaatggcagatcaaactctcttctccattgtcgagtgggccaggagtagtatcttcttcagagaacttaaggtatgccaccagctattacaacttacagcaccccttttaagagagacctaactatgttcctaattaatacattcttggtgctgaaaatatgtgttccttaattttctactttgtatgatttacagagtagacgtaattttattaccttgacttcaggactgtggcagcttaaatttatggggctttgattttgtgtagctcttagtttgggggggctggcatttaacataaagtataggaaactcgggcttttttttctaaatagtagaatatctgtattccttttaattcagatggtttgtggcttaaaacatttcaagtcaatgtgaaatagcgcctagtaaactatttttcttgaaaattaccatgtaaagagctatattataatggtgtcatcttgaaggtttcttttgaaggaaaaaatgccaacatttagtagtgtttagactctaaggaatgaaaatgataccactggttagtagtatcaagtaggtatttactactgtttgccttgacattaggttggtaaagcctttgttttcgtagcagattccaataggatgtttactgtcattggatggggaatgggcaaatggtgagtgctagtttacttggtttgggttgtagttctcataatctatgtcttgttgattttagtggactggtacattgtaaacatagtacttgtttgtatagggatctatgtttaaattaataattattttatttcctgaaacttaagtctgaatgaatgtgagaaagttatttagaagtttggaatctaagaggggctaccaaaacacatttggtagtcagtggtttcattcctattttaaaagtgagtcttgaatttgatttccaagtatattttgtcacaaaatcaatttcttccttttgctgtaacggggagagatgtggctgctaaatatctgtgacttgtgattacctaggacaggagattgattgtaaaatttctgagagaaggaaaatgcaaagccgacttttaattttaagagttactgttaaaaatcgtctgtgtaagtagatggtctggggaatgtggaagccacatgcaaatggaaaataatgctttcatagcagtctacattaagcactgttctttgtacatggaagcaaaaaagttacctgaacagacctaaataagttgataaaattccatcagcacgctgttaagactgtggacacatccagctctttatttccacgtcctttattgctacgcttaaaaatggctgaaggatatctcaggctgcaaagggcaagcagaatgcactgcgttagcacaattaggccagatattttccgagtatgtgttagggtttgtaaccactctatgataatcagaacatttttcatgaaaaaacaaaccatgcaaacactttcctgatattcttacattcaaaactgtgtccttaatcaaacaggtaaagtatttgaaaatgaaaattaaaatgataattttagatactgtcgaaaggttaggtaatgtaaaaatgaggaaaacacagactttttacaatcaaatgaactgcttaataattatgtcttcataggcaggttgttagattctctgagccttggtttttctcatgtgtaacttgtatatgtggtgtttgtggaggagtattgggagcacagatgtaactacttatattgaggaggttttcaaaggaaaatgagaatatgcagataaagcacccagtaccgggagtctggcatatactacatactcagtaaagtgtggtgctgttttaaattgatattactggggccgggtgcagtggctcatgcctgtaatcccagcactttgggaggccaaggcgggcggatcacctgaggtcaggagtacgagaccagcctgaccaatatggagaaaccccgtctctactaaaaatacaaaaaattagccgggcttggtggcacatgcctgtaatcccagcttctagggaggctgagacaggagaattgcttgaacctgggaggtggaggttgcggtgagccgagatcttgccattgcactcgagcctgggtgacaagagcgaaactccatctcaaaaataaataaataaataaattgatgttatcactgttgttttatgaaaaatgtgcagaatctacataatttttatatttaggatcaaaacaatgcaattatagtctcttagtttaacattggcaaaaactattacatgtgttatagagtagtatgattttattataattaacagttattaatcagtactaattaaggacctaaaattggccaaggggtaagttgggtataaggtaaaaacaacgttgaataaaacaacatgtttcctctcagagtttataataagacagtttcataaataattattttaaaaaataaagacagccgcagagaataaaaatatattttacaaatcaacaaggaaagaaataatgcatattattttcatgtaaaaaaggaaacatgaagtaaatacagctagcggctgtaaggcattaagaaggctgggaaaactttttccactattcctctcttttccctcctctgtggataaattttacagtgacttctttatatagcatgaggttaaatatttggctaaaacataaatatctttgagaatggggcatataaaagcatttttcaatcaattacggtgttgtttaatgcatttatcagtctttcatagaatacgaaaaaaggaaaagggaaaaaagtacaaacgtgagggtcgtctacaaggggtgggagatgttcccagaagagaaagataattttgacccacttcacagtttgccttgggcttactttgaccaggagtgattcaagtattttttggtgaacaaagagtagaattcagaaaaacttaaggatagtttcagtagagagttgggaggtgactattgacatttggaagaattccttttcctttcgtttataaatttactttgtcagaaagcaaaccaactcatttgaagccaggattgagacatctctagggctgtggctttcaatttttttaatcatgacccacagtaggaaatgtattttatggcaggacatagtgtaccaaacacatcacacgggcgcacacacacagagatgcacaaacatacaaacacatacacacaactaaaccaaagtttcaccagatagtacataacctacaagccacgcactctgatattttctatctattctactttagtctaatttatttcatgtttttaaaaaaattctggtcacgactcactaaattgatttcacggcccattaatgaggcatgacctgcaattcaggagaacttgctgctctagaggaggttttatcggccatccattggcgttgcctacctgctacaattaaggataataactccggaaaaaggtctcttcctcctggcgtggcctataagacatctttgaaacccacagcctgagtccccaccctatctttctgtaaaggttgtaattttaaaatatcatttgggaagataaatgctctttcttattcaatttgattttaattatttttgtagagacaggggtctcactctgctgcccaggctagtctcaaactcctaggctcaagcaatcctcctgccttggcctcctgaagtgctgggattacagacaggagccattgtgcctgttttattcattaaatatctgtccttttccttggtaacttcacagcaaattacctatcaagtgatatacttattggacagattttttatacctctaaaacccaaagatgaaaaatcacatatttgctcctaattaggcaattttgaaatgacctctttctcactctctttttttttttgagacggagtcttgctttgtcgcccaggttggagtgcagtggtgcgatcttggctcattgcaagctccgcctcttgggttcacgccattctcctgcctcagcctcctgagtagctgggactacaggtgcctgccaccacgccggctaattttttgtatttttagtagagacggtgtttcaccgtgttagccaggatggtcttgatctcctgaccttgcgatccgcccgccttggcctcccaaagttctgggattataggcgtgagccaccgcacccggcctacctcttgctcactctctcaggacaaattacactctctaccacataggaaaaaaagagaatttcatttgtttactagttaagggaacagaagggccaggaaatttggtaggttgttttgtttttctatacatctacaaggtgcaaaaaaaggtattctggttttcattcaaaagattggaatgaaaaagaagaagttacaactccccaactctcatagaaaccgtggaatttcagagctggaagatgaaagggaaaagggctagaggacacatataagcgagctgctttgtttttttaacacacttgtaaaggacaattctggtcttcatccaaaataatggcttgagaaagatgaaattaatactctgaaacttgtagcttttgcaacaacagatgtgcatcaaaagatactcattgcctagaaatcacaaggtttttcagagctagaagagatcactgagatcatttgaccctacctctttttacatatgaagaaactgaggcagaagggaatgtaatctgcccaagattatccagctactgaatggcagaactgggactggtagattcaggttcaaagaagcagtcctcttgtacacattccctcatcccccccagcatgcacacgcgcacacacacacacacacacacacacacacacacacacacaaagaggcagtgtaatctttgactccaaagaaaacagtcctttgccagtgaagctaaagcaaatctctaggttatcagaagcccatcactaccatccaattaccaaatcactaataatcagtgagacagattttccctgagtccagatgaccccgtgggagtgaatgagtcactttaaaaagctacaataattctttcaggccactggggtatcattcagtacagtggattcagcacttctgggccttgagtttctgaagcattctctagtgccctaccctctgcggatagtttactctccaggtgaatctggttcagtgacggcatatgggctgtgctctgccgttaaagcggccaaacacgattatatcctgtgctctactagaagctgggcatgttcagtatgggtttcttgttacgtatgcttgtcgagatagcagaaaaagaatgcagggagctcactttggcagcatatacaataaaattggaaagatacagagattagcatgaccccctgcacaaagatgacacaggcattcatgaaactgtccataaaaaagagaacacaggatggtaaccgggtgataggtgagccactaataaaattttctgatctttaaaccaaatctgttgagtgacctatgctcttgactgtttccttgtgtttttagaaattaagagctaattcgagacttttgtattctgctgaaagagctgtccttgtgagtcaagaagattggctttttttttcagttatttttttttcacctgtgtcttgaatatctcacaaacacaagagcagtgagaaaataattcccactttgttaaacaactaatgaatctggaggatctatttgatcttctaatgagaccagatgtcttaagagaattctgggaatggatatataagaacttcccctcggtgaatgattctgatacatgtacgtattaaaaaaaatctaaattaatcctgactgaaactcccaactagcatttctgtggaaaataggtctcagagactcagggagtttgtgccaaaggaatttagccatgctgaagttggtttttaagtatagctttatctaaagcgagggcacaaggggaggagcaaaccttcttttttctctagccaattatggaagctatctgagcagcattatttatctatttttaacattctagatcctttttcctaaatcacagttacctttcccaatgcaggcctataatctcagactttattgaatctgccccaattttaagctatattctttagtaaatttacttagtcctacttttttttttttaagacagggtctctctctgttgcccaggctggagtgcagtggcatgatcatagctcactgcagccttgaccttgtggcctcaagccatcttcccactttagcttcccaaatagctgggaccacaggcgcatgcaaccacgctagctaattttttattttttgtggagatgggatcttgcgacgttgcccaggctggtctggaactcctgggttcaagcagtcctcccaccttggcctcccaaagtgctggaattaagacataacccactgtgcctggcagccctacttttttttttttgtgacggagtttcactcttgttgcccaggctggagtgcaatggtgcaatctcagctcactgcaacctccgcctcccaggttcaagtgattctcctgcctcagcctcccgagtagctgggattatagcgcctgccaccacgcctggtttatttttgtatgttttagtagagatggggtttctccatgttggtcaggctggtctcaaactcctgacctcaggtgatccactagcctcggcatcccaaagtttacaggcgtgaaccactgtgcccagccagccctacttttctatgggagagaaagagaaactgagagagaggatcctgctcggtgtctaccacatttacttgccatatggctgttctttgccttctcctgagagttggggtcaggaatcatgggtccaacacgagcactcctcattgccatgtgatgtcacagagcaatagccactttacttacctttgttttcacttctctggatgcaaagtagctaatctgggaagcacaaggatgacacaaagaaaataaacattaaagtttgttttccagtcaaatttttcaatgaatgaaaattttccaatcaaaatttgatctcaaggcacattaagccatctattgccagttctcatactcatcacaaagttgccagaatgaaataaatcgaacctgcataggtttacaaggaaatgataaaactggtttttcttccgctgaaggtagatatgaaagtgttctgtctttgtgaatttggagagaatgttggaatcagcaggtttgattcatggtctctaaggtctcttcaggtgttaagcatctgcttttatatctttttccaagcagacctgaaacagaaggctttggtgtggctgatagtgttggatgagaatttatgttatttcagcctttcttgcttacatacgtatattgcatgtgtctattgtagactcagaaagccattatctttcttcttgctttcttctgagctttcttcttgctcacaattcactgaaagaatcagctcttctcagtcaatgcctgtttgtgctatggccaactcactgtggggcagtggaacatgcccacttactgtggggatgtgtattgttctttactgggatatcttgaaagtacaccagtcacctcaaaactcccgtgcattagttacttctactaaggtaaaatttactctccctaaaatttactgtttttaatgtacaaatgataaaacagctctttcacactttaaaattctcttgtgtccctttgtaataaactcctctccccaccccagtccctgccaatcctgatctgtttttgtccttagagttttttttgttacttttaaaaagaagtaaatttgctttattcgttgagtatacatttacaaactgcaaactcagtttaagctccctgaaacttatggtttcagcgtagttgagcactaatagtttccatggaaacatatcctccatggggcgctgggatatttggtaagagagtagtgatgatcataacttcacactgggtctgcttgttcacatgccttatgagcgtcctgttcgtattaacctgtatgttatctactggaaccatggggagaacatgagaatagcgaggcacacccaagaaatccatgtttaactagcttggccatcgtcaggtgtctgaatctgaacagtgagagtaggaccacactgctaccgcatacctgactgcctcattctgtgtccctcctgttcgatatagtctggttttgcaaactgaggcttaagcctcggcagccaagagcaagcccttgttcctgttctgatgaggatgtactgaattattttgtattcagtttcctacgatgaccttctctaattacacaaaagaaaacataatgaatttacatatctttgggtcaatttatgaaaaaccattcttttcagtaatacaagtcctttaagacctgttggaaaatggtacagacgtgagcattttccttgctctgctctaggtcatatggtaaaggagaagagaagtaacttttcttgggtacccactaagcacctactctagtgctaggtgctttcaggccattttctagtttgatctttaggacagtccagtgatgagagcacagtgtatggtcatttggtcagagtgggagtaaaagaccatcgctctcgtataacatgttctctgtggaggatacgtccgtcagtcataatgactcatagagatgtcaagttaattgattcgtaaaagtttgctaaatcaattttttttctttttttttgagacagggtctcactctgtcgcccagtctggagtgcagtggcacgatcttggctcatggcaacctccacctcctgcattcaagtgattcgcctgcctcagcctcccgagtagctgggattacaggcgtgcaccacaacacccatctaatttttgtatttttagtagagatgggattttgccatgttggccaggctggtctcaaaactcctgacctcagggtgatctgcctgcctcggcctcccaaagtgctgggattatgggcatgagccactgcgcctggccataattgtgcttttttttccttttttctttttttgagatggagttacactcttgttgcctgggctggggtgcaatggcacagtctcggctcactgcaacctccacctcctgggttccagcaattctcctgcctcagcctcccgagtagctgggattacaggcatgcgccaccatgcctagctaattttcgtattattagtagaaacaaggtttcaccatgtcagccaggctggtctcaaactcctgacctcagatgatccacccgccttggcctcccaaagtgctgggattacagatgtgagccaccacgctcagccaaattgtactttcagtaaagtactttactgtttacaaagaacttccatatacatttttttggtcctggtctctgtctttcattttgggagcatggatgtaactggcctttcatcaatggttcagtagtgttgttttttaaagcctacaacagaaccatctcctatgaattgactatcacctgtctaaatgccctgtttacagcatgttgtacctgcaagagcaggatatttaaagtactttataattgataattgccattatcaatatgctcacctctttaccatattccaacaggtcttaaaggacttgtattattttttaccgaagagagtggtttttcgtaagtttacccgaagatacatacatttattatgttggttttttgtttttttttgtttttgagacagagtcgcactctgttgcccgggctggaatgcagtgtcgcaatctcagctcactgcagcctccgccttcccggttcaagcgattctcctccgtcaacctcccgagtagctgagatcaggcacacgccaccatgccctgctaatttttgtatttttagtagaggcggggtttaccacgttggccaggctggtctcaaactcttgacctcaggtgatccacctgcctcggcctcccaaagtgctgggattacaagcatgaaccaccgcgctgggctgggttttgttttttgtttttgtttttttttttcatattagaggaggcccagacaggtgcggtggctcatgcctgtgatcccagcactttaggaggccgaggtgggaggatcacctgaggtcaggagtttgagaccagcctggccaacatggtgaaaccccttctctacaaaaattatgaaaattagcccggcgtggtggcacttgcctataatcccagctacttgggaggctgaggtaggagaatcacttgacctcaggaggcggaggttgcagtaagccaagatcgcactactgcactccagcctgggcggcagagtgagactttgtcttaaaaataataataataataattagaggagaccatcgtaggaaactgaagacaaaataattcagtatgtccccatcagaacaggaacagggtcttgttggttgcagagacttcagcctcattttgcaaaaccaggctatatataattggaggggcacagaatgaggcagtcaggtatgcattagcagtgaggtcctccccagcttgtgaatacctgggtaggcttaccttatctcccaacctcccagtgctcggcactggttcctactgaacaatcggtagaagcaattttgtcagcttgtctgcctagaagtagccacatgcttgtttgctgagaataattagggtccctgcttattccagtacttatgcttttccagcaggcacacagattgctcacagatcttatggaaaggctgccagtgttacttcctcagtgttggggaggtagagcccactaagcctgagccccctgttccctgtctgcacactgtcatacaaagtcacagaataagttaaacacatacacacatgcacacaaacacacacagaaaacatgactcatatgtgacatccctcaacacacttttgaaggactttgccctctgaacctatatggtaaaatagatcttttttattttccaggataaataaagaatgattttgctctgacctattcttctgcagcttgggaagtagatcatacaaatctttgagagttcaacatccatttgcagaatggctccatggaaattggccatttaaactattcttcacgttaaagacattaagctctaacccaagaaaaccacccacagccaagaacaacaaaaatgacataaaccacgtcacctaacccagcagttaggtatttcttgaatatctgatacttaaaacttaactcccctctacacctgtgtcctctccatacagtaggctaacatcaggcagccagtggcatgggcgccctggctggcttcatggggcacactaaccttgcacatcattttctttatcttctcctctctcctccttgtccacttttcttctgtcccaattcgctttttcttttcttacttcattaactctttttcctttccttctaatacctcaggaagcacgcttaggcattaccttgtcctcagctgcatcttcatttacccttcaggtgaaatgtggttgagcaaggaaggcaactcgttccctacaagtctgagaatgggtggagcaggcaagagaaacggttaaatagaccccagagaagggctgcagttaatgataataggatttctatctgtccttccactgtaccaagtgacttccacacagtggcattttccaagggtgagtgcagagggagtagctgctcagcttggatgggtatgggcaggagaggttactgaggctgcaggcttagcaaggtgagtatgcatggatcccacgaagtcaatgcaaaagcaatttgaaaatccctgcttttcaaataggtgtaagggtttctgtccatgacaaggctgttctacttcagtcttttaaccatgtatccacacagtcccagagatggtcactagtgtcttcctcacctttaacttcctccttggaaataattttcacatgctacgttcttgacctaccaggacaaattctatgaattcttcacgtatgtgtcctgggaaggaatagccaaaagctttgacaagaataactaagtctgggctgggtgtgatggctcatgcctgtaatcccaacactttgggaggccaaggcaggtggatcacgaggtcaggagttcgagaccatcctggccaagatggtgaaaccccatctctactaaaaaaaaaaaaaaaaaaaaaaatacaaaaattagcctggcatggcagcggccacctgtaatcccagctattcaggaggctgaggcaggataattggtcgaacccaggaggcgaaggttgcagtgagccaagatttgcgccactgtgctctagcctggccaacagagcaaaactccgtctcaaaaaaaaaaaaaaaaaaaaaattaagtctgaagtacccaggacttgttgaaatgctgcctgatcatttctctcagaaaactaacagaaaaccacattattttgaatatttggaaatgtcaatgtcactcagagtgcacaacattcgggattaactttttttttttttttttttggagacagagttttgctcttgttgcccaggctggagtgtaatggcgtgatcttggctcactgcaacctctgcctccagggttcaagcgattctcctgcttcagcctccaaagtagttggaattacaggcgtataccaccatgcctggctaattttgtatttttagtagagacaagacttctccatattggtcaggctggtcttgaactcccgacctcaggtgatccgcccacctccgcctcccaaagtgctgggattacaggcgtgagccactgcgcccgacccgggattaactttacaaccaaacttgatccaacttctaattctgtaagaataccatttctttacatgacagatggaataattggccaataggtctaaagtctgtcctttattgtgcaataagagcctcgcaaaggtggaatgcaacctgagatcttaaggtcctggtctctgtctttcatttttgggagcacagatgtaactggcctttcatcaatggtttagtagtgttcgttattaaattctataacagaaccacctcctatgaattgactgtcacatgtctaaatgccctgtttatagcatgttttacctgagagagcaggataattacttcatttaaattaaaaacatatttttatgggaatgacccatggtagacactggatacatgttgaattaacgtgctcaagacataaaggacggatacagatttctcaatggtaaaggcaatatgtagacatctttgctttacttttaagcaacattccatagatattgtcaataacctgaaaattcccagaataatgttttaaatgacttcttaattagtgttccttattttcatacaggcacactcatattcatttgctaaaaacaattatctgcatgcacaagttcagggtcccaaataattctccctggcagattttgtgtgtgtgtgtgtgtgtgtgtgtgtgtgtgtgtgtgtgtgtgtatctgtgtccatgtgtgtatcgcagtgttttgagtgcatatcctgttttcacacacattctctgaaatgttggctcattctaagggctgttgtttcatttcgatcactgtatcctgtggactctgaaactgctacaaatgcttctttaccacacatcttatcagcacagttgtgtgcctttttgatctaaagttgtgatgaataagaggctttacttgttgcctaatttttaaaaaacttaccaaatattacatttccccttataaaataatgatatagattagtgtttgtgcagaagtgttggcaacagaattcttcaaaagttttccgttgagtgatgaaaagctgttatattattttgactagctaatcaaatgtaattggggagcttgaagtgccttagattttccttgtacagttatcaaagcaggaaatgtaactcgcagagctgatgaaagccatctctcatggtattctttcaattatagatcttacagagcaaatgaaagaaaagctctactgctaaaaactcagaggcttgaaatgccccttaatgttaactgctgtattagctagttaacacattattatgtactttaattgattcttactccagctttggagaaaaaaattatggatctgtttggcatgtaaattaaggtggggggaagacacctgagtgcaataacagcaatattgctattaacacttagttcaagtaacatcagatacctgcagtgtaaacaatggccctggttcactttggcgtgtttttttttttttgagatggagtctcattctgtcacccaggctggagtgcagtgtcgcgatttcggctcactgcaacccctgcctcccaggttcaagcaattctcctgcctcagcctcctaagtagctgggattacaggcgcatgccaccacacccagctaatttttgtttttttttagtggagacagtgtttcaccatgttggtcaggctggtctcgagctcctgacctcatgatccacctccctcggcctcgcaaagtgctgggattacagatgtgagccaccgcacccggcctaatttttgtacttttagtagagacggggtttcaccatgttggtcaggctggtctcgaactcctgacctcgtgatccacccaccttggcctcccaaagtgctgtaattacaggtgtgagccaccccgcccggcctaaaagcattactatgttgcactcatctgttggtattcctgctgatgagtgttattgaaggagttttatttgaccattgagaattgcttttatgagtttatcaatgaagtgttataatctagtaaaaataacttcatttcagtcatatttggaagggtccagctgagatttttagcttttgaaaggatcaaaccacattacacctgcattttactggggtgtagtatttttctttattgttgaatcacactcttaaagctgcccctaaaacatttcagccataaatgggtagtcctgacctaggatcaggccaaattcaaattttattcacatattcatttattcactcacacattcatcaaacatttatcaagtttgtactgtgtgtcaatccctatgctaaattgctggagacatgacagaagcaagtgctgtaatcccagcactttgggaggctgaggcaggaggatcacctgagttcaggagttcaagaccagcctggccaacatggcaaaaccccgtctctactaaaaatacaaaaagtagctgggtatggtggcttatgcctgtaatcccagcaactcaggagtctgaggcaggagaattgcttgaacctgggaggtggaggttacagtgagccaagattgcaccatcgcgctccagcctgggcgacagagcgagactccatctcaaaaaaaaaaaaaaaggacgagagccgtcttcactttacaagttaagtcttcatggcagttttctcaattaaagtagaacccctcctgacattgatgcggcactaaacacaatggcaaactctgaccctgaaatcttgtgcaagtacttggttatgacagcacactaataaccccagccctgtatacaccaatgtttaagattatgtttgaactggaaaggacaacttaattcccatagacaacaaggtgagagtaagggagggttcagggcggcatcactaggagagaacagctcgtgtaaaaatacagaggctttggcatagcacttcttggaaacttcaagtaattcctatggctggaaggacaaggatagggaaggggcaaggggtaaagctggacaggtgagcagctcatttatacatacggttctaatatggattttattcaaagcaaaggggagccactggaaaaacttaagcatcgggggccaggaggattgaaaatgtaccagggacatatgcccaccacataatgtcatgatttcggtcctggtataggattttccttaattgccagcatttagcttaaagtgcatttaaatattgttttgtttttaatttactatctaaacttgtactaaaggagttggtatcttttatgtccttagttatttttgttattgtctccaacagacctttttcctctaggtaaattttggttattgatgacatgtatgtatttgaggtcctggtccttgtttcatatttaatttaaagaaatgtaatgttttaaaaattatttatttatttatttattgtagatatggggcctagctatgttgcccaggctggtctcaaactcctaggctcaagcaattcttctgcctcagcctcccgaagtgttggggttacaggcttgatccaccatgcccagccttcagatttcttcagtataacattctttttgaccagaaagttttctttttcttttttagttttaatttttttattgttttgagacagagtctcactctgtcacacaggctggagtgcagtggtgtgatcttggctcactgcaacctctgcctgggttcaagtgattctctagcctcagcttcctgagaagctggcactacaggtgtgcaccaccacatgcagttaacttttgtatttttaggagagacagggtttcaccatgttagccaggctggtctctaactcctgacctcaggtgatccaccacctcggcctcccaaaatgttgggattacaggcgtgagccaccatgcccagccaagtttttctttttaaccttgaactgatttattgctgattatttcatagttattattttaatgacaccaaatcatccttccagtatatgcacacatcgagggggcagtctagcccagtgtgcctaaagtgattccacactagctttttaaaattacatattcccaaattctaccccagacctgatgaattgctcatccattcatatatttattaattcaacatacattaattaagtatccagtatgtgtcaagccctgttctagaagtgggaagaaacaagtgaggaggaagggagcagttagaggggttcagagaagaccaatgtgaagagctgacatttcagctgaaatccaaataacaagaaagaaaacagccttgataaatctggacacacagcactacaggcacaggaatagcatatgcaaaaatcctgaggtagaagctagcttaatattttcaagaaaataaaggaaggtcactacctaaaaatcaatgattgtgggggaaatagggctcttgaaaatgtcaaaaagtttgacaaggtccagctcctggagggcttggattttattgtttggaataggaagccataggaggattttaagcaatggagtgatttcatcgaattctcagtagaaaaactattgcactggctgcagatgggaaaaaagttgaagggaagcaagagagtatacaggaggtccatcaccccaggggagagatggagagatggtggcttagatcagggcaggagaatggagatgggggagaagttgatggacccaggatacatgttgaggtaaagctgatagaatttgccaaaaagactttgagagaagatgaggcaggcaggactcaggtttttggcttaaccctttgggagccatttgtggagaaggggaaccagaccatctaggggaaaatcctgcacatgttctaaaacttccctaaacagatagagccaggtgccagagccagttctcagatgtcacctttgggaactattcatttattctaatccttatttttattcaagaaggcacagctcgaccactccacgcagatataaattcaagctcttcccaaagatttctcaggggtggggatcctctatacattccctgccatctatttaattaattatctttttttttttttttttgagagggagtctcactctgtcacccaggctggggtgcaatggcacgatctcggctcacagcaacctctgcctcctggggtcaagtgatcctcctgccccagtctcctgagtagcaggaattacaggtgcccaccaccatgcccagctaatttttgtatttttagtagagacagggtttcaccatgttggtcagggtgatctcgaacttctgacctccagtgatctgcccacctcggcctcgggattacaggcgtgagcccccatgcctggcccctgccatctattttaaagtttggcagtagtcaagacattcttttatgtacaacttaaatccttccttctgcatcacgtgtcattccctgtggacctgtcaatagagatggaacacgtggctaccccttgcttcatcataaccctttacatgatgacttgctgaattgcagctatgtgaaaacctaaaaaatttagacattagggaatctaaatttatttcagtaattaagacagaggggtataactaagactgatcacctatctatgcagccataaaaaagaacgagatcatgtcttttgcaggaacatgggtggggctggaggccattatccttagcaaaggaacacaggaacagaaaaccaaatacctcatattctcacttataagtgggagctcgctgagcgcggtggctcacgcctgtaatcccagcactttgggaggccaaggcggggagatcacttgaggttgggagttcaagaccagcctaaccaacatggagaaaccccgtctctactaaaaatacaaaattagcctggcagggtggcgggtgcctgtaatcccagctactcacgaggctgaggcaggacagttgcttgaacctgggaggtggaggttgctgtgagctgtgatcgtgccattgcactccagcctgggcaacaagagtgaaactctgtctcaaagaagaagtgggagctaaatgatgagaactcacgaacacaagggaacaacagacacgagtctgcttggggctggagggtgggaggagggagacagcagaaaagataactacagggtgctggacttaatacctgggtgataaaataatctgtacaacagacccccatgacaagagttcacctaggtaacaaaccttcacatgtacccccgaacctaaaataaatgtttaaaaacacacaaaaaagactaagtgcctatgcagacaccagtgtgcaaattcagttggctacgtatgcagagaaataatggctgagaacatttagtgcttcctcccttgaagttcctgattctgaggttggctctgagctcaggaaactttgcactccttgtatttaaagtgtgaaatattacctttaaaggtatttttctccttcagtatgaaacctatagatgaatttcatccgatgtttgcatcagtgtcttggcatagacccaatttgttttcctttgttgtcctttttatgagggtaaagttgctagttattttaaatattttttgtaagctttatcttcaattctttaatgatctttgttgctttttaaagaactctttcaactttcttttctatagtagcacaagaatccaagctatagtctttccaaggcttctctcctcctggggcagagcagtgtcagggtttggattagaaatcaaatccagggatttatctacaaaattacagatgagcataaatatgtcatacatatcagaatcaataaccctgctaatagcaatgagtgtttcatctattataattcttcagtctcccaatattccaacaggacttagtttcccactacttcgaaacttacttaatttacttctagtcatttgaaaaaaaaaattgataatattttgtctgatatctttgaagttgaaaaggcttcttgccagtttacttattagcccaagtcagtggtcccttgcagcagagattaatcccagctttgcggactctaaattttatacaatttaggaagcgctcagtgaaaaagaccacaaaaatctctttcttttgcacattttacaaaaacattagacctggagcatacacattgcttgagtccctcaaaaagccatgggattttctgtgcaagtaaaggctgctgaagctgaagctcattagtttcaggtaaatctgcttccgatttgcagttctgctaaggtatttcttgtgtagaatatcatttgggctaggaggaggtagaaataaagatagaaatctacacagatgatgatattttaaaatttggtaaaataggatttaagtctatactacccaaactgactgaaaataaatattaaccccagacatctgtagtgagtttttctttctaaaaataatttctcattgacccagggactatcaagaaagtcatgcctggagactaaagaagtaatttttctctgagctaagttcagcatttatagcctcattagacactctgtggttattcagtcttaagcattccaccttctcctaagctcacctagactagctgataccaggcatagtcccattagttcaatttcactctccttaccctaagaaatttttaatatgtatatcaaacaaatttaaatggaaaattgctgtaagttctcttttagttctgatgaagaatttataaacaattcatattctttttttttttcttttgagatggagttttgctcttgtcacccaggctggagtgcaatggcatgatctcagctcactgcaacctccacctcctgagttcaagcaattctcctgcctcagcctcctgagtaacacggattataggcatgcaccaccatgcttggctaatttttgtatttttagtagagacggagtttcaccatattggtcaggccagtctcaaacctcaaatgatccacccacctcagccttccaaagtgctgggattacaggcgtgagccaccacacttggccaaacaattcatattctacaatagcaatatagtattgcatatagatacaagttttactattatctaattaggaaactgtggggtttcctatggtaagattataaagtatgtcataaaggttttggaggtcctcatactgcagaaatttaatttttctattcgtaaaaggaatcacattaaaaactactaaattatcttacatttcctatttgattttatttacccagtcttgcccttcatgccaaagtaaaaagattagaattcttaagtgactaattaagaggaacattggaaaacataatctctaattatgtctcaatattacacatgtgtccatgaatagttatctctaagatgaactccatttggctttaaaataggatgttagagatatttttatgaaaagtttgctctccagagctgtaagttcaacataaatttggaaggctaagggaaagttttttttttttaagtcgtctttattcacttctaattttgcccgaaaaataaagtgacatccttaagtacttttcatttgtgaggtagtttgactgatataaattgtgcagggtagtagttttgtacacagttggttttaggtaatttttcccaggcatctactttcctgttcataataagctgtcagtatatgttagttaaatgaatggatggcagagcccctttgtgcatttgctgtgggcttcggctttctcggtcttttggtttgaggaatagttaaggcacacagagaaggtagcctagcaaatcttataagccagtcatatttgggagtgtctgaggatttttatttttaaatcatctacaagtcaagaatatatactttaaatgaaatgatcagccaggtgctgtggctcacacctgtaatcccagcactttgggatgccgaattaggaggatcacttgagcctaagacaaggagtctcagcatagtgaccctgtctctacaaaaaatttaaaaattagccaggtatagttgcatgcatctgaggttttagttacttgggaggctgaggcaggatgatcgcttgagctgaggaggtccaggctacggtaagccgagattgcaccactgcactccagcctaggtgacagagtgagactctgtctcaaaaaaaaaaaaaaaaatcactcactgttcctgcataataacttttaatcaaaaatctgttccaaccccccagccccatcccccccaccaaatatatacacaaacctgatttagagctggtttaagtggctggcttttgctctgtgtcaatgtgccacgcctgtgtatgtacctgagcagttaggatgcatagcagagtttcagtttatatgtgcaggctctcaggtaaaagggagaattctggaagaatctgcagggaatactagaaacgtgttggcaatactttataagagagagtaaaaatgaatttatcttttgaaatgggagcaaagctacctatttttccagatatatacgtccttttacaagtcgtcctttttagagcaattgacttctttggtttgaaattatttacccagatggctgcctaacgagaatttgagattaggtcaaatcatttgtaggactattttgattaatgttctttgatttctaaatcaaatgtaccagaccaaacactttcaaagagaggaattaatatccacaaaatattatttcatatgcttttgctctaggtttttccacagctttcagccctgtctcatttcaccttaggaggtagagaaaaataactaacacatcaataattagtttagacctgaaaacactctgctgcacagctgtaatgtttcacaatggtttctgagctaagaggtgtttatgtagcatcaactttatcgaaacaaaaccctaggtaaaaacacattgaaatggcacttaaaacaacaacagtgcccaaaatctgttgtttcattacacttgagtataaggcaaatctggaagttaaattgtcccatattgagaataactgaataaatgtttacataattgctcccacttttgctgaatcttttggtttgatcaggtttagagcagagaggtaaaaaatacatttattaaaagagagcttttgagattgaatgctctaattaactgctaattacttctctaactaggctattttagattaaaaacctaattgtctcaattctagtggattttgaggttgtgatgaagagcagagccgatattcagtgggaccacaggatcaagcactgcctgtgttactcagtatttctctgctcagagacagaaccaattataatatttagcagattttttttattggaaagtcttaaaaattgatcagttttaaaatagatgcacacaaactaccttgagctttactttctgatgaaaacaatctatactatatgataaagaacagatagatatggaatgctggttcaagctgacaaaatatgcacttttgttgtcttagatctagtgaggaaattgattcatgtttggtatgactatcttcacaaggaattgcttataaagaggtagggcctaactcatttatataaatcgaggtaaaggaataccaggagtaaatctaggaaaattaatttttctgtttttaggtgcttctaatactgggaaaccctattggtttcaaagggaacttctaggtgagaccatttttagagaacttgtattccagcaagcaattttttatggagcagaggaagcatttttaattattatatattctaaccatattatatagcaatcagataaatttaaagttatagtctgttgattaataaattcatggtgggttggctataatagcaattttgcttcagtatctaagacaaaatttgaatgatttgagaatgcatgatttacctcataatgtgacacccttttaatcaaaacacccgaaggccaaataattagatcttgtataaaacttggaaagaaaacaccgttgtatacccctacccaccattgaaatctgtttttagttaataaggaagtgggagtaaaatatttgagtgagcctatatataggctctcatgtattaaaagaaaagctatttacaactgatttgttgctaaataaaatcttggatgaacacttttaattactaaaaaggtaaggttacaataaacacaggaaatataaatgaataaagtgtgcacagagtcatgctgctttcaggactataaatagcacctccatctctgctactattattagcaagtatgaacaaaagaagatgtccagaaatagaaaggggaagagcatctccatgagccttgtattccatggcataggaaatgtttctagcaagcccgtgaatttagagggttaactgatttttagaaaggacatttccatgctgtcaatttgccaaggaaattcttttaccagcatgtttgtaaaattggcaggctgatgtttcctctaggtgacacaagatgtgatgaagaattttatctttacttccttacgaaaatcagcgttgattgcttgcctttttgttaacttatttggttactattagtttgcatctacagaggatcagttaacatagttgaaactggaagaactagtgcatcgtgaacagccctgaaccaaaagtcaggtttcagtttcacctgagccactaatgtgctctatgactttggtcaaagcatttacatacatatatatatatatatatatatatattcccctttatatatatatatatatatatattcccctttatatatatatatatattcccctttatatatatatatatattcccctttatatatatatgcgcacacatactgctgtcccttgatatctgtgggggattggtttcaggaccttccacagatattaacatctgagaatgttcaagtctctggtataaaaatggcacagtatttacatataacctcccatgtactttaaatcatcttaaaattataatacctaagagagtataagtagttgttacactgtattgtttagggaataatgacaaaaaagtctgtacatgtttagtacagacacaatttgttttccccaaatacttttgatccatggttgaatccacggatgtagaagatacagaatcacagatacgtaggccccactgaaacacacacacacacaccacacacacacacatatgcacacacatcttctctgagccacagtttcttgattaattaatatagcaaacatatatggagcgcctcaatatgccaggcacattgctaagcagcagggatacgaagtcggttaagatacccagtccttgcttactagcctcgcactgctgggagacagacttttgaacctgtaattagaatgggcaatgggtgtataacagagacgatagctgttataagaacacagggcagagcttttctgtctgtggagggggcaccagggaaaactttgcagagatggtgccatttgaatcaactcaatcttaaagaattcctcttgaatttttcttcaagactgatttggatgaaaatggctatacttggtcctcgtgaggaatcaatgacataataaaagtatgctaaaaagcataaaaaacaatataaatagtctattagtaatgaaatgattcatgggcatgaatattacagatctagttctaatttttgattgcctgtttattaatgtttttttctttttgataatgaattatgagtgcagttatttgagaactgattgtaagactgtagttaaaagtgggagaggccaggcacagtggctcacacctgaaatcctagcactttgggaggctgaggtgggaggattcaagaccaacatagcaagaccctgtctttaatctaaaagaaaagaaaaaaaaaagaaaaaaaaacaagaaagagagaaagaaagaagaaaaagggccgggtgcggtgggtcacgtctgtaatcccagcactttgggaggccgaggcgggcagatcacaaggtcaggagatcgagaccatccttgctaacacagtgaaactctgtctctactaaaaatacaaaaaattagccaggtgtggtggcggatgcctgtagtcccagctactcgggaagctgaggcaggagaatggcgggaacccaggaggtggagcctgcagtgagccgagatcacaccactgcactccagtctgggcgacagggcgagagtccatctcaaaaaaaaaaaaaacacgagagaaacacaaatctcaaacactttaatttttttttttttaaatcactatggactggaattaaaaaaaaaacttctccaaatatggatatattttcccataagtagtcatgatagactgaatgattattttttaaatagttacatttttaggggtttacacgtgaaattatgaagatatggaatttagtaataattctttttaaaaacatgtattacttatttataaactatatgtgtattctggtgaaagattgtcctctaggaaaaataagtcttagaattatttctctccagtaggaatttattattgtcctatcttcagccagacagctctgtggtaatttcatttggtgatctctttaataaatattttttggagtgcctattttgtgtgatgccaaatgaagtaaacagtgttttatgtaatatgttccaatatatattttttagaatgaaccatttaccaagtatacataagtcagacattgactgcatatcccactgaacatttccattaatataagtggaaaaaggaaagccgctttgcaaaaaaaggaggcttttttgcttcagcaatatgcaaattaatttgaagcatgccagtagttttaatataggttgattcagaattaccattgtgaataacattcacttctattactgcttttgttaaaactaagcgccaaaaaaggaagcctctttgcttcagcaatatgcaaattaatttggagcatgcaaatagttgcagcatgcaagtagtttagaattagactttcattaaaactaagtgccacacagagaagaggtgtaaaacagagtagtaatctgttgcgtgcacttgaagggttcttgaaagacgtgcataaaccgttaccgttgtagcacaagttgagcagcaaaagccaaagtcgcacatctgtgtcttgtcgccacctctccacttatccactcatgctggcttttctcccagcagctctttgccctcctccttttaacgctgtgggctgaggtgaggatgttctagtcaagagtctttacgagccttatatcgccaggctttcagaaaatgtgaagcatggtagtgtgaatttagaaaaaataaaagtgtgtataaaagctcttctgttttcttttcttttttttttgttaagaaacaatagtgtttatttatcatgttttgcttagaattcctttggtattctgttctcttgattttaacaagaagctaaactcaataacatcttttaaaaacaaaacaattttcggttgagggtgggtgaggaagttatatgaagattgagtgggaacctcaacccaaggacataatagacaagaaacagtttttttcctcccctttcttcagaagtagtcttccgcatggtttaatgtgctaacataaccccggttccaatatttcaaaagatacagaacttcccagcatgatgataaagttttcctgtgttccaataataaaacctcaacgtaccagtgatttccagttcctttgtggctcagcaacttgtgaagaccaactaagtcctaagtacccagcctgcagtatcagtgtgggagtcggaaacagatgttcacgggacaatgccatttgttgtcactgtcgatactatgtggcaactttcccaaatgaaattgtttgtggatggaaaagaatgtaagcagtgattcatgcccaggaattttttttttttttttgtctgcaggctaaccgtatcttatttgttttaaatcgcagagcattagtggattaaaaattttaggttaacttactattatagtatctttttcattttttgtcctgtacttctaaaaggagtgactaatttaggtagcttactgagaatagtaaataccttacttgatttgagaattcaaaagcagctgacatcttttcagatttagtgttttaactattgagtaggtacagagttgccatttaaatgaacagcatgacttgcttagcatttttgttaataatttggaggtttggagaattcaaaataaacattaagtagaaacatattttttggtaataggtggcattgcatgatcttggtttgagattttcataaatattacaaaggaacttccactaactcactcactgttagagataatagattaatttgtataaattaaatattaattatagagaagtttaaaatgtacttaaaatgaatttgatacaacaaagctacttaaaagttaggtagaccatgtcatgtgacatgtatacaaactatcctttttcaagaaaaaacctaacaagcgtttaaggcataatatctactactttagtgccgtttttataaaacataaattttaatctacaaatgaaagtcttttaaacatttattcataccaacagatgcctaaggccagaattataaaatgttttatgttgttttaaaaacatatgtatttctcataattaggtttcggcatcacagaaaaattattttaagggtcatacaacaaaatctgacttttaaacaacagccaaaggaaagattggtatcacatgtagaggaagaggtcctgaattaagaagcaaattccggagtttcagtaactcattttcactagctaatgtttaataaattgtattaggttagtgcaaaattaattgctgtttttgccattaaaaccacaattaggttgggctgggtggctcaagcctgtaatcccagcacattgggaggccaaggcaggtggatcacctaaggtcaggagttcaagaccagcctggccaacatagtgaaacctcgtctctgctaaaaatacaaaaattagccaggcatggtggtgggtgcctgtaatcccagctactcgggaggctgaggcaggagaatcgcttgaacctgggaggcggaggttgcagtgagccaagatagtgctactgcactccagcctgggtgacagagcaagacttggtctcaaacagaaacaaaaacacaaacaaaccggcaattaattttgcatcaacttagtagttgtgtggttccctcttcctcggacttctttttctcatttgcaagatggtacgtcagtctggatgacctttagggctctcgcagtttttgattctagtttagggctttgaattctgttctctagcagtcactgttaacattatttgagtatctgatgatagcttgtactaattttcccagaaaaatgcataaaacagaaattttgcatgcaatcccagggcttcatggactcattgaagcctagtgatagtcccaggtaaagaagctagttaaagaaagttagtatcctcacgtttctgtgaagattcaagcaagcatttcaaattgctccaaacgtgggcatcagaactttctgattattaaacaaagttgattgtttttattttctaacatatctacgttagaaatttggcattgataccagcacacttggagaaggcaaaaacacatgagttggtccactaaagacttcaatagcacttggaaagagatactcgtgtgtgttatgtatggcatgtcaagggaagttacctacatcccagctaccttgctttagaacaggaaaggaatgaactaaggtgcacttgcctgtctcaaccagtgaatcaagactgattgtttgtagttattttaatttatgaaaaattcaaaatttaatgctacagaaaagacaatgggcctagggaggactatgttaaagtcttgttcattttctagacccaacagagaatacttgaatgcacagaacaactgaggaaaatcatactttaagtaacaaatacaaactagaaattaattctttcataattaagactatttcaactattaattttcttccaatatacccctctactttttttagccatttatgggtcattctacattttcttaagttctaatatgatctggagaatgtcttggacttctttaaagtaacttcatgcatgtgctctcattagatcctttatttactaccttactttaatgttatacataatacataataaacatgtgaaattcattttaatgaatagtgtaagcctcaaaaaatttacttaaccacttctttgacctagcaaatttataagcgatagtaaaactttccttttacctttacaataatagcttttaagtactcaggctgacaaattcttcatggactcacttttatgtttttcaatttctattaatttctctgtattaaagttgaattagatggatttatgttgcctattcctggcattcatagcaactataaggcatgatcaagaaaacagaaattctaatcctcatgttacagaaatggccccaattctacttgacagaaatgatttcaattagggagtctctgggctaccttttctgtttcaccagaacaaatgttattgatataaggggaaatccttggataccatataacctgctcactctatggagcagagttacttagagtgctccgaatcccatctttgatctctggcgatatttttctctgttatgtcactgaggtcacctggctcatgtgtgacaaactgcctgcataagtcacagtgccagtggcagagatttgtaaccatgcccctggtccattgcctttgaattatttcacaggcccgctgctttacatttacactctgtcggaagatgaacaggggaagggagtaaaatcaagggcagggtctcatcctgaaggacaaggggaaacaggtggaaggttaatggccctggagcgattccacaagcctctcaggcttgatatatgggcctggggcctaaaacgggcattggctttcaaagatatattatttcatttgaggagagacattctggagttcctgcatttgtctgctgatagatgatcctctgtccacaattggttatggcgtgtgagttttccttgggcctgctcccatacataaaaattttgctgagctctccaaccttttgcatgcctttaggaatgggaccggtgcaagcccactggcaggctgttggatttttttgctgctattttagtagttccttttgaaccgtgaggcaagtggggaatgaaagacacttctgttcattcatacatgacttgataagggtggccttgttataaaaaaaaaaatggtgaaagggatgttaggaatcaaacatatgtgtcattttgggaagacaggctcagtccaaaatttagtcatttgggtttcaaaaagttgcttacataaaagctagatactatcaaatagcttttgactttattactgttttgcactccccaggcttttagcaaatggcttactctatttttctttattatttccaaaaagtttgaggtgatttggagaaagaaggagaacagacagttggaaaaaggtgctttacacagagatccatgattaatttgcctaacaagaaccatcaggcaatgctaccaagaaatatgtctaatggctcaaatgttacaatcaaatagaactggtcactagattaatggaaccagtcacccgaattaaccttgtgtggcctctcaaagttgtactatagagtctaagactgcaaaaatcatttgcctcagcctcttaatgttcatagacttaatattcatgaaaatatttggattctaatatgctttgatttatagtattttgaaatttaattattaactctggtttgagatatatatatataaaatctttgattttatagttcctggtaattgtgatactagctttgtcagagagagaatgcttattttatggcaagcattaaggaaaaatgagctctgtaaactcactatctaaacaaaaggcgatttttctttccagctcttttgtgttccattacccttgtgtttggtgaattctcacaccactgtatgaaatatcaaaatcctatttgtggacattttatctcgaatagctttgtcaaaaacaaattcttcacctggagaaactttccattatcatcacagatacactggcatttaactacaagaagttaatattggacaaatgatcagataatatctgagtatcaataggaatttcattcttggatgagaggcaacaaattgcaaatacttttcacatatatttacaagggatccttatcacaatccctattcatattgccctcagtagaaacatgcagcatctggccattggcccctgttaataatgattacacagatgtccttttcttttcctctggaatattgcaaagtagaggttagaccagaagcaagaagactggagaggcatgtttagtacctgcaagaagatatttaataactttcttagaggaaagattcagaatcaccaattacattgagttgaatgaggagcattagccgtcaaaagaatctgtttttccacttgttgcttggataaatggataaaagcctgccaaggacttcagtccaccagctgagggtaccatagctaaaatactcccaacagaagggcaggtcccaaaccacacaggcatgcttttcaatcacagaataaaatgtagttgttttcgtcatttcagcttgtgacctaaatgcctcattttcatgtttgaaaagttaccaactttatttcagtcctatttcccttcctctgtggtatttcccagtcagtagaccacagtcctgtgggttatatcaatgcctaaagcagagatcaaatcaaagcataccacataactggttaaaatgaaagctcattccgaattagtaaataatgcccgcctgtcttccacatctgtcaaagtctcccagctcagatggacacctccataagctgatccataggaagccaaatacttgcaaacagcctcttaattgctcatttgcagttggacaaaatgctaaatgcagaaagacttcaaaggcaatggaatctgcattgaaaacaggatctcaatacacatagtcgcttattgttgcaaaattagaataacaaatgttcccagcatgaagccaacataaacttgcctgagtattattcaacctgaaacatagtctaccttttttttttttttaacagcaatagaagaggcatacttagcactctgtttgttattctatactgttcattttaatgatatatttaggtctccctaacactttgtatttttacgtgtaattacccatattaaaaaaaaaacatcactcattagtgttctgttctactgacttaattatgccccttaattaaatctcagctaacagggggtcaccgcagtgtcagtgggatttgtcactgtttgtcagcaggtgtctggttgcatctatttctggttttcgtatggtttgaatctatttaagaacttgctacaaccccgtcctcccctccacaccaaccccaaatgccagagacagcattctcattggagggaagaagcaatatctatttgacaggcaactgcttcccaaaagcttgtttgtaagaggaaatttttgttttcattactctagaaaaaatctcctgattaggggaaagatgcttaaaacagacttggataaaacagatgcactatttaaaagatgaataggtttacattctaaaaattatgatcatatttttgtatacaattctaaaagttccttgaagaacaaaaaatatattttgttgctgctgttatgagaagaacatcacattaggtgttttgcatcatctggccattggtgtctttgtacagagtactttgtatcaattatttggttcacgtttttcattttaagaatataaaacaaattacaaacatatgagtcaaaccgaaaaaaatgtcttttgtgtgactaatgtagggtcaataggaatttaattcttgaatgagaggcaacaaattacaaatacttattatttggaatgagtcttagtattaagacttatatgtcttcacatttcacattagaatgttttaaactcatgattttagtatattaattaagggagatataattcccatgtttctgtatataataggcatctaatgttgatctgaataattgattagtccagtcaggcttttataattagttgtcagcttttcagtgtaaagccctcaaaacacctgctgtgcatctacaaaggtcttacatatttattagtgtttttaacctaaaaaggcatgcaacctacctgaaaagcatttaattttttttctggaactaagatgacccttccaacatataccctaagaaactaaggctatatgtctctgagtttttcagtctagaagattttggactgaaattctgatttttaaaaatcataacacttatctttatttaaagataaaaatgtcacagtttttctatggaagtttttcagaactcatatttctaatagtaaggttaagcaagacaatgggttacagatatcaaactatcaacaatgtaaagtagttttgagacttcactgtcattattgtataagcaattttatttttctgggtttacctacaaatgtggtagtcacagaagaagaaaaataatttaaagaaaaatttataatactcagcttatttatttctgaaattcaaatcaattcatttcatcctaaaaagttaactccaactggcttttcttaagtaacaaatgtcatcatttgctgtccaagtaattttcaatacaatgctcatttgatgttgcctctaaagttcttatcacacaagtaataagtaatccatacattacatatatgtgtacattttaaaaaccatttcaaatggtgagataagaatttttatgcattttatggattcctgtacagcctcctcattgtcattagataatgaaaggcttcgccatgtgtgtatcgtaaagacctactaagcaatatgaactctccagattgccttacatttacacagttgaagtatatatatgtacagtattgtacagtattgtacagcaatattgtatagcaatgtacagtattgctgggcacagtggctcatgcctgtaactccaacactttgggaggctgaggcgggtggatcacctgaggccgggagttcaagaccagcatgacaaacatggagaaaccccgtctctactaaaatacaacattagccgggcatggtggctcatgcctgtaatcccagctacttgggaggctgaggcaggagaatcgcttgaacctgggaggtggaggttgcagtgagctgagattacaccattgcattccagcctgggcaacaagagcgaaactccatctcaaaataataataataataataataataataataataataataataaagtacagtttaaataccatagggtaggtcagatattcttaagattccttctttcattcagtaaatacttatcaagtattagttgtatgccaggtaacattataggacttatagattcaacatgaagagcatagacaaaaatccctgcttttgaggatcatatttatatctattttagtgactaagagcatttatttaagacaattgcactcatgtaattaaaaagcacttataatctggcaagctagcctaatcttagcaatggaatgtttctgctctctttctgtttaagccttcaggagatcataccagttttcccaactggcatatggtgagttcaagtacatttcccacatatgctcagggattatcttaattgtattcctttctgaagcttggaatcaagggaaaaaaagaacaataatgatttagggaaaaataatagttttttaaaggtagatttatagttagtaactttatataggtgaactgatcacagagaagggtgtaaatcatctgaataaacaatggattttcacacttactagaatctctaagaataatattttccatattacagctaaatgagacccattatgtatgctttcagataaactcacaaagctcttacccatgtaaatctcatagatctgccattattcgtaatgaataacaagttttatcatgcattttcattaaaaatgcattaatccctttgtagtaacctctccctaattcattgattcgataatacaagaacagtaaacatttctggcataacaaaaatgtggtatcaaagcatactgtatccataaatacaaaatgtaacaggaaaacaaatacatttatcaaaggaggatcaggttttccagccactaaataatgctatggtcgaatactgctacagtctaatacattaagaactcaatcatagtgccgcattgtgagccgtttgtaccggatctgattcttccagattaaatgacttgttgaaacttgaagatgaaagacaggcagaagtatccggggctctaccctcaggaggctccagggtgggttactgccagtgggggactaatgcttccgtctagtggagataggaggaggaggatcagaagtgacatgtatgtacccttttttacttgtagattatttacttagctcgttttaggctctgtgtcctcatctgtaaaacatggcattacctctttcaggtattttactggggattaaatgacttaacacaaattaagtccttggtagatagtatatattcaagaaaagtcaatttcctccttcctttattgatgcttaaaagcccctggtgctgtatttgattgattcaacaaatacttgggcttggcacaaggcactggctatacagttacttccctcttatcatcaccatagaagcctcctgatgtggaaattaggcaggccttggagtcacacttggcttcaaatccccttccatttgcttcccataagctcagcatgtaacttcactgtccttctctaaaaataggggtaatgtataacttacgtggttatctaaaaaattaaatatttgtagagtgcagtgtgctagaatatctggatacagagagatggattagagatggtgtctagagcacaacagaatgaagacctatctcaaaaaaaaaaaaaaagaaaagaaaagaaagaaatggtctctacccttaaagagggggatacacatgtacaaaactgtgaatcccaatgcgatttttgtggggaatgtgttcgaatgctgttcctgaacatatatctcagcatttccaaaacaaaaattacatttcagaaactcagtagataagaaacatctgcaaaagaccgacacaatttatcttcaaactaacaaatgtgttgatctatgtgcatttgatatctctatacttatataggatgctaggagacaatttttttaagtctgtgtggtgctcattttctttgcgcctaatgtaagagctgtttggtccatagtcacctctgtccattctagaatagagggtggtgagatggggggtggtgtttttactcgtgagtcgtttggagattatcaggctaactacgtgataaaagatgctgaaacactggtttgagttagggtggagaaaatgtgaccaactcccagagtccagtatgattcacttactgttgttaagactttctgccttcctttaattactatgtcaaacaagccttatttatgccaaacaattaagtctattattaatggagaggtaagagggtggggagagaatgagttccggaaactttttttttttattttgagagggagttttgctcttgttgcccaggctggagtgcagtggcacaatctcagctcaccgcaacctctgcctcctgggttcaagctattctcctgcctcagcttcccgagtagctgggattacaggcatgcgccaccatacccagctaattttgtatttttattagagacggggtttctccatgttggtcaggctggtcttgaactgccaacctcaggtgatcctcccacctcagcactccaaagtgctgggattgcaggcatgagccattgcgccggcctgacttctggaaacttttttagaaataaaagactcagctaatagactacgatatgttgagtgcagtgatagaagttccctaaggagagtaaaatctcaacaaatgtgagtcctctttttctctgcaatcctgacctgtgctaaaattggggacaaggccgggcaaggtggctcacgcctctaattccagcactttgggcggccaaggcggctagatcaactgaggtacggagttcaagactagcctgacctacatggtgaaaccccttctctactaaaaatacaaaaattagctgggaatggtgacacatgcctgtaatcccagctactcaggaggctgaggcaggaaaatcacttgaacctgggaggtggaggttgccatgagccgagatggtgccactgcactccagcctgggatatagaatgagactcctcaaaaataaaaataaaaaattggggacaatatcgggtagacaaattttagtttctaaagtagctgaagggtctttattcaggtggtttctgcctttcagctttgacctttatctgccttgttgcagcccatgcatactcttcctcttccaatattcatacatccacaaatgtccctctcccttcaacacatacacccttcttcaccaacacacacacacacacacacacccttcctcttaaagcttattctcaagaaaggtttaagtttgtcctttcagttcaatagccatctttcctcatggagtttgtcaggtcccttcttttgtaattctcctacttgtactctccatccactttatttccctttttttttgagacggagtctcactctgtctcccatgctggagtacggtggtgtgatcttggctcactgcaacctccgcctcctgggttcaggccattctcctgcctcagcctcctaagtagctgggactacaggcacgcaccaccacacctggctaatttttttgtattttcagtagagacagagtttcaccgtgttagctaggatggtcgcgatctcttgacctcgtgatctgcctgcctcggcctctcaaagtgctgggattacaggagtgagccaccgcgcccggctttatttcccttttatctgttctttcatcccttagtcacattttattttttttatttttatttttatatattttttgagatagagtcttgctctgtctcccaggctggagtgcaatggtgtgatctcggatcactgcaacctccgcctcctgggttcaagcaattctcccacctcagcctcctgagtagctgggactacaggcacccaccatcatgctcagctaatttttatatttttgaagagatggagtttcaccatgttggccaggccagtcttgaactcctgatcgtaggtgatctgcccacctgggcctcacaaaatgctgggattacacgtatgaaccaccatgcccggccccttgctaacattttaattttgtttgtttattgtaattagagatggagtctcacgtgtggcccaggctggtcttgaactcctagcctcaagcagtcctcccacattggtttcccaaagtgttggcattagaggcgtgagccatggtgcccagccccttgtttttttttgttgttgttgtttttgtttttgtttttttattgaaacaataaaaaactcctctccatctcatcccacttgctcttgttgcccaggctggagtgcagtcgcgcgatcctggctcgctgcaacctccacctcccgggttcaagtgattctcctgcctctgcctcctgagtagctgggattacaggcatgtgccaccacgcccagttaattttgtatttttagtagtgacagggtttctccatgttgctcaggctggtcttgaactcccgacctcaggtgatctgcccacgtcggcctcccaaagtgctgggattacaggcgtgagccaccatgcctgaccgcccagccccttgttatttaaatctttcctcttccactggctctcatcagtccacatgaatgtgcaaagctcccctcctgaaaatagaacaccacattacatgggtctccctgtctgtcaccgtcctaccttttctcatcatgacacctttgcccttttctccacctcttctttttggtgttaacacagccaatactgtaggactgcagtgctaaagccgggcagcaagctcactgcatttgcacttctccatgggaaatgcctcttgtgaatcttaaacatcatcaaggagcttagccacatcttctcagccctcatcctctctccccattttaatccttggccatccttgaaattccttctggcccagacttcttggtcactactcagtactcctctctgagtgcaccttgctaggtttcttcactagctcctctccctctacccaatcttaaacaatatttttttctagttttctcttattggtttccttactttctcatccacacattcttagtgatttctcccacaaacacaattatgccatactttctctcgcaaactccacagcagcatcgtgaattgcttgctgaaacataaatgatcatcacctccaataagcctcatttagttctgcaactttgggttttgttttgttttgtttgttttgttttttgagacagagtcttgcactgtcacccaggctggagtgcagtggcaccatctcggctcactgcaacctccacctcctgagttcaagagattctcatgttacagcctcccgagtagagactgggtttcgccactttgggcagactggtctcgaactcctgtcctcaagtgatccgcctcagcctcccaaaatgctgggattacaagcatgagccaccacacctggcctgcaactttgtacaactttctttctttcttttgagaaggaatcacactctgtcgcccaggatggagtgcagtggcaccacctcggctcactgcagcctgcgcccccaggttcaagctactcttgtgcctcagcctcctgagtagctgagactataggcgtgtgccaccaagcccagctacttcttgtatttttagtagagatggggttttgccatgttgcccaggctggtcttgaactcctgggctcaagggatccatcctcctcagcctcccaaagtgctgggattacaggcgtgagccactgcacctggccctgtttctttcttgcactgtcaaacaacacattctctgcagttattatcctgggttgtctggtttgatcatatcactcacaactttctattgcatatgcagaaaaaattagaattcctcaaccaggtatctcatcatcactgtcttcctctccatctcgtctcacctgccaaactcaaagccattgatttgactagtctaaatgtaggcctggacgtatttgacatggggactatttgaaatggggactatttgaaatggggactatctggcaaaatctgggatgggatgtaagatgatcgcaattgcacactcactcctagcctggtttctgttagttatatgtctaccccctcaactctttccaacctctttcttgtcactgtttcctctcacaaactctagcacagagttttgaatttggtagttacaccacaaaatttttaacttgtcagaaattcatttatgattatatgcaaatgacttgtgttgatttaaagcagtagttcccacaccttttggtctcaggacgctttgcacttctgaaaatgaggactatggagacctttagtttatataatgtattgggagttaaaaacagagatatggttacaaatcaagcatccacaaatacacattccatttgtcaccagagtgatgatgtcattacatcctgtagcctctgcacactcctgacaagtggagggtgaaaagggcaaataacatcttggtgtaattggaaaaatagttgtaacctcttgactccctggaccatactcgtaaagccactgatttaaatattatcactcctatgggtgtctactctttcattgggattaaagattgatgccaaatgaatacattttccaaccttgaattttcaaatcagtaagtaagatcagggacatccaggggaacaaaaacccttctcagtgtcctgggatttctctcccagtggctgtgagactgtactcctggaggtagggggcatcagtgagaccagggccagtttgaggacagcacagatgtctctaggtaactgacaaacagacacaggtttccctgagtgtcagcctctgccccctccctaacacacactcacattcacgtacacaataaatcaccctggagtgcgatggaaattccaagaacttcagcattgtcttaacctgtgttctggtgccatcctgagccttgaccacattgactggcttttaaagtaggtgccattgcattcattcttctgagatcaatatccctctgggtctccccagcagctatggtctttctgcttggccccaagacaattaagagaattaatggggagaccatgtccaaataaaagactggagttattgctttaacgtgcagcaactccagtatttgcattaaattattatttgctttgtaatatttgatcaagctagggttagggactagactgacttttatagaagagtgatgcactctaacagtgactactatttattgagctcaagccttaagttctattcatttattagctcactaaacccttacaacaaggggagtggggagggtcaatattaattagaatttgactgcagccagaataaactaaagctcagggggtttagttatttgcccgagttcacactgatctgctggccactggtggagcctgtttctgtaccagacctgtctgattttgcacctccttaccctttgctctctttctttttttttttttttttttgagacagagtcttgctctgtcacccaggtgggagtgcagtggcgtgatctcggctcactgcaacctctacctcccaggttcaagcgattctcctgcctcagcctcctgagtagctgggactacaggtgtacactaccatgcccagctaatttttgtatttttaatagagatcgggtttcaccatgttggtgaggatggtcttgatctcctgacctcgtgatccactcgcctcagcctcccgaagtgctgggattacaggcgtgagccactgcacctggccccctttgccatcttagttattgttctcatcccatattcctgtgtctaacattttggtgtgtgagtgtgtgtggaggactgatgtgcacatgtggagtggggagcattggtttgctagaattttctagagctttttattcaaagtgcggtacatgaaccaccagcattggtttcattagtcagcttgttagacatgtagaatcacagtcccccgaactgctggatcactgtgtattttaacaggacccccaggtgaactctaagtgtgttcaagtttgagaaacatggatcttgagcacagttgtatctctctgaacttttttgagagaattaagtgaagccattagtagggtttcctgcatagacacatattcaacacctttagtaaaaaacaaaaagcccgcttcttaaaagaatatgctttactttgaaagtttgcatttatgctatcttgtctatttaatgctatataatttcagacataatatagtaactctacaagacctccttccctgtataaaaagacgcactataagtttttgtagtcatctttgaggtctgtctgtagtgtgctttattaaaagcgagcaaatactgaaggatcccatttaagtatgtggtctgcggtggagtctaatttgtaccactaggcaaaggtcacacagaggagctcgttaatgcacttactccgggatgaaatcaatctccatacttcaccatattgatctgatagctcattggcgcttccctccgtgaactggttagctcacgtgtgaatggagagagatagatagctttctgggcctgagaattctagctggggtgccatccagggcaaaaggtggatgtttttacatcctcatttgggtggcccttttggtttctggtgttaggctcttgtgctggtatatcagttagtcagaaaaaaaaaaggttttaaaataaataagttgcttttctaccatgggtttattctttttcttctgtagtttttatgaatcatgtgtgctcaaaagtatggatcacatttatctgaatacaggcagatgacttgctttaaagtgtaacattgatattactaaaagacaggtcttttttttttttttttttttttttttttgagatggagtctcactctctcgcccaggctggagtgcagtggcacaatcttggctcactgcaacctccgcctcccaggttcaagcgattctcctgcctcagcctcctgagtagctgggattacaggcacatgccaccacacccagctaatttttgtattttgtatttttagtacaattagacttgtagttttagggatttcaccatgttggtcaggctggtcttgaacacctgaccttgtgatccacccatctcagcctcccaaagtgctgggattacaggcatgagccaccacacccggccaacataggtcatttcttaatgaaaagataacctgctcagtgcaatcttcaggactcaggagtctcccctatgttcctttttgtcaaaactcaatgctattgatgtatatatgtggtcatttaattgcagaaacaccaaggaagtagggcttggtgaatccggctcataaaacacacacatgggtactaattccttgaagaaatgggccaaaataattctagaaatgaggtagaaacaagccaacaagccaaatatttccaatttttaaaagatgtatagattccagatgcaaactggataaaagcagactcagatcccttctaactttgagacacggttttccagagaaactatgaatattgagaaaacagcagcctccaaagccgccaagacttgatattttcattacgcttggttacaagctcgttgaaaagtgtttccggttcatccttgaatctcttccaatctaagcacaatgctgtgcacatgagcaggtggctttgtagtctatagactcctcctagacttccttttcctagattttaagtcaaattttgcctcgaggaagagtttgaagctcgagtctgaggcaagtatctagcccaaactttcgcaaaattgaattaacctcattctttggatgggtatttctaaatttttaaaaatttcttggccgggcacagtggcccacgcctgtaatcccagcactttgggaggctgaggcgggcggatcacgaggttaggagttcaagaccagcctggccaatatggtgaaactccgtctctactaaaaatacaaaaataaaaatacaaaaatttgctggttgtggtggcacatgcctgtagtcccagctactcaggaggccgaggcaggagaatcacttgaacccgggaggcggaggttgcagtgaaccaagatcacgccactgcactccagcctgggcaacagagtgagacgctgtctcaaaaaaaaaattggtttttttttttctttttttggagacagagtgttgatctgttgcccaggctggagtgcagtgacgccatctctgttcactgcaacctttaagcaaggggtttaagtgagtctcgtgtctcagcctccagaatagctggggttacaggcgcgggctaccacacctgcctgatttttgtgtttttagtagagatggagtttcaccatgttgcccaggctggtcttgaactgctggactcaagcagtccattttttgcaacctccgaaagtactaggattacagatgtgagccaccacgcccagcctggatgggtatttctaaaatacacatctattaaatgccactttttttttttttttttttttttttttgagaaggagtctcgctctgtcgcccaggctggagtgcagtggttcgatctcggctcactgcaagctctgcctcctgggttcatgccattctcctgcctcagcctcccgagtagctgggactacaggcacctgccaccacgcctgacttattttttgtatttttagtagagacggggtttcgctgtgctagccaggatggtgtcgatctcctgaccttgtgatctgcccgcctcggcctcccaaagtgctgggattacaggcgtgagccaccgcgcctggccaaatgccactttgaatgtcaaaatatgactgttcttcagatgaaaaaatagcctttttagacaccaggcaccaaaataactttcagaaaaagtagtgttcttctagagttctcatagatagaaaagaacataaaggaatatgttaaacataacaagaagactggacatatttgtaagattccaaatcttaggatataattctgtccccagcctttgtgaagacagatggtcacaatgaggaagagggtatagtttacccttcaatcaggctccatctgacctcctttttaataaaaagaaaaaaaaaaaaagatctcactgtttcccgggctggagtgcagtggtatactcatagctcactgcatcctcaaactcctatcctcaagcaaccctcccacatcagcctcctgagtagctgggactataggcatgtgccatcatgcctggctgagctctttttgagtaattgaaatagcaatgagatgcccagagtcctcagtttgaactgctgtgttcagcctagtgagaaatgcataggcacttcagataaagtggcatgagacttcagggaacaaatatagaacaatgctgcacaaattcacctgaccttgagcacctggctggatgtccattggtgaatgttgttagatactgtctcctacgaatgggttatgattactacttggtatcttctaagtaaaagtccttaaccatcaccaagtaatatattttttttttgagatggagtctcacactctcgcccaggctggagtgcagtggtgccatctcagctcactccaagctccacctcctgggttcacgccatcctcctgcctcagcctcccgagtagctgggactacaggcacccgccaccatgcccagctaattttttgtattttagtagagacagggttttaccacgttagccaggatggtgtcgatctcctgaccttgtgatctgcccgccttggcctcccaaagtgctgggattacaggtgtgagcccccgcgcccggccagcaagtaatattttttaaaaaattttttggcagtgaaaagtctaatgagacataaagaaataataggaaaagtactactagatgggcctgaaaatgctttggttctctaacttgtgtgtaatggccaacatcattaagacaaggacatgtgacagactaattttgaaaatttattctcatgttactgcatttttgttattctagttatcaatctacacccataccacaatgctgctttattttgtttgtttgtttgtttgtttttgaggtggagtctgtcacccaggctggagtgcactatcttagctcatggcaacctctgcctctggggttcaagtgattctcctgcctcagcctcctgagtagccaggactacaggtgtgcgccaccatgcctgactaatttttgtattttgaatagagatggggtttcaccatgttggccaggctggtcttgaactcctgacctcaggtgatctacctatgtcagcctcccaaagtgctgagattacaggcgtgagccactgtgcctggcctgtgctgccttcctgacactcaaacacaacagggtatgagttgtatgatcagctatggaaaacagactgtggtatgtatgtatgactgatatgtggtaacaacccttctctaggcctgtatctgtctacacaagcagaaactgttggtcagttcaattaaaaaattaactgatttaatgagttggctgaattaccttattgtttgacatgagtcaaccagcccactccagcaaaacagccaaccaactcagtcactctgtagaagcagcgtgtcattgaacaaccaaacacacagtacatcgtgcacagcataacgatgcttcataaatgatggactgcatatatgatggtggtcccaacatattataataatgtatttttactgcccattttctagtaacacaaatacttaccattataagtattgcagtgtagaatagtaacatgctgtacaggtttgtagcccaggagcgatagactattccatatagcctaggttcatggtaggtgctaccatctaggtttgtgtaggttcactctctgctgttcacacaaggatgaaatcacctaatgatgcatttctcagaacatgtccccatcattaagcgaagcatgacctgcatgcatgagtaattatgtgtgtgagaagccatgagaatacctctagaaacacaattcttctttctctgaaaaatgctttccctcaaagaacagtgcatgctcatggaaaatgtaaacgatttctttctataaatatcaaacccattttctctgtgattcatatttcaaataaaacacacacaagatcaacacttaaattgggtattatttctttttttaaaataaacctttgtcagaatattatttcttctttttttctttttattgccactcctcctctccagaatattattcctactgtgtgaaatccaaaggcaatgggaagggatacagttctgtctttctcccttcttacaagggagacaaaagaactcccttcgtcactcacctctgttagaaatgcattcctttaatacaaagagtatttctcccattttatgatgagaataattgggaaaaagaaattcaatactttatctttcacttctcagccacctttggggaacttatattttgtatatcaggatggctgtgctatgcataacttcttacagatcttgatatgctatctttcatcattatattcagatataaacccaatagttgtagagattattaacagtgagtaaaggaaaggctatctagaaatatggaagacataaagggattgtcttgggactgacctacagagtccttgcctcatggggacagattcaacagggcaatgctgacgtcttaggaagggagtgtgtaggcggtgtgtatgttgggtgggaatgggaaaggcagtatagtatcatagcctgcatattcttctcctttaatctagaataggaagaatatgaaagtagaggtaataagaaatatgccataagacacaccctcttcagacagtgcaaaagagctaggtgtggttttgctaaaaatctagctaatgtgattctgatttcaaaatcattaccttgcagcttgtgtagaatgttttcccctgtttaactggccaggacaaggaaactaaaatatttgtcaaaacttgtgccttacaatgttgtaaatgatgtttccatgtccctccttttgagatttaagctatctagtgggagtgggtgcctatactccaccctgccgagctgtaagcaattgtaagaggggccactgacaacttcacctctgagtcttctgggactgagacccagaataaatgctaggcctcagttcatctcccaaacagaatcactttctcttgtttttcccccaaatcggaaggagtgtctatctagattttatgtccagataattccaaggttctatcatttggtatctatggttttgtattttgtaaacttccaaaggacttcatttcccaaatcacaaatttctttacatttgaaatagagaaatcaaattatcattaatgtatttctttgcaggaaagaaactgggcaatattatattttaaaaaaataacttacagaaaaaaataggaagattgttctttactcttatatgaaagaggcatagtgaaagagcactgggcttggattcagaacacctggattcccatcctgtttctggcacctgagtagccttatataaaccacagcccacctagcctgagtttcctcttctataaaatgatgtagttgaacgaaatgtagctatcagatactttcagcattgattcagcaaatattaattaagcacctgctgtgagcctagtaccagggtgtgattcagcatgtaacaggatgggggtgtccccagtccaggtaatgaaagggtagaccattcacagtgtcaaagacagaaaactagataggacctattactcttagcatgctatgtttagggcactggcataaatatttcccactaaatattctacactatctagaaatttttaacaaagcaaaaattgttgtttacctagacctaatctttctgtagtttagggccaaacttcgactgttggagctccatcttcaattgctactactttctatgaatccatttctgggaatctctgaaggcatagactgactgtacacttagcactgtgacattaaggggacatttaaattgtgtgaagggacaagtcctctacttgtccctggggaactgagcagaggaattctcccaggagcctttgtacccagagaattcccatcactgaacagtccttagggacctctcctttacctctgccctaatttcggttgtacttttggtgagtaatatttaggccactcgaattcttttctcctttctttggccaactgcctgatggaagcagccagccaaaaaggacccaaggacattttagcctctataagccttttttttttttcctggctttgtaaagcaacctatgaaggaagaagttgcattaaatgacctcaagggagccacggagcatgccctctggaatatccctcaccttctccctttcttcttaaccctactatgccaaggaccttcattgtgcatctattttacaagctggagggcaaccaaaatcttccttaatttatgccataatcactgatatccagatgatgggtctgctgcacacctggaattcttttattttattttattttttgagatggaatcttgctctgtcgcccgggctggagtgcagtggcgctatctcagctcactgcaacctctgcctcccaggttcaagtgattctcctgcctcagcctcccaaatagctgggactacaggcacgtgccaccatgcccggctaatttttgtatttttagtagagacggagtttcaccgtgttagccaggatgatcctgatctcctgacctcgtgatccacccacctcggcctcccaaagtgctgagattacaggcatgagccaccgcgcctggccacacctggaattcttttttggctgatggcattgttgcctttaaggcggtgtctggaaaatgagaattacaaacataacctcattatgctattagaaaaatgaccatcatattcacaactgccttcttgacattccaagcaacccagaggaaaatatatcaagctgagaaggattctgttttcattacttgaatattgtctgccaggttagacatgtgagaacattgctttaattatacataagagatttctaaactggagaacaggaaacaggtagtggtcataaatgaaacaatacccagaaagagaaggcactggaaaatatttctcattaatctactttaaaatatttcttttctagttcatgaacattttgcatcacctgaaatattttccttcgtacttcatttagcatctttcatattttgcctttatttatttatttatttatttggatttcagtttaagtatttttaacaggatgtctgctatgtggtgtttttaatagggtgtctgttaagttttagttctttgcccaaagttacctggttagtgagaataccaagatgggtgcccaggtctctgagctccaaagctatgcatttccttatagtgtttagcagccctggcatctgctataatggagcctaaaatatatgcattctctccatttctgtgttgtcttggtttatctttgtaataaaacagaccattagaaagttgtgctctaggaccaaatcgtcttggctcttcttaacattgccatcagcgtacactgagggcattcaaaagaacactctctgtgaggctaaatattgtatctactgtggggatattgttagagccctgtttacataatctggaattctctgtcttggaaaaacccacaaattttgctcaggagtccagtagtaggagaagatgttttgcaaaaaagtgctttgattgttatctcatgtacaaaaagaaatcatgtcagtaatgggctctggctacaaggaaccaaattgtggctcatttccaacaactgaaacaacccttatggagcttattttggggctgatcctgatccttggctttgacttattttcctgcctttatttccctttatcctcatgtcttcatttatcccattcatcttatatgtgagtttattcatctcacatgtaaactgcttccaaatcttttcttaaggatgtgacattatccatatctatatatgcatacatacagatatttactgttgaattattgattccacagagtgtaatactttgtatgcttcctgatgcactaagtattttgcagggctatgtcttgttggtccaattcatttataagttccttgaggataacaactaggtgttatattcattcaagtcttgagagtccccagcactaatatatgttgttcgctttattgttgattggagtatatccacaatctgagaagataaatgattcctaggttaaacatgcccttgtacaaatcatcctttttcataccagtgtcaaaaaatcaggggctaggtaggctatgaagtttgtcaatacacgaattgctatgttctttactttgcaacttcatgaaagagtcaccctactgcactagctgaatcatcatgttgagcacaactcttaagggaagtatgggaaagctaacccaggagtggcagagacctccttttcctcctctatcttaacatgtgtacatgctttgactttgaagcaatggaatgtgattgattccctaagccactttcaaaaatagtcccattacctgttagtgctcaccttaatcagatcatataaattatatgtggctatatatggaaacttaagaaacagaaaagtctaccaggactgcggtgacaaaattcctgagtccccagatatgatgaacttatcattagtttgtaattaattgatatttcaacaagaagctttttgaaacgtggttaagaggaagaataaaagctggccaaactttgtcctttggtttgataaattctgagaatgtagctataattctatgcaaaagaagcagactaagttacattatataccctggtgattatatgtttcttcacagtgctgtttaacatttacatacaatactgtaaacctcaaagatgtcactcacttatgtaattacctcacagttatataaatgaaaaacctgacatttaataagtgacactagcatatctttatataaagtagtgttacatttaacatccctggggactaggtatatcgtgtataccatgcggatggatgttctggatgaatgaaacttaactttggaaacattgcactttgaaagaatttttaaaatttttgataaagactctctaatacaaatcgcaccattccatgactttttaaacagaggatttgataagcctgttcccaatgacttgtcatggttgtgaatgctcactgttggaccctaggttacagagtggtttctttagcggttcctgaagtctaggcctctgacttcctgtactgagtgactctggattgagctgttcaagaagcagaggaccagcctgttttgctttctgtctaccccttctgctgacagctatcatgttcatttcccaactgctgtgctactcgttcactttacacctaaacatgtgaacgttgggcaggaccgaggaggccctgcttccatggagattaaggatgtcagcagaatgacagccactaaactccacccctacctctgctttacttccaattttacttccctttactcccattcccaatttatgaagttcccaaaatctggccccaagacaatgaaagcttattttgtacaatttaattttcagtctatatgcactcaagttttgaaccgcttactctaagaattttgcacaatccaaatccattaatgcaggttaacatattacaaaaggttacatgaatataggaatgatagtatgggatggagttgatcagggaagacttcctgaaggaggcgccttttagaatggtttctcaatgcattgatggatattttaggtaaggtataatgctatatgccttgttgctaggaccatgaactcttcagatattggctctgctgcttatttgctgtgtgacatttggaaagttacttaacttttctacctcagtttcctcattggtaaaatgaggattataataagttctgcttcattgagttgttgtgaagattaaatgagttcatgcatgtaaaactctttttttttttttttttttgagttggagtctcactctgtcacccaggctggagtgcaatggagtggtctcggctcactgcaacctctgcttcccaggttcaagcaattctcctgcctcagcctcccaagtagctgggattacaggcacatgccaccacgctgggctaattttttgtatttttggtagagaggggatttcaccatgttggccaggccggtctcaaactcctgacctgatccacccgccttggcctcccaaagtgctgtaattacggatgtgagccaccgtgcctggcctgcatgtaaagcttttaggacagtgcctgagagtacaatgtaagggtttcccaatagtggtagtagaagtaacaagtcataagaaagatgcctacagcaaagaggcaatgcttaccaaagaactaggatgtaataagagctgaagttgacatgggaaaggacatttaaagaaaaacttctccatctttttcattatatggctcatatttaaaaaataatatttacatgtcacagcagtatcaacaaagcgggttgctcgcagtctgaggcaactgccctcagtttctggctgctgcaggccaacctaggctagaggagaaggaggcatacggataatctattcccagcatatactgattagggagatctggtttagtgaagattttcgaagagaagtctagggaatttggaagaggtgattgtccaaaggaacagtgtgaccaaaacagatagttgtagtaactgtatatgataaaacagaacaagagggagaagtatggagatggtgtaggtccagattctgggggactattgggcgtgacgtacatgggagatgaaatgaatgaaaactggggtttggtgggaatagaaaagagagagtccagatctggcaaaaggaggttagggggaggtcctttgtgctgcattggagaaacatggaaaggggccagcatagctcagttatccaaggaagtgttgatagataggactttgtattatggaacagcagcagcacaattagaaagcacattggaatcacccccagttatctctgggcagggaagaacttctggttataaatctattgagtattgcaacaattgactagggcgttttactggctcttagttctcttgtacagtagtgtttttagtgcttgtttaatcattgttaatgtgaaatcattttttcttggactttgtagcagtttattatagaggttgcagataatcatcagtgttctttatgaaaacagtaaaggattaatgcagttgtgtgtctgtcctgcccagagcaggttctcattaagatatggtaagttgattttgatttgtttgggttttaatttttctctcccctcttcagaacaaacttctataaatgtcatcattgttacaaaaagagatggaaattcatctttagggatttttttttctttttgccagaaagaaaaaaagaaggaataatagctggacttaatttgtaatgattctgaagcatcttcaaaatcattttctttccttttctatttattttttttgagacagagtctcactccgtcacccaggctggagcgcagtggcgtgatctcggctcactgcaacctccgccttccgggttcaagcaattctcctgtctcagcctcccgagtagctggaattacaggcacgtgccactatgtctggctaatttttgtatttttagtagagatggaatttcaccatgttggccaggctggtctcgaattcctgacctcaagtagtctgcctgcctcggcctcccaaaatgctggcattacaggcgtgaaccaccatgcctggcctttttttacttttttgagacagggttttgctctgttgcgcagactgagtgcagtggcatggtcatggcttactgcaatctttacctgctgggctcaagtgatcctccagcctcagcctcctgagtagcttgaaccatatgcgtgtgccaccatgcctggctttttattttatttttttgtagagataggatcttactatgttgcccaggttggtcttgaattcctggatgcaagtgatcctcctatctcagcctcccaaattgttgggattacaggcatgtgggccaccttgcccagcctcatttttttccctacattatactttgttccaagagcattctaacaggaaacactgagagagaaaaaaaaagtgattctacaagttaaaacctgcttcagcacatccttctctgaccccctaggaagcctccccaagaaatggaatggtataaactactcccgttttccttgtgcatatggcattataataatggattcacacttctgtctcctctcattggagtgtgagtttcatgaaggcagggattgtattttaataatctgttttccctcaagtttctaacacaagacctgacacaccaaaattaacgatcagaaataagaaattagttcatatctacttaaaactaccagtccatattgtagaatgttttctttaaaaatctctttcttaaagtttaatcactggccaggctccgggggtcatacccatagtcccagcactttggaacaccaaggcaggaggataccttgagtctaggagttcaaaaccaggctgggcaacatagtgagaactcgtctctacaaaaaagaaaaaaaattagccggcatggtggtgagttctggtggtcctagctactcaagaggctgagatgggagaattgcttgagcccaggaggtcaaggatctatgacgtcaattttaaaaagcctctgcaataaggaaagtaaaataacagctcacttgctggactattaaaagggaaatgggagggggccgcaaaaaggttttgataggctaaatgtgggcttgacaaagatctacacatttttcttctaattgttggccagattcactcctctgtttttttttttttttttgagacagagtcttgctgtgtggcccaggctggagggcagtggtgccatctcggctcattgcaacctctgcctcctgggttccagtgattctcctgcctcagcctcctaaatagctgggattacaggcacccgccaccatgcccacctaattttttgtatttttagtagagacggggtttcactatgttggccaggctggtctcgaactcctgaccttgtgatctgcctgccttggcctcccaaagtgctgggattacaggcgtgagccaccatgcccggcctagattcactcttcttatgaaaaagtacaagtttctaatgattaactttctgggttatgggaagttgtgcttcataacaatatgggacttgtattcctttacactctcatctataatatcaatataaatagtttctctgataagtaactaggtttctgagataagcccttccttttattgtagctgataacacacgattatatgaggtggtattgctaaccactagtgagaggttttgctatataatgtggaacttaaacttctttggtcttcttcccagaactgcctagatgccactctaaattgtttattgacagcattaatacctggagaatttgcttaaaagaagtagattatttttctccccttcctttttctacccacacccccataactctgtttttcttaaaaaataaaaaatcttcaaaattgtcaacattgctcaattgttgagaacaagggaacaagccaggcatcacatttaccctattttttttattcatagagctgcgtaaaaactatgttatccaaagcaccatgaagctgcacactcaccaatttcaagataatataaaataccacataatcaattatggaaaataatgaaatggaatgttggcatagaaaacctcctcggagagtattaaaacaaggaatcaattgctcgagtggcgggggcggcgttgggtgttaaaattaacaatcagtcaagtctttaccaagggccagctgtgggtgcagacctgcagggcacgtgtgagaagggtcagatgcaagttgctgaggtagtcactgccctgtaaagattgtcattaattctacaaacaaacaatgaaagagttgtttgcttatgttgtgggctagatgcacaagatacacagaaaactgcagaagtgaaagtaattcagtcatttgttccttcatttagcaagcatttattaagtggctttttttttttttgccaggcaccagggaagacacttgggagctgtagcttcagaatccgtccctgccctcagggaaggcagaacaataagcaaacaatcataatactttgcgaaagcagggagattataggagatgccgtgttagacacaaaggaagacaggataatgtgaacagcacagaatacaaaacaaaaatgaagtactaattacagaaaacagataggctcaatttcacctattcctgcaatttttagagaagcagaggaacagaggatatgcagattttgaagtgtgtcctcagcatcctaaaagaaaagaaatctaggaaaagtcagactgttttttgcttgttttgagacagagtcttgttctgtcacccaggctgaagtgcagtgacacgatctcggctcactgcaacctctgccctctgggttcaagcaattctcctgtctcagcctcccgagtagctgggattacaggcgcctgccaccagacctggctagttttttaagagacggggtttcaccatgttggccagactggtcttgaattcctggcctcaagggatccgccagcctcggcctcccaaagtgctgggattacaggcataagacatggcacccggcctcagattgttgtcttacaattttagtatggcttaattgtggcaaggtcttgttaccgtaactatttctgtcaagttatatatgaaggacaggaaccatcaaatgcaaatgaagaggaagaccccttgatgagatggctctagaagacatacgtgtgtgtgtgtgtgtgtgtgtgtgtgtgtgtcagggtcttgctctgtcacccagcctggaatgcagtggcacagtcatgtcttacttcagcctcaacctcctgggttcaagcagtcctcccacctcagcctccggagtagcaggtgtgtgccaccacacttagctaatttttacatttttttgtaatctccctatgttgcccagtctggtcttgaactcctgcactcaagtgatcctcccacctcggcctcccaaagtgttgggattatggctgtgagccaccacacctggctgacatacttctcttaattttcacccaccttttctccttctgttcatggccagaagatagtctcagttcttccatttttccacctgcaaaatgggaataataaattttcttgtataaataggttcttaagctggaatcctttttaggtgtccataaatagactttggggattctacagtcccccacccacttagaaatttgatgcaacattaacatgtatggtaattgtttctggggagccaatttcaaagtaaagtattttgggcttccctgaaataagtgctaaataaacaactaatacttcacatcacagaacaacataacaaaaccaaattaccatcatagactaataaatctgaaataagatgctgatagtgtatgagaatataataaaacccagagagagcaaagtacacctggctttgaaatcactccttagcacctgagaggatcagttcctggaatctgctgtgtatgcaatgacatgcatattgctaggacattaggccacagctccttgggtcagctgttggcagggaacatttgggcagatctgcataagctgctgcccaccacctggattgtaaaaccacatgccattctggagactttccttcaaagaaaaatgtgaactctcactgtccactaaaccactaaatactgtttgggtgaacattctcccgcaccagaatcattttcaaaaaggcagtgactgcgtttatcttgtccacccttatatgctagggcctggcacttataaccaccaaagaattggctctcaacaatagctatttacttaatgaatgtaactgttttggtcagaacatactggtttgaaacatttctgatggagatgtgctgggggatgccttttcctgatcacagagcttgattatagcttcaatttctgtaagtaatttctttttctcttctaaacagcacttacatgatcctccagttgggagccttctgttagttgttatttctgcatttgtgtgttgctttacacttcacaaagggctttcccatccattatctcattgcatcttcacaagacttgccccatatatttttagccgagaaaatataaggctggagaattaagtagcttggccaagctctcatagctagaaagtgtggaactgtgcctcaaatccttgtttttgctctgtgtttggtggtttcttgagctcactgtgtcctgaaattgtggaaataaagttagccagaaactcttatcactactaatatatcagtgacagctattcggagtcttatggaatggccacataaaaatgaatttgataaagtgaattaaatgtatttgttttataaaattatagagcctcttgatataatttggagacagcctagattgtgagagggagaatgagaattcttattttgagatggaatcttgctctgtcacccaggctggagtgcagtggcatgatctctgctcactgcaatctctgcctcccggattcaagtgattctcctgcctcagcctcccaagtagctgggattacaggtgtgcacaacgatgcccagctaatttttgtatttttagtagagacagggtttcaccatgttggccaggatggtctcaaactcctgacctcaagtcatctgcccgcctcagcctcccaaagtgctaggattacaggcatgagccattgtgcctagccaataagtctttagacatacccctgaacctctctgacacccctgttttctcatctgaaaaaatggataccagttctgctaacttcaaaggcatgttttgcacgtcaaatctaaaatacacaaaactcttaaaaatattacacaacatataaatggcagttgctttttcaataatgtatagtgtatgtctaaatatggccattgcatttgggtacaccaaggtttttgtccggtaaacatcacaaaacaaaaagtaaactgatacaaatagctatagaaatggataaatatgctgtccatatttaaatacgaggactggacatgagacagatgtgcatttgtcattgaagaatgcagttccctggcggggaaggtggaacgtgcataagatccccgttataatgtagcacttttcattgtaatcctcatagcaaccttgtcaggaagatacttactgttcttgggcccgtttttcagatcagaaaactgaagtttagagagtttgtggcaaaattgtccaaattataaaagaaattccagttagcaccgacatcatgcttggtgagtgttctcttcagtccagcacaatcggactttcagttaacactggttacaaaacgggctgtgtgtctttgtctccaaaagtcctatgggctgtaatgctaattttcttttatatgaattcttttggcttggcagtttgctaatatctgtgtactatttcagcttcactttaatgtactgtattcacttttagatacataagcataggcaatctggggtcattctaatggagcctactcaggacaacctgaggcacctggacctaactctaatagctctattaatgttaggtagaccagtttaatggagtgcattctcctagcagttcattgattataaatacttagcttaagtacctacgtgtgtcctaaaaaaactatttgtccgaatgaaaatcctgattttcaggagcagtgatatgaattctgggcacctgtgcttcagtgaccatgggtggagactttcttgtttatatgtagtcctcttatgttgaaaattacacaaaaacaaaaaagtagtgaataacagtgtcattttttgttttttttgtttgtttgtttctatttcttttgcaggttgatgaccaaatgaagctgcttcagaactgctggagtgagctcttaatcctcgaccacatttaccgacaagtggtacatggaaaggaaggatccatcttcctggttactgggcaacaagtgagtgtagagaccaaaaaaaaaaaaaaagcatctttttattaagcatgttcagaatggccggaatttaactaggtcagaagcactcttgtgctttgaaagggagagattggctgccaataatttagaaaagatgacttggtgcactctgttcctgctctgatgattatagttaaacttgtaaaagcaaacataatcatgaacattctgctgcttccagtctgctgggactgaaagtcctgcttacaagggtccgaagaactggtaaatgaaacgtaatgattagtacccaggttttctttttcctcgagcttctgctttaacccaagacacttgtttgtcagctgttttaaaaccttataacttgtggagtccttactattttggaaaaatattggtgaacgagatggatttggatgtcatgaataattgaaatagttggtataaaggcaaatgagaagggaggggaatttcagttttcaagatccagtcattcaaatgaaagatagagagaataaaattactgttaggtcctacacctttctgaacagatgtttgttcgatcaacaaatatttattgagcatcctactctgtgctagttactttttgggggctttggtgtatattagtgaacaaaataaaaaggttcctgcccctgcggaacttaatgttgtagcagggagaagctgacattaaacaataatcctaggaaacaagcctgtaatatgttaaaggtcaaagtgctactgaataaaagaaaaaaaaaaaaaggaaagaaccaatgaaaagaaaatcaacactcatccacagacatgtgttgcagtgtgacccataagttgcactgtgaaataggaatggttggtttggctttattggaaatgtaacatttgagcaaagtcttaaaggaggagagacagctttgtgaatgtctttggagagagtctacttaatagacctaactgcaactttacaggaatttaggcaagtctctccagtttcttaaccctccgttctacaactgatgtgctatttaaataaatgtgtgggacacagtgattccttcaatcctttgggtcatacctattcagggtcccactgcattgttcagcaatggtgacttcagtactcggcaccatgatcttttatgttcagccataaatgtttatgtgctgtgaaaccacagcaatgctatttggaaatgaagggctgtctccacatcatttgctgtattattaataaatcaaaatttcccaatcaaactaaaagcaagcactatttcagagtttttgcaaattgggtcaattcaagcatctccatcactatctggtccttgctatctgcacctctcaggagaaaagcgttgcagaggagaaaataaagtctcaatgggtttgacttcctgtgctttcaaattttttttggcattttcattctgggacccaagtctttggagaaaatgtacccattttcagagtctaatcattgggtgtgcctcccaccttcaccgaactaggagctgcattggaagtacaagactgggcccactaattaatttgatttcatttccttctgagtttcagaaatgaaatgggtttgtgccattctttttctcaaagcacttccattcctgctctttagaaatatttcttatttcacatttcattttgccttaagtgctgcccgtgggtgagggtaattactatttaaaaaatagagaaaagtgcatttcttgctgtctgattttcaaaaccaagaacaatcaaggaatggatggtattatagttttttggatcaattactggtgctttgtgttttgtcatcagaactgaatgaggaactccatggtggagaaatagttatttccttatatgtttcctgcagcctggattcttccagctcccctccccaccctttaaatatgtttcctgcagcctggattcttccagctcccctccccaccctttaaagtgtgccacaggtctgtcagaacccctcccttcacttttttcatccggtccagtggctaccctagtaatgattaattgtaatcagacattctcatttatggcaattatggtagacatgtttattttcttttgcggaatatctagacaaaacgttttgaatttatctctgtgcttcttgcgtttcataggatggaagcaaaagtgctgcaaaggaagacttcaaaagcctgtaacctctctatcagaatgagacagatatcttaaagcacggtcatatacatgtacttcttttatatcctcacagtacctagcacaaagctgaatatgttgggcacatgatacatattacctgattgaactaaatgagaactattgtatctctcctggttgcttgattaaaacaaattaagtataatttttttgagaattataaatacttccctgagtgtaaaaatgggaaaattagatttttgctacaacaacattactttgtgtacacaaattttaagaaggtagttaaaacaatgatgagtggaaagaaaggaatatattaagtataagagtaaagcaatatgctagaggaaaagaggatttataaaaaagaaaagaggccgggcacagtggctcacgcctgtaatcccagcgctttgggaggctgaggcgggtgggtcacttgaggtcaggggttcgagaccagcctggcgaacatggtgaagccccatctccactaaaaatacaaaaaaattagcctggcatggtggcatgcatctgtggtcccagctacttgagaggctgaggcaggagaatcgcttgaacccgggaggcagaggctacagtgagccaagatcgtgccactgcactccagccttggcaacagagcaagacgccatctcaaaaaaactaaaaaatagaaaagaggtggaagctagaagatatatatatatatacacacacatacacacaaatatatctacatatatacatatatatacacatatatatacacacacatatatgatatgaaagtagttgaaggaggcagaaaaaaaagaaaaaaagaactgcttcctgttatgtttataatccaataacaattgagctgtggttagagtatattttctttactagtgcagaccatgtgctctctggtgtgtgtgtgtaaaattcacacatacaggtgtaatttagaattggaacaacctgttttcgtgtctccattccaaaacttcctggctatgtcatatttagcaagtcgctttaccttttgaggttcagtgtcctcacctgtccagtggcaactatgatgttatctaccagagagaattgcagtaggaattacaggaagtattctgtgaaatgctgacacaaaaattagaagtcatcaaaactaggccagcgcaagggtgacatttatggagtcaacaaccccacgaagaaaggactattatccctctttggcagatgaggaaccaaggcaaagaaagatgaagtggttgattcaaggtcaagacccatctagtaagtggcagaacagatggtcagatcgaggccaactagtgctagagtttgtgttctttaccaacatgccataccgtttatctgattaactcacagatgctgcagagcttgccttcacgccggcatttaatatggtcttcatgtgtaattccagtgcatgacagactctatggaaattccaagcaaaacaaattcatttccttttttattgagactaaatggatatgcttttttttgtggtttagttagttagttagtagtttgtttttgggggaattttctatatggcattgtaagcacattgttacagtagatttaagttattcacaagcaattttaatgtgattgttgcttagtgttatgaaattattttaatattaagaaaaaactaaaactatgaaaaaatcactcataatgccaccacttgaatcaactttttgttgaattctcttccaatctttgggggaaaacatgtatcttaaaagaggatttttctcatttttctaaataaaataactcgcctgccccagagacatattgacctgctatcatggatttgtgtggaatgtgaactttcaaacactgctagaagtgtgtttccatgaagcactgtattgaggccatgttgttgatatcatgggaaaaagtaaatggtattaccccaatacagcatgcaaaattcccctaaaggcagcttggtactcacttgtaggagataaatacattttttaatttagttaaaacaaatgcttctgatggcctgataaatgaagggaaatcaaagatgtaaggggaaaaacattagacacaggtctgcagccaatagtgataagaggcataattcatccacctaattaatgactgccctttgcatagtgcttttcactgtgtactttcacaggtaagccccattacacagggtcagagaaagtgcggggaaatttcagaggaggaagtgcaaagagaataagatgggtgttctaagctgtccagatgattcagcttctataaggaagtgccttacccctaaagtgaggatatttgattgtactctcctttgtaagttgaggaagacaccattgcttaaaatccttctaggtcagaggaacagtgacaggcaattactagatgaaactttaactaaactcgccacctttttcagcctcagccagaagaaatacaattcactcattatagatttccaggtttacttacagtattttctcaactgccctgttgagaaaatgattacttctgaaacaaatgaaaatgtttatactgagtattttgagattggcaaataggaatattaaatatgcctcagtccacaatatcaggaatgaagtcccaacacaaagggaacaccagacagtgattttgtttcaccttgaaagcatgtatgtcatgtctacacattgctttatagtgaccctttggacagacaaaggaatgcaagaccccaggtgttccgtagcccaatcttctggctttttcttactaaacacagctcactgtaaataatgtggtgaatttgtcatagcagagaaaaaagaaaaagactagcctggattttaaaaaatgagtgactatccaggaaattgctccttggagcttgaaaagagaagaaaaataaaatagcacagcctttctcttaagcccagtggctcacaagtttgcttaataaatgtttgcagaattgaactatgtctgttcatagttcattcagaactagagaaaccaaaatagccccactgcaaagagcagcccaggacaccagtacatagtatattgaaatgaggattcagtgtttcacttaaccctgtaagttagctattatgttttaattgcgtctttgaatcaggcatctacataaatgtatattaaatagccttgttaagcaaaaaggaaattatgattatcagtaatattaagcacttcaaatgttctatatagtcgcaacttagttatgaaaagaattatttcctatccaatattttaaaaactacacacgcacatatgcacacatatatctatgtatgtataaaataataatgtactttgaagtggggtcaggttttagtatttgcatattgttgctaattaacagccactgtaacatcatcctaagggaaaggtctactgacaacttattatcttctattattgtgtatcatattaaaatgacaggcatcttataatatacaagtcatcaaaatttcagtgattagaattaaaagcaatttaggtaaaactgttttctactttttcatgatgagtgaaatttatctaaaggggacatcagtttagagtattgcttcaatatctcccttgaatttaatgacacaaagattacatgtaagagagcaaaaaattaattttactaagtacataaaagacaaggccaactgctcctgaaatgagcacaaactctgcattcaacaatgaaaatataattatgtttgtaataaaatgtaaggaagttggagatctgaatgttgtttcaagaataaatcacctatccttctttagagctgtgcaatttgataaatatccttgaaagaaatgttttctaagcccccatttaataagcatgtttgagctttcaaattagcatgtaaataaatgtatagttataaatttgttggtaaaccaattgattttttgaggtccatctcactaaaggtctctcactaaatatataatcctatgaaacagattcctttccgttatagtgtactacattttcacatatgaaattcttgtatttgaacttattattatacacctgttagaactatacacaacaatatttaattaactccatcttaataatggaaaattaataccaacatatttgtgtttcattttagtatggtcttcctgattcaggccttaactagtgattttcttttcttttcttttttttttgagagaagtcttgctcttgtcccccaggctggagtgcaatggcgcaatctcggctcactgcaacctccgcctcctgggttcaaacgattctccagcctcagcctcccaagtagctgggattacaggcacttgccaccacgcctggctaatttttgtacttttagtagagatggggtttcaccatgttggccaggctggtctcgaactcccgacctcaggtgatccacccgtctcggcctcccaaagtgctgggattagaggcatgagccgccgcacctcgcctttttcttttttttttttttttttgagacagtctcactctgttgcccaggttggagtgcagtggtgcaatctcagttcaccgcaacatctgcctcctgggttcaagcgattctcctgcctcagcctcctgagtagctgggattacaggcatgtaccaccacgcccagctaatttctgtatttttagcacagatggggtttcaccatgttggccaggctggtcttgaagtcccgacctcaggtgatccacccacctcggcctcccaaagcactgggattacaggagtgagccaccgcacctggatcttaactagtggtatttactacaatatactttgtatatattaagctacagctacagcgcattccgttgattccaagcttaaattgttaatcttgtcccatctatgattcttgataatcatagaagtgagaggtaccttattatcatcacctaacttaactgccttacttaaagataaggacaccaagggatggagatttatacgtacttgtccaaggctcttcgtttgtaagaggcagcattggctcgggtctcttacctagtctctggcttttgccaccactgttgtaccatcaggccttcctgctctcattcactcatctatcccattagtctcagtaaaatttgtattattattatctgaagtagttgactatgtgcagtttttaaagaatttatagcataggcacctttttaaagtaaggactttccttgaagtagaaagttcccctgtaagagaactggcaaaatgatagttgagacgtcactttgtgtgctctgcaaataatcccaatgtgccccacagagttcaacagtgtgtcctgcctccttccagctcagggttcaggttgcccaggtactgacccttctttcacatattctgaaacagaaaccacaggagttcttacaacacttgatgtttaaatttagtgcgtagatgccagcacctggctaaagcaggtagacagtgctgtacatgatgcaagagctttcctctaacacacattaactgtggctttttcatgcatagttgactctatataaactgattgacacctttgggggtcatctttccactgactcataatttttctcactcttgaaaaaggtttctgtacacccagtattctctagttaaagctgaaaattcaactcatcatatttacacaataaaaaaaatccattctgccttgtttttaattgcaaattctactcaagggactagttctcctgcttaggaggcagccctgtgccttctcctagagaagcaagtgcagtcaattatggtaatgaaatgtcaataaatataaaaatttaatacagtctgctctgggtgagtggcagatgaggacttgcctcccagacaaatttgctgctgctgcaaatattaaatgaacctaaaagagtatctggttgcctgagagctctccagtaaaaaaaggatgggagcgtcaggtaccaactgggctttcccattatgctgtaatcgcagcagcaaagccagtgctatcactgacagccatcccaacatcttaacttgttataaattgaacttcttatgtccccatgaataatctaagattggtgcctagcaacacttttttttttgagacggagtctggcttcttcccccaggctggagtgcaatggcacgatcttggctcactgcaacctccgcctcccaggttcaagcaattctcctgcctcagcctccccagtagctgggattacaggcacatgccaccacgcccagccaatttttgtatttttagtagagatggggtttggccttgaactcctggcctcaagcgatccgcccacctcggcctcccaaagtgctgggattacaggcatgagccaccgtgcccggccagcacttttttttttttaatgaaaagggaaataagccttttctttttttgcttccagacaacggaattattctcctaaataaagttattgctgtctttagagagaaacacattaatctgatgtaatctaatgtaatcatctgagaatagcagttttatgtcatgctttttaggaaacagaaaactaaagaataatttatttgtatttattttaaatttttaaattaacacttctgctgttctataaagaataatttaaatgtgattctttcatcatccacaaacatccaatcttgaactatgattactttaaaatgtagtctcataatacaagtagaaatatatctgcctttattttcctcatgcactagttaatattgtatatacatagaacactctcctggattcacttttcatggacagtatgtttttctttcaccttattcatgagagttaaaattttttatcttatgtgatgatgtaatttcataatataaaaaaggcatatatacttgaaaaatttaggtagccaaaacctctttcctacaaagcttatcaaaagtgattatatttatcagacatagtaattctgatgcattttagaatcatggaatgtgcctcaaactacttgcatggggaaaatcccttctgttatcaatctgtattgtggccaggcatggtggcttgggcctgcaatcccagcactttgggaggccaaggccagaggatcacttcagctcaggagttcaagaccagtctggtcaaatagtgagaccccacatctctattctattttaaaaacctgtattgcaatctgattttacccatagttcttacgactcaggtgaaatacatattgctgattctgatagtccttaaaactgtgattctgtattgcaggtggactattccataatagcatcacaagccggagccaccctcaacaacctcatgagtcatgcacaggagttagtggcaaaacttcgttctctccagtttgatcaacgagagttcgtatgtctgaaattcttggtgctctttagtttaggtaagaaatccttttctcatgctgtgctcaaccaacgattgctaaatgatgttgaagttcaaatatcttgtggtccatgtatgtttttgttctatcaatataatgcccttcctgtcaaattatgaaatcttcaaacgtgaatatattttcatatatatttctgcatgatgcatagcccttcagtggatacgttggggaatggaaaatgagttattcaattgactcattcaaatgagtcctggtttttcttccataatatacagataagcaataaccaaataaagctatgacaaaggtttaaaacagacagcttaggaaagatgtatggtatcaaattttagccatctttctcccattggtaatttctatgtgcctttcgtttcaacttgctatttacttctgtttttattcttctaaaatatgaatcgtaattaaaaacctgtatttaaatctctatcgggattaactagagaatgtttataaccagatgcaccactatgcaagtacaaaagatgacagttgtcaaggggaaaggatgattctttaggaaagctttggaaaagaaagataactaagcaagacagattagctaaatcaaggttctcagtgagtcagttgagaaaaatcaccacagcttggaataaaaaaaggattaaggagatggatttttattgacttcaaaggaacagattttcctgtctgtcccttacttgatttctgtattttgttggcttaataaagccaacttaaataaactttttgccaagtccatttattacttattggcagacagctgagggaggcaacttcccttgaatgaaaaaaatgcagaaatcagattcaccaacatatgttttttctttagtcttcagttataagatagttgtgaattcatattctaaggaataaaacaataaaacaaactgcaaagtaaaacagatgtgtctactctccaaatttggtactttatttttaaaattcttcttgacaggactgcacaactgttgctaataaaggggtagtttgaagtaatagaaccagagttaatttttcatgtatagtcaacatttaaaataaaaagagcattttcatattttggaaaatgtgataaatacagcaaaaagaaatgttactgaaaatttaaatggacaacagaatttcatggatgtaacgttcaaaggtttacaatgccaagactggatcctgtgtggtttctgtattaaccacaataaaaaggaaagttctgttcaagtaagtctgcatcttttacccgagaacagtgtttagaatgttaaaaaggaagatagcaagcatacgcctgcttgctgtaatcgcacaaattattctggtttatgttaagatcttagtcttttaaactagtgcatttgatcactaattaaatggaaaatgtggtaatatatgtataagaaactgtatagcatcttagtgataaaatatttacagcgtcatctcatttcaatggtattttaaattagttgaagaaatgtattacatttgaagatgtacatattaaccatgagccatctttagttttcagcacttttaactttccttcatcatcttccaaaattattatattctctgctaatactataaggagggggttgggctagatctgagatgctttcaacttttgaacctcaaaaattatcttcctgaacaactgggccatgtatttaccagaactttagtcatacactctgatgtttaatgagcacttcgattgtttcaggagcccagtacaccagtgaatagctggtctaaatgtccattaaatccatgtctatttgttgcttaaggaagaaaggaaagcatggctttcagatcagaggcaaatagaattctggccgagagtctatttttttagagaagcaggagaaaagtaaccagtagtaaaattcaagtagtttctaatttgtgagtggaaaaactttttactctgtagaaacagtggctaatcaattttttgaatttcacctttattgaggtatatagataattaactttaggtgcctcagctagccccaaatgctggttttacctgtgattaagggtgaaatcataccagagtcactcttgaaagttaaggccaagtcctaagctggtacctgctgtcccagatgctcctcctgagcctcgagtcccctgagtctgaagcctgctatatttttgtctcagcccagccttgagactctttggtcctggagaaaaatgaagattctgtggactagtcagaggccagggtctgttctgagagatgactgcagcagtattctcctgtgagagatgaaacagtgttttccagatagatttggtgagagaaggtgggatgtggtcccaagcaggtgcagcgttccaagctagaagcactaccagtgtgaaagcttaaaggcaagagagagcaaaatgagtttggggaactgttagttgatggatacggcttgagggaagcagcagatgtggctggagacatagacaggagcctggacatggacatgaaagccacagatgcattcaacacatactcattgagtgcttactatgtgtccagcactgaagaaggcactggggctatagtggcaagaagaagtaagtgccatggctttcattctctagacaattaggaagtatagcagtgttcttaaggcgacggggatgcggtgaataacttaagtcgatttgcctttctggtagcagcatggaaagtggactggaccaagaacagtgctagaaaccctgttttcagaagttttatttttattttacttatttaatttttttttttttttgcttttattcctggcatgctgtgatttatttttagaggtggttttttttttttgaaatggagtttcactcttggtgcccaggcgggagtgcaatggcatgatctcagctcaccacaacctccgcctcctgggttcaagtgattctcctgcctcagcctcctgagtagctgggattacaggtgcctgccaccacacctggctaatttttttgtatttttagtagagacggggtttctccatgttagccaggctggtctcgaactcctgacctcaggtgatccacctgccttggcctctcaaagtgctgggattacaggtgtgagccaccacgcctggcctagaggtggttttaatactccctgtggttggactgagatgaaggatacaaaccagttataggtttcaagccacaagatgtggcagagttgagagggaaaagtctagggtgtgtttggggtttctggatgtctagctggaatagaaacatctacaggaacagtaactgatcagttgattcaaagcgggtcccaatagcagtcatcactttctaatctaaaagtcattcttcactaaagtttgttactgctgacacaaaaagctcatgacaggactcaaaagaaaagtacagtggactcaagtccttctagtttgctctctgacgtttcccccctcagattgtatccatgagcagacatcagttgggtaagctggtcaagaaaggaaataagtaaaaaatgccctctcagcacatttctctgtgtataacatcatagattctgtaggcccaatctctgttagttgttagttttaatgttttctttacatttctagcacaatgcttggtacatagtagggacttacaaaatgtttactgataaaaataaataaatgggccaggtatggtggctcacacctgtaatctcaccactttggaggccaaggtgagagaactgattgagccccacgggtttgagaccagcctgggcaacatagtgagaccccatctctacaaaataattagccaggtgtggtggcagacacctgtggtttcagctacttgggaggatgaggtgggaggatcagccaagatcgtactacttcactccagcctgggcaacggattaagatcctgtcttagaaaattaaaaaataaaaataaacaaatagtttgaaacttaaagcgaagcctttaccgaagcaactcgtgataggtaataggaggtggtttagctaaaagccgtattcaaatacaggttatttttcagagaccactttttccaaagaactctctaataaataactcctcaaaattaaattatttctgttatcagtttgcattctcccagtttatgagaggagatgtttattcataagctctttgggaaagctaacgtgaagaaaaattagaaagaatattactgactaaaaccaggtggcaaatgcatttctgttctaagcaaatgcaagatgataggctttcagcccatgttaagtaatagtagttaagacaatgttgtacaattctttcttggcattgatacaatcctgtttccagcaaaatgaatggagaaaatgttatatttgttcatcatgatagctctttgcttcatactaaacttccaaattttgaatgtgacatttgattatacacatcccaggtaagttttgtcctcatggagacaaacaccccagggaagatgggttatggttgcctcagggaatgactcaactggcccagacagaaaagctactgcatgctaaatgtcctcaccagcctgtcacctgatcctcatctgcagagaagcaacgggcataattcaagaacaaaactgattgaagagttgcttgtttcatccacaggttcagttcaggcattctgtagtgtctagtcacgatttctttatcttaaaaaaattaagaacattatcttaaattataaaaggtcatctaagcaagtattataatgtctcagaataaacagtattgtttattaataaaaaatgtgacttgaacacaagttgaaagggattttcaaaatggatgggtaagaccttcagggcttgaaagaactttattttattatttattcttcttaattttagagacagggtcctgctctgttgcccaggctggagtgtagtggcatgatcataactttctgcagcttctaactcctaggctcaaatgatcctctcgcctcagcctcctgagtagctggggctacaggtcacactcattgcctggctaattttttaatttttttatagagacagggtctcactatgttgcccaggctggtctcaaactcctggcctcaagcaatcctccctccttggcctctccaagtgctgggattgcagccatgagtcacaacatctggccctcccttgaaagacctttaaaatcataatttggaaggaaaaaaacagtatttctaaggcagagcagaacatttttctctttgttgtggctactttaaactgtataagtctgaccccaaacaaagttgggggcagggctctatggttgttctggttttctctttttattcttttattttttctgtgctaagtgaaatgttcttgttttcttagtgaagcaaagttcttttatctgtcaaattaataaactgtaaggttcatgaacacagtgtatgttttactcctcatgtactgcctggcatataggcttttaataaatattgctttcatgaatgaaagaatgcctttcctcccaacttctagattaaaaagaaaaaaataatgggaattgaaaataattagctaaaaaaaatgcaagcacaaaatttgaagaaagagagactagaaaacagattctatggataactattagaggatttggcatcttcttttcccctttagaaagtagggagataagtcttcacattatgaaggggattttttttttttttaatttttagtacagacgaggtctcactatgttgcccaggctgaactcctcaagtgatttgcctgcctcagcctcccaaagtgctgggattataggcatgagccactgtgcctggcctatgaaggggattagtataagtaatgtagagactaaactgagtccctcctctttgcaaataaaataataaatgaaattaattactgatgatcagcatttaggttctatttgaagttgtaacactaacagtgtcaaacaccaaaatgagccatagaaggaagtggtggtgatgcttttcttcagtaatgttaataataaaatgtcctcaggtgaataaatcacttagtttctctcttacagaatgaagagacctaagagaacattctcctccagttttgtaattaaaaaaaacaaaactagatgatttatccaacattttaggttcagatccaggtctagaactaataaccccaaatgacagtcagtactttttctgattcagcctactttcctcttcggagacattggatctcatcaatgagcatattaaaaatactgtgtaaagaagacctttgaagacacaggtttgaactgtgtgggtccacttctgctcaaaatttttttttcaataaatacagtcagccctctgtagctgcaggttctgtgtacaaatgcaagtccaaaatacagtatccaaaaggccgggtacagtggctcatgcctgtaatcctagcactttgggaggccaaggcgggtggatcacctgaggtcaagagtttgaaaccagcctggtcaacatggtgaaacctcgtctctactaaaaatacaaaaattacccaggtgtggtggtgggcacctgtaatcccagctattttggaggctgaggcaggagaatcacttcaacccagggggcggaggttgcagtgagctgagattgtgccattgcactccagcctgggcttcagagaaagactctgtctcaaaaaaaaaaaaaaaaatatatatatatatatatatatatatatatatatatatatggtatccatcagatgcaaaatccacatatacagagggctgacttttcagatctgaaggtttcacagggtagatggcaggacttgagtatttgcagatttgagtataggcaggggtcctggaactgatcccccttgtataccaagggaggactgtacttactaagacactatttatttatttatttattaaggcaaaatgatataagaaattaggacagtcatctgaagaatgtggacaaaaataaaagcaatatctattggtagaagcagggaaatacttcacctgaatttccaatttttattgaatatgctaagtaattatatagctcttaattcactcagtttctaaataccgtcatccctcagtatatgcagggaatcagttccagcacccctgtttataccaaaatctgcacacactcaagtcccgcagtcggccctgcagaacccgagcatacaaaacattggtcctccatacaggcaggtttcgtatctgtgaatactgtgttcttatctgtgtttggctgagaaaagtctgcataagatgtggactcacgcagttcaaacctgtgttgtgcaagggtcaactggatattgtcagttttgtttttctctatgtgaactctgggtttcagagctccagcaagctcccagaatgcatttgcctcacagctttggtacctctttcttaaagacttcctccttgtagctgattgtcacctcttaggtatgacgttttctttggaccattcactagacattaggaaagccaaatgatcatagctttcattatatatatgtctattttaggatgtattttaactgcttgtgatggtaaaaggaaaaataataacaaaacaaatagtcattcttttcccctctggcagtcactggcattaaaaatcctaaagtagccaattgcatctctaagatttaggtggacgagctccctggggcagggcagggtggagtgggggtggtgggcaggcagagaggagtgtagtaagtttgtacattctgttttcaagtacagccgtccgctttcctgaagggttcaatcataactcggctcttgcaatatgacactgacattgttaatagtaaataaaatgtttactagctgaaagatttggataaaagtcttttagatagggaaatttatttgcagtggttagttttccaatagtctttagtttctgatataggaatgtttttcttatttgaattttgtccattatttcttctgctttgacatttaaagaaatatctaatgcttcttttccctttacttaagtgtgtgccatttgtcctctggcattcaatatcagaacctggcagaggtttgctgtcaaagctccctatagagtggttggtaaggcaacatgcaaatagggagactggccccataccccaggcccagtcaggacctctgcccagagcttataactccagcacaagccatcatatatgggaactctgtctcatcacttttgagactctctctctctctgaatatatacacacacatacatacacacacacacttcatttgaaaatgaaggctttataaacaagccaagaactgcagagcaactactgatctcacatctcacttaagagacaacagagatttgtaggaatagcaaacattcagccattaagtgaggcatacaaaagactgctgtgttaacatagcccagaaaaccacggcacttcaatcagaacgtctttctccttgtctgtttttctttaaaagaggacccttcctttttgtccgataggaagtactattctgaatctaccagcaaggctggcatgtgctctcttataaaaggaaaagacttcaccatgcatagcctcttcaccctaactgctcagttgtttgctacccctggcaaggatgttctaattgtgcagtggagggtgtgaactcgttgctttaactgcagttccattagctaatcggagtcctgatgtcagtgtgacattgtggtgtaaatcatgaaggggtttttctgccacttcctgtggagagaaaacagttttgcaggatcacctgatgattggccattgtggggttgtcttcttgaaaaagaaaagttgttctgacctgggctgtgctcaggatgcctacattttgcctttgcaaagcgatgaaccccccagaaaggaagtgtatggggggcactgttggagtctgagtgctcccttccctcagcacttctggagaagcctggaaatactgtagacacagttttggagaagagaattcaaagggcttacaaaaggagagtacttttttgtccacttctctagaagaggcacagcaacttgttgagtttgtgttgtgttgtgttgtttttctgccaccaaattaggtgttcctattgtgtgggaggtgaaaaagagagcacaaatctattaataagtaaagcaactgaaacaaagggaaaaatgaatccccattttgcttttttgcaacattacatccagttaataaaagaggcttacaaatccaacagagatctgcttgcaggaactaactaggaagaagaagaagaagaagaagaaaaaaaaaaaaatccaacagagaaatttgatcactgatttaaattgtgtttgcagtgcctaaagcaagatgaacgattcattcactgtaagtcagaaggtgacagtaccaggtgtaccatttgctatatggcaaatctacagctgctctagaaagtgaaatagcagtgcctgttcttatcccttagttgactacctcatcactggaagtgctgtaagagcttcagaagggtggaaaactagtaaaaaatgtccaattgtgcatcaaaatttatgcttattaattctgaaataagcattatagtctaaacatcataaaattctttttgcttggtagctgcataaaagttggttttgaaacagcaaaacctgattttcctattatgtggcaattctccttcctgaagctggtcacaatatttgctttattgctggcttcctctaaatatgattacatactcacccacacacacactgccactggctggactgcaaagcctagtgaagcagaacatttacctcacatctttacccaagagcattggttaaattgttcttcatgaagtcagataagcaaaagaaatatcccagggttcttcgtacaattagcattcattctcagtgtttaccttttcatatgtaatattctaatttagaaaaacactcactagacacttgtcaaataactgcacatatcttcatactaatgccttgctgatatatatgcacctgagggtaatgctggcaaataagcatttcctaaaatttatgtaatcatttgaaattcagaaaggattgattagcattcaagagatgccactgttcaatatttacaccatagagatttggcagaagcaaataatggcatataaagttgatgcttgtcttaattaaatgcagtataataggtgttgtggattttttttttcttccagtgagcaaagcagtttagcaatgaccagatgtaattcattttggagttctaagtttgaacttaatcaatatgaacttacagccatggaagaagtgattatcatttgttatttgctggcacaagaatataattgcctaaatagcatttatttaagcatatttctgaataccttatgcctaaaaatatttgtcatattttagctgttaatgcttatcttgtcattttgctaactactgctatttagtgagatgatttttcagagacatattggccaggcaagctaggaataaccagcaagaaaaatcaagtgagaatgccatgtgctcttggttgatgtttctcgctgctttagctgtgtcaaccactctgttcaaatctcagaatagagtggctgtcttagtaccagctcagaagagcgtagttggttaacgtggttagcccagatgctgcactctagtggactctggacaccccagggcctcaggtctgttctacaatggaccaaatcagtgactcacatctgagtcttgcattagatcttctttctagtttactgataaaaatctgataagtcttatcttgagttgtggctgtgtttggttaagaaggttaaatttcaaacagaccaatccaaagccaggagagaagaacaaatagaagtacaaggcctctcatcagtattgaaacattaaatcacacaaaatatattgagtggccactatgcagaaccattgtactaggcaagctatgaaatgacaacatagagtcttttttttgtttgagatggagtctctctctctccagctggagtgcagtggtgcaattttggctcactgcaacctctgcctcctgggtttgagtgattctcctgcctcagccgcctgagtagttaggattacaagtgcctgctaccacccccggctaatttttgtatttttagtagagacgggatttcaccatgttggccaggctggtctcaaactcctgacctcaagtgatctgcccaccttggcctcccaaagtgctgggattacaggtgtgagccaatgtgcctggcaagaactggcaatatatagtctttccaaagagaaggaaactcctatgatacagagctgcattttggatccccaggacactgttctgaataaggcgtggtacaccaagcgaagagtccaaaacatgccatgccatcagcaatgctgcatgcatctcttgtctttctttctgttccttgttttcactgaactaatgcacgttccacacacatgctattctccttgattacattttattaatcagaaagcctttgtcaacccccatgttacataaatctcacagcaatcagaggcttcatgcctcttcagtttcccaactcctctgaaaggagatgatttttcagagacatattggccaggcaaactaggaataaccagcaagaaaaatcaagtaagaatgccatgtgctcttggttgatgtttcttgctgctttagctgtgtcaaccactctgttcaactcctctgaaaggagttgggaaactgcgtgggatcactccaggagccttagcaaggggcactgtccctaacacccacatcccaagttacccagattttggacagcaccaatgtggcctcagccctggaggaactgagtcccagaacatcagcatggaagagaacctatgctgttgctgaatacaaacacgtcttatttctgagtaagaaaatttaagctaatggaggttaagtgacttgtacacagtcatgtagagtcaggatttgaactgaaatttttgaactccacacgcaggaaaagagcacagatatggatttctatattacagaaatagtgcttttgcatttgtttcaaaattagacttactatttcttggccatccttttcaactaaatctaaaattttcattgtgaagtgtaaaagtgatttcccagaaacgtggggaatgtacattgccttttgctgccttaggactcagctgtgcatgctgcatgctgggtaccctgaactttggagggcagaatctctcctacagtcactcacactttgactctctccactttactctgggtacatggagctctgtgccatccataaaggtcagtgtgtcctgagtggccatgctggactcaaattgggcaattctgcctaatccgtcagcaggaatgatcatattcattttgtcctatcttggttatacagtcaagcgttatataatgatgttttggtcactgatggactatatatatatatatatatatatacacacatatatacacacatatatatatatacacatatatatacacatatatatatatacacatatatacacacacacacacgtatatatgtacatatatacattatatatatatggtcatatatatgatagaagactataatggaggtgaaaaattcctattgcctagtatttaccctactatatactttgaagttattttagagcatattctttatacctatgtatataaaagaaaacttactataaagtagcctcaggcaggtccctctgggggtatccagaagaaggtattgttataggagatgacagctctatgtgtgttattgcccctgaagaccttccaatgggacaagatatggaggtggaagacagtgatattgatgatcctgaccttgtataggcttagaggctaatgtgtgtgtttgtgtcttcatctttaacaaaaaaagtttaaaaagtagataaataaatttaaaaatagaaaaaagcttatcgaataagcatataaagaaaattttcatacagctgtacaatgtatttgtgttttaagctgtgttattacaaagagtcaaaaagcttaaagaaattgaaaagtttataaagtaacaaaggtatagtaagctatggttaatttattactgaagaaagaaaaatattttttataaatttaatgtagcctatgtgtacactgtttataaagtctgcagtagtctacaggaatgtcctgtaccttcccactcactcaccactcactcactgactcacccagagcaacttccagtcctgcagtctccacctatgataagtgctccatacaggtgtgctattttttatctcatagactgtatttttactataccttgttttctatgattagatgcacaaatactcactgtgttacaactgccttcgatattcagtacagtgacacgctgtataggtttgtagcctaggagcaataggctttaccacatatcccgggtgtgtagtaagtttgtgtaagtacactctatgatgatcgcgcaacgaaatcacctatcagtgcacttctcagaatgtatccttgtcattaagcaacacatgactgtgtatataagaattgatagcacacctgaaataatcctttctctgtaccatttatcccaagagaaagtaattattatagtagtgttaatactgctaacatctatgtaggaatttttaagtgcagatttatttaatttttaatttttaaaattgtgataaaatctacatgagatttaccattttaacaatttttaagtatgcagtttagtggcattaagtccacacacattgcaactgttaccaccatttgtctctagaacttcctgtcttccaaaattaaaactgtgcttatgaaacagtaaattcccaattcacccactgctcagcccctgcagccgtcattctgttttctgtggagaacattttatttacaaagtaccctattcttataacattatcctttacacataacacaacattgaaagtttagtgattttataatacaaaatgtgactggactcagcatggctaacgtgctcatgaccacacagctaggcatctgagagagcccatgctccaagccagggccactgattccagatctgctgtcgtcactcacaggcaaggaagtcttttgacttggggcctgaaataataaagcatgaggccaggtgcagcggctcacgcctgtaatcccagcactttgggaggccgaggcaggtggatcacctgaggtcgcgagttcgagaccagcctagccaacatggtgaaaccccgtctctactaaaaatacaaaaattagccgggtgtggtggcatgtgcctgtaatcccaactacccgggaggctgagacaggagaatcgcttgaacctgggaggtggaggttgcggcaagccaagattgcgcccctgctctccagcctgggcaacagagcaaaacttcatctccaaaaaaaaaaaaagaagaagaagaagaagaagaatgcatgaatgaggaaaaagagaggcgttcatgacaagtttcttactattgaggtgatatggcctaatggtgatgactgcaaacttgaattcagattcttgttctattgtatccttaggaacgtgtatcacctcacttttttccatctgtaaacttgaaataataatgatctacctgaagcatgattgtgatggttacatgcaataattattaggaagaacttaccataatggctggcacatagtattaataagtgattattactcaaaacatctgtgaaagtcatagaaatgaaggctgcttatcgggtaatgcctcttctcagatacaatctttggtttacagattctgtgaaaaagatctttctcacgtcagcaataactgatacattaattcagtaccaagccatagtttgaaatctttgatctactaaccaaaggcatcattattatccttgatgttttggaatatgtcagagtaagcagactcaagccgcttcactttaattcatctatcataaatcccaaaatcaagccaaggtctaataataaacaattaggcctcttcctaggttggtgcaggccctagatgatgagaaagtggaatggctaggctcacacctgccctctgggaatgcctatgctaggaagctcttcacttttttctttcttttttttttttggagatggaatctcactctgtcacccaggctggagtgcagtggtgcaatctctgctcaccgcaacctccgcttcctgggttcgggcgatttgaacacacacaagaaagagcacagataaggatttcacttaacatcatgcctggaataaagttcatattaaaaaacaatactcagtatgttcgattataatagctacatcttattgtcctgtatgagcagagtacattatacctgttgtttctaatcttcataagcaagccttcgatgaaagtatcatttgccattcctgttttactgtctttccctaagatcagagaagtcaaacaactatacaaaattgctgagctagtaagtaatagaactgggatttgcacactttagacatcaaagtctaggttttctccactattcactgctacttttctggttcattgattaagtatgtagatcagaaggcactataccagtgcttgtcatttatgatgaagctaacccattctaaatctgatccttctagatcctacttgaaagtacaagggctgagtaacaatcctgccttcttaaatgcttaataattccccctcatcaacatgccatggtttcagtcagagctgctttctattgatcggtttcaagaagtatcacagcttttatcaccacggtcagaagcactgctgaaattatagggtatttaatcccttatgctggcctacttactctaagcagattttcttttctttatcttttttttgagacagagcctcactctgttacccaggctggaatgcagtggtgtgatcctggctcactgcagcctcaacctccctggttcaagcagtccgccagcctcagccacccaaagtgctgggattacaggcatgagccactgtgcctggccagattttattttatttatttatttatttatttttgagacagagtcttgctctgttacctaggctggagtgtagtagcacaatctcggctctctgcaacctctgtctcccaggttcaagcagttctcctgcctcagcctcccgaatagctgatattacaggtgcacaccaccacacctggctaattttttttttttttttttttatgtttttggtagagacgaggtttcaccatgttggccaagctggtttcgaactcctgacctgaagtgatctgcccaccttggcctcccaaagtgctgggattacaggcgtgagccaccacacctggcccagattttacttttaatatgaagaaacatctgctgtctaaattcctatcctcttacaaatatttactgtgaacagaatttgataattgattgaaaatcattaccagattattagcctagattattagcagattctccctttcctaatattgccagcatcaaactcaatggagtgaaagaagaaggaatgaagattaaaacatgaatttgtgtacgtttttaagtattttaagaataccaaaataaaagtgtcatatgaatttcttagtatgtttctgatatagacaggatagagtttagtaattagcaatttcttctaattttttttaaaaaaagtttattgttgttacttgctacaagaaattatgggacaaattggataaccacatgtgctggcatttgtccaggacagcccatatcaaaagggattggggtccatgatactgtaacagtatcatttctaattataacttcaaggaaattcctctctcaaagaggtagctaagaaacttattcttgtcttacaaaagaatagggtttttaggatttaaaaacaggttgatgtgccatttttcctccaacttatgtattttagattctattttgattttcactgatccatggtatttcgttatataatgtaccccacagtttattgattcattctccgattggtggatatttattacaaacaatgttaaaagaacatttttctccatgtcttcctgtaatatattgttggacaatcactctattgttggacaattacttgcaactctagaaactgtcaaagtgttctccaaagtagctgtaccaaattacatttctaggcatagtaaatgagagcttctatttttccatgtcatcaccagcactataatacagatgctgtcattattctgttttaatttgtatttctgattaccagtgatattgaacatctttctgtttctttgaggtacctgtttatcaatgtttttccatacaatttttgctttttaaattttcttaagaaatacttcccaaccttggaggtcttaaagtacattctcctttaatttttttccaagtgtattaaggccttgcttttcttaatatgaatctttaatgtccagaatttaattttgtgtatggtgtgagggggagatctagtttttattttatttttcttaagggtagtcagtttttcccacactgcttactgaatcgcttgtctttcccactgtttttaatgccacctctcttatgtattcaagatctgtatatgtgtgggtctctttctggactttctactttgttcctttggcctatttgattatctcagtgctaatctcacatgttttatgcatttttataataaatcttaatatctgcttgagtagtccctccaccttttatttcaaaatagtcttaattagtcttaggcttttgcttttccacatgaattttaggtttggcttgctgttgttccacaaagaacccagtggggtcttgagtaaaattgcattgtatttagagattaatttggagaaaaattattttcttgggagtattgagactttcccgttcatgaacatagttcatctttcctttagtcaggtgtactctgatgtccttcaataaagtcatacaattttctccacagaggtattgtacatcatttgttactaatttattctagctattatatagagttggtttttataatgcaaaccttttctgtagttaatatccatgtggctggatatttttatattgcatttttatttaacaaatctactaaatgcccttattatttgaaatggcttttctgtaatttatcttcaaccttctgtgtagacattcatagtctgaaaataaatacagatttatcttttgcttttctggattccatttctgatcttattttgttggttagacaatattgacttggtgtgataacaggtactcttgccttatttcagtcttttataggaatcattctaaagtcaaatgacttgatatgaaaagtgttgtctattttagtagtcttctttttagtagaaaaaagagaagaagctattgatcttggagagagatccaacagctattttttctttgccttttatttcaacaaattattctcttatcttttgttattttattgttctggttctagcttcttcagttgacgattttattcatctaattttcagccatacattttcattgttcttttgttttgttttgttttgtttctcatttgatgaaagcatttagtattagaaagttgcctcttggcacagccatagttgtatttgtggaagttttgatattggagacagacattcaaggctgctgtgggtttatgcaagtcactgtacagaactctagggggcaccactcacactatagtatatatcaatgcatccctaagagttgtgtggtacacaacaccagtagccctgtctggtagccctacgtccagtgctaaatattttgtcatctcgattgtaatcgagatttatttcacaatgggttttaaaatttccaaacaaatggaggttttgattatctttttatttttggattataagatgatttcactatgaggttatgcatattactgaatctttcttttgatgtgatatttagttaattttaataaatatggcatatatgacacagtctcaattttagatgtcagtatttatttctttatatcattattgataaatttgttatatcttctgtgtagattatttcttttattattatcgtgtgcttcttattttctttctttcttttctttttatagagacaaggtctcactatgttgcccaggctggtctcaaactcctgagctcaagtgatcctctcgcctcagcctcccaaagtgctgggatcacaggcgagcaccaccacacctcgccacttattttcttttaatgttttgatcttttaaatctgctttgtctgatattaagaatgttttatcagctttttaaaattaagattgacatcttttttcccattctccttgttttctcctgttcagttgatttagtggagtttcttgtgtttctgtgatttaggtggttttcctgtaagcagcagatgtctatattttatttggcttttctttaatctagcctacaatccctttaaacttttaaatttgagatcattttaaatctacaggaagttggatgttaagatacatataggggagtcccaagtacccttcatccaatttctccaatggcaacatctcacataactatcctcaatctaaaaatcagaaaggcagggcgcagtggctaacgcctataatcccagcactttgggaggccaaggtgcatggatcacctgaggtcaggagtttgagaccagcctgaccaacatgcagaaacccagtctttactaaaaatacaaaaattagccgggcatggtggcacatgcctataatcccagctacttggaaggctgaggcaggagaattgcttgaacctgggaggtggaggttgcagtgagctgaggtcatggaattgcactccagcctgggcaacaagagataactccatctctaaacaaacaaacaaacaaaaccaggaaaatggcattggtatagtctgtagactttaccaattattcagtttgcatatttcaccagtttaaatgcactcgtttgtgtgtttgtatgtgttggggggtgggttctggcaatgttatcacatgtaggttcatgttactaccaacataatcatgatacagaactttttcatcaccacaagtttcctttgcgctagcccttttatagcacccacccctccctccattcttaacacctgacaatcactaatctcttctccatctctgtaattttgatatttcaagaatgttatataagtatatagtatgtaaccttttggaattggcatctttcactcagcaatattcccctaagattcatccataagtgtatcaatagtttgttcatttttatgattgtgtagtgttctttggtatggatataccacagtttgcttaacccttcacttattgaaagacatttgagttgtatacattcagttttggggtactacaaataagctgctatgaatatcatgtatgggtttttatgtaaatataagttttcatttctcttggataaatgcccaagaatgcacttgttgggtcatatgggaaacataggtctataatctattttttaagaggtgagtttgatctatttactaataaaccatcctagtttttgtatgtaggaaatgttttaaatttggccacttcttggaagatagtttaggtgaatataaaacttgaagttgacaatatagtctcttaacacttgggaagtcttttggaagtctactgtcttttctttttgataatttttaaggtttttctttattgccagtgtcttatatacttttactacaaggtgtctgagtataccggaagtgcacatccaattagagggcactgaagaattctgctattctcttttcatatgtcacttctatgcaaatccctctgctaactcctatcaggcatatgttggagcctcacagtctactgtgtcttctagtttttaagcttttttcccccttttatctcactgtgctgctttttgcataattccctcttcaactatatccagtctagcacatataccatcaacttagtgttttgaataattgttttttgttttaaagacttctttttttttttttttttttttttttaagatggagccttgctctgttgcccaggctagagtgcagtgacacgatctcagctcactgcgacctctgcctcccgggttcaagtgattctcctgcctcagcctcctgagtagctgatattacaggtgcctgccaccacgcccggctaatttttgtatttttatagagatggggtttcccatcttggccaggttggtctcgaactcctgacctcgtgatctacccgcctcggcctcccaaagtgctgggattataggcgtgagccactgcgcccagcctaaagacttctttttttaaaaaaaaaattattattatcattattatctttagagacagggtctcactctgtcacccagcctagaatgctatggcatgatcatggctcactgcagcctcaaacttctgggctcaagcaatcctcccacttctgcctcccacatagctgggactgcaagtgcatgccaccatgtctgtcttgctttaaagatttctaatagacccgttttcccattaatgtttaaatttggcttctattgtttcattacgtatcttttaaattttttcattttttcctttttaattaatcaatttatttattaagatttttttcttcttgccttgtcttatggcactgatatctttctttttagatgaataatatctctatttctctcttaaacacctcaagcaaactgattttgaggtttttgtcagattcttccatagaaataatttcttctggagtgagttgatgttttatttttgctgactttttccttagcaatatatatcttgctgtatatgctgtatgtaaaaagtgtgtgtgtatgtgtgtgtgtgtgtggtttttcacattattagttgcagacttactttgagtaagacttttggtggctgctcttgtttccgtctctttctcctgtcttgtgttttctttgctacacacactgtgctcactcctctgcatttagcatttctgtattagcttctgtctgactctatgagatcctgagtccagaggcaagtcctatatggtgtttaggcttctgcactgtggtcatactgaagatactttagatccagtcacagaggcagtgggggccctgctttaactcccagtccggggatatatttttgccctgctaccttgcctagttccacagcttaccaaatctatagcttgggcagtaaattaggattagttttgtttttttttttccccttctttcattccttctaatagcctccttttacaaaaggagtggaagtttggaactcctgccccagccctgcgccatgctttactttaagcaagacctagctctggttgccacatgcatggttgccacactttaggccccaacacccttcagaagctggactccagctactgttcactggactccagctattgttcataattttttttttttttttttttttgagatggagtctcactctgttgcccaggctggagtgcagtggtgcgatctcagctcctgcaacctccgcctcccgagttcaagcgattctcctgtctcagcctcccgagtagctgggattacaggcgcgcgccaccaggcccagctaatttttttatttttagtagagacagttttcaccatgttggtcaggctggtctcaaactcctgacctcgtgttccacccaccttggcctcccaaagtgctgggattacaggcatgagccaccatgcccggctactgttcaccatttaaatcctggccactgctctgcatttctgctctgtttgtgacagagatgttgacattgtttgagcctagctatgtccttttctctccctttgtatttttctgtcattgatatgtttgtaacaggaagagtgcaccaaaatgagaattcaccacaatattttgactagaagcacagcataactcttctgtttccaaagagcctgaaatgtttgaatcctcccatcaccaccaaccaccaccgccaccatcatcccagcactgtttctctctcacacacacacacacacacacacacacacacacacacacacagaacaacactcaaggccaggatctcctaaagccttgtgccgtgggtctccggtctgcctttccaagtttgtgtctcaccattctccttgcccatgtcagcacactgttgcccaacaaactgagcaatttgatcttcctggagcctattctatatcttactactttggggctagtttgtgttctgcctctcttcttgaaatgccattcaaaacaacccccagtctttcaagctcagacaaactcttcctctatggaaagacctaccaaatctgccatttgggaaagaatttccctcttctattaacccattacattgtttccaatttttattacatttgccatgatcaaaataccattttaaaacatcttacccagtctcaaacacttaacatagtcttatactgaagatgttaactgtttattaagaaactcttgtgtactagatgctgtccaaggcctttttagatacatcgttatctcatttaattccttcaccaattacggtatgaggtgaaatttgctcattttacagataaggaaattgagcgtgagtaagtcttacccaggtccttatgaaactagcagattcctaagacctctctgagacctactaaataggaattgctaaggatggggcccaggaatctgcattttaaccacctctttatatgatgctctagcactcctactgtttaaacctcgttgctcatcagaatcatctgggggttgagggaggtggcttaaaaatattcagaactgggcgggcgcagtggctcacacctgtaatcccagcactttgggaggctgaggcaggcggatcacaaggtcaggagttcaagaccagcctgaccaatatggtgaaaccccatctctactaaaaatacaaaaattagccaggcgtggtgtcacgtgtctgtagtcccagctactcaggaggctgaggcaggagaatcgcctgaacccgggaggcggaggttgtagtgagctgagactgagacactgcactccagcctaggtgacagagcaggactgtctcaaaaaaaaattttttttagaactaccaaattggaatttccagagtaatggcaattttttttttaccagtttctcagatgagtatgaagcaggtggttcaccaattcctgtgtgaaatatacctaggcaaatgtcagaaactggtaggccattgatagaatttgtgtgtgtgtgtgtgtgtgtgtgtgtgtgtgttataaaggtgactcaacatttaaaatcaagagaatccacataaaatatgaattccagtttctttctaaaaaattagaaggtcgggttacactaggttcttatgttgcaggtttgtttgattattttttaaaggcagggtcttgctctgttgtccaggctggagtgcagtggcaatggccatagctcactgcagccttgaacccctgagctcaggcaatcagcctcagcctcctgagtagctgggactacaggtgcatgccaccacacctataggctatcatgttgcaggtttctaggtgccttgatactttgatgtccctaataatgaaagtaactgcaagaagggcagtcagtttatgcctgaacataaggaaaaattcatatattagaagaacactgtacacagatataagtacaccagataaatgaatataagctttactaaagattcattaccaaatacaattttactcttcaaaaattttacttatcaaaaatttattgaagatacctcataatctcttccctttaataaaaattaaaatgtaaatgaaataaaattataggattcctaaatattaaagactactaagtacaagaaacaagattagtaaatattaacaaggttactaaatatcaaccatgagattcttgagtttctaatttgccattcacttgcagaagttcacctgtgagttttgcattggtagataaagaaattcatctatctgctacaattggcctcagattctaggtgaatctggtctgtctacagcactccaaatataaagaagaaataatgatagtttcactttctgtaaccctactcagtggattctgttgctctacttgtttagctgtaactactgtcagaaattttctgtggaggccaacacaggatagtcggttttttaatgtgatacagttgtgattgtaacaggctgtataaatagccatcagtgggtaccatggaaaccacctggaattctttatctctgtcctagaaagtactggagcttttgtacagcaactgaagacatatttaagatctttccaagtaataaaaaaggtctttgtgcattttaaacattaaataaaattaaatcacaaataattattaaatagcaaattactaggttaggccctttctctagctctctgggaatcatggttttcagacctatggttctcaaactggggctggaagtcaaaattaatgaacaaattaccccaaatattcttagtactttcaaaaatttatttggaaattacacatttgtctgctataaagttgcaaaggctaaataagtttttactgattaaaaatttacataataatttacttatcaaaaaattacataatatgactcatattcccttgtaaggatacataaggatagagaacggaaaatgtatccttatgtatgtatccttatccttgtatccttttttttttttctggttccactttgtttttattcactgaaaccaataaaagagttgaacacagcaaaacttggaacaacaaggaattaactgggtggcagcaaagggcaccaaaagaaaagataaattgcccaaaataaataagggctggtgaggaaaataaaaaatgtttccgaaaaaagtgggctgtgatgcaaggtactgtgagataaagaagcaattgtttcacgcaaaaaatagaggggggcacctcgctgaagccagcgaggccgctgcaccacgtggtgtcaggagaccttagcaatggcccaggttcgctggctgcatctgctgtgccaggcgcctactgtgcgctcctctcctcatccagcaaagctcggcctacatggaggtttgctgactcccccaggccaccttagttcctctcggagtctgtatgggtctgggcgagatgcaggcagcttatctgtttatggggctgcctcctccagtacacggagagctctttgaggcaagggacaatttgatctgtttcttcatccttaaaatttctgctgcttttgctgtttctgtgatttccttggtttctccattggtgtgcttaaagcgatctcctctacacgaacgctagggcagagcacattttcgcacaggcagcgccgcagcttgccctggatcttgtcgattgagttgaagtcggacacgtggaagacatgggtggacttgggctccgaggcgatctcctccagctcctccctgagcgcctctcccacgtccacggtgaagacgcggatgccggcgcgaatgccggcacggtgggcagccgccgtggcgtccagcaccaggtcctgggtgcagccattggtgagcagtatggccacctgcttgtaggcgcagtccccggagcggtggccggcgcgcggggagaagctgcgggctgtgatgtggtgcagcgcttcgccggtgttggtgttgccctgtggtaggcgatgcatcgggcggccgccttgacctcctcccgcgagccgaaaacgcccagttcgaaggccacgttgggcaggtcgctggagcgcacggtccccatgcagtcggggcccgcctcgaaggtatccaccaggttgactacccactgctgcaccttctcaaagtcctccttgcccacgctggaggaggtgtccaagaggaagaccagattgtagtggacgcttttgcaacctgtccgttgggcctatcagccgccgccccgactccacagcggcagcatccaaaggaagccggccacagcattccctcggagggcagccatggctctcctgttcttggggacaggcttttcttggccatttaggccaagaaagacgcagttagggcctactgcagcatggcctagcagggaggcactcgggctgccagcaggagtccaatcctgggcccaggcccactggaagcagcagctgggagaagacaccagccccaggcagccccctcctgggggtcacctgccagcaactcgcccactctccccccaataatctcacaaactcagactctagacaagacttgcagtaagtctggaggctttccccaggccagggggccagagaggatacatacataaggatatgtaggggaaaattagtcaaaaataaagaagttaagtgaagcgcaaatttgagggaaaaaaacttttaaataaaaatctccctggtaaacttcaaattcactaaaatcatttctatgtggatgattttctcttttctttaatatattttagtagctaaataatctacacaaatgagatttaaaaattgaactccagacaaatggaaacgtgaaggatcctatgagcatttcctgtccttataagggtggaggttttttcttcttcatctttttgtctccaactcctagcccagtctttggcatgcggtacttttttttttttttttttttcctttgaaaccaagtctcgctctgtcaccacgctggagtgcagtggcacaatctcaacttaaaacaaccaacaactcttgggttcaaacaattctcctgcctcgacctcccgagtagctgggattacaggcacctgccaccatgcccaactaatttttgtatttttagtagagacagggtttcaccatgttggccagactggtctcaaactcctgacctcaggtgatccatctgcctcggccccccaaaggctgggattacaggcatgagccacctcacccggccacacgcagtacacttttagacagagtctactttgcacttcttggtgctgtttactggcacacatattcaaaagagtgaccatggctgatgagtgtgggtcgcaataactgatgcgtggccaaaggtgtttcccacaacagttggctttgattcaccgtgtatcttctgcactggctaccgtgtagttatgccttgcccttcatgggtcctgggattacttgactgctgccgaggctaacagcctcttttttattctgattgtgacccattatattagtctgttggccactgactcactagtacttggaagcaacccacagctatgttgtcacatccacgtattcccctcaacacgcagcaaattggggtgagaccaaggaaaggcccatgcacaaaggaacctgacagctgtcagcagtagcacctgaggccaattgtaggcggtaatagcacacactcagaaaaccatacgccagcagtgtgtgtgcatcacaatgccgggagtgcacatattgtgggctcctcatcaacagggaactcatcctgcattgcttttatatcccaactgtacttagcacaagactaaccatacagtaggtatctgtgcctataatgatttcaccaatatttctacatatgaactactattcatcatttagggtctcactaaatgttgcttctttgaagatatttgcttgaatcccctatggcattttgtagttacctccatgcagtaatgataatatccaagtcattcgttccagagtttatatcacttatgtaaagcgtataactccaaagctttgcaataggtgttcaagcagcatataatggatggatggatggatggatggttggttggttggatggataaacattaattgcttagaagccaagtggagcaatttgaaggagcactctctcctatacttcttgttttgttatgtcaattcatgaaatccccagaatgacacataaaaggaaaccaaaatcaaattaaaacttatgaacctaaaccatcttgtgtcatccttggtagacatttagtggaggaaatatgaaattgtactattcattcaaggagttaataggtaaaccagtttatccatcactaacttgtttttatagcatcaacatggtgtaaagacaaaaacaatcttgaactctagtaactatcatctatatttaatgcctctatgctacaacagtaagactctggatgattatcagtaccacttagaattagagcttcttgttaaataattcatacatttgatggggaagagcttcaaacaatgctcaaagctccagtaattaatgggctaattacgagatgcttgtaaaatggcttaaacactgaaagttcagtgtaggtataattgttttagagttaaccctgtgtatttaaatgtcaaaaaaaatattcagtgaagatgagtagagggttgggagagagaagagagatcataagatatcacaccagtttagaagtcttcactattgatttaagatttctaaaaaggctctggaaaggcagaatgcaggccttcctaatgccccaggcattttccaaccatgtctctaatcacataagaagaacatcacccatgagtcataggactctgggtactcttagaggtcagaaaccgctgcagtgcaagtcctttcagcctaatcgcctcttcactagcaacgcccaggttccacaagagtgctctgtttcattccaggacccgtgggagttaagaattgaaggtagttgattttttggttggttcatttgtttgtttttcctccctgttgtttgctgttctcagaaatgacctgctctctgagctttcttggagtgtaaggcatttcaattctagaaaggtggggctgggaggaaaatggtctccttgactgcaaaccatctagctgaaatgtctttcactcatcccactggaagggggaaaaaaagccttctttagaagatgaaacattgtcttgtgtcttttagcatcgttctgggcagtcagtctgttaggacatattgggcgattataggactgtctttttagagaaagccatgggtttcaagttagcaggaaccatctatcaattcttaagattatgccatgatttactgtcagagcatcatgtattctgattttctgcctcccatgaaacattgtgctttccttttctattgatgtatcaactataatagttacaagcagctacagaaaaatcaatagcgagctttcattactgtgtacatcaagtaaagagccccccgctgcaagagcacaacttgttagatgctcaccatggaaggtgtacaacactcaactgtttttttcccagactgcattagaaaaatcaactatagaaaaattataaaatagtatcatattctacatggaagcacagagaccctataaaatctctcaaagggaatggacaggaggcattatcatgtttcaaaatgagcacagcatttccaaagtgaatataaaggtatttaatgcgattcctacgtggtttttgtttctggttttcttttgcatttgtcttcttaaggtcatcaggatagtgggaggaaatactgaattagtatttactagattgactgcgtaagcagaaagtcaccactggctgaagtgcatgctgcaatagtcatgcgctcaacacccagccaagcaatgaggaccctaagaactgtgtgaatacagagtaatattaccagggtcttaatcagatccaggagtcccagacatacatatgcaaagttttattctctttccaagcacatgttggaaaaagaaaaagacttaggattttaaagcaacaaatacctttatttgcctttgggagcacattagctaccaattagtgcatgtaaattgagactgctgaaaaagagaatgtatgaactgatagtctgggtgggggactctcaaggcctcagaagttctctagcatttcagcatcaatttgggcaacataaagagatttccaaagcaaatcctaacaagtcctgaatctgaaccatgtacaaatcataaatcccatggaattcccaatcttaacatgtgcaatgaatgtattcagatctatatatttaagtaattagttcattactttctgatagttatgatctacataaaggttttccatatgttactgttatgatccaagtccaaactccagttattttttatctttagagataatatatttagcaagaaggcaaaaacgtgcctgataatttttatgttcatataagaatgttaagaaactacaaaaatgtgttttgaaatattacagtaacaaacaggaaacaaactaaaaccttgagtaccaggttaacttccccaaaataccattttaaaatactgatgaatttgaacaagtggtttgatttttgggcatctgttttgttttaggggaagggaggaatatttaaatgataaaattttcaaatatcccatttttttcatagttttcccaacttttgtggattttttttctatttcgtttttctatgcacccaaaaattatgtgagaattttgcatttgcctttgacattctaacaacagaatgaactgccattcagctatggtcactacattgagagtttaatgctccaaaaggtatgctctgcaaggactgtgaaaagattaattagtctttgctggtttcatcagaggatgctgagaaactggcaacaggctctctcctgcaccacagcccaagaggaagatcctcttttccccagcaaaccaggtagcaatgacatctgcaaggttagcctttctatttgccagtgtccctgacaattaaaacagtgaaaataattcatgcattgccaatcttaattacactcttgctttcgtttattccttttgctactttcctggctggtgttttgcatgttacttatatgcagtagtacttatctaaagcctactttagagtagttgtccttacaagaaatggaagtctaagtagagtggaatagcatttggatgattacagattctctgtgaattcagctaacactttcctcaaggtagcactcatgctcctgttaaaagtacattctttccacatgcttttttcacatagttaaaaagaaatccttccatgacatactgaaccctaataccaaataagctggtgcttcccctgagccacataggagaatgttggctctgagaatgtcgcagcatccctgcactgctgtgatgtgcagtcaacagagggtacgagctctggcagaaaacccagaacaggatattatgcacagtaggggctttccaacccagctgttccaagccctatagggtcaaaatgatggggaaatccagaatgacagtaattatgccatcaaccttacggctccctgccagagaggttgctggttagacatctatacatctagtagctgtttaatacattttttaaaacaggtatagtgaaagaatgcattttaagcaggaattgaaaatgtactaagaatgagacaataatgtatgagcaagtacttactttgtttcttactttaggtaagaaaaaataaaaggaaggaggaaaggtatggagggggagatagagggatggagggaaaagaaaaggaaagagaagtagatagaaaatcaaacacagatgaaagcaaagacaattatgattataattatttcattccctaatcatgtaagatttgaattttctaattaagaaaaaagaacaaaattagttcatatgtcaaaaagaggattctaaaattgcactgacataaatgttattctgtgattcagttgcattcttaaattggtgtgttatttatgcaaattatggtaagaaaaataattttggatatttttgttttacaaatatatttttcactttcaccacattatttccagaagtatctttccttccacaggggttccctgtctgctcttgcttcctccagctcctcaatatatgtacctttcagggttgtttcagcagtcctgaagttgtgtgtgtgtgtaagcatgattaagagtacttttgtgggagtgtgctattgccagcctcacagatggtgttatttcctgtgttagacttcctacttactgatagctgggctcacacttgacatcctctcttaactgcctctagaccaaaacatgcaaagtcttgcagtgtgggagggaacctgtggctgtgcattgggttcagttgataacaataatcaccagccctgatgagtcaccagagagcaatggggtgatactcaagtaccagagagatggtggtggtctctggtggccccaccactgtccaccacttgcaagtagataaactggtcattaaaggagctgtggagagccagatgcagtggcacatgcctgtagccccagctactgcagaggctgaggcaggaggaacacacaaggccaagagtttgaatctgacctgggcaacatagtgagacccctatctttaaaaataaagaaataagtaaatttttaaaaagaaaggcattatgagagtttcagcagaacatttaggaagggtcttctagagataatgatggacaagtcagtaagctgcttgttcacacactaatgtccagttcatgttgactgctatctacccacgtcttctcttctggcacctgccttagtggctggaagctctctcagaagcttaaaaagatgcttttattttacctacccaacaaggtttctacgcattccagcctccaaggaggggtggttcccctttgtgaactgagatttaggaatatctatgtttacaactccgggactaagattcaataaagcttcaggagggtggaagtgcagcttgtgagggcaaaactttagaatccagtggacttcttaaggtcatctgaacagtgagagtaagtactaggctcttatcccacttccaccaccaaccaatgcagaagtgggattaagattgataatcctgagatagcattaaatgttttgatacaggcatgcaatccataataatcacatcagataaacagttgttctgtgcacacaatctaacatttatgcattttttctttaaaaaacctttctgcatccaaatggcacattcattaagtttaaaatgaagcacaaaagatagagataaaatgaagcaactctataattatataaattataaatcttactgtaataattatacagtagacttggagaaagacaggcctttcaagaattggtttttagagatgtgtctaatgccttaaagaagtgtttgctttaaaatcttgaaaaagcctcatgtagaagtgagatgttgtaaagtcatcattggctttggccactgccaggtcgactaccagtttgctatttgtgatgtatttcactattttggaacttacaaagctattcctgatttccttctgttaatggaggattaatgacaatgctgaatccacagataataataaaaaaattttttttttttttggacagtctcactctgtcacccaggctggagtgcaatggtgcgatcttggctcactgcaacctccaccttttgggttcaagcgattctcctgcctcagcctcccaagtagctgggattgcaggtgccagccaccatgcccagctaatttttgtatttttagtagagacggggttccgccatgttggccaggctggtctcgaactcctgacctcaagtgatccacccgcttagtctccccaagtgctgggattacagaggtgagccaccgcgcctggcccaaaaatcaaattttcaacagttacttaaatccactacttcccaagatgaaagctttattaccaactgaaacttagagaactatgagtggtcgtgggctgcctctgaacttgctgtgggtatatttactgagccaccatgggggtcatgtgaagagtctagggttttgttttacatccttaacacttcagttttgaaaatccctataagacagtaatagttctatagggtaaactccaaagagggcttctgtagggggcataggagtggcacccacagttgtgggaacgtcagcaaacctgcatcctccctcaggggagaggtcagagcaactcagaatattatgactactgaaacaactttttgacttcacgatgctgcaaagcaatccacatccagtagaaaccatacttcaagtacccatacaaccattctggtttttctgagacggagtctcactctgtcacccaggctggagtgcagtggcgtgatctctgctcactgcaacttctgcctcccgggttcaagcaattctcctgcctcagcctcccaagtagctgggattacaggtgcccccccaccacacccggctaatttttgtatttttagtagagagggtgtttcaccatcttgaccaggctggtcttgaactcctgacctcgtgatccacccgcctcggcctcccaaagtgctgggattacaggtgtgagccaccgcacctggcccattctgttttttagtttcagtacagtattcaataaattacatgagatactcaacactttattataaaataagtttttggttagatgattttgtccaactgtgggctaatgtaagtattctgagcacatttaaggcaggctaggctaagctatgatgttcagaaggttaggtgtagtaaatgaatttgtgataatattttcaacttacgatgggcttattgagacataaccccatcgtaagttggagcatctatattgccgacatcttaacagagccgctctctgtatatgctgactgatacattaggcttgggataaatcatatctgacctttccttataatagcactgggtggacttcaaaggtggaagagatatttcttgttcaattaagtcatcattgcagaaagatgaaacagatgatactttataagccaggcactgtcctaccttgtggtaattcctattaaaacacatttaaaagattaggaaactgaaacttagagcaatttactaatttcaatgtcttatggccagtgcagtgttcacggatttaaaatcacttcaatgcaagtatcaataattctgctaaataatcaggagttgactataattaatctgcaaaaaccaaacaattttccccacttgaattaatgatttctgggtgtgaaagggaatggtcaccacatagtcttagtttccttccatgcaaaccttagaattgagcatagcacttacgaaaccaatatgatcagataataagatatcttactattatcactgtcttagcaaaatctgtcattacactgaaaaaaaaataggatagcttcttttgcaaatgtttcaagctccaaaagttcttagaataatctttcttgttattttctctgccacatggttacacaaatacaaaacaaattggaaatatggattttctgtctttcatatacaaatacatatccctgagcaattgaatgaattattaatttgttttgtccaaaaatggataagtatttggctttaatgatcttgttaggcaactagtttcccttcccttatagttctcaactccagagaccctctcttttcatttttcaagcaaataattcagaatcagtgttgatccactgcatgatttttcccccttcatttcaacctctgatcttactgagcagaattttaatagctaagggaaatgatgtaataataagtaacaagtatatctagctcttaaagagtagctttaatttaactctacaaactcataaaatattggatatttagaatgaatgtagatagtaacagttctcatatgggcataaaattgcaagaattttactgattgtgatgtattacttttagcacaaatagaatgtaccaagtacaataaacttcactaattcaggacatttcaacttggcaacaaaaagctcaatttatatgtacttaaagaaatgcaattttagtaacctcagtctaatgcttaattaaagtaacatgttaacacagtggggcacaattaaaaaggagttgggagcatcagctataatattcaaatacctagtttttttccaatccaattaatctattttgtgtgtctgtctcagaaaggatagtaccagacctgccaaaggtgttggcgggagtgagataaagtagatgcaaggggtttaataaaaattcaaagaatgacataaatataaagtattattctcagagattacaattcacaattagcctgcattttataaaatacctctaaaacatcttcaacatttaaaaattggatgttaaaattggtgatacattaataatactcttcattccttgaatttctgattctgttgctgactttagatagaatttatttttcatcagttacatactcaaaggctaaaacaggaaggcattcttttttgagacaaagtctcactatgtcacccaggctggagtgcagtggcgtgatctcagctctctgcaacctccacagaaaggcattctttaaacttcttatccaaaataaacccaaatacaatttccgaagtagcatagagttcaagttgctgagtcttacctagtgaaccatcagccaacactgtagaacatcatggtgctgccatatagtgtatttcttgctgttaggaaagcaaaattccctatcctattctgcattctggtattgacctgaccttaatatgtttgattctttttttttttttcctaatagggacagggtctctgtcacccaggctagaatggcccgatcacagttcattgcaacctcaaactcctgggcttaagcaatccccccgcctcagactcctgagaagctgcatgccaccacacccagctatttttttttttaatttttaaattttttgtcaaaatgggatctcactatatcagactggtctccaactcctggcctgaagcaatcctcctgcctcagcttcccaaagtgctaggattacgggtgtgagccacttactgtgtctggccatgtatttgattcttttaaaatcatgaatacttgttctttcaaacaacaaatatattatagtcatatcttggtttccaatttctgtttaaattaacaagatgagaattgaggcccagggaatcagaggttctccagatgtttcccttcattcacatctaatcctacccctccacaggaggtatgaaaccaactcattgcaaagatgtcacccagggccacatcacccagggatactggggttgggcgagagcataacgggacagtagagacctcacctaactttgccttcgtgcttgagcactaaggtcaagcaaacgttttatgaagtttcctgcccagtcaactgctgagtaatatacattataccaaataaactggttattttgtagagattgttgaatgctttcgttcaacattttcattttgaaaagattttttaaattatttattattattattattattattatttttgagacagagtctcgctctgtcctctaggctggagtgcaatggtgccatctcggctcactgcaacctccacctcccaggtttaagtgattctcatgccctagccttccaagtagctggaattacaggcgcgagccaccagcacccggctaatttttgtatttttagtaaagacggggtttcaccatgttgcccaagctggtctcgaactcctgacctcaggtaatcctcccgcctcagcctcccaaagtgctgggattagaggcataagccaccatgcctggtctgagaagatttttttaagagtgttctgctgctctttagtttcatgtaaacttattttccccatggcaccctcctcactgtcatccatgtcccttttctgcgtgagctggtatcgcttgctaccctctaagacctaggggatagaaaacaatgggctctagcctgccttctgcagggagcaaagcctagaaacaggaagctgctacaagcaatcccaactgcactgtgtccatggagtatcatgaatagtttacacgaagaggatttctttaaaatgctgaattatgaaggagtattgattgtgtgagtagaaatatctagaagactacatcttttgtcttctagtctaatgctctgacatggagaagtgtttccagtcaacggtttattctgaagatagcaccttgtccactaaatgcacattacattctcaaatttacctttttaaagattctctttgaaataatctctccaaaagtcagtaagaaacatgtcgagcactaccaaagctgagaaagtggagctgaatcgggctcttagcctcactcacacaaaataatattttaattggctaagctaatatttgatccaagttcataaaagtttgaaatcaaataattaaatgcaaatacagtcttcatcccaaagacgataagaatgcctttaagctaatatttttaacaagaactgttccacagcgctctcttgtaaattttatcatacctgaggcagttttcctcattcgattagctggaaagctgaatttatcccgaggcaaaccagacatctagtatgggctaaattcaacaactggagcttaaatttggcttaatatatccccacttggatctgcctgtttaattctctttcatatgataacgttggtttattcatagtcttgacttgccacctgaacaaactgaacctcatatcttattctaagagaataaaactttgcaaaaaccaccaaagtttctgaatggaaatcaaatacaaagtgatgctcaaaaactgtttcaggacgtgagtacaaaaaaaaaaaaatagtgaagaggttttctctgagggagggctgctctttacgaatgtggatgtttcctatgctttgggagcagatggtctttagcaggataaggactaagacctccaagaccagccaaggcagctgcaattgtgtctcaagcttgaaattctgcatgctacctattttatcaaacaccgtatgtatttggccttattgttaaatctattttaaatacaactttatttgaggtttaggggcaaactaggaaattgcttcatcctatatccctttaaattctgtttcctggctcagaatatcccatcgatttccagccagaggccttatttttctttgattttccgtatattttaatgtagttttcactatcatctgatatgcagaagttgatacaatgtacgatctgtttcataaacccctttagtatagcattctgtcctcatttttatccctaagaattctagaatgcaaattgcaaatgtgtatacagagggaaaatggaagtgttctatgcccgtgatgtggtccctaacacagctcacagccccaaaatacaggcttcctgaaaatactcagattaccacttcacaacatcaaacatatcaaatgtttttccttctactcattgagctcaattacttcaattttgaatcaaattacactttttctagagacacattataggaaaagagctttgttatatttgaaattggttaggaatttaacaaggtgaggaactttaaaattgcttaagagtctaatagctgggggtattgatacatagaaagtgctcaatatatttttattgaattaatttgcatatgctttgtattcatgggcactgaatacaaattagccaattcaataataaatgcattggttgtcttttatgtgtgtggtgctatacctgtgtggtgtaggaaataagaaacataagtcagaatctctgccttctgagagaatgcaatctagcaggagaggcaaggcataaaccagtaaccggagaatccagaaaagcttgcctgggaagatgcaattgcaaatatgtggaagatgttccacagacaagcaagcaagaagactggcgtgtgaaacaaaacggattctcttattcgacaaatgtgaactgagctcctcctttgtccagacattatgctaggcctgggaaaggttataattaacaagagagacatatccctgtcctcataattgacagtgaaattaccatgtaatacccaatgccctgcatgatgggcaaatagagtgtgctgtagactcacagcagagaggacttcaaggaggcttcctggacgtaatgatatctgcgctgaggcccaggagattggtcaaaattatccaaataaaggttaggggaagaaagttccaggtactggccaggcacattcaagaaactgaaagaagttggtgggtggggtgaaataaaacgggatagataaacaggccagataaatgtgtttaatctttaacccagggtagtggggtgccattgaatgattttaagcagagggaactagaggacataattggattcacatttaaagttatcactcatgctgttgtgaggaaaatgcatttggaggcggggacaatattggaggaatcagttataaggaacagaggcgagttacggttgcagcaatggagaataaaggacagattcaagacgcaattagaaagcagaggcagcaactcggtgatggctggattggaaaagaagaggagagggaggagtcatgaatgaatctgggtctcaggcttgaaatcccaggtagatattgggtaacgggatggattcttagtccaatcattggtataagaaaagcaggagaaggagcaggtttagaaagccagacagattgagctacattttagacactgagtttgagatgtcccctggctatcaggtagagacatctagtaaatagtaaacagtcatatgtacagaaccaaataaagttatatgctgcagtcttccacatgggtcactgagtgagctggtgaaagcattgaacacactgaaataaaatgttcaacacatggaaaagtccaaaggatttgagaaaaacaagcaggcttggcactacaagccaaagcacccagccaaaaagtcctctttgaatccatttcccaagaaagtacaatctataatggagtttgtgcttttcacttgctgttataaaacaattctacacaaaataaaaataaagttggccatgaatttgatatggaagaatagcagcatgtcaaaggcaaaaaaaaaaaaaaagaagaagaaagaaaagaaaaaaagaaaaatgttggtttagggcaagaatttaaacaaaaaagcttattctcatatttcctgaggatctcctctgtgctgagcactggccaggcactaggaatacagctgcacataagaccaagtctctgcctacacggctttcattctagcattctagtgggggtgacgggcaattttgtttattgtttttttttttttgagacaagatctcactctgtttcccaggctggagtgcagtggcactatcttgcttcactgcagccccaacttcctgggatcaagtgattctcccacctcagcctcccaagtagctgagactataggcgcagaccatcacactcactaatttttgtatttttgtagagacagggtttctccatgttggccaggctggtcttgaactcctggggtcaagagatcctccagccttggcctgccaaagtgctgggattacaagcgtgagccactgcacccagcttggcagtttttaaaattagacaaatgtatgcataatgtaaggtcagtcatgaacaagcaataataagaacacatcatttagggatataagaaaacaggtgatattgtttggatccttgtccctgcccaaatctcatgtcgaactgtaatccccaatgctggaggtggggcctggtaggatgtctttggatcatggggtcatgatccaaaacaccaggtccctcagggcctggtgttgtcttggtgatagtgagttcttgccagatctggtaatttagaaatgtgtatcacctccctacacatactctctctctctggctcctgccttcaccatgtgatgtgcctgccccaccctcacccgccaccatgattttaatcttcttgagacctccccagaagctgagcagatgccaacaccatgcttcctgtaaagcctgcaggttcatgagccaattaaacctcttttctttataaattacccagtcttaggtatttctttatagcagtgcaagaacggcctagtggaaatacagaattctggattatgatcacctctggggcatcaggaattcgttcttgggaggaacacacagatagcctgaagggctctgaccatgttctggtcttcctgatgagtggtggattcataggtattcactatactatgtttaaaaactgacatatacattacatttaaaacattaattatagtaaaatatgcacaatgtaaaatttaccatcttaaccacttttccatagattttaatagacttttttttttttttttgagacagagtcttgctctgttgtccaggcttgagtgcagtggcatgatctcagctcactgcaacctccacctcgtgggttcaagtgattctcctgtctcagcctcctgagtagctgggattacaggtgccagccaccacacccggctaatttttgtatttttagaagagatggagtttctacatgttggccaggctggtcttaaactcctgacctcaagtgatccacccgccttggcctctcaaagtgctaggattacaggcatgagtcaccgcacctggccaactttattttttagagcagtttttttttttttttttttttttttttagacggagtcttactcttgtcacccaggctggagtgcaatggcacaatctcagctcactgcaacctccaactcccggattcaagtgattctcctgcctcagcctcccgagtagctgggattacaggcatgcaccaccacacccagctaatttttatatttttagtagagacagggtttcaccatgttgaccaggctggtctcaaactcctgacctcaggtgatctgcccgcctcggcctcccaaagtgctgggattacaggcgtgaaccaccgtgcccagccctggagtagttttaagttcaccacaaaattgagcaaaaggtacagagactccccacataacccctgccccgctactgtcagcattcccctaccagcacaagcctcccctactgtcagcattccacactggagtgaaacctttacaatgaatgccgctacattgacacatcctcatcacccaaagtccgctgttcacattaggtaggtagggctcgctgttgatgttgtacattctatggatttggacacacgtaatgacatgtatccaccattacagtatcatacagagtagtgtcactgccctagaagtcctctgtgctctgcccagtcatccctccttctaccaactactggcaaccacccatctttttattgtctccatagttttgtcttttccagaatgtcacacagttggaatcatacaatatagagccttttcaaagtggcttctttcatttaataatacacatttacgtttcctccatgtcttttcatgggccaacagctcgtttcattttagtgttgtgcaatatttcatggtctggatacaccacagtctaaccattcacatactaaaggacattttggttactttcaagtttgggcaattatgaataaagctgctataaacatccctatgcatgtttttgtgcagacatacattttcttcataaccatttaaacgtatacagttcagtagtgttaagttcatttgcattgttatacaaccaatatccaaaattcttatctgacaaactgaaactctatacccatcaaacaacaacctctgttcctcattcctgccaaccaccattctattttctgtgcctaacaaattcatttgacacaggtgcctctaggtgcctcttaaaagtggactcataagcgtttcctttttgtgactggcttatttcacttagcataatgtcttcagtgtgacagagaccagagtagcccaccattccctttgaacattggtattgtaccacaaaatcaagtggttttcaaacatttttgatccgtgggagctttttttctaaaccatgtatacaaaaaaagtcaaaagtggagaaattcttatttcttagccttggcacctgtacaatacaattggaaggggttggggtggggcttgtccagagaagtccccacaaaggtgccccataacactagactgtactcagtctccatcgtgagactattatttataatagtgatttgtggcatttaagatgtgaaatttccttcaaaatctcaaacattaagttgtgttacatgccaatttaaatgtcaaatgtatattatttcattcaaattatctgaaaaccattcattcgcatatcatgagaccctttagaaacggaactacttgactaaccagcacttcccattctccaactccagcaagtgacagaaacttgcaggcattgacacaataggggaaaaaaaactccaggactttaaaataatgagccctgcagggttcagattcctgctccgcccgagggaagtctcatggtagagcatacaaggactttagagtgagacaggcctggtcataaattcaagatcttcttactagcattaaaatcctagatgagcttctcaacccctttaagcctctgtttttccactgggaaaatgatattaataataacttccccataagattcttaagaggattaaatgagaaaacatatgttaaagacacttgtcacattaattggtgtttggtaaatgttatttcctccctcattcttactgactttgagatcctgggaaagccatttaatccctctgattcttaatttcatcatacctataacaccttctaggatagaatcctttacaatttagcttatcctgaatcccactcctaggccagttttctacatactctcactaactcctgggatttcacccatcacccatcagctgtacactgataagtcccaaatctatacctccagcccaagcctttctcttgaggtctagacctttatgtctggccatttcctggacatcttcacccaatattccatgtgccccttaaattcaacatggccatacctagactccttaaatattgcttctcaaatctgctgctcctcttggtgacagccaccaccttcttcccttaacagacacctggaagccatccaggaccctcactctttctctctgtctctcctattttttattaacccaaggccagcaaaccctgttgcatcaaccatcttgatgcctttcaagtccctccccacctccttggccgccgtatttctcatctgtgttcctgcagcaggatcctggctggtctccctccatgagcctgctctcccctcaccctcctgcacacactagtcccttctacacacttctggcagaatgctttctttaaatcagaaagctgaccatttccctctttcctaaaaccattcagtgtttctgccttgcttttggaacaaaatccagaccatctgacatgcagcactcttcacagtcttaaaccttagggcccatcttcatcttgcccacctattccttctccacaaaggctgagctgtttaacagtgtaccaaagacctctctgttctttccttctctagggtttgtatatagaccactgtctgctaggatgtgcgttctcttccacgcgttgctcagctcattctaactcatctttcaaaactcctcaggtgtcaccttccccagggacccctcttttctcttgaaccctgtgttagctgcccatcctgtaagggcactgcttatctgtatcacattaattgagctactgtacacagagactgtgccttttatttccatatctccaacacccagaccagagctgttaagactgaatgaataaatgaatgaatgaatgaatgaatgtgtatacattgtgtatacacgaaggtatgaaataataaataaagcatgttaagaatgttttgtaaactacaaagcaccaatcagttgtaagggcctgttatttctgtgtacatatatagtatatacactttatatctactttttttttttttttttaagagacagggtctcactctgttgcccaggctggagtgcagtggcacaattacagcctactgtacttgaactcctgggctcaaatgatgctcctacttcagcctctcaagtagctgagactacaggcacacaccaccacatccagccaactttttatttttatttttagggggagacaagggtcttgctgtggtgcctaggctggtctcaaactcctgggctgaagcaatcctccatttttgtagacagctcctgccaagggcagcattttcttattattaatttgcctatgaaagcacaaaattatacattctagttggtaaaaataactcttgggttagtgtgtgtgcatgtgtgtgtgtgtacacacctatattattctaagggacttatgggaatgaatttaaaatcttgagtttcagatattgctggaaactggagacagaatctcagtttaggtgtcagcaccaaaattatcctgccctcccctccccaatccctaaacagccctgatttctttttaaaagtgaactttgttcgtatgaaaagaacgaacatgttctgcaacttccagaagttcttacaaaattagttatgcagattatccatatttagccctttaaaaaataattttgaacattagctccttacagaaaatctattttctttctccttttctagaggaaagggccttctgagggcaaatcgtgtgacagtttatagattgtcatctctctaaagacctcaaggaaaagaagtattttctatgtgcaaaacggtacctcttttttccacctttatgtcctttaaaagattagataaaccagctcgcacctgtaattaatcccagataactcccagttactgggaccgggagtagctgaggccagaggatcgctcaagcccaggagttcaaggctacagtgagctacgatgtcaccactgcttttctgcctgggtgacagaacgagactctgtccctatttattaaaaaaaaatcagacaataatattagtaatttttaaaaaataaaaaatatttaaaatctttaaaaagacaaaaaagactaaggaattttttcccacttttgaaaaattaacaaagataattaccttatcagcaaaagtcaacacactccatgtgagcctcacagcccccagccccctggctcagcagaggacccatttctgaaaaagtgtgttgaatgacaaggtttataggctgcaccattatggcagctaccagggaggcagagaagagtatcttcctcttcagagagagcctgaatgttgtgtgtgactgaaaagtcagtactataatatattcaagaagacctaagggtttactttccaataaggatggaaaaaatctgagcaccccactgtgagcttatcgtaatgctgcttcatataaaaagttggtaattagtccctgagtgaataaagtagaatagatgataacagattgatactaagagaagcacaaaatgctctcgccagtcatcaaaatttaaaggctatagagaaagggttggggatgcctctgtctgtttacatactatttccaactcagaatttgtaatgatagggtttattaactggtgtttttaaattgtatgaaaatgaagcttatataaatttcaaaggaacgcacagagtgccaaatgcaggagcctttgcaatccagcctaaaatgccacagaagaactggtggaaatttttatctcatatccatctcttttcctccagctgggggtcttttgctaaaatccagatgtgggacaatgctatttaatatgagaaccaaacagcaaatttcaaaaacatgtatttctgggaactccagaacatgtaatcatttgtctagattttggtttttttaatataatttaatatcaattcacttgtatatttctgttgttagagactcctgctatagatgagttcagactcccaagttgccagctactatccattacttaatatggaataggatttgatttttattggagggacattccagagaaaatggaaatcaggacgatttcagtgtttacatttgggccatagctttgcattaaacatgcttcccctttccatccccaagttctgagaatttaaatttctatttataagggattcatgttttaattttcatgaaaaagtatgcattttcatcaaaactaattccatgagtaccgaggaaacacacttaagtttctaaactcttcctaaaaagtaaatacaagtgaaccacataaatgagtgaaaattccaggtcttctgggaggtgttatcatttgtattttggcacttaatctcttccattgcttttaggtccttgtgaactatctgtgaactacctcaattacagtggaaaatccagggtctacctgtctgtcaggtccagtccgcagcatcccagggactgattccaatccaaatgagaacataagcacgtttcccttaacacaaaactgaccagtgaaaatcctcatttgcaaaacatataaattagaacttgattattcagatcacaaaaggattcatcacaggactttttgaatagaaaagactattacatgtaaagtacagtattttatttcagggagagatccattacatatatgccaaatttttgaaaatcagtttctagttagaaaaaggaaggaaattggcttgtgaaataatttaacaggtcaaattcacaattgtatcaatcttggacaaatgcaccaataatgtgaagcaaggagttaccggtgtattccctggggatggctgaactaaagcatatcccttatccccaggagcttacggtctgcatagggaaacagacagttaaatagacagaagccagcatcaaggcaggcagcagagcaatgatcctggaatggcatggtcagtaaatgagaggaattcactcagaacttcttcaggatcattgccatgtgtatagatgtagaaacaaaatagacattcggcaagtaagaatctttgggacaattagcagcatatgttttattatttcatgataacattcatcaaaatagcttaatgggataattaactcaggcatgtggattcaattctgatcagctttagcaaaaaatagtatatttagccaaaatatgagacacctatatattttcctgccagaaggaaaattgcacatatttcccaagttttgggggaaaagggtgtcagtttggaccagtattcatagaaattaaccatcgaggctggacgcagtagctcacgcctgtaatcccagcactttgggaggccaaggtgggtggatcactggaagtcaggaatttgagaccaccctagtcaacatggtgaaaccccgtctctactaaaaatataaaaattagctgggtgtggtgacacaagtctgtaaccccagctactcaggaggctgaggcaggaggattgcttgaactcaggaggtggaggttgcagtgagccgagatcgcaccactgcactacagcctggcaacagagcaagactctgtctcaaaataaaaaaaagaaagaagttaaccattgaatgctgagctgaagactctaaattatcattctataatagtaagtggataaaccaaaacttatgatctagcctttgttttatgtttgttggtagttttctttctttttgtttttccttaacagagcagcatagtttatcacagaatgttaaaactggttctcaaagaaatacaattatcaaaaaaggaaagtttcaaacaactttctaaaaagggtattcttcatttttcttacattttacattcattctatgcaaatttctacatcctctctattaatctctgactgttactagctttgcttgctggtgagagtatttttcactgtagcgtaaaataatactgcatttcaaatttttaatagtcatgttttaatcactataatgcaaaacaaatgtagatttttctatcatgtaccaaggtaggacatattgaaggtatttctgattgtttatattttgcaattttgaaccaagtatgactctggatacatagtcatacttataaatatttttaagtaacttaaaatcatttttaaaatatattaaataagacaggtggaatatgctttactaactgtaaagtgccgcatgggtaaaatgtccagagcacaccaatgtggttgccaatttaaatgccaccggaagactcagagctccttattgtgtagtatttatgtttgtacaactcatcaatgaataatcaactatgtttgagtctgccatctcactttgaaagagatgtggtaccaactcactacataactatttcagtactaattcctcactgtttttaatttgggtcagagacttggggatggaaaggggaagcatgtttaatgcaaagctatggcccaaatgtaaacactgaaatcgtcctgaacacacttcaacagtgaatgtatgacagcccagtgtaaagccatttagaaataacaagatggacatgtacacatatgtaggttaagttcaacagtatataatgcccaaaacagtatatagtgggtatgaattacttgaaccgagtttagtatctttatccttttagtcatagtactgtgtggttttctccatattctctttcttatttatttttgtccaattagaaaataaagcagggcagggtggctgcatctgtttactttctgagcatgggtgtatgtaaacacacacacgtatctgtctattttttccagaggcttctatgtacacatcatataaaagtcatactgttaacataaatcaaccccagaagagaaattccagcataccattttcccttgcctattgtctgtgtgtgtgtttgtatgtcagtctgtctttttttattctggctttctctcttattcagtatttataaggacctttagggcagatgtctaaaaacaactgcatagtcatcaggagttaggcggaatgaaatgcctttgctcatcttctctacatgagtgaccagaagaaaaaaaagaaacacagagtatcagactttagaaactacatgcaggttaaagggcactgaccatcctggcttgtgttctgcctaaaggacaaggctctcatttgataaagatcattagtcaccaagatatatattttagagagttcccagtagcgaatattctgttggcagtcactggagtgtaccagatggttcattagcataggctagacaagtcaaagactttcagaatcatttagaaaatgtcaaacagaaacaagaatcctgtcactttttattagaattaactacatcataccctggacacagatttcaccttgggtcagaaaaattaatacagaattatatgaattgtgtaatatactgggttaagataggtctttctccagggactcatttgctggcaatatattaagatccctctactttaggaatcctcaatcctttccttttgtaagatatgaaaagagttgaccttgctcaaaatccactggtgtctaattgatttgaggtatatgcagaatttcaacaagacattcttctaaagctcttttgtgatccttttcccaggaagtttggtgagtggggtttactgaatattcagcagcatgtaaagtatgtttatgtcaaaaggaaaatacatccattaattgaacacattgctttagtaaacaggaattgaaatgctattgaaatgttgctttttttttttttttaatgcagatgtcaaaaaccttgaaaacttccagctggtagaaggtgtccaggaacaagtcaatgccgccctgctggactacacaatgtgtaactacccgcagcagacagagaaatttggacagctacttcttcgactacccgaaatccgggccatcagtatgcaggctgaagaatacctctactacaagcacctgaacggggatgtgccctataataaccttctcattgaaatgttgcatgccaaaagagcataagttacaacccctaggagctctgctttcaaaacaaaaagagattgggggagtggggagggggaagaagaacaggaagaaaaaaagtactctgaactgctccaagcaacgctaattaaaaacttgctttaaagatattgaatttaaaaaggcataataatcaaatacttaatagcaaataaatgatgtatcagggtatttgtattgcaaactgtgaatcaaaggcttcacagccccagaggattccatataaaagacattgtaatggagtggattgaactcacagatggataccaacacggtcagaagaaaaacggacagaacggttcttgtatatttaaactgatctccactatgaagaaatttaggaactaatcttattaattaggcttatacagcgggggatttgagcttacaggattcctccatggtaaagctgaactgaaacaattctcaagaatgcatcagctgtacctacaatagcccctccctcttcctttgaaggcccgagcacctctgccctgtggtcaccgaatctgtactaaggacctgtgttcagccacacccagtggtagctccaccaaatcatgaacagcctaattttgagtgtctgtgtcttagacctgcaaacagctaataggaaattctattaatatgttagcttgccattttaaatatgttctgagggttgttttgtctcgtgttcatgatgttaagaaaatgcaggcagtatccctcatcttatgtaagtgtgaattaatattaagggaaatgactacaaactttcaaagcaaatgctccatagctaaagcaacttagaccttatttctgctactgttgctgaaatgtggctttggcattgttggatttcataaaaaatttctggcaggaagtcttgttagtatacatcagtctttttcatcatccaagtttgtagttcatttaaaaatacaacattaaacacattttgctaggatgtcaaatagtcacagttctaagtagttggaaacaaaattgacgcatgttaatctatgcaaagagaaaggaaaggatgaggtgatgtattgactcaaggttcattcttgctgcaattgaacatcctcaagagttgggatggaaatggtgatttttacatgtgtcctggaaagatattaaagtaattcaaatcttccccaaaggggaaaggaagagagtgatactgacctttttaagtcatagaccaaagtctgctgtagaacaaatatgggaggacaaagaatcgcaaattcttcaaatgactattatcagtattattaacatgcgatgccacaggtatgaaagtcttgccttatttcacaattttaaaaggtagctgtgcagatgtggatcaacatttgtttaaaataaagtattaatactttaaagtcaaataagatatagtgtttacattctttaggtcctgaggggcagggggatctgtgatataacaaaatagcaaaagcggtaatttccttaatgttatttttctgattggtaattatttttaacagtacttaattattctatgtcgtgagacactaaaatcaaaaacgggaatctcatttagactttaatttttttgagattatcggcggcacaatcactttgtagaaactgtaaaaaataaaagtatctcctagtcccttaattttttcataaatatttctggcttttgagtagtgtatttatattgtatatcatactttcaactgtagacaattatgatgctaatttattgtttcttggtttcacctttgtataagatatagccaagactgaagaaaccaaatatatgtgtttactgtagcatgtcttcaaattagtggaacttagttcagggacatagaagagtcttaatgaattaaaatcattcacttgattaaatgtctgtaaatcttcatcattcctactgtagtttatttaatatctattgtaaattatgtgacttgtagcttcctctggttttcaagtaaactcaacaaggtggagtcttacctggttttcctttccaagcattgtaaattgtataccaaagatattagttattacttctgtgtgtacaaagaggattattttattatgtttattaatcacctctaatactcatccacatgaagggtacacattaggtaagctgggcgttgactcatgcgcaatctcagtcacccgtgttatcttcatggctcaaaggacaatgcaaaatcgccgatcagagctcatacccaaagcattacagagaacagcagcatcattgccctccccagctgaaaaacaagttggctagaagatacatggagaggaatggtgttgtcaacagttaatgaaacggttctatcatgcatgtgtaatgtggatggagacaattataagatttgactataactatttggagggtctttaacattgccaaaaaaacaaatatgttgatttttattttattttattttttattttaagaggcgggatcttgatctcacatgttgcccaggctggccttgaactcctgggctcaagcattcctcctgcctcagcctcccccgtagctgggactaggggtgcatgccagcatacctggctacgttgactcttaaaatctatgttctcttattttaaagatacagtgctccccactgaaaattaaacctaaaaaatgtcacatattggtatgttgttaacctggtagattaaatcatgagaatgattagaaagacgggcaacacagcgggttacatccacactgctgatcacaccaacgacaggagctgataagcaagaaagcgtcacagccagcgtctgttcacccaaggttgacaagtgaagtttctctaatgttgattgttagccgatttgtaacctggcatttacttagcaactgccttatcaattacaggatttgccggtaaaagcagactcaaatataaaggtttt

SEQ ID NO: 12291 - DNA, 42989 bp, Human
  misc_feature (1)...(42989): n = A,T,C or G
accaggaggtgttgagaagtttacccacaacctctcagaagctttgtttcctcagctaaaaattagtataataaaatctccttaccttaagctttgtaaagactcaaagaagtataaattgctttgcagtagttgctaggcagttatcattatgtaaaagtacagctccccctttgagcagagggcataaaccagtagatgctattctgaataacccactccagcaaggctccaacagaaggaagtaattataaagtattagatttgaatgtaagtccactctggccccagggtccttttctacctgaaatgtgcatcttctaaaacagtgccttaggttggaagagaatgggatcaaataagtatgactgccaatgcatttggatcatttggggagtgctttcaattttttagtggaaaaaaatgctattaagcttagaaaatgtccccattcttctaggcccccaagcatgctgaagtcatcatttattacacatttactgagcatctactctgcatcggacattgtgctagggaagatagacctggtcccctgccattaatggtgccttcatgttgattcatacattaaacaaagagtcacacaaataaggataaaattcaaatggcgatcagtgctatgaaggaggaagtcagggtgtataagagcctaaaacttagagaactacgtgagccttacctttctgagataactcttcctaatcccctatgcaggaaaaagatttcttgtgaaaagcaatgatagaagagcaatccggggaagcaaaatgaaacccagcctgagttagaaaggagagaccagtacatgacattctagactggactctcctttactccttttcaatgggctcatgggccagtgtttattttgctgactgcctcaaaggaagtagtgtcctcctcagacttaaccactcttttccaagtgaagacttgggtgggttaagcagcatggatattaacaaggcaggaattaagagggtccgcgtgaggccgggtgcggtggctcacgcctgtaatcccagcactttcggaggccaaggcgggcggatcacgaggtcaagagattgaagtgatcctggccaacatggtaaaaccccgtctctactaaaaatacaaaaattagctgggcgtggtggtgtgtgcctgtagtcccagctacttgggagactgaagcaggagaatcacttgaaccctggaggaggaggttgcagtaaactgagatcacaccatgcactgcagcctggcaacagagagagactctgtctcaacaacaacagcaataacaacaacaacagcaacaaaaagaggctcctcttgaagtataagagtcagtaccagccagcccctggacacaaccaaacctagaagaactgaggctgggatcaccaccttgcccagtctccaggagttacatggagcagaaaagtggtgcagaggaagcacggcccactgcaattgcagatctatgtattttagccagagatagatctgaatggtttccaggagcttctaagagcctgaacatgaagcccctcttggaactgtcctttctttctctgccttaactcaaaaagttgagaggggacaccctgaagcttatccccagtatgaccctgctccaacagcttcagcaaggggatggggcctgattccacagggcagctcaactcggggactcagcttgcagtgcatgctggcctcaagcctttccattatgtgctttatttttggtaacattggtttagttttcaacttatattattggtcaaattgttatgactacttggggaatgcatctcaccattgcttcagagctctcccctgtaacaaaagaaaccaacacccaagctctgtgctagtttttctatctcttctctctttctctctctcttttttcttttttgagacaaggtcttgctctgttacccaggctagaatgcagtggcatgatcatagcttactgcagtctcaatctcctgggatcaggcaaccctctcacctcagcctcccaagtagctgggactacaggtgcacgctaccatgcctggctaatttttttgtacttttagtaaagacggggttttgtcatgttgctcgggctagcctcaaactcctgggctcaagcgatcctccctcctcggcctcccaaagtgctgggattacaggcttgagccaccgcacctggccttccccatttttctcttaatccatatctcagacaggaatctgtatctctcactctacagatcattctgtaggcactatgctaaactgacaccagtttcaaatttagtccttaattgatcttggcctttaggtgagcaaagttacagtggtaaattacgctccttcgcttacaaaatctcttgcttggtatttattccccaggggttacatagaatagagtggaggcagtagacatggagaaatcctatcttttaagaaagaaaaaaatgggcatttttctcatggggaaggatttttatttttcaaatgggtgtttgaactgtaatgatttcatgacatctgcctaacggttttgtttctttgtcttacagaaacaaacagtcgttgctgtcaaaaaagaggtaattagtcttacacttccagtgaagaatggttttaaatcttctaacaggttatatgtactttgttttaccctctgcgcttggtaatgaaatgaaaaccacgtgcaatgttcaaacaattatttccaaattcacggacagcacagagtgacgaagcatcttctgtaagctctggctggggctggggctgaggctggcactcagggtctgaaaaacccctcgaaggcacagagctgaggggtggccagagaggactgtggaaccaatgctgcaggctgcagagactctacatccccaacgtggcccctgcacctatcattacagggccagaatctacccaaggtggcaactgcctattttggcaaatcttatgtctggggcccaagacagagtcctgggaaccatggggcattgagctggggtgtacggttagctatctgaacgtggaggaaggtggttgaggaggggataacttgctttggccaatgctgcagaatcaggaagtttaaggatgtcacctgtggtggggaccactctctgcttctgtctgccagagacatgtgagggaaaagccaagcgtttgtccccgtgtctcagttgaatgctccttagaacttttttttttttctgctgatgctttttcccagactaatacataatggctgaaggaggccactgatttgaagtctgtggtcatctgtccactgtgggcctgacccactggtactgagggggctggctctgggcatggaacgggatgtggctctgggtaaatggcttctgggtttggaggctgtgtgtagtgacactgaagggtgggagggggttgaataccttctaacaactgtgtctcttccagatcatgtattaccaacaggccttgatgaggtccacagtgaagtcttctgtgtccctgggagggtatgtccctgatttgttgatcttgctaaagtctgatgaacaggtagacaagaggagaacttctgcaaactcgacaagtcctgggctgacagactgaagattcagcagaactgtgagggacaaaaccagtctcttgggggcttagttcctagttcatccctcagaataaacctccgggtctcatcttgggttatgcaaaatcgagcgtaggtgaggttctagaaaagactgttatgtttcttggaatccactaatgtgtggatggggaagttagaaagagttggaagtccgtggactgtagaccctgtgaggatccaagacagcctgggttcctatcgttactggttccaattcattaggagtgtgtgagtcatgtttactggttccatgtgctactaaatgtccattgttcatctttgatttaaaatcccattaagataaattggacatttatgtttgatttattgaactttctggctaccttgacccagccccccataggacatcatctaggagacaagaaagagctgagtgctgcctcccacgtgcaagcagttattcttttaaaatgcggaatttatcttaggactgcatttctaactctgggattttcctgcacacatgaaaataaacttggcttattcctgggaggcacgatgtgactaatcatgtattctgactgtgtaagactcaagtcatggtactaatcgggactgaagatgctgttttgtttagtgccttccttcaatatgtttaagggttgggctcttgtaaaaatgttttacatcttcctatgtccccagtttgcaaaaatgccatctgcctgagaaaatatgccctgaccccacacacatttcagtgactctgctgctgctaagccctgatcccagctgaggagggcacctgtgtactcaggggcattcactttgggttataataatcatcattgttcagtgataaactcaaaaccatttacttccgtgttccataaacccagtttcatgaaaccaaacagaaagaaaatggaaggagacccaaggatagttcttagacccagtttccaatttttatttgtctcaggacctcattaccgtaattttgacatcattagtgttttgacctgtgaaccagtttttttttttgttgttgttgttgttttttacctccagcttctccactggtaaatgtctgggcccgtcgaggtgcctcatgcctgtaatcccagtactttgggaggctggggtgggcagatcacctgaggtcaggatttcagggctgaggtcggggcggatcacctgaggtcaggagttcaagaccagcctggtcaaaatggagccccgtctctactaaaaatacaaaaattagccaggaatggtggtgtgcccctgtagtctcagctacttgggaggctgaggcacaagaattgcttgaacccaggaggaggtggcttcagtgagctgagatagcgccactgcactccagcctgggagacagagcaagactttgtctcaaaaagaaaaaaataaaaaaggtctgattgtcgactaagagagtctcgggagagaataagccagggggcttgagttctgaatagaattgcaaacccagtgcttgtctctaaggtaccagtggtttatctctaaggcatggatcctgttctgtccaaatcttatggctgagggaagacttcagggcaggtgcatttcacattcactgtggacacaattccccacctacggggaggaggcacagcaggttttcaatacccagacagcaggaaatgcattgactcagaaggtctgactcaactcaagggaattagctttttttagaaaagttttttaaattgacacataattgtacatgtttagggggtacatagtgatgtttcaatacatacaatgtgtattgataggatcagggtaattagcatatccatcatctcaaacatttatcatttgtttgtgttgggaacattcaatatcttcttttctggctatttgaaagtatataaagtaaaacagaggttactacagactgggaagggaagggggaaggggagatagggaagtatttgttaaaggataaaaaattaggccgggagcggtggctcacgcctataatcccagcactttgggaagtttcaggcaggaggattgcttgagtctaggagttgaagaccagcctgggcaacatagtgagaccacatctctacaaagaataaaaaaaattagccaggtggtggcacatgcccgtggtcccatctcatcatgacactgacgtgggaggacggcttgagctggggaggtcaaggctgcagtgagccatgattgcatcactgcactccagccttagtgacagagcaagacaatgtctcaaaaaaaaaaaaaaagttacgaaattacagctagatagtgttctgtagcactgaaggatgactgtagttaataataatacagtatgtatttccataatagctagaagagaaggaattagctcttcctccaaatagtgtgtttggaccaattaagccccaggtttaaataatgggcctaagtttccaaacccaggcattatcctgagaaagggtagaacccaacatggcaagagtcttggagtctgtggcaactttgggcttctaagatgggtgcagagacacaagtttgaacactccaagttggtttgaatctaaaaacctattgataaaatataaacaggccatattttaatgaaatagatacagaaaggccgggcatggtggctcacacctgtaatcccagcacttcgggagactgaggtggatcgcttgaccccaggagtttgagaccagcctgggcaacttggcaaaaccctatctctaccaaaaatacaaaaaaaaaaaaaaattagcctggcctggtggtgcgcgtctgtgatcccagctactcaggaggctgaggtgggaggattgcttgagcctgggaggcggaggctgcagtgagccaagattgtgccactgcactccagcttggctgtctcaaaaaaaaaaaaaaaagaaaaaaaagaaaaagaaataggtatagaggaatgacagagggactggatggaagacaatgtttcatttcacaagtagaattgggactgattttgtcaaatacctgccaatcccaagggttatttgatttgaggaaatttctaggaaaacagtaataagtatgtcaccaaatcgatacaggaaaagaggacagcctggtcagttgacctgtgtattgatgtcatatcttgggtgtcgagcttctaggaaatcattttctgtttccttttcaggattgtgaaatacagtgagcagttctcatccaacgatgccatcatgtcaggctgcctccccagcaacccctggatcaccgatgacacccagttctgggacttaaatgccaaattgtatgtattttatatattggtgttttttaaaaaaccgtttttgagttacaattcacatgccataaaattcaccccttcaaagcatacagttcaatggtttttattatattcatagagctacaatcaattttaaaacatgttcattacacaaaaaagaaaccctggacgccctccagccttaggcaactatgaatctactttctgtgtttacggatttgtctgtctggacatttcctatcaatggcatcacttggaatctgaggaatgacagagggactggctggcagacaatgtttcatttcacaagtagaagaggaactgattttgtcaaatacttgccaatcccaagggctactcgattcgagcaagtttctaagaagacagtaataagtatgtcactaaatcgatacaggaaaagaggacaggctggtcagttgacctgtgtattgatttcatctcttgggtattgcgcttctaggaaatctaggaaagactatggggtcttttgcgacgagcttttttcacttagcatcatgttttcaaggtttacgaatcttgtagcatggatcagaacttcattcccatttatggttgaatcatcttcatggtatggatgcactagagtttgtttatccattcatctgctgatggacatttgggtggtttctgccttttagctattatgaagaatgcggctatgaacattcgtgggcaggtttttgtgtgggcatattttcatttctctcgggtgtatatccaggagtggaattgctgagtcaaatggtgactctatgtttaacaacagattggttttgaaaattaaaaaatcatatgtatggctttgcatgtttgatatctaattagcgtaaacttaagttctgggcgggcagggccctaaacctgccctttcccttaccctttggcttttttttgtcagttttgaatagtcattgctcactggacctgcacgcttgtgttatttggaagagggggcagaggcagaaacacaggagagttccggcacacagagggaggaagaagagaagggtgtaatggtcaaattagagggagagagagaggaggacaggggagaagggacaggcctgagtgtgtgagggaggtggggtgatgggaaaggaaggagtgccaggtataggtcacagcttgggtcaacactgccgaggccatgaggaacacacaggtgacactgacccagctgggtaagcaggcctggcctgggagggccctgattctcatcttaagcaacactggtacctattccacgtggcccgctctgggcagccaacaggttaaggaggccactcctctggagtcaggggtcccctgtctactaaggtcaactgcagagccaaagactctagaactaccttctggggaggcttcccttatcctctttgggctctggctgttggggtgcttctctgcagcccatgtctgcctcccagcgtactgaatgagagaggcgacctgtgtctgcctgtggacaagcatgtgcggacgctggctctccctggaggagaaggcagggaatctggccaggaagagggttgtcctaggagggcttggggaggagagatggatggccgctgaattttaaataaaatggggagcatggtattgaagacaggtagagattgctggcaagaagaaaaatgtgtgttctgtgtaagaaccgttgatcagagggcactgggtgggtgacaactggaactccccattaaagtgggaagccctgttcttttttgtggatcctatatgtttattgaaccaaatatatatatacacatatatgtatttgtaagtatatgtatatatatatttttattggtgcacctatcaactgtgccgcgtacactgaaccccgtttttagtcttatatccctcactcccttttcacccctttcccctgagtccccgaagtgcatcgtgtcattcataagcctttgcatcctcatagcttagctcacatgaaagcgggaagtcttgttcttaatggtttagattttagaacagtattacaattactggggaagcttaacaaaaacatcaacgttcaggccttatcctcccaaacctcttatttggttggcctgggttgctgtctcaccactatcagcgttttttgaaagctctgctgattttcacaaacagccaggattcttaggctggtttacagcgttgattcccagtgtgggccctggaccagcggcatccgcagcaccagggaacctgtcagacatgcgtattcttgggccccacccactcctactgaatcagaaactctgaggttgggacccagcaatctgtttcaatgcatcttccaggtgattctgatgcatgtggaagtttgcaaaccactgtcgtcatcacaactcagcttcttactaattatgtgagacttggcaagtatttaatctctttgagcctcagttttcttgacaatgagatgggatagtaatactcaattcatagtgttcttttaaggattcgatggtatgtgtgtaacgcacagtacctcacataggacaatgctttgtgaatggcagttgttaatgttatcagttttcttattgtttgtacacttgttcttatggaaagtgtaaaacttgcttggcatgctttatcttggatcccatagacatgaattgtgcctggttctggtcctagctgctacatcagtgggaaaaatggtgtgagggacttgaaaccttagtttcaaaggtctgtgttaggtttaggagaattccataagggataggagagaacactgagtctttttctgattctctggaatgttagatctctgctagctgggctcgaatatcctacctgggatcagggaaatctttccaaacaaggaggtgcagtgggacctgcatcttagaggaagccctgaaagggagtgcagagatggcaaatgggtctactccgaggcacatggcctgaggcaggtacaggaggagccaccggctcccaccagaagccagggtgtgccatggtaggggggcagctgtcgtgggtgataggcacccagcaggtggcagtgattgtagcacccatcaccaatgctgctccagaattctctcctagtccaggtggcagcctgaccctctgctggccaggctccaggctgttaccatgccttggaggaggcatttgaattcgtttgtccttaaggttaagtgagcaggacctgagtgtgggctccccacggtgggcatcctcctcacctctgggatggtcatgtctttgatgtgagccccgggggacttgtctgtggctgcatcttcctagcaagtgattacttggcttgtgtgttatgcagggattgggaggaggaggattgaattgagccctgggccatgagactaaaggccctcaccccaacccaggccaccacctgtcacaaccgctacctctctggtgcatttacaaatcatccttgcagggtggaaatcccaaccaagatgcgagtggaacgatgggccttcaacttcagcgaattgatccgagaccccaaaggtcgacagagcttccagtacttcctcaagaaagaattcagtggtgggtctttgtttacaaaaaaaaattaaaataacttacttttagaaagagtcctttaatgtctagcctagggtttggggaatttctcagcagatgttttcagagctttgcttatgcccttaaacagttgcttcctttcacagctttaagaatgggacctgagcccaagactcgttctttccatagactcaaagaggccccaccgtctgggggaaaattgcacctgctcacagaatctacatcaggatccctcacatttctgagggctccatccatcctggatgcccccactgtcacccgaggagcccccgctccttctagtcagcctctaaatataatgaacctggaggaagggaagggagacaggcaggctttccctttctttctctttttgtctcccagcctgattttcttttttctttgtttctttcttttttttttttctggagacagagtcttgctgtgtcgcccagcctggagtgcagtgggatgatctcagctcactgcaacctccgcctccctagttcaagcgattcccctgcctcagcctcccaagtagctggcgttacaggtgcctgtcaccacacctggctattgttttgtattttgagtagagatggggtttcaccatattggccacgctggtctgaaactcctgacctcaggtgatctgccctccccagcctcccaaagtgctaggattacaggcgtgagccactgcgcctggcttcctgattctctttagctcagtggttctacacattcagtctgcctggggatattttaaaacatgttttcctggatctcatccctaaagttgcttttaaattggtgggggttggaatccttgaagttttggaaactccccagatgattccaatgtgtggtgattgacagccatcaccttagctcctggcctgatttcttcagggccttaggagggtgtggattttagtgaaatgggcagggccacattttgtcccatctctgaatgtcacctcatgaggggaactgtgacttttttttttttttgatatggagtctcgctctgttgcccaggctgaagtgcagtggcatgatctcagctcactgcaaccattgcctccgaggttcaagtgattctcctgccnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntagtgatccacctgcctcggcctcccaaagtgttgggattacaggcgtgagccactgcaccaggactgtggctttttaaatatactgcacttcccggagaagcatccacaaaaaaacacgaggccagatcagaaccaggctgtgcattcaccaccttcattgaaatatttacctttacgggattcttttacttccttgctcagtacccagccctgggggcatcactcctgagccttgacactcagctgcttactacccaagatccacttgtctgtggcactgctccagaaacgaatcctactggacatgcctttagcctggctgactgccggatgcaaaacattacatgataatatggattgttgataatcatctccctaatcaagtctaattgctgctctagaacaaaacccagaaaagatggatggactggcgaataagtggttatagtgccatctagtggcaaagtgacaacatacaccctgaatttattatctcccccccactaattccttagtgagaatccagcgaaaagatttccctgcattatttaaaccgtattattagcaatctcctcatgagattcctgaggctttaggtatgaacagggcagataaatcatcaatttgctcatttactttttaaaaagatttttaaattgaaatattatttgcatatgatgaaattaactttttaaaagtgtacaattcaggggttttagtgtattcactaaattgtgcaaccatcatcactaattctagaacatttttgccacattaaaaagaaactctttacccattagaatcatcttctattcctgcttctcctgcaccccagccctaggcaaccacaaatctactttctacccctacggattcacctcttcaagacatttcatgtaaacgaaatcatgcaatatgtgaccttttgtcttttttcacttagcataatgttttcaaggcttgtctgtgtttcagcatataacagcgcttctgttcctttttttttttttttttttttttttgacaaattctcactctgtcgcccaggctggagcgcagtggcgtgatctcatctcactgcaacttctgcctcccgggttcaagtgattctcctgcctcagcctcccaagtagctgggattacaggcgcccgccaccatgcccagctaatttttgtatttttagtagagacggggtttcatcatgttggccaggctggtctcaaactcctgacctcaggtgatccacccgcctcggcctcccaaagtgctgggattacaggcgtgagccactgcgcctggccacgtggttcctttttaatgactgcataatatttccttcattcctttttaatgaccccataatatttccttgtttgtatgtaccacattttgcttatccatttgtaagttaatgaacatttgggttgctttgactttttagctgttatgaataatgctgctatgaactttggtgtacatatttttgtgtgctcatttaatatttttggtgggaaaacgtatgtaacataaattttaccattttaaccatttgcttttgagacggagtcttgctctgtcgcccaggctggagtgcaatggtaccatctcggctcactgcaaccactgcctccctggttcaagcaattctcctgcctcagcctcctgagtagctgggattagaggcgcccgccaccacggccggctaatttttgtatttttagtagagacagggtttcaccatgtttgtcaggctggtctcgaactcctgaccttgtgatccgcccccctcagcctcccaaagtgctgggattacaggcgtgagccacccatgcccagccgaaatcttcttcctttttaaggccaaatgatattcccttgtagtcttcaccatattttgttcatccattcttttatcgatggacatctgagtgctttccacttactggctatcacgaataattgcttatttaattttactaagcaatcaactgtcttttgctatgggcaagatggtttacatggcacttttgtcagatcagttacattttagttgagagcatcactggtctgtgatctcagtccaaagaacgccctaaagttcatgctgaaaaggaaggacctctatagagctatgggacaaatgccaactagtttaaaattgtgcagccttttctaatatgaagcacccaggagcttttaaaaaaatgcagttgacccttgaccaacactggtttgaactgcacgagaccacttataggtggatttttttttcagtaaatatatttaaaaacttggggggatttgcaacaatctgaaaaaacttgcagatgaactgcatagcctagaaatagaaaaaagttatgaaaaggtatcatgaatccataaaatatatatgtagatacatatccacttatgtgtccattgactgtttatgttattagtaaggcctctggtaaacagtaggctatttgtagttaagtttttggattttctactgcataatggtctgcgccctaaccccttaattgttcaaggtcaactgtactgagaaaagagaggagaggattttgttgttcatttccccacactgtgacacactccacgatttacacacacacacacacacagacacacacacacttgctctctcttgtgatcgtctttattttcccaggcaaaaatcaccacctgggaccactgtatgaacatatgcgtggtacctctggacgctgcaggttagagaacctcgagttggagggagatgaaggatttgggggaacctggcttttccttctgggccaatcccctctggctcaggtgatgctcagttcagtcctgctcctggccagaccttccctgagggtcagtccatcagcactgcttcttgaacagcctctctgtaagaaccgttggcctggaatatgtctggtgagggactgcaaatgatgggttctctaagcacagccaaacaaaggaggaagaactcacgctcagtcattcaacgggagcaaaggaaggaggtcttgatgtagaaaaccgtagcgtagcaacgcatgtatagaagcctattcatgtgcgagctcgttcaagcaatatttcctacagccaaattctagaataaaaaagagtacgacaacctctggggggtgatatgaactctggcctgtgtattgttggaggaaaggaagctgccacggtgtgaatgcattgctgcaaacatggtaggtgccaatctagtttatttctaaggccacgtattgagcaattactaagttcccaatgttcttccaggccgtagaagtgaagatgtggctcctttccccaaggagtattgttgtctagcatcacaatgtgcaatagcttgttctgcggcaggaaaggtgttcactgagctgggaaatggaatccatcccggttgactcatttcttttatttcctcttttcttcttccaacttatttcctgcccggccctcatccacgtggacttctcaccatgcaggagagaatctgggattctgggaagcctgcgaggatctgaagtatggagatcagtccaaagtcaaggagaaagcagaggagatttacaagtgagcatcagccagggtgctggaaagccttcccttgggcctctgaggaccaccccattgtgcttgaggtgaagataggatgagaggacaacagcctggtagctggctgggccctggtcagcatcagttcactgtacttgccatgctagaaatagttccccgctgctttgggaggtttgggggttccctgaagaaagcctggtgagacatgcagtgtgagtcacctgttcctatgggaatgtgtctaggggttaaaaaagcaagctgtcccgaattacagtgcagagtgctctgtctttgactaaagccttcttaggtgtcctgaggggtgtgtgtgtgtgtgtgtgtgtgtgtgtgtgtgtgtgagagagagagagagagagagagtgagagagagagagaagaagcagcaagatgggaaacctattcctcacgcttccttagagatgtgaggaacacaggggaagggagctcctcccacatgtctgggacagtgagcgcagcttggggtacaaacatgggtgggcacatctcattcctgacatcacggctccagcccccacttgttctgagcagcaataagtctgtccctctccatgactgtctctcctccaaattacacaaaagccaagagttccaggttaaaagggtcagtcctgttttcaatggccaggtggagagggaggggaaggtgtgatgaggctcccaagttgctgaaagccacactccccctccccaacactcctccccctacaggcctggtgggtgctcctgtcctgctgtggtcccatctctgtgggtcctttcatctgcactggctgcagtggacatgagtcctggatactgagggcccagcattgttagttcatactcacatgcttagccgtgttgcccaaagcccaagcaccacgctgggctggaaccagccctttgcagtcaccagactgtggtgctgaactttgggcagcaggccaaacagccccttccctctgaggacttagcctctggaccctggatgtccttcctgcaaatgaactcagattgcaacaccccggtttccagagaagcaccagcagcattgaagagaaaagcttgaggtctcacttcttcttatacttagaggttcatacactctattgcaaatttgcccagctcctcccacagggaggggatccatgcgctgagagaaatgggggtgcgggtggggtgcagtggggagggctgtcggtccgggaagcttccatgacatcctttgcagtacaatgggtgcctgattgccttacacacagtgacgcacacacaactcctgattccaaaaatctgctacaggaagcccgctgcctctgccattagaccagtttccttccccaggctccctggttatgttatgtaaatctcagtttcaattccaaaattttaatgtacatcttagaaaggtaggaaaatattcatatgagtatttctaattcagcaacagctcagaactggaaatactgagagagctctgcatcccgacatcccaggtagagccacgggctcaggaagtgtggccaagtttggtctaattgggagccttggcctgtctgcccagcgggtcagacctctgggttctgggactatgggctgcctctcgacacagcatgtgaaattcattacaaagcacatgtgggttgggaggagagcagagacccccagaacacctgtgtgaaggtgtcttagcctggtcccaggttgcccctggaatcctggtgcagaaggtgtgaagttggaggctgagttcttcaccctcatggccaggacctaatccgacctgggccccagccccttcttgctctctctcctggaggttggaaacatcaaagttaaatattcatattcccaatactggaagtttcttgcttcaaggaaaaattgcttgacaacctcttcaaaagttcatgctctttagtgtctcctaaaaaaaccaccaccctcaccctcggtaaccgattcgtatcagtccttccctcccaagcagctgtgagctatccatgaattgacttggtttagttacttttgctaacatctccctcccaccccaggctgttcctggccccgggggcgaggcgctggatcaacatagatggcaaaaccatggacatcacagtgaaggggctgaagcacccccaccgctatgtgctggacgccgcacaaacccacatttacatgctcatgaagaaggtaggtgggtccgtgctgtggatacggggtccagataggctttctgtcactaagtacccggaaaattctttagatataggaaaaagagagaggatacgtggatagagctttgccggttgtggcatgcagctaagcatgggggctcatgtctgtaatcccagctctttgggaagctgagatgggaggatatcttgagcccagaagtttgagaccagcctgggcaacacagtgagaccctgtctttatataaaaaagaaagagagagaaagagaaaaaccccagaattgtcaaccgtctcttccacctgtccactggggtggacttgccttgagcccctcacccacgggcctagaggaactcctgtagaagctgtgtgcatccttacgggccccactctgcagcagtagacaggtaggagtaatggcattagtaatgacaacattataataacagccatcattcgttgagggcttacaaggtgcagtcgctgtgcgaaacacagaactttatgctcaaagacagcccacaagttaggctttgctgctccagaatctagtggcttggtcaaggtctcaccagagatggggctgggattcatagccaggtctgcctgggtttcaaggccgagctcttagtttctgctgcagagtgatggcaattctcaccaccctggccccaggcaaatattacacatagaggcgtagtgtctaggagagacaaatttgtgtgtgtgtgattgtagtaagaccctgtgagaatttagatagccctctggattattaacaaagtgcgaatgcggtgggaatttaaaaaaaaatatgtgaagggtacctgagagaaaaatcaatcattttcttaagaaactagaatcggaggctcagagttagccttaaagaacttgtctagtttgattcttctttggtgccatccttgacaagactttctttgggtgcttcaacttctcattatggcaatgatttctttaagggcaaagtatctttataggatataggttatgtgatataggctatttgatataggttatgtgatataggttatatgagatagattatgtgatataggttatggatattggttatgtgatacaggttatgtgatatagaccatctgatataggttatatgagatagattatatgacataggttgcgtgatatagcttatatgagatagactatgtcatacaggttatatgatataggttatgtgatataggctatttgatataggttatatgatataggttatatgagattatatgacataggttacatgatgtaggttatatgatataggttataatgtgatataggctatctgatataggttatgtgatataggctatatgagatagattatatgatatgagttatatgttatagattgtaatgtgttataggctatctgatgtaggtcatgtgatataggttatatgatatacattatatgatataggttatgtgatatagattatgtaatataggttatatgatatagattatatgatataggttatgtgatattggttatgtgatatagattatgtggtatcagttatgtgatataggttatataatataggttgtgtgatataggctatctgatataggttatgtgatataggttatatgatatagattatatgatgtaggttacatgatgtgggttatatgagataggttatatgatgtggtttatatgatataggctatgtgatataggctgtgtgatataggttatgtgatataggttatatgatataggttatgtatataggtttgtgtgaatggtaaatgctgattagctttcctgatttatatttcttctatttagtcttttattgtatcatttaaaagtatttttactttgtttttaaagcatgtaataatttagaattgccgccaagccagattagccattttcatcattttttgaatcagtggggtgtttctgtgtgttttgaatcagtggctgtctctttgtttttgttactagacgattcacagcagggtttctttaataataatcctctttaatgtattttaaaacgttttggttcttaaaaatgtagttttcggctgggcgcagtggctcacgcctgtaatcccagtactttggaaggctgaggtgggcagatcacgaggtcgggagtttgagaccagcctggccaacatggtgaaaccccgtctctaccaaaaatacaaaaattagctgggcgtggtggtggatgcctgtaatcttgctacccaggaggctgaggcaggagaatcacttgaacctgggaggtggaggttgcagtgagttgagatcgtgccactgcaatccggcctgggcgaaagagtgaaactccgtctcaaaaaacaaacaaacaaacaaacaaaaaaacctgtagttttcatacggctttttaggggatgcccagggaggccagttactagccagaatggaacagtcattggtaactgcagaaaagaatggcatatatgcccactggactccctatatgccattacagctatgtcctatggtgaaacactcaacgtatcccagtggctccatggtccctattcctagactctatcctagttctcataacttttactgctcccacttagtctttagaatagtgccatttcaataaatttttaaaatacctcaatccctggtttgttgcagtggcctttgtcccatattgggtatgactagagttttccgctcgcttaaaagtaacgagcattcatgaagcttctctgaaattgcccagagtcccagtaaacagccccataactggactctacgcgttggttgtttttgtttttgctttggtattctcttgcctttacacccaaaacacagggcagaaagggatgtcaatggcttagaagtgggctccatactcctggctgctcatcttccttggaagaaagtcttggagaggagaggtcagatgtgctcttgtctcatgctggcttcactgaaccactccaaggtggatcttcatgtgtagggttacagactgtaattctcaaacttaaaggtgcagcagaattacctggagactgttcaggtagttgttaattgttaattgtttaggtgtcctcatgtgaacaaatgatgacaggcaatgtctccatacatgaccagctgtctcacctgtttggcatgtagcatgcagcatatgagaataagtgaaacaaattaagcagttctgggtctagtgtacttttaactgtagcagcttttatgcaactggctacatttacaacataggctgaatcacagacaatgttgataggatctgaagctgtgagctgtaaaacctgagactgttcaggctcagggtgaatcactcccagagtttctcatcaggacggctggggcaggcctgagaagttcccaggtgaaattgatgcttctggaggggaccacacttgagaaccactgctctcaacacctcccccaacacctttcacccaaggagacaaattctcataacttttccattctactgccaagggaggcttgaaaatggcaagggtattggtttgatttgactgcttttttctctcataattactgttgttttcttgttcccactaggattcttatgctcgctatttaaaatctccgatctataaggacatgctggccaaagctattgaacctcaggaaaccaccaagaaaaggcaagtggaattatctgtaattgctggctgcctgctgcttagtttacagagaagtgagggtctctttcagccaaatggctattatggagatatttgcttgatgaaaatattggggactgggaagtattgctcagggaatgagtgcctcatttgcttcataatgccctgaaatcactctagcaagatttccttagtaattaccaccactaagttttgtttcccctaaagctggcttgaaagagtttagaggatcagaccaataattacccttatcacaaatggaagcttctccttggttttttaactgctactcgttacctccaaactgatgtatgggaattaattaaggtacatccttgtatttaaattgttctaagaccttagagagaatagcagattgcaccccaagagaaaatgctcagtgaaggggaaacggacagtaacgggctaggtattcttgctgcctccggggaccatgttttagaagtccatgaacttgttcattctcacttttctcattggagatgtggatcatctcatctggtagagccattgggacaatggacgaaataatgtcctgaggggcagattgaactcttttccgggggaattcaatctacaaggattgaagatttaaaatataaattgaatggcagcttgaacaaaactgtaaggctttggcagaggtttttccactggcaatcgtgtgtcctgtcccccccaaagtgagtgactgttcccctgtttgctgggtcaacccacactgggctcctttccagcatcttccatcaattcaaaagggggatggccggaccagagcctttatcaaaggagaaaaaacaacaacaacaacaaaaaaaaccaacttggcttcattcttgaggataatggccctgttatgaaaaggagagaaagaaggtctttgtggtgctattcttctgggtttaccaagtaaggaagggagttcagtgcccctggggacttaaaagcttctactttaagccagaagaaaggcctgtaatagctccagtagttctgccagaaagtaatgaggggacaaaagaggagtctcatacctctctctccagatattttagaagttggggcagacgtgagaattctcactattgtgagtgagaattacacgtgaatgcattcgtaaagtgtgaagcctggtctgtgtccataccaggactacagtgggtgtgaattttgttccatgatcccaggtataagacaatgtattcaaactcaatttttgcatgacaagttacccctagctccaagccttcctcttggcagggctggtgagaaatccaatgtcagtgtcaggctttacatcctggtaggggagcccttcttctccttaagatagatataagagttcaaggggcttatgtagtcaaggggcttatgtagtccagaaatatggagtatgttgcaggtctttgtctcttattgctgctgaagttcttggctccaagcttacgtgggccctcaaaggcaggtgggctccactgctcactgcccactacatcacttggatacctagagctttgtcctggctcctaaggccatggcagggagagtttggttccaggaatccagtttggctttgaagaaggttctggcatgtgtcaagatattgcacatgagcagggtaccaccagcccaccagccctcttcaggcctcttccctctttctctgttcactggggcctagctattttggacagtccagctctttccttccttcccagaaccatagcttttgaaaacaaatgctccagccaggcgcagtgactcacgcctgtaatcccagcactttgggaggctgaggcggatggatcagttgaggtcaggagtttgagaccagcctggccaacgtggtgaaagcctgcctctactaaaaatataaaaattagcctggtgtggtagtacatgcctgtagtcccagctacttgggagtctgaagcatgagaatggcttgaacctgggagatggaggttgcagtgagccgaagtcgtgccactgcattccagcctcggtgattcagagagactctgtccccgctgcccaccccccaaccgccccaaaaaagaaaagaaaataaacaaatgctccaactctctccagtacccaagccttcattatccacttctttcatgaagatgttacaaaaagttaagataacaaattgatttctacatactgtagaagttcaatgcaacttcgccaacaaaagggtcttccttgtgcctgacctaaaatctgatggcagttggtactcactctggtctcatcctccaagtggggagaaaggagccaaggttggaccccactggaggttcactggaaaaaggagggaacaaaatatagattctggaccttccagccccagctcccatcaagtgtgacagggtcagtgttgggcaagctgtgtcattttcctccaaccaccaatctgtccttccttccagctccaccctcccttttatgcggcgtcacctgcgctccagcccaagccctgtcatcctgagacagctggaagaggaagccaaggcccgagaagcagccaacactgtggacatcacccaggtcatgagcaagctggaccgcaggagccaactccaaaaagagctgcctcctaaataaatctgtgattcctgggggtggggtcatgcacttgggagaggcaaatgaagaagggtagggtcagagtctagaaggttccattccccatttgtggaggtcatcaggttcatcccatactcctctaactttcttcatgggggacttcctaataccacagcaaccagagcttgttctcccaagcccactcatcaggggacagggtgggcgaaggcggtgggtgggagaggggatcacctgactcaattgctgtgtggctgcctattgtaccttagagagttcttaggggaactatgaactttttcagtaagagccagggggaaaaagctgtctcagtgagagccatagggaaaagtggtacacaaagctctcactgagagagagctttgtctaccactctctgctttggaaaattaaaaagaaggcctctccccatacccaaggcctagtgtttttcagggagatttgtttaaaatagctttatgaagctcctcatcctatctctctaatttagactattgtttccaaatcattctgaggatccgccgaggggctagttgcagggaagtactttctctgaactcccctgctatgcctgcctggaaagaccctgctgagacgtttctcctgttgagtttgttcttagtcataattactggagggttgatgggctctcttcttcccatctccccatccccttgtccatgctggggaaataagcggcttgcgggaatgaaggactcaaatggccctctgaggagcatctttttggctaaagaacaaaggcattgatgtcttcattcatgggaagaggatggtagacatcgagatgagtgaggatcagagatgatactctctaggacattttctagatgttgattcttccctcttctgtaggtgtagacgaggtcagccctgtggtcaggactgggggagaggacagttctaactgaccttggggggtttagaaggtcattctcgaagttaggctcactccttacacttgtgcaagaatgcaacagagatagagcacagaagtgagcaagagaccagcctgaccaagcaggaatactcactcattcagcacgtctattgagcacctactatgtgcaaacatcggtgaataaaacagacgtggttctctctcatggagcttcttctagtctaggactgagacaaaataattaaacaaactatcaggtagctattgctgtgtgacaatcaaccagaaaaatagagcaacattcagcaagtgttcattgttcatgcatgtggggtcatctgtgtggctctgtggatcttggctgggtccactcatctgtctaggagtgttgcagtggcctaggctgagatgagtgagatgagttttctctgcttcatgtacctctcttctcccagcagtcttgcctaggcagaatcccatgctgaagactgaattgcaagggagcaagtagaaacacacaaggcttcacatagtctcttctactttattttattggccaaagaaagtcataaagccagcctagattcaaggggcaaggaaatagactctacctctttagtgagagaaatttcaaagtctcatggcgaaagatggatgaaatttcaaagtctcgttgcaaaagacagggaaagttgaagaatgagggccattgttgtaattaacaacacaaatgcctgcccaaggattataaaggaaattaatgtggtactgggataggaaagatgggatgtgtgtaggctatgcccctgctaggtggtgacagagaagcagggaatgagaaagagttggccataagagcatgtggaccaggcagggagaacgttctggggagagagggctgtgtgggcaaaggctcagagctgggaagtagctcagagtgaaccgaaaggccaggtgagtgaagcctgctgggtgagggggaaactgtgcaagatgagtttagagagtgggcaggggccagatcattgatgaccttcaaggctgttctaaggagtctgtggtcactggtttcatgttagcaaaatgattctagcccagaagagggacacttacactttccatttgcactggttgcagaccagtttccactctgaaagtgcatggagggatatgctttgctcatctctcttctggagaatcttggagtcttcccactctggaaggtaccccaagtagaaatgtaaaccattgtaaactgggtgacacgagaggagggactgtatttatctcattcattacttggagcctgattcctgacacccagggggttctgcaccaacatgaatgacatgagtggatgaatgaatgaaagaatgaatgaatgaatgaaaagagccctggatttggagaaagcctcctggttcctgttcctggctctagcactagtcatgtagccttggacaagtcacttaacctctctacatccttatttgtgaaatgaggtatcaggaccagctctaaacttctctaaacagactttgtgaattccgactgggaacccgggctggggcatccattttacttgaagatttggaatgggaggaaaattaggtaatttctaaaagtttcacattaaaataatcatgaaaatattatgaaatagaatgtaaaatgtacatgaatttttaaagatacaatttgagacatcaaaggcattttgtgcttggctgtggcaggctcaggcccctgccctccaacttctgggggaacgtgttttcgggctctcctgctgtgtggcctacttttatgggaacatttgagaagcatgaaaccagagaatatttgctgtcccttttggttactccatatgagctgagatgacatacccagcagcctggtggtgagggtggtggtgagcatgttgttgagggtggtggtgagtgtggtggtgagggtggtggtgagtgtggtggtgagggtggtggtgtgggcatcgcatgcattgtggcttctacagggcacagattgtgtcttgttcatctttggctcaggtatctcttgtctcactcgccacaggtttgtgctccagttatctctcattctcccacaggctactatgtgctctgtgtcaggctcatacggggactccttgtgtattgatggaagcctgctcaagttgagacacacaggatctcacaatctaatgagagacacagcacgtaaacaaagcagatgagcattctttattaaatgaatgaggacatgagcgtctcaacactatctgtctagaggaaggaatataaatggcttcatggctaaatggcagcatttatgcttcatagatgtattttatttatgtatttatttattttttgtttgagacagggtcttgctctgttgcccaggctggagtgcagtggtgcaatcatggctcactgcagccttgacctcccaggctctagcaattcgctcatctcagcttcccaggtagctgggactataggtgtgcgccaccaggcttggctaattttttgtattttttgtacagattgggtttcgccatgttgaccaggctggtcttgatttcctgggctcaagtgatgcaccaacctcagcctcccaaagtgctgggattataggcatgaacaattgcacctgccccatagatatattttaaagaccttttttgtgtaagaatctgtggtgagtgctatggtggatacaaaaatgaacaaaatggtctctgccctcaaggggctgacaaggtgcatggatgcaaacagctgtagccggaggcaggatgcagtcgagactggatgatgatcaaggatgatgattgttgattgagaccacaagctggaggaacccagaggtgggagagaattgtttggctgggggatcatgataaggtttttggaggaggcgtgcttgaggtatgtctcaaaggagagtagggtgtcatcagatagagattgggaagtgggcactgcagggcatgtgggcagagcccaggcacggctactgctggcctctaggcagcttattgggtcaggaaaaggtgctccctccaagtaggtgtccttataacacctggctggatttcagtcccaccttgcccctcagccaggtgcccctgagcagcacacagcttgcataaccatttggtggccctgagcacagggtccaggaagcaaagctgggagggtgctaggttgaagatgtatcatggaaggctggaatgtggactcgttactgcagtctcataagcgccactccccatccacccctggctgatttagatgccccttctctggctctccttccattctgctcatacctctgtctgtgaatgctgcactgtatcgaaacattgtttatgtgtctttttctctcactgggctgtaaaactccttaaaaaggagagttagtgtcttgtggggttttgtgtctcagggctagacacagcatgggcttgcagttcgtatgctggatgtctgaagagcttcagcacactggaaatcaggagctgaggagtgaagacgagttaagaagtggttgctgtggtctctgtcaagaggaaggtgtggattaggagggtggtggtgggttcagaggaaagaagagagatgctggaggcaggtggataggacccgattgaaatggggtgatgtgggggaagaaattaaagaagacccagagattttgatcctcctaagacaagggtgatgttaagaaaggtattgattatgaaagaggactggattttgtgttagcagttggggaggcaccagggaggtttggagtcccagacgaaaatgtgtacaccattcatgtaatcaacatttacggagtttctctttctttctttctttctctatctttctttcgttctttcgttctttctttctttctttctttctttctttctttctttctttctttctttctttctttttttttgttttgagacagagtctcaggctggagtgcagtggcaccatcctggctcaatacaacctcagccttccaagttcaagccattcccctgcctcagcctcccaagttcaagccattcccctgcctcagcctccccagtagctgggattacaggcacccaccaccacgcctggctaatttttgtattttcagtagagacagggtttcaccatgttggccaggctggtctcgaacacctgacctcaagtgatccgctggcctcggcctcccaaagtgctgggattacaggtgtgagccactgcgcctggccttggagctcttatgtaccagacactgggagcctgcaaagcccctcaaggagttccagactaggaaagagacagacacactgtacaactcactgacacagagggtatcaggactcatagcggagcaagcagaacagaaggagaatgtcaaggaggaagtgatggatcctatctggaggcatcggggaaactggacctcaaagattgagtataattttccaagtggaaggcagagagctgtggttaataattatagttcccccttcttccagaagggatttgaggcagctcataatactataatactatatgatggaatgtctaaaatgatagattgaaaactaattttagacagtagtttgtacacagtgaaccgtggatgactgggttatcaaaactgaatgttacattttttttaagcattaaattttgctctgaaattcctgacaactaccaagcaaacagagagacagattggttttagaattttactgtgtctggttgggtgcagtggctcacgcctgtaatcccagcactttgggaggcggaggcgggctggtcatgaggtcaggaaatcgaagcatcctggctaacccagtgaaaccctgtctctactaaaaatacaaaaattagccgggcgtggtggcaggcgcctgtagtcccagctactcaggcggctgagacaggagaatcgcttgaacccgggaggcagaagttgcagcgagctgagatcgcgccactgcacttcagcctgggcaacgattttacagtgtcatgaagtcaagcattcaagtccttttttacctggatcctccccctactcctaagtcccaacacgaggttgaaaatgtgcttctggtgagggagatttctaatccattcctgttctaggcataacggatgcagaactgaataagatcatcaagtcttatttcatcgagtttgcattttagctgggggtgcggggacaggcagtagataataaataagtgctctgaaggaaaggaaagtaggttcgagtaactctgaattaaggaaggggagtaattttagatgggttcattgatccagaattgactgttgaagatgtgacagtggatggaacttgagggccagagagtggatggagagagaaaagaaggctaagagggaagcttggacgaggccacattttaaaggtgtaagaggagagagaagagttaagaacggagtggcagagctgttaggacgcctccctgagaagatgggtgggggatacgggtgggtggccagcagcgttgagcagagacagtgcctactggatagtccctgggcacccttccacttcccagccaccctgcaattagctggggccacatgtctagttgtggccaatagacatgggctctgctgaggtggatcagagcatggggctccacctccatctcatcccctgctgtggacctgggagtccctcctggcccacacaggactttatgtgaacaaaaaaccagacctttattataagaagtcacagagagtttggagttgctgtagcatagcccatcctgccgtgccgaatcaagaagttgagcatgtcaaggactggcagaggccactggatttagcagtaaggaaatcactggggattttgagtgggtgatttcagcagaatagtgaaggaagaagtcacttttgtgggaataaaggagaagatgttggaagtaaggagagtgagctgtgtgtgtagattaccatttcaagtagtttgggaggaaggcgagagatatagtggtaacttagataatggagggttgagaggaggcatttccaaaggacagcgtgaggtgggggtgtttgccaaatgaggggatgatcctggggaggtggggagataaaataaagaataattgataagagaaagcctggaaaaaattggaggggatcagaccaaagccaagattggttttggagaggaatagtttactctctgatgttgcaactcagagagatttggaagtggaagggaaggaagctgaaggctaagttaaggtaagatcaattttaatgattagggaatatttgaggcatttgctgagagcattgcaggaggagggcagtgtggctacagaagcaaggccatgtgactgcaggagaagtccctgaagtgttgaaccaaacaagtgcttgacaatcactgtgaggcagtgatgatggatgctgaaccaaacagttgagtagaaggttgtcaagctaggagagggaagaagtgtctcctctccttatatggaagtttctgtatgttcaaaggtggcatagagagagatgtacattccatgatactccttggtcagccaagcagccattcaggaaaactttggaattcccagcaactttgtcaatgggaaatgctgtgggatggccacgggaaagagggaggtgttgtcttccagcagtcattgactactttcgatgcagaactttaagaaacccgcttgctatcagcttccagtcagaacagcacttgtaaagggttgatccttaaacatcgctaaatgaacacatctctgtcttgtggttccaggaattttaatccttgaagctagatggtatgagaacagctttttttctgaagccaggcttgaatggtaggggaaggaatgtggactttggggttaggcagacatagttttgatattttagctgggtggctttgaccttcaacctgtctgaagttatcatttctcttagaatgttattgatagtagagagtgtctggcttagggtggatgctcagaaatagctctctctctctttcctccccctttctttctgtcctcttctctcactctctctttcttgctcactctcttgcttcttgtaatctgccaaggctgggatccagagttccagcttctgtgaatagaggggtcaggctctgataacagttttcctctatctgttatgaccactcaacattcaacagagatattcagcacctgttacatgcccagcatcctgctaagtgcttgggatcaccagtgagcaagagagacacccttgcggcatttgctgttcaacaggagagacaattaaaccaaatggtgtgatattatagggaagccacataatgttttgggaagggttggcaaggactgctagcctggtgaaggcagtggagacttggggagatcagcagaggctaaagcagaggggtgggcagggccaggcagggcagttcgttggtgatcaggaccagtggccaaccgggaccatccatcctggaaagctctatgcagctcctagggactcagggctgtgtgcatttgtgtggcttcaccatgatctcaactccaggtatcagctcttttccaccttgcacctccctctccccaacatcagtgtatgccagtgctctgctttccaaccctggagtccaccaggaaattctcatgtttggtagtgaagggactgcaggttctgagggcttgcaagcatctgtggctgctgctattgttccagcaggtggcagcttctcctgctaatgtttaaactatgtgtcccacagggcccgttgaaatcccaaatagcataaaaaataaacatttatttggacaatattaacgatatatttaaatcactatgaaaatctctattatgccgtgtccttagacacctttgaattccttaatgttatattttaaacaacttaacaaacccctctatccatggggtgcatagcttgtgctaggatataagttattctgtaagtacaaggatttcctttatagagttccattttccaacttgacttttagagaaaaggctgctttcattgtgaatattaagtaaaaatataagggccagggacaaaatatgagtaaagacctaagacaattcttggcctattataagccctcaacgaacactagctgctatcatcatcatcaccaccatcatcattgtcaccaccttcatcgccatcactatcaccattatcaccatcaccaccatcaccatcactatcaccatcataccatcatcaccatcatcatcatcactatcatcatcaccatcaccaccatatcattattattatcatcaccgccatcctcaccatcaccatcaccattaatacacaatcatcatcatcatcactatcatcatcaccatcaacatcaccaccactaccatcatcaccatcatcaccatatcattattattatcatcaccaccatcctcaccatcaccatcaccattaatacaccatcatcaccatcatcacctagtagcttcagtcttagagtaagcttgtgctttcttctagctgttggtgttgtccaatatagtaaatcattattctttatttaaggcatttcctgagagatatttaaaacattgtcatctcaaaccatctatcttctctgttctttgagaattttgcagtgcggtcctccagctctccagagaacgttaggatatatttgaggggaggagggggagaagttgatgtcatgtcctctgtctgcagcttctaggagaggactgaccagcaacagtgtagtgactggtcaatcctgtagtctggagtttcatggctgaagtaagggtcgttgctaactgagaaggtcttgtgctagactgtgtcaaatgggatgaccagtatggggtcatgccatgtgttcacccatggcagagttttccccatggggctaactttgcacatttgcttgggggcggtggggaaggggagagtgggaaggcactggaagaggggactttgcacactgcatgctgcacctaaatgtggccctctgctcacctttctgctcccaggaagtgggagttcaggtggccccaaggtctctttcaaattctcaaccacattccgaggacagaaaatgaatttcatctctatgcactacctgctttgccattcattaaaatgcctgtgattgtgttctcatgttaacatacctgtttcatttcatgctcctttactcccttctcttggttcccttgtacaataaaacagcagcatgaaacaaaacaatgctaagctctccttcactgtgtctctgtggtgtcacatttctttgccatgtgtcatgcatgccactgctttgctgcctcacaccaatggtaggtggggcatgggctggaggggctgggtctccaagcagagccccaggctccatgggagggaccaaggtggggaattgtgggaacgggtggaaaagacatctgcttagattgtccaggaccagtaaagctaatggtcatttgcccagaagaaaggaccatctcaggccaggtaagtggccatcttcctcgcctgtctgtcattcatcccagaaaagagaagatgctaggggaggagtggagccagagatggaccgagagaggtaggagggtgggaggagggcacagagttgggggagggcatatagagaggctgatctggtcacaaactttgagttttgtcaagttgcatcatatccatgaacctcagttgtcttatctgtatagtgggatgatagaagtttatcacaaattctgaggaagtggaatggaagttaattctgtatctctcttgacaaagccgagttcctagttttggtatttttggatggcaatgtgaatcagcaaggaaagcaaggccctttgggtcacacagacctggcctcaggttctcatttagtcactgcttcagttttctattgctgcataacaatgaccacaagcaccagccaggtatgagctcagttttccaggagacatttggctgatgtcttgttcaaggggctgtaagggaattccataaactagggaacttatcaacaacaaacacttcccgcggttctgaaggctgggatgtccacgatggaggccccaacagattcggggtctggtggagtcccactttgtggttcatagatggagtctcttcactgtgtcttcccacggtggaagggccaacctagtgccctggggtctatttcataaggatactgatccttttcacaagggctctgccctcatgactaatcacctcccaaagaccccgcttcctaatactatcacctgcaaggggaaggccttcaacatatacattttgtggaggacacaaatcttagacagcgcagctgggttctcagctcagggtctcacattcaaggtgtcagccaggctgacggggttctcatctggatgcttctaagaagaatctgcttccaagctcatttgggttgctggcaggattcagttcctcgtttaagactcaggtcactgtcttcttgctggccatcagctgggagctgctctcagcagctgggggccacctgcattccttgagatgtgccccctccatcttcaaagccagccatggagaccttctccccagttgaatccttgccaagcttccgatctctctgccttctgcctctggcctctagactcagatggaaagggctcctgtgaccagctggagctcacccagacactccccctttttaaaagtcagctatgcctcatcacatagcctgactgggagtgactaccccatcacatttatggttcacgtgtacactcaaggacaggggtgggaatcctacatgccacagtcactgtgattctacatgccacagtcactgactagtcatgagagctggtaaagggtaatgagcccctgtgggcctcaatgttctgttctctaaaatggggtggttatagataagcaaagtacctagcatgtagtagatacttgatacatctacgagccacccttttccacctaacagttgtctcccaagcccctaatcaaggcccagctttccctgctgtacattctttgcagaatgtgtcctaagtagagttgcacctccctatagaagggaaggggttagaagcttagtgcagagtcccttaagcttacagggcagaataatctcagatgtcagctagaaatgctttccttcagtcgcacccccctgatattctccttcagtggggctgtggtggggccaggttctgcctttgtactaagcaccctgagtgattctgatgtggccgatctgtagaccacaccgaggcatcccgcgagcgatgactgcgccgactccgagtcagccagttgggtttcaaagtctgagcccactgttcctggcagggtgtccctggaggaatggctggacttctcttagtgtcctcatctgtaaaatggggataataacagttgcctcactgggtggctctgtggagcatgcaataatccacaatagtggatttgcaattacagtaataattgcaattataatagttattgcaaatgcaataattcatgattattgagtaaagtgctcagtccagggcctcacatttgctgtgttctcactgtgaattaatgatgtgattgttattactataataaccccatggccctgggcgtgggcctggcttttgctctgccaccctgtgggattctgggcagtgagggggaatgatgggctctgagctgctgtttgggaacagaatctcgtttgaacttcagggagctggtgggaaggaatgagacaagccctccatgccctcctggccctgccctcagtggcccctggcctttcttcccccaccagagctgttcttgggtgcgcctgcccttccctgttcaggctgggacctgcccatgcaggtgatctgaaagccaggccaccctctgcaggagccacctgctcagggaccagggctacctccttcagcccgggggcagtgcccagatcccggggtcagccagctctcactgagcagggcaactatgtggctgtgctgtgtgttaggccttttgtgctctgactgtcctggagcccctcacctccttctcgaggaccagagcatccccagcttgttcatgccaggcttttttttttttttttaagatggagttttgctctgtcacccaggctggagtgcagtgacgcgatctcggctcactgcaatctatgcctcccgggttcaagtgatcctcctgcctcagcctcctgagtagctgggattacaggcacccaccaccacatccagctattttttttttttgtatttttagtagagatggggtttcttcatgttggccaggctggtctcgaactcctgacctcaggttatccacccgcctcagcttcccaaagtgctgggattacaggggtgagccaccatgctgggcttcatgccaggctttgatgtggcttgggccacagcaggcctttaggagggaatccagcaaacccaggcccatgggccagtgtgttccgccatgggaaaagtggtgatagcagacaggctcactgaaaattccgattttaatttccttttgtctgctttcaggcaactttgggctgtaaatgccagatttacccctcctggcctatgctctgggggctggggccatggtggcccaggaaggttgagatacttcccctttctccactgaacacctcctcgccatgtattcctgtttccttctccccagcctggcctggttccacattcaacctttcttcctgaccaccccggctctgcctgaggggagatctgggaaggtgctgggcctagaccaccccaaaagggtggtcactgtggatactgggcagggctcagagcaaggaggggcctcaggcccggagcagtcaggaaggcatgagctgggacttcttctgtcacctccacttatcagctaaaagtgttttaaatgcctccagacctgaggttggggcccaaggatggagaaggcagggcatgggctgtggcaggtactatgcattgctcatttggggactggagttgaggggtgatcgggaatgcagcctggccatactccagcatccttggcctggaagaaggtcagttcatgtcccgggatacaactgcttagccctgggactgtgaccagggctgggcgacaggcaggtccctggacaggaggcctctgtgtggctgtgccattgtcataggtagctttggacaccgttcccagctccctaggaggcagccatatcaggcccgcactcttgtcgctggaaggggactaagttagcagaggacagcccaggggccctgctggctggggccatgcaactcaccactgagctctctcctttccttctctacagccgggccagcacatggctcccagcccccatctgaccgtgtacaccgggacctgcatgcccccgtctccttctagccccttctcctcctcctgccgctcccccaggaagcctttcgcctcacccagccgcttcatccggcgacccagcaccaccatctgcccctcacccatcagagtggccttggagagctcatcgggcttggagcagaaaggggagtgcagcgggtccatggccccccgtgggccctctgtcaccgagagcagcgaggcctccctcgacacctcctggcctcgcagccggcccagggcccctcctaaggcccgcatggctctgtccttcagcaggtttctgagacgaggctgtctggcctcacctgtctttgccaggctctcacccaagtgccctgctgtgtcccacgggagggtgcagcccctgggggacgtgggccagcagctgccacgattgaaatccaagagagtagcaaagtaagaacccgaaggggacgtgccgtatgcatgggtggctgtgggtgtgcaggcctctgcatgtgaatatgcatgctttgggctggggactgggatgggtgagaacagataccccaggcagcccactcagatcccttggccactggaagatattcagaaactcagttttgtcctctgctgtcctcccgagggagaaggaacaggtgtccttctttttcatcttccaaatcttttccatttttccaaatctcttttccccttatatgttcttccactcacattgtcccatcccaagaccgttattagtctaagaaacccattgcatctgtaaagagcaggaaagattggtggcagcagtgggagctgcaggtgttgggatgccctgggcatgcttctgggtgctccagcccctccctcaccataagtgcccttgcctcccttcccccaccctaaggaaaccttcccaccctcctctgcatccattggcacagtctcttagagggactttcagggagccttgttctggcagtcatttctgtgaaaatgaaagtgcgtagcctttgcctgagggggggcccctctaaacttcattttgggtggtcctgcaagcctgatctctgagaacccccagttccctgagacaggccagagggggcagaactaaggctctgaggagtgctccataacgcctggatcagagcagaaagaaaacttgtgagcgatgcaacacagagaatcagctcctacacttactgagttttgggggagacagtcaggggcacccctgcaccaatcaacatgtgtttggcctcgtctgggcttggagaagaaagcaccatgcagaagtcttaggttgccagggatacccggggacagccaggcagaggttgttatccctcctgcctgtgtcgcttagggggagagggaggagcaggtgactctagttgccttaggagaagggtcagaatcctgtgtgagtgtgtctattgatttttcccaacaggccctgcagagggaatattccagctttggggccgctgctatgcctcatacatgggcttgggactttaaaaggctctcttctcaagggccactacttcctcagaaggcagttttttgtttgtctgggtgtttttttttttttgagatggagttttgctctgtagtccaagctggagtgcagtggtgtaatcttggctcactgcagtgtccgtctcccaggttccagcaattctcctgcctcagcctcccaggtagctgaaatcacaggcacatgccaccacgcccggctaatttttttgtatttttagtagagacggggtttcgccattttggccaggctggtctcgaactcctgacctcaggcgatccgcctgtctcagcctctcaaagtgctaagattacaggcatgagccacagtgcccagcacccatgaagtcagtttaaaggggttgatgactaagtcctggtatgtcctacagggacctcctgaatccatcaaaaccacagggatccgagcacctcaaaaatgaaaacaaagcaccttcagaattatttttcattcaaaatgaaaatatgaatccccaataaaaagattccaccaagccaatcactgcacacacaacctttgtagtcaaatgctctacccctgagctatacctgcccccaccacagtctttggcaaatgcacctggtatgttcatcttcaaggatgtcaggatgatttggggaggtgcagtccctcctgcccctgcccctacattactggctttcctcttgcacctgaagctttttccagatcaaaatggatgtgcccacggggagcgggacctgcttgatggactcggaggatgctggaacaggagagtcgggtgaccgggccacagaaaaggaggtcatctgcccctgggagagcctgtaaggaaagaggcaggctgagctgggggctctggaccaggaagatgctctgacagatgccatggtatgggccacaggacacacttgctcgagaaccaaagtgcatttgggtgacatttgaagattggggagacaagatggggtagattgtggcaaagaatgctctggctggttaccaggggccaactccttctcctcttcctgaccctccctcccctgggcagaagaaacgcatgtggaccagaagactttccctgctgccttaaaaccaataaaaggttaactttaagtttcttggaatgttagtgtgtgtctggttttgttagtaatttgtgagctattatttatgagttaaactcacgtcttcttcaatcttctggacaaagggacattgagtcgcttccaagagctctctccttgtctaaatgggtttgtgcacaatgcttttctcatcagcagagctccccaggggatgccccggggcatggcatctcacaggaatggacagagggctgggagcaggcacactcctaaaatgccaggtgtgttgcctcaggtcctccaagaagcagacaccaaggtgagattcgatggacaagagatttgttggggaaaacacctgtggtagataaaggaagggccagagctggagaaagttgaagttgagtgttgagggggttcggggcggggggcagtccagaccgtgctgcaagtctgacctctgggcagggagagtcttagatggcagtgcagtccaagaaagttttgaacaggctgctggggtgtcctttatgcagtccaagaaagttttggccaggctgctggggtgtcctttgtgcagtccaagaaagttttgaccaggctgctggggtgtccttgagccaaagtcattgctggagagggcctgcatctctgggaacggccctgcattcgtacccccacggtgcatggtcatgtgctgggagatcccgtggaaagcctgaccttggcatggatatgctggtggatcctgagctgcagcagcttggccatcagcccgcgtgctccctgcagttggagatctgagtgctccttttcacttccgctgcactaggccagtgggaaattctagaggtttgggctttggtgtgctcctcccacctcccctcctagttactcactcaacatgtgtttattgagtccctactatgtgccagacgctatgacaggcgctggggatgttgctgtgagtaggactccttgtctcatggaattcatccgggacagtgtttctccaccaggtcaatgttgccctctagggaacaccggtcagtgtttggagacatttttggttatcaagactgcggcagtgggtgggggttgctactggtgtctagcaggtaaaggccagggacgctgctaagtatcctacaatgcacagaagctcccacaacagaagattatcagttcaaaccaccagtggtgccactgttgagaaaccccgcactagagattacagcgtatgtacttgtccctggtttctgcgcatgctctgaagtattgccccaaacggcactgctgggatcataattagattggacagcgggttgcgattaagggctacgcggtgaataaaacagctcttaaaagttgcataggaagtcctcacaggagaaaaaaatcaagtggtttgccaaaccactcattatacccctcccctttagccctcaacttcctcagaattcaattagtagataagagcccctgacttgcttttaacctctgacaacttatttagcccataaatactggggttgctgactcatctctgcacacttctacaaatgaatgttgggtgggtgcatggctgaaacctagatttgctaatccccgtagggaaaacacagagcttcaatacttaaagaccattgctcattgtagattttactgaatctattccactgggctcacaagagtcactcacaaagggctaagaaaaattttcccccagaatgtaagtgagagagtctggtcctttcttggaagagtgagtgagctgttaacctgatgcctttatttgcaatgctgatctaaaatgagatgaaaggcgaagcaatccacacccttagtttactaccagccaatgtcaagaaataaggagaatctcaaccctaggtttgtatatcagtgtttaagggttcctctcctaagcccccagggtcctaaagagaaactaagcccacatggaaactaagatccacatggatagagcgtcaatgacagaaggctccagaatccactggttgg

SEQ ID NO: 12292 - DNA, 38954 bp, Human
tggttatccttttttagcacctagagcaagtgcaaatacgtgtgcaatgtcagaaggatgggcagcccactcagtagctgatgggcatttgtccattattgctgccaggccctgtggatctgtgttcatgaccatatgttcattataaataatgaaatcaccatcatgacatggctgagagatctttaaacctgaacaaacaattacaaatacaaacccacacacaccatgtctgagcatccatggatggtgtggacaatgagcaggcatccatggactagaggacattcaccaagagggacagatggtgaccactgttcttcaagaacactacagtcagtcataggccctgtcacccaagccacttctgtttcctgctcagagaaaagcagctacagtgtagcacctgggctagttatttgaaaagcaaaggagtcactccccctttgctccacttgcccgccttccccatgcttatttcccttaagagttttaatgaaaggttattcaacatcagcatacgcagagagtcacaaaatgactcattttaaaatacatcactttattgagtcagtatcatgtacatgagggaaggttcacctttttacatctacagttctatgaattctgacaaatgcatgtagtcatgcaaccaccaccacaatcacgacatagaccatctccatcactgtaaaatgttccttcctgctcctttgtagtcaattgtcttccccacctgagcccctggcaacaactgatctgttctctatccctatagcttggcctttcccagaatgtcacataaacggaatcatactgtatgtagttgtttggatctggcttctttcacttagcataatggcatgtttttgcatgtatcacttgcttgttcctttttattgctaaatagtgtttttttttctttgcctcgttgtattagaatttgtttatccattcaccagttgagtgacagatggattatttctggttttgagaaactatgaataaaactgctgtcaacactcactgtgggtttctgtagtgacagagctttgtggacataagttttcacttctcttgggtaactaggagtgggactgctggattgtgtaagtgtcttagactgttccagctgctataacaaaataccgtaggctaggtggcttataaacagtagaaatgtatttctcacaatcctggaggctaagtccaaaatcagggtgccagcctggccgagttgtggtgagggccctcttctgggttgcagactggcaaagtcctgctgtaccctcacatggcagaagggcaagacagctctctgggcctcttttatgaggacactaattccattcatgagggctcctcccacctcatggccccacctcctaataccatcttcttggtgattaggtttcaaaatatgaatttgggaagacacggacattcagaccacagcatgtgtgtttacaacacagcaatgcatggaagagccaatggctccgcatccccccggcatttggtgttggccacagactgactctataagcagtttaaaatagttgctaatgataagaagtttgttttatttgtttgttttcctaaaagcacagcttctataggttttagatctatccaaagaagttaataatgagataaagtatgcttctgggtaattgcactcttacatgatgactttttccctcttatcatttaattaagacttttacaatcaacatccttgataccaaagcagtaggtaggatagcaattggttctgtgttcaagaagtgtttttaaacattcaaatgagcttgcattgtcattaaaagaaagctttccacttcttagtgctgttttgaaatgaatgtaaagattcctgtgctctgggaaaaagcaaacccataattagaacaatggcagccttggactgttctcatttctcttccaggaaatggttttttaaaagttattggtctacatgatgcatatggattatcttctttcagaatgacgcacagccaatttagaatactgagttgccccaaatttccctataactcccttcactgcccaatccaaccgattttgttttctactcagtacaaacatgctacaaactaattttaaatcattagcattgtccaaatggaacataattagagaattaacactgttacaaaaataattacgtaaaccaatataaagactagtactcatagcttcaggtgttcactgtgtttggagcgtcagttttacagttcttcattcgcctaggaaattgaaaataaaatgtgttcgttcagcaacagtgtgacagcggaagacacagaggaggagagccacttggggtaggactcctctgccctctttggcctgttgtccagcagcggttcacaagccaagtcaacactatttgtaaactcagcactttacaaacaaaacacagagacttctgtgcaggcttttgctaattgtccttagcagcattgttgaatgtttgaattatcagatagaccggggctgtgggcttagtttccctagaatggcttctagatgtctctcttgaggtcctcaggcctgagggctgtgcagggaagaatgagaagctgtgatttaggtccttgattggaaactactgaagccccatagaaacagaaaggtaaaagatgaaaactttgcaggacgcagtactgttcactatagcctccaggattccagcaaaattatttgtgtcctcaatgattgaccccaaataaaagagaacagtaggaggagagaatgggactaacattagttaaacttaactactatgtgctgatcattgcactagagtctgtttcataaattttcaaatttaatcctatcagccatcttatgaatgagatatgatctcccacaggtacttatagctggggaacctggaggtcagagaggttaagtaacttgctcatgttgctattgtagtggccaaactcaaagtccctccagacctgactccaaagcttgttctcttcccactaccccacaatagcctccccaaagacctgacagcattccttaaaaatcctaccctcaccagcattgccaagaaaatccaagatgcccagttaaattctcagataaagagctagtactttcttagtatttatatgtctcaaatattgcataggacctacatatatactaacagtcatcctttgcttatcctaaattcgaacttaactgggcatcctgtagttttatttgctaaatctagcagcctagccctcactgacgctttctggccacatgatggtgatgtcaatgttctgaagtttgctcttcattattaaatcattcaaaaaagagttcttcccattttgagggatggtggagtgatgaggaagtgttctaagggaggggtccatttgagcataaccatgtgtgagaaaataacaggcacttccttctttatggatcactgcactggaataggctggaaagtgctgggctggctgggtagatttgcatgatgcccaggtgtctaatgcagaactttccaaagtgtgttttgtggagccccagttcatgagctacatattttgtggacacgtaactttaggagaggctatgaatggcactccccttggagaatatcccctgggcatgctctggtattagagaaagcctagagaagagactgtattaattctctagaccttagaccttatcagtctccctggagacaacaggtggagcccccttcctgtgggaggacaagaaacccagtgctgacttgggtcccattctcaggctgtttctgagactcttcaagccatgtttacaggttcttttttattctggggcccttggtacagagttgagtcaaaagtgctcagttgccagcacagagcctctgtggtctgtaaatcctcagcagtgtcaatcctataaatcccgggctgggctgcactccaccttccctacttcacccttgccaccttgtcacctgcttctccaggctgctgtgctcttccatgctgattcacaccctgcttcctgtttacccttccccagcacagaaaaggcaaatagcactggacagcccacaactctagagtcagcagcatctctgtctggccgtggggtgctggtaaacatttagccacctgctggaggggctgagccctagcgtttgcaattcctgtgatttcaagctcccggctgtgatgttattgaatggagttgggaagagatgcacaatagcacatgtttatattgtattttcctcggactggtgcaatagacctcaagagcactgatgagagaaaatgtagtaaaataattatcaagcaatgaactctgagtatttatgacctctgtttttaatataatttatttaattgtaaacgtatataatttagttttaatttaatttttttttagagacaaggtctcactctgtcacccaagctggggtgcagtgatgcaatcatggctcactgcagcctccaactcctgggctcaaggaatcctcctgcctcagcctttcgagcaggtgtgtgccaccaccatccctgagcccaacgtcaatcattctttttgaattttttgtagaaacagggactttctctcccacccaggctggtcttgaactcctggcctcaagcaatcctcctgcctcggcctcccaaagttctggaattataggcgtgagctgccacacccagcctataatttagttttaaatgatggccatgtttatcaaccagcttgcaaaattcctgaaaattttacaatcggctcttacaagtccatagagctagttccagcacactactgtgagtttcagggtagacctctccttagccttcagctgggctccaaattgcagggcctgtaacttccatccatcacccacttctcccatctccaccacaagcaatgggaatgtacttgaaaccatgtttaccctactcggaaacgacgcccaactccttcccctgaaaaactctgcaagatgcaaacctgccacttgtgaagatcagccttgagattatcacacaggtccctttatcttgagccaccatcattcagaacagaatagttgcttcactttgcataaacaaaagggcaatcatgtatttttctcaaagcaaaagaatagtctgctcccaaaggtgaattctagtttctagctgaaagtcagcacagtggagaaccactgaagctttggaatttggggtgacctttccccagctcccaggatttcaaggatttcagcatccagtcttagataggactccaagtccctgtcctccatccctgctgaagaaaagcttttcccagacatatagcctaccatgggtgttgtgttggtttttttgtttgtttgtttgtttttgttttattgttttttggagacagagtctccctccgtcgcccagattggagtgcagtggcacgatcccggctcactgcaacctcctaccaggttctagcgattctcctgcctcagcctcccgagtagctgagattacaggcacacgccaccaagcccagctaatttttgtatttttagcagaggcggggtttcgctatgttggccaggctggtctcaaactcctggcctcaagtgatctgcccacctcgacttcccaaagtgttgggaatacaggtgtgagccaccgcaccgggccaaaggtattatggttaaattgtgtcccctccccaaaaaatacgttgaagtcctaaccctggcacctgtgaacgtgaccttattttgaaatagaatgtttgtaggtataatcaagttaagatgaggtcataccggattagtatgggccctaaattgaatgatgtcctcacaaggagaggaagacacacagagggaagacagctgtgtgaagacagaggcagaaacaagattgatgtagtcacatgtaggactttgagcctcctaaactgtgagaaacccagtttttttttttagcttgttacagcagccctaaaaaactaatacatttgggtacctagctctgactgcaaagatctattactccctcccagaacttaaaaagattcagacaaaagaggataccactaggacagtggggtttctgctgtggtcccgcgtttgttctggaagtctcaggtttgccctctgaatccacactgtgtccttctctgtctgccctgctctgggccaaagctgacatacaatggaccacaccaacaggaccctctgcactctcgcttctggttgtgccactaggaggccgcagcaggagacaggagagagagagggaggccagggcatggattctgccagctccctcctgcaggtcagctgtagctgaagatcgcagctctcatcacgcttctcccagcttctctgtgtccaggttccactagcccctcccatcctggcctctagaatgaagggtggtaatgtacccactggccccagtgtcccctagtataccacactattcttcatgatttgcctaaaccctgtgtatgagtcttctcgggctaccataacaaaataccacagactggatggcttagatgaagaaatgtattctctcaaagttctagaggccgaagcccaagatcaagatgctgtcaggatccgtttctggtgtgggccatcttcctggcctgcaggtggccaccttctcattgtgtcctcacgtggccttgtctctgtgtgcatacactcctgctgtgtctcctcctctgcttatgtggacaccagacctattggactaaggtcccacccatatggcctcatttaaagtaaattatctccctaaagctctatcttcaaatacagtgacaatggagggtaggaattcaacatatgaattttgggaggacacaattcagtctatgacaccctgctcacatctcagttaagactgagacaaagtcttatgggcgggagttttcttgggaagtggagtgggggaccagggagtgtgaaattggggcggagggaacatcagtgcaacagcagagcaaccagcacttgatcccccaggaccttctgcagaagcacgaagattttgcatcagaactgcccacctgcaagatgggtggatttccgtaccccttcagtagaggctgtccagcggggaattaactctctgctggtttctggctgtacttgtgtcatctgtttagcatgagctcccatggcctccaagtctctacagtgtcagggaagtcccagggcaaagatgaaggcaaagtccatctggggtgagggatgttagcaccaagcaggtggggccccaaacttcactccacccatggctggagtcaaaggtggagcacagaggatcagagtcagaaacaagggcaggagatgcaagttcttttattaaattctcaaattacccaatttgtgtgggccatctctttcctacctggaccttgacacattcagaagtcaacaggacactgtccgaatgggttttggttagtaacttccttatagcgtctctcactgtggctcacccatctgtgttgttctcctcatccattcaggagatgagattttttttttttttttttttttttttgagacagagtctcactccatcgcccaggctggagtgcagtggcgcaatctcggctcactgcaagctccgcctccctggttcatgccatttcccagcctcagcctcccaagtagctgggactacaggcacccgccaccacgcccggctaattttttgtatttttagtagagacgggggtttcacggtgttagccaggatggtctcgatctcctgacctcgtgatccacccgcctcggcctcccaaagtgctgggattacaggcgtgagctaccgcgcccggctcaggggatgagatttttaatggcctctatttatgattttggagggtgaaggaaattggtctggagatgtcttgggccccagtgaaggagtttacaccttccaagatgtttgagaaccactttaccacaacacacctctgggatgtttcagtccgagcaaatgtcagcatttggtagcagcaggtgaacataagcaccatctacagggattagggaatcagaaggaaagtactttatagttgccaagataagaacataatttcctattagtttgcccccagtaaatagaaacagccagcagaaaatccctggccaaaagctcctttgctctatgccgacaaatttcatgatgtcccggaggatgtgaagaattgaggcaacgtccagcctaatgccactcacaggaaggcggggagggcggggtccagggggctcctgtctcttgtctttctcctgtgggctctactgctccaaaggacctggaagcctgtggaggaatcagctgaacctgaacctgttacataattaaccccctggttgttctgtcctgaccttgacttatcctttttctttctttttcttttcttttcttttctttttttttttttttttttttttttgagacagggcctcatgttgtcacccaggctggagtacagtggcaccatcttggctcacttggagccttgagctcccaggttcaagcctcagcctcccaagtagctgtgattacaggtgtgtgccaccacgcatggcaaatttttgtatttttagcagagatggggttttgcagtgttgcctaggctggtctcaaactcctgagttcccacctgccttgacttcccaatgtgccaggattacaggtgtgagccatcatgcccagctgacttgttcttgattttgtaactgatacaaatgtgaattcacctctattccaagtttattagtaaaggaagaaggaaaaataattcttccagaattcaggcctaagggcctaagggctaatcctgggttaatgcgcctgaggtgggtgttacaccttccatgccctcgcatgaatcagaccttccagtatttatggcctagaggagtcccttcccacactgatgctgggcttggccacgtgacttgctttggccaatgggtaccagcacaggtgacccaaggagaggcctgataagtacttgtacatgggggcctgacctttggggattctgtcaccaccatggaaaacacctgagccatcctgctggtgaggccccatggaacagcactgaggctccttggcctatagccctagaatgtgaatgaggccttagacctgtggtccccaacctttttggtaccacagatcggtttcatgggagacaatttttccacagatgggctgggggatggttttgggaagaaacctttccaccgcagatcatcaggcattccactctcataaggagccacaacctagatccctcacaggtgcagttcatagtagggttcgtgctcccgtggccctggtccgctgatctgacaggaggtggagctcaggcggtaatgtgtgctcacccaccactcacctgctgctgtgtagcctggctcctaacaggccgctggtaccagtccatggcccgggggttgtggacctctgccttagaccatgcagccctatatgagcctccaggttagactgcagcctcatgagtaaccctacctaagacttcacagctgagcccagacttgtaagtaaataatagaggccactctatgccactagctttggggtggtttgttattgagcaacgaccgagacatggctcttgatctggacttgcctccctcattcactgaagctgtaccctactgggctcttgccatgtactggactgagtgatgggcaggaggggcgcaaaggtggatgtgtgtgttccatcgagcaactcggggttcaaggaaacactgcagctcaagctgcaagcaaggtcctggggacccatccaggagttccattaatcctcagcgctgagagatcatgcaggcctttaagatctctaaggccctcttcctgcctccctggctgcctctcagtactgtttttatctctctgctgtgccaccccaggcatggagcccagtgggcttccattacccttcagcccccctgaaacctccccaaaggcagatgtgtgcataacagcccttaccacgggctcgtgacagtggttgtttggacctcaagatggcagttcctcggctcaggccccattgcttaaaggctttgccatcttggacaagttgcttacctcctccatgcttcccttcctcggctctaggccagggagcctcagtgcacttccatggggcctctccagcaggacagctcaggtgttttccatggcggtggcagaatccccatgggtgggttgggggggtggtgtggaatatggctagaacccctttcaaaatggccattgtaaggaatagatgagataaaccagatatttattaggcacccgagtgcctaatattcaacagtattacggccctgcagaaatacaaataacataaatgaatattatctgggcctccagtgctgggatttctcacagggtggatttctccacagcctgttatattttgtcacggccatgtcctttcccatcccccagccacttcatcctgaggccacacaattcagttttctgggctccttcgccccttccatgtgactcagttctgtgatttcaccagtagcggccgtgcagctcccaccagcccctgctcagctcttggccaaaggcaccagagtgctgagtgctccctgctcactggccgtccaccccagtgaccaagcaggtggggctgcgacacttctatcctctcttccctccctctagttggacctgagccgtcggaatttattttcccagagaaatgaatgatgcactgcccttcaagcagaagctgtgacagtcacttcaggtttttaaaataagagaattggccgggcgcggtggctcacgcccataatcccagcactttgggaggccgaggcgggcagattgcctgagctcaggagttcgagaccagcctgggcaacatggtgaaaccctgtctccactaaaatacaaaaaattagccaggcatggcggtgtgcacctatagtcccagctacttggaaggctaaggcaggagaattgcttgaacccaggaggcggaggttgcagtgagccaaggtcacaccactgcactccagcctgggtgacagagtgagactctgtctccaaaaaaaaaaaaatagataaataataaaataaaataagagaatttccactttcacctatgaacaatgccggccttctccctagtgtgatcagcacccactatcccaaggtcctccctggcaggacactggcaccacccttgcccacaccaccactgcacctccagctctctccccatccttgcctggtgaatgcagcctgtagagctcagaactggccaggtgtgaaagccagatacccgtgcagtcctcacatcctgcacactaatgcagactgtgtccctttttctgaggaaggaaattaaaactgggggaaggacagagaattcccattccaggagcctgggagctctgataggacccaattgatattgactgagatgaaagtggccacatcacctgaggcttgtctgcctggattttccccccattaaccagaaaagaaaggaacctaaagccttgtgataagaaaattcattttctataaagcaggcttcttggaggagatatatcaggacgtgatgtgaatgctgacaccctgacacagtcctgtgtggcttaaccacggggctggttctgagagatgccgcgttaggcgatttcatcgtggtgagaacatcatagagtgttctcacacaatcctaggtggtgcagcctaccagacacctaggttcgatggtacaccgcattgctcctaggctacaaacgtgtacagcatgctgctctgctgaatactgtaggccactgtgacatgatgggaagcatttttgtatctaagaatagaatagacacagtcgaaatacagtatgaaagacagaaaatgacccatctgtcttggagctggcaggactggaagttgctctggatgggccagtgagtgaggagtgaatgtggaggcctgggacgtcactctacgctgctgtagactttagaaacaagctacacttacttacactgcaccaactcttccaaaatattttcctttcttcaatgatcaattcatctttgtttactgtaatttttttacttaataagctttgaaattttttaacattttgactcttgtaataacacctagcttaaaacacaaacacactgtacaactgtgaaaaaatactttcttcatgttattgttctataagcttttttccttttaaacttttcttttttttttttttctttttttgagacagagtttcgctctcgttgtccaggctggagtgcaatggtgcgatctcagctcactgcaacctctgcctcctaggttcaaatgattctcctgcctcagcctcctgagtagctgggattacaggcatgcgccaccatgcctggctaattttgtatttttagtagggaaggggtttctccatgttggtcaggctggtctcaaactcccaacctcaggtgatctgcccgcctcggcctcccaaagtgctgggattacaagcatgagtcacagcgcccagccttaaaatttcttttttttcttttatttttactttttaaaccactggcagagccgcatcaccacaaacacgagaggaatgccttgcaccgagacgacattatgacaactatgacgtcactaggtgataggacttttccagcttcattataacctcatgggccatggttgtatctacagtctattgttgacccgcacgttgttttgtggcatgtgactatatttgcttaagaagccaatcatgccccatctccagacatgtatgaatttacctgacagcattcaggaaatatgttctattactatactttttctaaagcaaatcaaacatagttctgagactctgcttgacaaaggtagtgtgaattcacttcgtcgggttttggggtgccactctgcttccctcaagtactgtaagagtctgtccagaaattttggggaaaggtctttttggcattcagtccatcctggatgatgtatgaatcctcatgcattgtctcaggtcatgtggtcccttcgaaggtggactgccacgtcctttctgagcaaagcttggatgcaaagaccattagcctcatagcttagggcttggtctctgggtgtcccatgagaatcctgttattgacagggtgctgcaatggaaggggatggaaggagaaatccaccccacttgggcttgggaagtctaactgctctctttgaggccacaccactgctcacttcctaaagccccaggcccctgctcagtcatggtctcctgaaatgcccatgtccttggccctgaaacctgggagtgtaacttctatggcaaaagggactttgcagatgcaattaaattaatactcttaaaatggggagattatactggattatccaggtgcatcctaaatataatcacacgtatcctcagaagagggaggcagagagagatttgacttcggaagaggagaaggccgtgtgatgaaggaagcagagaatggaggatgcactttgaggatggaggaaggagccacaggcaaaagaaggttggagccttctggaagttagaaaaggtgaggaaatggattttaccctagagcttccagcaggaaccagccctgccacttcaaacttccagcctccagaactggaagatgatagagttgtgttgtgtcaagcaccatgtttgtgatgattagttataatggcaccaggaaactaacacagctcctttactccctggacaactgagctcttgggcctagactttttttttttttaacagatcgaagtgttgataagatgagaaaacccagccctctaggacccaaagactgggctgccttcttagagtgcagaaaggaaaataccttcatttctttcatcaatgacttcacggcaggaggtaagacatggttggtttctcaatcacgatatcctgtccctcaggaacatttgaagtcttagtcatcggggctcctggaaacctactgagactggaaagatgcagcactggcccataaagcttggggtcacacaggtctgtcaccaatgcttgaaaaacccgtccttggctggggggcctcggtcacctgcactagtagaaagtctgtggacccatttttcgtgaagaggagatctgctgaccttctataaacaattgcccaagtggaggcagggctcatcgagactcacccagcagaggaaaatgagtccaacactgcggctgggcaaagtgggactgagcatgggtagggagcagtgtgggcctgaggcgctctgcagggaggatgtgcaacgtggtgttctatccacatggggtgtgccttcaggctgtgcatgggcaggacagggctctccctccatactgtcaggctgcaaaatgtaggacattggtaggtaagaattccacttatttggggaaaatctatattccataatttctatgttactcatgctttattgtgccttcccaagatattttgtatttctaaggggtatggaaagagtccatcctctttagttttctcataaaaacactaggcaatcatccagttagacaagtacaattgtcccttggtatccatgagggattggttccaggacaccaaactccatggatgctcgagtcccttacagaaaatgatgtagtatttgcatataacctacacacatcctcccctatgctttaaattatctctagattgcttagcatacccagtacaatccaaatgctacatacgtagttgtcatactgtatcatttagggaataataacaaataaattctgtacatgttcaacacagacacaaccatccattcggtttcttccaagtatttttgattcctggttggttgaatccacagatgcagaacccagaacccacaacccacagatatagatggactgctgtctatcagtttcctactgctgccgtaacaaatgaccacaaacttcatggcttaaaacaacacaaatttatgatcttgtagttctggaggtcaaaagtctgaaactcacagggtgatatggtttggctgtgtccccacccaaatctcatcttgaattgtagctcccataattcccacgtgtcatgggagggaacaagtgggaggtaattgaatcatgggggcaggtctttcccaggctattcttgtgatagtgaataagtctcacaagagctgatggttttataaatgggaattcccctgcacaagctctcttgcctgccaccatgtaagacgtgcctttgttcctcctttgccttctgacatgattgtgaggcctccccagccatgtggaagtatgagtcaattaaacctctttcctttataaattacccagtctcaggtatgtctttattagcagtgtcagaatggactaatacactgggcaaagatcaagaagtcaggagggccacactccttctggaggctcagggagaatctgtctttcccatttgcagcttctagaggctgcctgggttccttggctccaggcctcttcctctgtttttgaaaccagcaatctcatcactccaacatccgcttctattacctcatgctctgagtctgcctctcctgcttctcgcttacttgcagggcttggataatccaggatagtctcccatctctagattattattattttttttagatggagtctcactcttgtcgcccaggctggagtgcaatggcgcaatcttggctcactgcaacctccacctcctgggttcaagcaattctcctgcctcagcctcccgagtagctgggattacaggctcctgccaccaagcctggctaactttattgatttttagtagagatggggtttcaccatgttggccaggctggtctcgaactcctgacctcagatgatccacccaccttggcctcctaaagtgctgggattagaggcgtgagccaccacgcctggcctcccatctctagattcttaatcacatctgcaaagttcttttttccaagtgagccgatatattcacaggtgccagggatcaggacatggacagttttggggggtcattattctgcccaccatagcaaacaaatttactatgatgttttaaaacccagctataaatatctgttcatggaaacttctcaagcgagtctagtgctatctgcaggtgcctggcacagccctaagtaaatgcttgcttctttctgtcattcgtttcccttaagttccagctgtccttgtacatttgctcactcatgagccttcccttcccagtccttagaagcagcttctggagatgaccccattgtgaagtttctaaggctccccacaaagggcctctggggcctgcggatgaataagtccttgaccagcctccacctccctcttctagggtctgacgattggctggctagtccattgccagaaagaaaacaatcttattcctaggcaatcagaaacacacatggcttccagaagatggggccagacatgtccttacttacatacagagccctcctccctgtgagggtctctgctttctctgccctctctcttttttcctcccatcctcagcccttcctcaggatcctggctccatcctggtggcagcccacagagtcatggggagcattcctcctgcactatccaggaagccaaagcaaggttcctccctgttcccctgcttagcacaagtcataagattttcaggctcctttgggcaggatgtgaacaagacaagtccttcttgctgatattaaccattaatatgtattatcatttaagtgatcttcctagcttggctgtctttctaagaccctctcctcactgggatacgaggaaaagacaagaaggctgtaagaaggatggaaaatcctatcctcccacaaaccataatcaactgaatgtataataattgaatgagtaaatgcatgcatgaaatgcatccaacatctttgccttcctattatctcataccttgtaaaagacaggagactttggcaatgaagactgcctttactgcagagctggaccagcaaccccatctgtagcccctctcctgtgtctagttcataccacatttttgccctgattttggatttcaatatactgagaaataagcttaactgctagagccatctgtcttctcttttagaacgctggaaaatatgagatatctaaaatgtcaagctggaaggttatttcataattgatgttccagctgtctcaggataatttctcaactgtaattgtcaagggctcctcaattgcttctgccaaaatcttttcattaccacaccagtcagatttccaaatattcattcaaattcataaaacatgctagcaccttcctgtgtaagatgatgtgtaataactattagttagctgggctagcatgtgctgtaatgtcaaacctatgccaggaatatcctatgatctttcagggaaattctaggtccctgagcaaaacttttgaaacaattctttcttgaaggaaaaaattcccagaaatatcctcagtggggctccttagggagttgcctgggtagtaactatgcctctatttgtgtaaccaaaacgtatttttaagggggatttaatcaaatagttaaaaagtaatgccttaggagagcaatgttacgccctctggaaaccacatgaagaagatactatctatagtctgagatgctttgttaaggaaccaccagctcagatagccttgatcaccttgatcaaggccaccatgatcaccttctactaggaattaggatttttgactctagactaaacccttaaatgggcaagacttcattaactaccaaagtatttgaatatcaagctatgaagacattgaagtcaattactttggctgtggcaattatggtgtgtcaagtcaactgtggtatataatgacaacttgttatcctacaacactcttatcataaatggtaccctccttaataacgaaactcaaatccatgtctgcctaatgaccagccagcagaagtcagctcggtcagcacccacactgcaagcaaatgagcctcatttacagctctctagtttttgtacatttttcttcacactttgacaatttttcattcatcactatgactgagaaaaggaaatataatgcataaaatataaaatctccacaataagtcaggagagcaaccatttaagaaatgaagcactatattccacactgtgttggccaatgttagcaataggctcaaactcctgacaagaccagatacagagatgccttgtatgacatcaacaggatttaatttctaaaggttaaagaaggaagtcaattcggctggagttcaagtgaaaaaccatcaagattctcagtgcaagcttccagatcagagctgccctacagaattttccatgttgaccagacggtaaccagtggccacatggctgctgagtgcttgaaatgtggctggtaccactgagcaaatacctttacaactttaattaattttaaattatcttcttttttctatacctcaaccccttttctccttccatccccaatgcattcttttagcatctgggtcataaaatcctcatgggagagagatgtacacattgggtataaagtctgagaaaataagggtcccattacccttcctggaaacctaaccatctattgctgaggtgggcttgtatgtagcctaatctctgtatatgtcagagatcatcttacctacaccaggttcacattttccatcttagagttatacaggacattgtatataggacctgcagggatatggggtacactaccagtacacccagacatgaatgaaatgctgcctcagcatcctagactccaggctagcacagtgttgtccaaagaacgtttctgaactccaggctgagggactggagcaagattcaccctgacatctctaggagttatgctgacaagctcctcagacagcaaaagggcttgtcttccacctggcaacggaagtcaggcatggatggacatgaaggagcctcccggttccagtggttctgttaagctacaaacgtaattttcagtcacaaagaaaatagctgacggaagccaatcgcaatcaacaaattattttgccttctggttggtcatcgttgtaatgaaaatatttcctttcaatgcatggaaagcagtttagcagaactagcaaagaaagatggcatgatcattagctcatttaatattacagctcatgggacaagcatagattcagaagcattaaataatattctaggtaaattatcagaagtcaagaaagaggaaagctagagttcatgacacatgttaatttacttagggaatcttcaaacatgaaaaagaagtaaaaataaagtgaacacctatgtagctatcaaccaagttcaacaattatcaacacctggccattcttgtttctttacttcaacctactttcccttccatccccagcgaattattttaaagaaagtctcagctcttcccctaagtgtttctgctggcaatactaagtggtacaacctgaggtaatctgtgaaaatggtttgctattcacttgatctgtagaagcccacacaatcatacaaatcaagaggttcaaattttcctgttcactttaagaacactcgtgaaactgcccaggccatcaaggctatgcatatacaaaaagccatgaagtatctgaaagatgtcactttacagaaacagtgtgtaccattccaacgttacagtggtggagttggtaggtgtgcccaggccaagcagtggggctggacacaaggttggtgacccaagaagagtgctgaatttttgctgcacatgtttaaaaatgcagagagcaatgctgaacttaagggttgagatgtagactctctggtcattgagcatatccaagtggacaaagcatctaagatgtgttaccagacctacagagctcatggttagattaagccatacgtgagcattccctgccacatcgagatgatccttactgaaaaggaacaaattattcctaaaccaaaagaagaggttgcccagaagaaaaagatgtcccagaagaaactgaagaaacaaaaacttatggcacaggagtaaattcagcattaaaataaatgcagttaaggccaggcacagtggttcacgcccgtaatcccagcactttgggaggccgaggtgggtggatcacttgaggtcaggagtttgagaccagcctggccaacatggtgaaaccccttctctattaaaaattaaaaaattagctgggcgtggtggtgcgtgcctgtaatcccagctactcaggaggctgaggcaggagaatcgcttgaacctgggagacagaggttgcaacgagccgagatcgcgccactgcactccagccggagtgacagagtgagactctgtctcaagacaataaatgaataaatgcaattaaaagttttaaaaagtcccagatatcacataattttatcttttaaaaagcctttagtttatatcactaaagataaggcaatttttaaacatactacagtatcatcacatctaaaaatattagtaataattcctagataccatcaaataaacagaaagtctagctgtcatacctgtaccctcctctgttgcctccctctcccacagtaatattttttagttttgatttgtccttcaattatttttttatgtaagcaaataaatatagtaaatatttgttgttttttccttcacagagaagaggtaacccattatacacattttctgcatctggattgcacttaaaaattattctcacttgacaccaatacatagaaaactttgttctttttttcagctacatagtactccaacatgtgaaggtactttattcaaccattactctgttgatggacatttgggctattcccagttttttgctcttactagcagtgtcatcatgaaaagccttgtgtatatgaatttcttattttgagagcatctttggaatagattcctagaagtgggattgatgagtcaaaaggcaaatgcatataatgttgctagctattgtcaaactctcttctataaagattataccacttaatattgccagcagaaatgagtatggtgtccttctttatgatttttttggccctctgagaaatgagaagtagtatctcagtgaggtttcaatttccttttttttttttctgtaatctatattttgagaacttcattctaagagaacaagactccttttggacagtaacaccattggaattgtcaaaaaagaaaaatcttccctggttacattatgtgttgaataaagaagtttttcttgcagataggcttgagttgtcaagttttcattcagagcagctcaagcatggggagtttatgaaaatggaatcgttgaaattcatagaatgagaagcctcaaagagctctttttaccagcatattccattgaatacctttggagacattcatacccatcaaatactcagagcatactttttgagaagattaaacctaacttagaagttggaggttcttggcacaataaagaaaagcaatgcttaaccctgaaagattaactggggaaaaacatgataccttcagtcaaaactttatggaacttttattttaaaaaacttcatttcaccctacccatgaccaagtaccccccaagaaatgtttagaacatatcatttatatgagctgtttgaatttaaacactgaataaatgcttgcaaaagcatatatttgtcctaacttctattttatttttaaatcaactttggcattttcacactgtaaagtgagttttttatgtgagggcttgctttacagaaatttcaatatcccatgtttacaaagaagcactcactgaggattcaattctcttgcaattaattttcccaagttgccagctagcaggctaccaatctatggagcgttcaacatttagggatgaactttcatgggccctggggatgcaaagattactactttgtggttcctcggtagaggagctgaaaagtaaacatgtaaattaaaacagcctatgacataggaccaaccagggtgtgttgtcattgttgacatgtatctctaccagaaaagttcactcttctttataaatgacagcattattgagctgttaccaacagtaattcacatgaccaatggtggacaaccaggactccaagatggtgtcagttgcaccagtgaaagagaggaaagtcatggatgcctaacttggggagctgccaagctggctattgatgtggggtttcaccctgaaaggcatgattggagcatttcaaagaagttactacccgcattagaacaagtgcctcacaggaaggaagggagcattgcaggggtttctatagctggcagcttacagcttttcctctatgttctttcttacaaagagctcaactgtgagcaactctgcaagcatcacctaagaggggccagtgaagggtgcactctgcccttctgaccatgacctccttggcccatcacccctttgtgagaaactccatcactgctgaatccttttatatcctaattgagaactaacgcccaaacagaagatgactggtatgtgtaaagaaatacaaataataaaattcacataccatataattcatctctttaaagtgcacaattcaatgggttttttgtgtgtacattcagagttgtgcaaccatcaccacattcaatttttagaacaattcatcacccccaaaaagaaactgtgcatccactcacagtcactcactatttcttccaacctgcaccccccacccccagccctgagtgaccactaatctttgcattctccctagatttacctatctgggatatttcatacaatgaaatgaaaatgaaatcatacagtatgcagtcgtggtgactgtcctctttcataatgtttttgaggtttgtcaatgctgtactatgtatcagtatttaattcctttttctttccaaatcatagtccattgtggatatactatgttttctgttgcttactgtttgatatggtttggatttttgtccccacacaaatctcatgttgaattggaggacgggcctggtgggaggtgactggatcatgggggcagatttcccccatgttgttctcatgacagtgagtgagttgtcacaagatctgatggtttaaaagtgtgtgacatattgcggcactattcacaatagcaaagacttggaaacaacccaaatgtccatcaatgatagactggattaagaaaatgtggcacatatacaccatggaatactatgcagtcgtaaaaaaaggatgagttcatgtcctttgcagggacatggatgcagctggaaaccatcattctaaacaaactatcacaaggacagaaaaccaaacaccgcatgttctcactcacaggtgggaattgaacaatgagaacacttggatatagggcggggaacatcatacacccgggcctgtcatggggttgggggaggggggagggatagcattaggagaaatacctaacgtaaatgacgagttaatgggtgcagaaaaccaacatggcgcatgtatacctatgtaacaaacctgcatgttgtgcatatgtaccctagaacttaaagtataattaaaaaatatatataaataataaataaataaataaaagtgtgcgacacttccacctttgctctctctctctcctgctccaccacagtaagatgcgcttacttcccctttgccttccatcatgaatgtaaatttcctaaggcttcctggtcttgcttcctattaagcctgtggaactgtgagtcgattaaacctcttttcttcataaattacccagtcttaggtagttctttatagaaatgtgaaaacagactaataccctattctgttattaggtgacactaatatacagtgaaatgcacacatgtgaagcatggctatgccacatttttgttatccattcatctgttggtgaacaattggggtgtttctactttttgactgttaggaataatgctgctgtgaacattcatgtagaagcatttgagtggatgtttagtggaactgctgggttgaacaggctaactcacggaaggaacgcatcattgtattcctctaacaagcacaatagtagaaatttagtgagtcatcagcttcttgctcaaaagtggcaaccaatcaattttcctgcactttggaattgggaggggcctctgctgttggctggcccatgttcttggtcagttgaccatccagcccatggttgtggtgtgatattatccaattcacatttctccatctcatttatatggcaccatgacagagcctttgccaacatccacacacatgaactccatgaattcccccgatctgctaatctagtagtaatccagaaaaagaaaaaatgtggttagtttggcatcacctattctaaattctactcatgactaaggctgaaaaactgactgctgaatgataggtactaatctttaaccaggaagtaacactaacttgttcataattcttagactccacatttccctctttaaaaaaaaaaaaaatctttacatcagaccctttgggtgtttgtcgtgtctctctcattgccctaattgttcagccatcaccccgcaacagctcccagccccctgcaatatgactcatctgagctcgaagttctgtctgctctatctcacgcactcaggatgttaaagctgtaggctcctccctctctgggtttcatagctctctaagcttatttttattatacgcttcctggtagaaagatcattttccgtgatacagaaacaaaagcgttattgagcagttctgagtagttctgcattcttcttggcagatatttacactacagtctcccttaggtctacgagttgtcttccttgttccctggctctgatagatcaataaagccctctgggttggccccagcatttgtctcaagccctgatctctacagtgtttagaacttcctcccgtggttcttaaaggtccaggcccttcttttgagaatgtctttggatggctggctacaggaccatttacctgtgggaactatcttggaataatttctgggtagtgaaggattctttcttcagggtttccaaggattggctagctgctctccttctgagccatcaccacctgctttcccccagactttcctctcccacatgggcactgcaggaagggacccagctgtccatctctcttgctctactccaacccttaataaggctggaaatactttggaagtcatcaaggcaattttgtgctggacagggcaagaaaacaaacaggggattaaagataatggaaaatgataagaaagctttaacatctgtaagagtcattcctgaaacctactgtgacagattaactctagattggctctttctcaatcatcccgtagaatcggaaagtcagttctcccaatctgggtagctccatgtttgtttgtagggtcattcatgagttttcctatctcccctctccttcttcttatctatgtctttctggcttagatgaaaaatgtaaatagtagagtacttggcctacaaatcagaaatcccctccagctcccataccttctttcttcacctactgtagttactttaatcactaggtccctcctcccatcttgcctgcatatgacttatctgagagctcactgagcagccatgctgatatttaccaatgccagctctcaccaggatcatttggaatcctattaacactacaacacacgcacacacacacgagtcaattcttgctattcccagtggctatggtctacaaagtcaccctgaagacttaattggccaatactgaaccactgctcttaggggaaatagaggcttaagttcctgtgagctttcggtcacatttctttcatcaactggtcaatacataaccttgttttatgtgttctctgtttaaagaatgcttatttaatatatattgttgattaacattgaactcatagccaacagcaccataactcttgcctgaatgaagctttgctaacacatgtattttctccatcaggcatatcacagccttcttacacttagaaactctaaacagcacttcagcagtatgtgtgcaggccattttaaacagaaaaatcaccaacaaaaagtacaaaaatgtgaaaaatgtggtatttcataggccaggagaaagacacttgtttatagtacaagagctgagacaagaaggcagagtgtctcaccttgtgtgacctccgctgggaacgtgcattttgggtgactcaattttcttggccacttctgtgtgttgcagatgaccataaaagtgccacaagtattaattttggggttacaaatagattttagtgagtaggcaagttcacaaattcaaaatctgcaaatgatgaggattgactctacacacacacacacacacacacacacacacacaaatatatctacccaggaaagttatcttttgtttgcaatgcacccattattgcacaagccatgatatgaactggggcctgtggcatatggttcaccagtgtacgtaccatacctaccatatggcctgaccttggaggcccttaataaatacttgttagataagttaatgaaggactgaaggtccaataaagtcaattacacacacacacgcatgcacacacacacgcagacacacaaagagtatatgccgtctaccatttactccaggaacatagtctgtacagattagataatcttataatagccactaagtccatttgaaagatgcccatcgcatcttcacctttattaggcacagaatttttattatggtgatcattacattggtgtagctctttgtggttcaaaaaccacattcatgtagtttccaagcctatagtggtattgtatataagtggattgttcattcaaccatcatctagaatcactggatttttaaaaaattttgataaagcctagagaaacactaaaataaacagattagtccatatacccagttctgtgtg[450 bp omitted]tttattttaaggatgaaataaaataatgcatagaagctagcatagtgtctggcacatagggggcaggcaatacatgataggtattattacatctgtttgaaaaaaaggcgcaaagtattttctctaaggtcagaacttaattgatgcatacatgcatgtgttatcagcacaggggcaacatgcattgaaaagcatatggaatcagagtgtttagtatatgctttagtgcaataggatttattttattacctgttgaataaataatgtgttgtaaacaaggagatgtcctggataaagcaactcagaggaaagttcctacatatttcagattgaccttccatttcaatggaaatgcacagatagtagcaagcaggtcatggttatttcctgtatgcccactacaaataaaaggcagtgagttcatgacaaatataaagtggaaggtgttccaaataaataatggacctttattgcctttctaaggaaaagtcacatctttaaaacatatttctaatcccattcagataatattcagtataagatatcatggtctcgtctggtgttgtccacgtagcttcatataatggagattcgggtcaatgggaggcaggaactcagggaaatggcaaactgcaggactggggattccctactgtgatctcctctcccacaccctgtaactggtgtgagcttgtagtttattttttttcttgcctgctatttcttgtgggttgaatgcacccctccaaaagatatgttgaagtctgaatccctagtacctgtcctagtacctatgaatgtgaccttctttggaagtaggatctttgcaggtggaatcaagatataaattaagatgagatcatctgaagtaggctgggccccaacccaatatgactggtgtcctataataagagtagagacaagagcgccatgtgaagacaagacacgcacagagggaagatgatatgaagacagagaacaccgtgtgacgacggaggcatctacaagccaaggactgcccacaacacagaaactaggagaaagtccaggaacagattctccccaaagaacatggccctgctgacaccttgatttcagacttctggcccctcagaaatatgagagaataaatttctaggtcgggcacggtggctaatgccttcgtgatcccagcacttcggtaggctgaggcaggtggatcacctgaggtcaggagttcaagactagcctggccaacatggtaaaaccctgtctctactaaaaatacaaaaattagccaggcgtggtggcgcgtgcctgtaatcccagctactcaggaggctgaggcaggagaatcacttgaacccgggaagcggacagtgcagtgagctgagatcatgccactgcactccagcctaggcgacagagcaagattccatctctaaaacattaaaaaaaaaaaaaaagaaattctccccaaagaacatggccctgctgacacctcaatttcagacttctggtgccccagaactatgagagaataaatttctattgtttcaagccacccagtttgtggtgctttgctgtggcactctaggaaaagaatccactcttccagcagagagaagttacagcgtgccttgggggctgaatgttgatctgagcagtgtttaatttcctggaattctcaccatataaaattatagcaggctgcctctacacaagaggggtgaggggattgacaccatctgtgttcgggccacactgagtaacaggtgaagaggaaaaaatgaaaacatttaggatctctgcaatgctggtcccacctgggtgggaaaaaccaggattttcctctctccagggctgagagccagtttctgaagcctgcttctgtcttcagggagaggacattcatgtaatctgccaatgccgggttttttttttttttctttttacagaaacttacaggacacgtgccttcctctctcccctccttccctgctgttttcccagctgccaggaactccacctccgtgtccactctcttctctccagtcaagagtaaacgaaactcaagttattgggctttgaaatatcctagctcaattcacatgcgtcctgtttaaatccgtggtgtgttacctcggcttattcggatttaggaaatgctccatcatcctgttgactcagcgcctaaaataagaggcagatgccaggccacttacgcaaaagggactcccttggcagcatcctgcttgtagttaagaatgatcccactagatggagctccacttaaggtccgaccagaggttcttgcactttcctcttagtatccagcaattacaggagcaaaatcccagaatgagcaagaagcccaagaaggcagatttagaagacaatgatacttacccttcgcgtttgacttaattttcagattagacagaacttcctactgcttccctcattaataagatcatccacgatcaaattccttctacctccctccctcaaggtacaaaatgagcttgcaataaacacatgaccaaattgtaaaagtgcatggcaacaggtgagaaaatgcttatttggaggctctcagggctttgaggctgaatagaggaggtaactgtcaatcgaagttagtttggtcctcagcacagccagtgatcaggcaggcagagaaggcattgcagcctggcactggctggacagtctgtgccagttaacagcctcaaagagtggccagctgagaaggacaggatgattttgacaccatgacgggatcaagtgcatttccagttgaaatactcaagacagaagaaagaagaaaaaacctgaaccaacttttcccatcaaaatcactgtgtttaaatatgggggcaaaaccgtagggggctcaacggtaataaaactctgagaggtgctctcaggctgcccttgctttatgccttaaaagagacttccagtttgtattgtctatagaagactttactttttgtaagtggcaaagtttctgttaaacaccagcttcatgccatcctcctgattctcattttcatcaactgtaaattggagaaatatagttctttccttgtggtgctatggtgaggcttgaaaataaaatgtgaaacttcctagcaaaagatgtggcacatagtagattctcagtaaagaactctgtctccacttcttgctgctattctaggaagtttggaggacttcctccaagatgttgctgtaattattacacacaaatcaccaaagcacacttgctaaacaccttggtatagatttatgccagaggcacaactatggcaagtgctctcatcaccattttcaccgtcttcaaaactgattacaggcaagacgtagtggctcatgcctgtaatcccaacgctttgggaggccaaagcaggaggagtgcttaaggctgagtttgagaccagcctgggcaacatactgagatcctatctctacaaacataaaaaaaaattagctgggagtggtggcacatactgatggtcccagctactcaaaaggctgaggtgggaggatcgcttgagcccaggagtttgagtctacagtgagttatgattgtgttactgcactccagcgtgggtgacacagcgagaccctgtctcttagaagaaaaagttgataattgactcagaaacagtggaaaagggaacatgggggctccttttgccctctgatttgcctactgagtggttctgggaaaggacacaaaaaaacaaagccaagtgtgctaacttccccaaaataacctgggcccttcagcctcagaggggggctgcaatttcggagccatccaaatggaattgtgaaatggatgagtctgatatcgagtgttttcaatctccctatctgtgtctccttctttcttctctcatctaagttgcaggccaccatttttttttccttttttcctattaaaacttgatctcaggaaaataaaaattgattatcactaactttaaggaaggggacattggtgcaccattctctctatatttacatgatttttcctcaattattcattaccaagaagatggcagaagtgtttagaaaggcagtgatcttctttgcccctgaaatcatcccagaggacaactctgcccttcactttatctaccctaaaagttgaaatgattgatgttcttggaaccatggatcccactcaggaagtcccccgaccctggagcactcacgtctgagaaggccttaaaagtgattcagtgaattcaaaaataccactgtggtggagacaaagtacagacgatccggtcccccattatgatagtccgatacaattttttgatgttaccatagatttattggagtgttaaatgcattttcaacttatgatatttttgacttacaaaatttttgactgaattaccagggagctatcaaggacataaccccattataagttgaggagtgtctataatcaacgaggcttccaagattctgcctccaggagagacatgtgggtaggaagggttgaggaccactgttaactgacttgtacctcatacatcccagagtcttaggacaaagacattctgattggtctttcaacatcgtggctatcaagttcattccagagagtgactctccagaattatggagttataatgaccatccgtgttagttgagatggaagttcatatacagagtctcaagaagcagagacacatagttgaagagtcctataatagtaccctttatttgtcacctctcaggtaccagctcatattctcttggttacccatgcatctgagacccgtgtatctgaggctatgagtttggcttcagttgcagagactgtcacctcacatatacacaatgactctgttttgctctattgccatgccttttcttttaagccctggggcttccttgttactgctgagatgccatgcaatgctcttggcacctgtatatatgcaaagcatagtatcagggagttaagacccatgaggcaaacttttgaccaattggcaacaaaatcagcagctaaatacttctcccttcttctttccctctgaatggactatgctaagacactgtcactcatgtagccttttggaagacatcatgctaaccttaagcaatcaacgcccttagtacaaagtggtgcccatcttagtagcacattctcttgaatcttgactgactctttttcttacttactctctttttctcacgttttctttgctttttctatacaccttgctacagtatgaatgtttgtgtcctcctcaaaattaatatgttgaaatcctatccccaaaagcgatggtgttatgaggtgaggcctcttgggaggtgcagaggtcatgaggactctgcggtcatgggattaatgtccttatacaataggcccaagggagcttgttcgcctcttctatcatgtgagaacacagctcaaagatgccatctatgaacaagaaagtgggcccccaccagacaccaaatctgccagcaccttgatcttggacttcccagcctctagaatggtgagaactaaatttttgctgtttataagctacccagtttatggtactttgttactgcagaccaaatgaactaagacactcctcaaaaaccatattcacaaatgaattttgcctcaggctcagtttatagaaactcaggctaagataactattcctgtggagcagagtcagaattttatattgctataaaagataaacagtgctttctcaggacagcttgagactcctgtaacccaatttacccagtcagtctgtcaatcatcctcctcagtccctgatgggattgatgtgatctgcctgtacttctgccagaagaaaattcaatactttctgggagatcataaaaacaccctaaacctcttcaatttacataccatgtgtagacagtttttaatccaaaattatcaggtctgtcagatcacaaaaccaaataaccaaagccaagagaaaaagcagacagaagaaacagacctataggtgatccaaatattggaattatcatacatggactttaaagtttccatttgaaaatctgttttcttgatatagattttctatatattcaagaaaatagattttcaaatgggaactttcatcagaaaactggaatctatgtttttaaaaagcatgaagtaaaatctcagaactaaaaactgaaacaactgaaattaaaagtttaatgcaagaagtttataaaacaatagcaatggcagaagagagttagtgtagtggaaaataggtcaggagaaaagtatcaattctgaagcacaggattaaaaggattaaaaaaacacagaaaagagcatacttgacacatgggacatggtgaaaaggtttaatacatgtcatgaaagtctcagagagacagaaaagagagaagggggcacatgaaatatttgatgagttactgtctgaaatctttcaaaaaatgaaaaaacattaagctacaggtttgaaaatctctaaaaactccaagtaggataaattcaaagaaaaccataccttgagcactttaaaggtggctggtacaactaaggaaatgaggttttaattgtattttatttaaattaatttagatttaaatagtcatatacagctagtagctacttactggactgtgaaagcctaggacagttgctaaaagaacaaaggaaggggctgggcacggtgtctcacgcctgtaatcacaacactttgggaggccgaggcggggggatcacgaggtcaggagctcaagaccagcctggccaacatggtgaaaccccgtctctactaaaaatacaaaaattagccgagcacggtgccaggcgcctgtaatcccagccattcaggaggctgaggcaggagaatctcttgaaaccgtaaggcggaggttgcagtgagccgaaattgcgccactgcactccagcctggacgaaagagcaaaactccatctcaaaaaaaagaaaaaaagagtaaaggaaggatatagaacaaagaaaactcaagctggagaaatataagcactaaagtttctaatgatattcatgtccaagttgagtcatacacagcatatattgttgacatcttttataagagccaggtcttatggtttttttaggtttctggtctgtatcctctttagtgaccattgcccagtattgaatagctacagaaaattcacagcttagctctgaccagcttttaggggacatgccttccccatagaaaagacaccatttctgaataatcacatttgcaaacctggatttacctcgatctaatcgtgattttgtccttcttcctccagccctgaggcttgaagtgtagtctgccgtgtccccaaatccacccaagattgatgcttctaatccagggtgcaaacaccttctacagttgccctagcaaagccccaagagttaggactatacccttagagcttcctgagtgctttcaggaaaattcacaaggaatgccaatctgcagaaacaattaattttgtcaaaatcttccaatatgagtccatccattttctctaacccagaggacagaacagtctctccattctgaataaaagaggcctgatttagatgttcctccaggtcaagagaagctggacttactttcttccaaaaaaggtggaagaggaagagaactaacaacggtgtttaatcttctgtgtccttggtatgtcatcacatgacatacaggtatccacagctcaaggagttttcacttctgttctctacacctctagaaagttatagcaaagcaaggaaaagcaggacaggggcactgaaatgaacagagatagaggaattttgtaggagagttttcagaggtaaagacttgagaggcttatacttgaagtttgcaaatccatgaaaattatgattaattttgaaaatcaaggactgtttgtttgttttaccaaatttcaggctatcagatgcagagagtaaaaagaatgtagtttggggcaaataagagtgagtcctcttgcattaaaatgagtccattgattactattttttaaaaattctaggccgggcatggtggcccacccctgtaatcccagcactttgggaggccgaggtgggcggatcacgaggtcaggagatcgagaccatcctggctaacacggtgaaaccctgtctccactaaaaatacaaaaaattagccgggcgtggtggcgggcacctgtagtcccagctacttgggaagctgaggcaggagaatggtgtgaacccgggaggcggagcttgcagtagccaagatcgcaccactgcaccccagcctgggtggcagagcaagactctgtctcaaaataaataaataaatgaataataaataaataaaaataaattctagtatgtggtaggaattcaaactaataaagaagctccagaaaggttaaactgcaattaaaaataacaggtccttagctggccattaaaagatgtaagagatcgtgggcgttggggcagcccagggaagtgccatgggtgcagggctttgggccaggacagaaactgctcccctttggggtcagttgaagcagggatctggtcatcaactctcagtccttatgtatgaggcttcccgggcaagtcctgccctggtttaccccattctcctggaggctgctggaagcatgaatcttgtttccagagcaccagggtggaggtttggaacaactgggtacttgctattggaattcctgaaaaatggcagcaaatacccataaataaatgttaggaattaaatacagaatgcttggcatttcacatatttttaaaacattgtttaccaatttctttcctccttgccagttgttagagttgccaaacagctttttaaggtttggcctacgccccacctctcaaattatgaccctggctcgaggaaaacattatctggatccaaactagccaacggtatatgtttgcttaaataaccagattttattccacacctgtgtcaagcatgcaaggaaagggtggccttaggctataggacacagatttggctttgacagctgagaggtcaaaacagggagagcaaacccagagctccactgaccggctttccctgatcccctcttcatagcaggctttgccaattgatctgagcccttcttctcatggggcagaaacaaagtctcacaatcttcagtgcaactatctaagaatggcacgtttagagtaggcaccaaaatgaaactctgattatagcttaatgtgggtccctagtgggaaggccaaagccttatgccaattgctaaattctttgacggtgcaggatagctctttccaatgagacaactggttgcccttaaaataccttgcaactccattgtcgactggtaccagaaatttggtcatcagaacatctactccaagagtgcatagtcttggtccttgtagggaagaaacttggaagtcctgtacgtgtgtttactcatgtaactctcataacctgctatcatccacattttattttattattttattttattttgagacaaattctcactctgtcacctaggctggagtgcagtggcgcaatctcagctcactgcaacctctgcctcccgggttcaagtgattctcccacttcagcctcctgagtagctgggattacaggtgcccatcaccatgcctggctaattttttttgtatttttagtagaggcagggtttcaccatgttggccaggctggtctcaaactcctgacctcaagtgatctgactgcctcagcctcccaaaatgctaggattacaggcataagccactacgcccggcctataaaccacattttacagatggaaacattgaagctcagaatgaattgccttagatcatacagccagtaagtgacagagccagaatgaacaatactagggtcattgcacccccaaaagccttgctttctccacatatcacacagccgctaagtgtgaagatttgatacggagccaggggaagagagcctgggaggcagcaggaattaagttccttcttctcagagagaagaggcccataggaagcctgtaaagataaattgcccagattccacagtcctgcctagggctggacttgggtgaaaacaagagagcatcaaagtagaagctgacctttccacaagaatcaaggtacttgtgtccattgggattcagcaaattgccttttgtcagccaagaagagaagcaggtggcaaatatctgccatgtgataaaggtaaccgtaggaatgtaggtaccgatgttggtgcttgttttaataccaaattatatcttcttcttctcttgatagacatgagtgtcacctttaactggcaaatccccccagaatgctgggcccgctctagcagtgggcctagtgtatttgacacctgcagtagatcgtctttaacaatgcctctaccatatgacaaaattagttttaatgataatcacaaaattaaacaaataatgataatggcagggaaagaaatgcagacaatgaaatttcttttcttttctttttttaattaaagacaatttttttggccaggcacggtggttcacgcttgtaatcccagcactttgggaggccgaggcacatggatcatttgaggtcaggagttcgagaacagcctggccaacatggcgaaaccccatctctactaaaaatacaaaaaaaaaaaaaaaaaaattagccgggtatggtggcatgtgcctgtagtcccagctactcaggagtcaggagaatcgcttaagcctgggaagcggaggttgcagtgagccaggtcgtgccactgcactccagcctgggcaacagagcaagaccctgtctcaaaaaaactttttgccaccatgcctgcctctgttttttttccttttttggtggagatggggtctcactacgttgctcaggctggtatcaaaatcctgggctcaagcaatcctcctgccttggcgttccagtgctgagattacaggtgtgagccactacgcccagccccagtttttcttttattaaacttcacatatataatcatggcagataaataaatactacattgccaaaaaaggaaaaaaagtaaatacttttaaattctggtctttttctgagaaaaggggaagaacttttacctacatattgctaatgcatgggacattatagtttttggttctgagacttctgcaaatttgtcagtgatttaatcaaagttgattttccttgcagagccacatttaatatgcaatgtagccaggtttattattctagcttcactcactgttggcagagggatacttttgactcatcttaatttctgaagttttgtttcccccgtagccaaaagcatacaagaagttcagaaaagccataaacataaggataaatttgcagattccattgcacaacaaattccgga

SEQ ID NO: 12293 - DNA, 66175 bp, Human
  misc_feature (1)...(66175): n = A,T,C or G
tcaaatcttccatcacgctaggaaaacagcatgcaatccaacccacctagccaatttgcctttgccttcttccatcagaggggtggccttccaaataggatgttgaccattcacctaggaatgactgtctacaaactaagtagctcttggttggtcagtaaagagctgcgtatagggcagtgtccaagtgaccacagaatccagcagctcctcactcagttccagactcagtctgtggggaacagaggctccctgctcatgagtgtctcctctttgccttcctcaggcaccaggatcccgtatcaaccatttccattttgtaatagaactcttcggggactgccctccccgttagagcttttccaagatctctgaagacatcatgagtttttcaggtttcaagattattttatgtccttcagtcacagggggagcttcagctagtgttccatcgtaagctagtaagtgcctctcaaatggaaactttatagtctaaaggcccagttccctggaggtgctcacagccttttgccattagccctaggcagtgctccacacagggcacagagaatgtgtgttacctgcagtctggtttctagtctacactgtgtagtccaccctccagggccaaggggcctggagtgctctaaagactttcctgcaggccctcgtggctctgtgttaatgctgtcagtcttcctgaagtcctgtcctctcacctcctgcctagatctgcccccagcacacattcctgactccacacatttctcagtgcctgcgacctggcacacatttctgatccgaactcagtgcctggggcctggcaggtgcccagggcactccattgctcaaatccaagcctgtggagaggatgacatatcattcccaggtttctgatgagcagaaaaaaaaatctttgtttctatagtgctatcctcttttatccaccatgtgagaggtcaggagccgactcaccccaagggtctaggagttgtgccattgaccttactgcctagggtcacaggctggcacccttcagtaccacacattggatctctccacacagcagcagtgtgcttaactcaatggggaggtgagtagcccaaggtcagatagttggacctggatagacacttgactgggggacaggctttggaagccactcccctgggcctcctctgtccatggggcctcaatactagagcccacaaggtcggccagagagtgtctgtgcctcgaccatgcaaagggtgccaggttgtggctagggatgcccccggggttcctctccctcctacctactcctcagcctctgcatgtgcccgtcatggcccctgtgtccttcattctgtccactcatgtgttcactgggcccctccttggtgccaggcacccgctactgagggataccaagcccctgccagagaagcttggagctgggtcacagcagcaaggaggctggagacatcagtggcatcagtgcactggtcagtgaggccgctgtgggaggagggagtgggagcagaagctaagagtggactgaagtccttaggccaggaggtagttcagggtttaagaagaggagagacaggcgtcccggggagggagcaggctcaggatgggcctccagtgcctcctctggagctcactacccagactacagcagcgcagtgggcagcgcctcagctccttccccttctgctgcctacagcctggacaggacccggaatcaaaccgcaggccctgggtcaccgctgccggaaagagccagttcctgtccgtccatgcacccaccaccaaaacccaggccttcctggaggtgctaggggaggccatgccccttttctgagtgcttggaagtgactgctgcaagtgacaagtgaccacgccttttcccccgcgggtataaattcagaggcgctgcgctccgattctggcagtgcagctgtgggaacctctccacgcgcacgaactcagccaacgatttctgatagatttttgggagtttgaccagagatgcaaggggtgaaggagcgcttcctaccgttagggaactctggggacagagcgccccggccgcctgatggccgaggcagggtgcgacccaggacccaggacggcgtcgggaaccataccatggcccggatccccaagaccctaaagttcgtcgtcgtcatcgtcgcggtcctgctgccagtgagtcccggccgcggtccctggctggggaagagcgcacctggcgccgggagggggcagggagacggggacacggcagggatgcctggccctggtcacctgcggccgggcatgtccgggcaggacgaactcgccgtcggagtcaggggaagaactgggtccccgggctgggcaggagggacccggccgcgagggagcagagaggcggtccccctggctgccccgagcccgcgaagggagggaagttccagaatcgagagagggagggagtcaaggtggaacccatagagtgagcctcctgaagacacagagcggttgcctctctcattaattaattaattagttaataaaattaaccccatgtttacattcttaaacgtgttccttggagatcggtttaaccaacagccagtgaaaaaacttttcagcgctgtctttagcaactttcacctcctctgtcctgaaagtggcaggaagccggaatgtggcaggaagcggttaaccaaggtgctgccttggttaatgtcttccactaccacccgtgtgtcccctctgtatcccataggcaggaccggggctggccccttccttcagcataaacggtgtaaagttgttgtgagttggctttggaaactgagattggtagtagtgtgagtgcaaggacatattatgtataaaatatgcagacttctaggtctctttcagattgattgaggtttttgctaacagccctttttaagattctttatgtaatacaaaaaaaagaaaaaagaaaaagaaaaggccaaagcaaggttacagaaaccatgagagtttgcatgttgtctttctacaaattaatgctaaattcagaaaagcagtaacattttcacctctcaaaaattacacaactgacttttaaaatagtttatagtgggtggacttacctgaggcagctagaagaatggctgtgtcaggacagtggccctgaagagagaatgcatggatgaccagtgtagacaaggccagcaacatcagtttcacggttttgggaatgtgaactctatgcgtcccaaaggaggctttaatccctccatcagtcttgccttattaaatgcatttaaatgtacaatcactttgttaaattttggagctaacacaaatcacattagatgttttatggcagtacattcagattgatcttcttttaaacaagggtattgtattttactgcatgggtaagccacattttaattcactgttgccgcctaggggcagctggttagatcccatcctgacggcctttgctaattccaacagcattgtactaaatacccttgtatgtatcgtgtgtccacatatccatgcacaccagcttattgggcaactccttacaagttgaattctacttctccttctgtgggataaatgacttcagaagtttctttaaatgttcacgaattttcctccaaaaaaccactgaacccagcttacagtcacacctagtccacaaatgtgcctgtgtccctacacctttgctacacttagctttcattctttactagtctaagatgtaaaacataacacatcacattgctatgtatttttgtttcctcatggtattaggaattttcaaggatataggagttttttggtactgggagtagaccagggtatccagatgagacagcagggaagactgaattctgagctgtgcacttggaaaaccctggtcagttggggccagtccctgccacccaccatgcctgtgaatggagataaggtctccatcctcagcctgtcagggtgacttcagatgagcctggagctgagttcagttcctgaccccaggtcctggctctgtcaatgctgggctggtccaatctgtgcgccaggtccttccacaccattcctctctctatcaaagtaggaattgagaagttccaacggctcagaatctcggactctcaggctgtcaaggactcctgagattgaaggttgtgaatggctgggccctgccgtgctccccctctggctctgtgactctggtgtggccccagctcctgcctgtaaagtgaagaggaggtaaaaatcttcagcagccctgtgtaaacctcagagggctgtgttaccaggtgtgggaggacaaatcacatcctcagggctggtgtcactcactctggactggatccccaggcacctgtcctccatccagcagaggctgcccctgttcctacctgcaccctggtacttgctccctgagcttggggcagaagcttctgaagactagggtggagcaccacggggaggggccatggaggaacagaggagccagacgtcaagtgaggacagcgatggcactgcagggccacagcctggtttacctgccatgcttccagttgtccttctggtaggcgcctggcccgggttgtagtttgaagagtgagcaggaaatgtctccatccaggtggctgcagatggctactcacccaggctgtactgagaggccacagtcccagttctggtcctctgtcgtgtatccaggagtggcagggcagtgaggctctagcttctaggtcagggatggggacagtggggacagtgccatgccccgagcctctgccgttgggcagctggtatcctgcttccagccagagaatgcacatcttcatgtagtggatttcctaacaacccggggagatgaaggtaggttgtttttcctgttttacaagtggtaaaatgagattcagggctagagttctctgagcagctgcttctctgatctctgtcctgcccttggcctctgggagctcttatggttcctcagcagagttcacagggctcttggagcctgtccttcggccttgagctgaggccacaactgcgcgcacttcataggcttgaggggaaagtgattcatccaggaagtaaacagtgagccctttactctgagaacacctgtgcctggagtccgccggagtttgggaggacaaatgaaccccatgtgaatcctgttccctggagcccgcagtgtggtgggagaggtgacaccagggattatataactaataggaggtagcatgaaggaggcctgagatctcactacccttgcctccccctcctccagagaggctgtgctggagagaggccatgctgttgcagggccataggatgtggtactgttggcctggaagatgtggtttgattacagtcaccattgagggtcagggaggggagcgaagctctcctttagatgcccccccacccgatttttttttttttttttttagctgggcctgagaatttgattcacctaagagaggtccacaggagacaagcacacacatttatttaattcaagttttacctggcatggaagaacctgtgagagtcagttacttatttactgaattagaccaagtaactcatgaagaagcaagtaactatgtgaggagctaaaaagatgagagtggatccattctaacatggtctgcacagtaccctcttggcctcgacttctcatccttaaaaataaggaaattgtcagctgggtgcggtggctcacgcctgtaatcccagcactttgggaggtcaaggcaggtggatcacgaggtcaggagatcgagaccatcctggctaacacagtgaaaccccgtctctactgaaaatacaaaacaattagcggagtgtggtggcgggtgcctgtagtcccagctactggagaggctgaggcaggagaatggtgagaacctgggaagcagagctttcagaaaaaaaaaaaaaggagattgtcctatgtttccctggggactttcatctcctgcttttaggaaacacaaaagaggtcaaaggatcttcttgcacctgttgtttttcaatagcctttaattcataatagtcaattgaccagggtgggcagggtgcgatggctcacacctgtagtcctgccaagacaggcagatcacttgagcccaggagttcaagaccagccagggcaacatagcaaaacccggtcacaacaacaacaacaaaaaaccaaacaaacagaaaaacagaaaaacacagaaaattatgtcgtgtgaaggaatccacacagaatgcttaccatctgattccatttctcattaaaattcgaccaatctattctgacaaaaagcagaattattgctggggacataggagcaaagcggaagagaggattacattgaagaatgaagaaattctggggtgtggtggacatgtcattttcttatcgtggtggtagttccacaatgtatacacacgtctcaatctaccaaactacatgcttcaaaaatgtacactttgtttcatgcccattatacctcaatgaatccatttttaaaaaaccttcaatagaatgtaaacacttgagtgtatactgtattccctatagcacttgcacatagatcatggaaataggtatgcataaaaagtcagtttatccaattaaaatggaattctaaaaggtaattaacattaaaatgtgcagggggaaaaggagtaaaaaaattagactagacaatcatagcttaaatggtaaacttacaggtctatttcaactatatcaattattgcactccctgtaaatccactgagcactacagttcaatggtagaaatgtttggaagggctgagaaagcaagactcaactatatcttgtctatatgagatgggccttaaaaggaagacacagatgttgtctgttgaaagtaaatagatggaaaaagatacaccatgcagagtgtaaggccaagaaaactgccatggctatctcagtatcagatgaagttgattttgttagcggtggatgagatccgagttaccctacgttgaaggcggcgaatccgtatgcgtccacagcaccttcagctcttcgcctcctgagaagaaagaactggtttgaggggcataaggcagaagcagagatggaggcaagtttcagagcaggagtgaaagtttattaaaaagctttagaacaggaaggaaaggaaggaacaggaaggaaaggaaggaacagaaagaaaagaaggaaagtacacttggaagatggccaagcaggtgacttgagaaacagtacgcagccggaccgcctgagttggggttttataggttggcctacttccaggatcttgccttacttctccccactcctgaaatcttattgggaagctgctgatcagtttcaagtgttttctatgtattaggaaactgcttttttctggcatcggctgtaaccagttattactttagagacacagttatcaactacctgatggtcgcccaacactgctggtgtcagaagcggggacccctctcctgtcctgctcatacctaactagctgcctactgtgacaattttaggacattgaatattatgggagatgaaaagggacctttgtagttaaaagggttaattcttcaaggagtataataacaacaaattgtatatgcctagtaatacatcttcaaaacacatgacacaaaaatagaattaaaaagagattaactcagctgtttctctgcacttgctagcatgattagatgaaaatgccagtaaagtggcaagcgatctgcacactatcaaccaccttgatttaactgacatttaaagagcaggagtggaacattcactgaacactcattcctttctatgctcatgatactttcaccaagatagaccaggttctgggctataaaacacacaatatgatctctaaacttaatgaaactaaactggaaatcagtaacaatatccacagagaattctaaaattttgatattgaacaacacacttctaaaaatctgtggttcagacaggaaatcaaaagggaaggtaagatatttcaaagtaagtaataatgacaatataacacatcaaaagtggtgcgaaatagctaacagtgctcagggtgaaatatacagctttcaatgtttgtattaaaaaactgggggttagggagatggggagttactgctgaagggtatgtagttcctttctggagtgataaaaatattctaaaattgattatagtgatgattgcatagctatgagtatattaaaaactgctgaagtgtagactttaaatgggtgaattatatgaataatcataattattaattatgtgaattgtgtctcactaaagctgtcaaaaaaagaaaaaacgtgaaaattatgggccgggcacggtggctcacatctgtaattccagcactttgggaggccgaggagggtggatcacgaggtcagaaaatcgagaccatcctggctaacacggtgaaaccctgtctctactaaaaatacaaaaaattagccaggcgtggtggcgggcacctgtagtcccagttacttgggaggctgaggcaggagaatagcatgaacctgggaggtggagcttgcagtgagccgagattgtgccactgcactccggcctgggagacagcgagactccatctcaaaaaaaaaaagaaaaagaaaaagaaaattatggcctgaggagctacattaatcaatcataaaatataagtgtaaatttaaaccaaacaaagtaacaggaaggagcataaatcaaagaatacaaaccacagaaagaactgacaaaaccaactgtgtgcggtggcttacgcctgtaatcccagtactttgggaggcccaggcaggcagatcacttgagctcaggagttaaaccactctgggcaacatggcgaaaccccagctctacaaaatatgtgaaaattagatgggcgttgtggcacacacctgtctttggggactgaggtggcaggaccacttgagcctgggaggcagaggaggcaaaggttgtagtgaaccgagattacaccactgcactctgcgctccaacatggaggacagagggagacactgtctccaaaaaaaaaaaaaaaaaaaaaaaaggccaaaatgaaaagttggtcttctgaaaggattttaaaaaacactaataaacccctcattaaatgagagggagtaagagtgtgagagcagagaaaggagacgcagacatcgcctgaacctagagggactccaacccgggaaagaatgatttgggaaaagtgggttagcttcactgtcaccaactgctagtcaggctttgatgtggaagaaagctacattttgtcttgtttagatccaggcagttgaactgagcccaacataagcagctttcattgtaaccattttggttttgcttaaattaatttcctactttaaaacactcccaacttaaagaaaagttacaaaaactatacaataaaaacatttgaaaaaatggctgttggcatgatgaaagctattattgaattctttagtgtgtactttctacaaacaaggaaattaacatcaacacattaccactatctatccgcactctattccgatttctccagttgtcttctagttgtcatttataacatagagatcatggccagaatccctgaattgctgtttcatcttttttgtcactctttgatatttagtgggagcagcttgacaaggtcctttgtaaagcagtaattaattacttaatgtttgatgctatatcctgactttctgtaaggttatatatattataaccttcatttgtaaagctgagtatgtttaagtgtgtgtctgtgtgtatttgtgtgtgtgtgagtgagagacagaattcacctattggtcaattaaacacttggtgaaactaaatatattaaatgctatttctgcatgaagggctcatatgtgtgtggttttttaaaattcttataaaatcttttctttccaaccatggtggcatgtgcctcttatccacatttcttgggagactgaagcaggaggatcacttcaggccaggagttcaagcctatagtaagatatgatcacacctgtgaatagccactgcattccagcctgggcaacatagcaagactctgtatcaaaaaaacaaaatagctcttcttgctcccattatctggggtaaatttatgttataatatgagaaaaggatacataagtgtttttctttttcttttcattttttcttttttttttttatttgagatggagtctcgcactgtcaccacattggagtgcaatggcgcgatcttggctcactgcaacctctgcctctcaggttcaagctattctcctgcctcagcctcctgagtagctgggattacaggtgtgtgccaccacacccagctaatttttgtatttttagtagagacagggtttcaccgtgttggccaggatggtctcgatctcttgaccttgtgatccacctgcctcagacttccacattgctgggattacaagcttgagccatcgcgcttgcctgtattttttttttttttatagaaaatagctggccctaacaggccaagggacaaacacaggtacgaaagaatgaaagtttggagctggaaaaaatgtccaagctctgatgggttttgtcacttggggtgaagggaatgtgagatggagcctgggaggggtgaggtctggaagtcactcacacccatcactcctttgtccccacaggtcctagcttactctgccaccactgcccggcaggaggaagttccccagcagacagtggccccacagcaacagaggcacagcttcaagggggaggagtgtccagcaggtgcactcttatttttaaaaatcagtttatttttaattgacagataaacattgtatgtatttatgatgtacaccatgatgttttgaaatatgtacgcattgtggaatggctaaatcaagctaattcacatacttaatcatgtattcgtggtaagaacacttaaaaatctgctcagcaattttcagctgtatggatacagagccctgggataagccctctttgccctttttatctgtgggttctgtagccttccttatctatgggttctgtatccatggttgcaacaaaccacagatcaaaaatatgcggaagaaataaaaatgataatacatcaataaaagcagataaaaagcaatgcagtatagcacttatttacatagcatgtctattgcattaggtattacaagtaatctagagatgatttaaagcatatgtgcgtgggttttatgcaatactatcccaatttatatcagggacttgagtatatgcagagtttgttccatggaatatattccctgtggatagaaggcaggactgtacaacacattgttttaataactgtagtcgccatgtcacacaatacatctcttgaatttattctccctgtctaactgaaattttgtatcctttgactaacatctccccatcccaccatccaactcaagccctggtaatcaccattctgctctccacctctatgagaccaactttttctgattccacatatgtgagatcatgaggtgtttgcctttctgtgcctggcttatttcacttagcatagtatcctccagcttcatccatgctgacacaaatgacagaactcccttctttttaaaggctgaatagtattccattgtatctatgtgtcacattttctttaacttttcatccatccatggacacgtaggttgattccatgtcttgaccattgtaaataatgctccaatgcatatgggagggaagatatctcttcaatatactgacgtcatttcctttggatgtatacccaatagtgggattgctagatcatatagttgttctattttttgttttttgaggaacctccatactgttttccataatggctgtactaatttccattcccaccaacagtgtaccagcattcctttttctccccatcatcatcaacacttgttaccttttgtctttttggtaatagccattcttacaggtgtgaagtgatatttggcacttgatggttagtgatgctgagcatttttttcatatactttttggccacttctatgtctccttttgagaagtgtctattcaggtcccacgcccatgtatccattttacttggattatttgattgtgtgctattgagatgtttgagttcctgtgtattttggattttaaccaaaatcttggatcttttgaatattgaccctcattctgtaggttgtctcttcactctgttcattgtttcctttgtcatgcagaacctttttagtgtaatgtaacctcatttgtctgtttttccttttgttgcctgtgcttttggggtcatagtcaagaaaccattgcccagaccaacatcatgaaaattttcccctatgtattcttgtggtagttttaccatttcagatcttatgttttaatctttagtccattttgaattaatttttacatatgatgtgagataaaggtcttatttcattcttctgcatgtcaatacctacttttctcaacaccatttattgaagagctgtcctttccccattttgtgttcttggtatctttctcacaatcaatcaactgtaaatgcattgatttatacctgggttcactattttgttccatcagtttatttaccattgttgtgccattaccattcagttttgattactatacttttgtaacacgttttaaaatcaggtagtacgatgcctccatctttgttcttttgtttgttttgcttaagatcactttggctatttgaggtcttttgtagttccatacaaatctgggcgtggtggtgcgtcgcctataatcccagctactcgggaggctgaggcagaaaaatcgcttgaaccagggagttggaggttgcagtgagccgagattgtgccactgcactccagccaggtgacagagcaagactctgtctcaaaaaaaaaaaaaaagacacatgaatatacataacagtcaggatgtcctgatgggaaccatgaagaatagttaagtgacaggagatagacaaggttggtggggcctctcggggatggtgatttgggctgatatttaaagttggacagggccagtcttgcagagagccaggaagagtgctcttgagaaggccctgaaggaatgagaaccccaggtttcgggggcttggggagactgagcgaagacagggggccactgtggtgagtggacagcaaacaggtcaggtggaccagcatgggcagatcacatgtacagtaggttggatgttattttgtgagtgacggcgtaaaaaaagtaaaatatctcaatgatgtgtattgattacatgttgaaatgtagtatttcagatattttaggttaaaactatattgttaaaattaatttggcctcattctttttactattttaatatggctctcatagaatttgaattttgcatagaatttgaattttgtattatatttctgtcagcagtgccagtcaaaggtatgtaatagatgctgaatggatgacaagaccaagcctggaagagtggatttctctgtctcaattccagtgagggccaaaaaagaagtttccccaccactgtcagcctctgggaattctgtggtgactcattcattggcttttctcttccttcccaggatctcatagatcagaacatactggagcctgtaacccgtgcacagagggtgtggattacaccaacgcttccaacaatgaaccttcttgcttcccatgtacagtttgtaaatcaggtacagaatgtgtggacctcttgtccagaggtggagcgtggggcaatgaggtgggagttgtagccgatatgagtcagggaaccaagttccagcccaacctggtcttcatcaccctgttctatgattatatatttgactgattaaaaaaatagaaagaaatcttttctataatgcatgccacctggctgggaaatcgtctaaactgtcagctgcaagagggtggggggatcattagagcatagagaaggcctggcccagtggacagggctaggtttcagtagtggcacgggtctgctccagggccaggctctctcccccaggctctgtgctcctggcaggtgctcggcctcactcagccttcaggttctcaggccccttcctcctccccagcaggcccaggctttggggaagtcccccaaggcctccgtctccttgcagagtctctcaggtgatgcccttgcacctcccttgctactgaccatgccatctaaacaatgcttttcccctaatctgatgtaataaataatgaattatgctcctttttatgactcctctgagtgctggtgacagctgaagggtgggtgtcctgtatgagccctgagtgtgctggtgcagaaactggcccttagaactccttggtgaacttggttgagctgagtgggagggggtgggtggtaaggaagatcgagggatacatcagggaaacacattcccaaaaccttatgctctgttgtcagatcaaaaacataaaagttcctgcaccatgaccagagacacagtgtgtcagtgtaaagaaggcaccttccggaatgaaaactccccagagatgtgccggaagtgtagcaggtgagacagcagtcaggggctcctgacagctttcaggaacccgagaagacctgagtcacctggtacccctatttctccgctgaccctatggagcctccagacccatggggtgtccctgagcctgtggggtctcttgggtctgcagtggccgctcctggtccatctgcctgtccccacccctaccccctgcagcagccccttcccagaccctccccagcacgagtccccttggccagaccaacttgttcactgggcacaagaagcaactttctggatcccttgatccttttcagcaaacctaggaaatgcgatttccttttgaaatgagaagaaaacacttgaatccagtctgggttgtatttgttgctataccaagctgttttaaaaaatgttctttttaatattttttatgcaggcaggacccataaagacaaaagtggtcacggccgacaaaagtcataagaaggctgtgggtggagctccttcaagttcccatgaaggcctgagccaatccagccggcctcacccctggccccaatccctcaataagtcctgtcttttccctatttgggctttaagggccaagagtaatttgttcttctctggccccctaatgtttgccgtgatagggaggaaccagcagacagttgggggtgagagatcacttgtactgtgggttgactggaggaaggggctcagcttgtggccacaagggctcgtgaccttcccctggagtgtggctcctcctaacgcaggcctcctctgcagcccagggaagctcagtgtgtgcccggcacagaaggctcctgtggccccagagcagggaggctgaggggctgaaatgcgcatgctcagacccttccccagcctcaacgagggaacttgggggaccccctccagacaggagcctgtccttcccctgacaccttctcagggacattggagagggagggtggctccccttttatcccacctggctagctttccctcaggagtcctcacctccctctctgtgtgtacccaggtgccctagtggggaagtccaagtcagtaattgtacgtcctgggatgatatccagtgtgttgaagaatttggtgccaatgccactgtggaaaccccagctgctgaagagacaatgaacaccagcccggggactcctgccccagctgctgaagagacaatgaacaccagcccggggactcctgccccagctgctgaagagacaatgaccaccagcccggggactcctgccccagctgctgaagagacaatgaccaccagcccggggactcctgccccagctgctgaagagacaatgatcaccagcccggggactcctgcctcttctcattacctctcatgcaccatcgtagggatcatagttctaattgtgcttctgattgtgtttgtttgaaagacttcactgtggaagaaattccttccttacctgaaaggttcaggtaggcgctggctgagggcggggggcgctggacactctctgccctgcctccctctgctgtgttcccacagacagaaacgcctgcccctgccccaagtcctggtgtctccagcctggctctatcttcctccttgtgatcgtcccatccccacatcccgtgcaccccccaggaccctggtctcatcagtccctctcctggagctgggggtccacacatctcccagccaagtccaagagggcagggccagttcctcccatcttcaggcccagccaggcagggggcagtcggctcctcaactgggtgacaagggtgaggatgagaagtggtcacgggatttattcagccttggtcagagcagaacacagagattttccgtgtgttggtttttactctagttccccttctcatcccccttcctcagggtgtcccctaattgcaaggccccattcctgtccccagccccagggctccttgtccagtgtcccagcccccagcccagccctgtgccccactgtcctctgggagggaggtgctgcatgggcccctccccacctgctaaggagactcgttctcttccaagtggtgaaagggcccctgagcgtgtagacagagtgacttggtttctccagaaactggaagcctcatgggctgaggaactgcctcccacccacagcagagccctggcggacacaatcccttttcctcatggctgccctgactctctgaagtggcttggggttctgggctgactgtgggggacacatggccatcttgagcatcacacagaccggcgggtcctgctgcagtcctgtccttcctgtagtcttcactccacagcctcactccacagtgagtgaccctcactggacaccctcactccacagcctgcaacctgaggatggggtgtccgcctgagcacagcatcgggggcctggccccagcagcgggtcctggatgtgctgagattgggctgcctgggttgacctcattgggaggaggtggggacggcaggtccagctgcgtactggggaccctgctgcaagccctggatgtggactcctgagtcagttctttgccttcctgtggtctttttccggcactcacatcgcccaccaaggcctgggtgggtgagaacagtgcccacaaggagaccctgagtaacagagactcacagcccatccaggtctctgggcaggaaattgaaggaatcatcacattttacagaggaggagactgcagctcagagtgggggaagtgtgtgcaccaggccacaggcaagtctgtccagagcactggtaggaatgagggaaactaggaatgaccactttaaaaagttagatgagaagaatttcaaggccgggcgcggtggctcacgcctgtaatcccagcactttgggaggcggagatgggcggatcacgaggtcagaagattgagaccatcctggctaacacggtgaaaccccgtctctactaaaaatacaaaaaattagccgggcgcggtggcggacgcctgtagtcccagctactcgggaggctgaggcaggagaatggcgtgaacccgggaggcggagcttgcagtgagccgcgatcgcgccactgcactccagcctgggggacagagcgagactccatctcaaacaacacacacacacacaaaacaaccaaaaaaagaaagaaagaaagaatttcaaagttaagtcattggagtttgttggtaatatatttgtatggcttaggtcatgttacgcgcatcaccccctcaccccatgtctgctgttgggtctcagcactgggtggagggaggggcaatagtcctggtgaagaggaggggggagcggcaccagctggagtggggcctctgccgctgcctcttcctgctgtggtttctccggcttagactgcccctctcacctggcttgtctgtggggagatctttgttctctggctgcttttaagactttctccttaacagtggtttcagcaattcgattgaggcaaaaaggagctgcagaagccatgtctgtagcatttgtggcctccccttctgtataatagcagccatgttttggcctctgcagggctaaggtcctctgagcagctgcttctccacatctctgccatgcactcggcctcggagctcctggtgttcctcagcagagtccacagggctctttggggtcccctccctgtgctgtagcctggaatctgtgacctgaggcggtgagctgaggccaccactgggctcacctcatgggcttggagggaaagtcactcccccaggaagtaggtgatgagccctttactctgagaatgtctgcgcctggtggtggtgggaggacaaatgagccctgtgtcagtcctgctccctgaagcccacagtctggtggaggaggtgtcaccagggacctaaatagctatcaggaagcatgggggccacctccccgctccctgcacctccagagagactgccggctccaggaatgtcatccctccctacttgactctggcagagggaggctgtgccgttgcaaggccccaggtcaagatattggtggcctggaggatgtgatttcattaaaatcaacattgaggggaatgattgtactaacaacagcatgtgctgaaatacagtacttgcgcgtgccaagctctgttctcagcactttatacacatatgaacacacttaatcctcatacaaccagactgtacaggaaccctcattgtccttgtcttagacaagcagcgtgagacgcagaacattcgttcagtggaggggctgggcacggagatgagtgaccctcaggggcagcagcaatgattgggtcactgggttctgctgacctttcccaggggagtatttggtgcttgttcgtgaggcctgcattcacctagcgctgggtcacagctgggggtccctgagaagtcatttaaggtcacctcttatttcaggaatgaaacatatttagataagaagtggcttcccctggaccgtgatgctggcccaagactacaagacagatggcttgcttcttaatccaaggttcttcttataccaaaagaacaaagaaagaaaaaagccacaaaagactcaaaagaagcagatttcccaccacagcacaacctcagaacaattctgagttgctcattttaagatcaacgaggcatttttagggcatgtatgcctgagagaggaaatcaatgtgaacggcaaacttccctctaaaacagcctaatacaacactggtccaggaggaacaaggcaaggaaaccccctggtgaatgactcatctcaggaagaggcagggcagggtcaggagagtctatggaggagaagacctggaacaagacctctctctcttgctctcttacacacacacacacacacacacacacacacacacactctcacacccctatgagcccaaatctatgaattgagaacctcattctctgacctcaccttccatctccctcaatcagagatgcccacaaacctcagagctgtgtcccagcatcacttgttttgactcccgtccccaactgccttgacttcctgtctgcctgggaacctgtctgtgtggacttttccctctatgtccaccagtgtcctgtcaccagtggcatttgtcacctctgcctgggcagccccacatgactctttgcaccttcatggactttggggttattgatgtatgtgcctcatctccctgtgaactggaactgtcctaaggaaagggagggtcgtgccttattcctgatactccacgattccttgtatagtgtggccaccaggcactgacatgctctccttggatgaatgagtactgtgggttctaggaagcccgcatgaatgcagatgtgatgtcctcagcctttcatagacatgtttcatgtgagaggtgggaagagcagctgaacagaaggctgaggactgcccaggtccagagtcaccaagagcttgttgtcaggttttcacttgctattcgcagagattttttttaaaggcactatttgtagtgttaaaagggtgaatttatcagaaggcataataatcataaatgtgtatatgcctaataatagaactttaaaaggcatgaagcaacactcaaaaggattaaagggagatcatctcacccccttcttaccaattgatagaatgatctgatgaaaacagtaaaataacaacagatctgaacactgtcaaccatcttgacaaatacttatgcctagtgttccattattggaacactaaacatgtggaatgatttatatcctactgctcaaggtcatcaccaaggtctaattgtaaaatttcaaaaaattgcaacctcaggcataaatgggttaatcgacatttatagcacacacatgcaacatgtaccagagattccttcttttctatgaacatggtacttccaccaagatagaccacattgtgaactataaaacaaatctaaaaacatttgaaatgaaggaaattatataaaatatgttctctgatctcaatgaaattaaattaataactatatctagaaaaactcccaatatgtgaatattaagcaacatacttataaaaaattcatagttcatggatgaaatcaaaagagaattcaaaatatttcaaaataaattatgatgattatataaaatgtagaaatgtgtgggatgccactacaccagttcttagagtgaaatgcacagctttcaaggcttctgttaaaagagttgggaattacaaaacaaggagcagcgactgccaatgggtgtggagtcttttttggggtgatgatgaaaatgttcaaaaattgattttattgatggttacacacgtctataaatatatttaaacggaagaattatatgatatatatgtgatatatgaagtatatctctgtaaaattcctaaggattaaaagaagaatggtatcacaatcaatgactcagaggtctgcattactcacccataacataagtgtaaattaaactcagaggcagtagcaggaagggaaagaaataatagagtagaaattaatgaaatagaatacaaagaataaaaggaatcaacaagccaagagttgggtctcagaaatgatcaacacaattaataaaattaataaaccaaacctcaaaagaaaaagaacaatggcatgaaacaccaatatcaagaattaatgatgggatattattacaaactctacagctattacaaggataatagtgggatctgatgaataactttatgcgaaaaaaattcaacaacttaggtgaaatagagaaatttcttgaaaaaccctacttagcaaaatagtcacaagaggtaaagatcatttaaatatttctacagctatctaagaattggaatttatcatttaaaagcttacaatgatgaggctgggcgcggcggctcacacccataatcccagcactttgggaggcggaggcaggcagatcacagggtcaggagatcgagaccatcctggctaacacggtgaaatcctgtctctactaaaaatacaaaaaaattagctaggcatggtggtgggcgcctgtagtcccagctgctggggaggctgtggcaggagaatggcgtgaatctgggaggcggagcttgcagtgagccgaggtcgcgccactgcattccagcctgggcgacagagccagagcgagactccatctcaaaaaaaaaaaaaaaaagatctacctagggcctttccctctcagccacacctgacttgaatctggtggaaatcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnttcaatacttttttttatcatagaacatgcttcaattcaagtattttcttataactcaattaggtcttgtgattttcttcagataagttattccttttttttttttttttttttttttgctgagatagagtctcactctgtcacccaggctggagtggagtggcatgatcttggctcactgcaacctacgcctcccaggctcgagcaattctcctgcctcagccacccgagtagctgggattacagatgtgtgccatcatgcccggataatttttgtatttttaccccggcgagctggggtttcgccatgttggccaagctgatctcgaactcctggcctcaactaatctgcccaccttgacctcccaaagtgctgggcttacaggtgtgagccactgcacccggcctcttttttttttttttttttgacggagttttcgctcttgttgcccaggctggagtggaatggcgtgatctcgactcaccacaacgtccacttcccaggttcaagtgattctcctgccccagcctcccaagtagctgggattaccggcatgcgccaccaggcccagctaattttgtattgttagtagagacaaggtttctccatgtcggtcaggctggtcttaaactcccgacctcaggtgatccgcctgcctcggcctcctaaactggggggattacaggcatgagccaccgcacctggcccaatcttgatttcatttcattgggaagacctaggtctttcaccattaattggctctgtttttcttttcttttctttctttctttcttttttttttggagtctccctcctgtcgcccaagctggagtgcaatggcaggatctcggctcactgcaacctctgtctcccgggttcaagccattcttctgggtcagcctaccgagtagctgggattataggcacccgccatcaagcccggctaatttttgtatttttgtagagacggggtttcaccatgttggccaggctggtcttgaactcctgacctcaggtgatccacccaccttagcttcccaaagcactgggattacaggcgtgagccaccgcgcccggccggctcttgtttttctacaaaaattcttatcattgtgaattgtcctcctattctgttctaagaacaagaataggtgaataattctgctaaatggcttctcagcctccactgagacgatatgatgtttgcttattgatactattgatacggtacgttatttttgaacacattcacattctctgaatgagcttttacgttagattttccaaagtaccctcatatatatggaagtcattagtctcctaaaagccagggaggaggtagctgtgtcttgttggggtggtgaaaattgcctaaaaggggcagaaagggactttctgggaatggtggaaattctctgtcttgattgcataatggttacatgtgagtatacagttgtcatagaggaaatgaaacacttaagaaatgaacagctgagactggggcccggtggctcacacctgtaatcccagcactttgggaggcggagatgggcaaatcatttgagtccagcagtttcagaccagcttgggcaacatgatgaaataccatctctactagaaatacaaaaattagccaggggtggtggtgtgcccctagtcccacctgctcaaggggctgaggtgggatgattgtttgagcccaggagactgaggttccgtgagctgagattgcagcactgcattccagccagggtgacagagtaagaccctgttgttttttgtttgtttatttgtttgtttgttttttaactgaatagtttactgcattaacttacatctcagtgaccaaacagggacagagaatctgtgagctctgcaggatgggtggtttattatttacatggagaccaaagaggggaggtgacatgaaccaggtcccacagctggtggcttctcagggtcactactggaatccacgacttctgactctgatcaagggggttctccattgtctttttttttttttttttttttttgttgagatggagtctcgctctgtcaccaggctggagtgcagtggcgcaatctccgctcaccacaacctccaactccctggttcaagcgattctcctgcctcagcctccctagtagctgggattataggcacacaccaccatgcccagctaatttttgtatttttagtagagacagggtttcaccatgttggccaggatggtctcgatctcctgaccttggcctccttgaccacctaccttggcctcccgaagtgctgggattacaggagtgagccaccgcgcctggcccactgtcttttacagacacctaaaagctgaagggtctcagatgaaaaaggtgaatgaatatcagtgaatgtcacttgtttctttttatattctttaaacgaggctgtacaaaacataagctcgtattcctggccctctctctctctaaggaaggcggtgtgccgtgtgatgcacacacattttattgaatcccatgtgaaaaataaataaatcttgggaccataaaatcactaagccaaagggaaaagtcaagctgcgaactttgtcaggcaaacctgcctcccattttattcctaaataagatagttacaaagattaaaaagctgcatacctccctcacaattcgcccatgagggaattccttgtgggcctcaagatccttaccctaaaacagttctgctgaatttcactctggcaatgtaaattgatagctgatcttcacatgtgggacagaaagtcatccctctgtccacctgagacaaatgcatatctgactgcttcctccgccctattgtttatgaaaaatgcagattcactgagccagactaaggcatgagtgactattcctccacctctactcttttacatataagctgtgtattcagtgaaaggctgatcaaagacccaaaagaatgcaaccttttgtctcttatctacctatgacctagaagcctccacttctggttgtcccacccttctggacagaaccaatgtacatcttacacatattgattaatatcccatctttccctaaatgtataacagaaagctgaccccaaccattttggttgggacctcctgagcctgtgtcatgggcgtgtcctcaaccttggcaaaataagcttttaaaaaatttttatttatttatgtatttatttttgagacagggtctcgctttgtcacccaggttggagtgcagtggcagggtcttcgctcactgtaacccctgtctcccaggttcgagagattcttgtgcctcagcctctcgagtagctgggattacaggcatgtgccaccacacccaactaatttttgtatttttagtagaggcacggttttgccaagttggccagggtggtctgaaacccctgacctcaagtgatccactggccttggccttccaaattgttcgattataggcaggagccactgtgcctggccacaaaataaactttctaacttgattgagacctgtctcagatattttgggttcgcaccctcgcagtcctgagatctgggtggggttgctccctcttggggtgacttattgctcaggatctgtttgccccacctacctctgccccggcctcagggaatgaggctgagctgggtgtaaacagagatcccccccacagaccctgcggtttccacagatgcagaagtggccaccctgggacctgctcccatgacaagcgcagcccaggcagcctcctccctcctctgagctcctgctgcagccactgtctctccctccctcggactctcacccactttgctttcagcctcactggatgggttctcagccctgtgtgagggctgattctctgatgaccttgactccctgcagcgccttgggtgtcagggaggccaggcagtgtgggcgcgctctctatggatgggaagcaggtgggcgctggagcagtaggttcatccatgcagggggctctccaggttccccccttgggttctgggcctaatgtgggaacttctgtcctttctgaactgagtcccaattcacctggctctctacatggctttctccacccagctcagaggctgtgcttctacaactttggacagatcctaccctttaactcctggaacccgctcatgaggcagccgagcctcatggacaatgagatcctcatggccagagctgatgcagcgatccctgggaatgccttgtacggatgctagtgagatgggtcagcaaaaccaggtggggccccttggtccacaccctgcaggatgccttggaaacactggcagaaagatgtatttacaggcataattattttttaaaaactctgaagctaggccgggcgcggtggctcacgcctgtaatcccagccctttgggaggctgaggtgggtggatcatgaagtcaggagattgagaccatcctggctaacatggtgaaatcccatctttactaaaaaatacaaaaaattagccgggcgtggtggcgggtgcctgtagtcttagctactcgggaggctgaggcaggagaatggcgtgaacccgggaggcagagtttgcagtgagccgggatcacaccactgcactccagcctgggtgacagagcaagactccatctcaaaaaaaaaccaaactttgaagctaatatattatattagatgttttggtcaatacattcatttgtctcattctttttaacaaaagcatagtagcttctttcatagtggaactatggtccattctactgttgccttctgtgggtagttgcatttgtttttgaaaattctaacagcaatcatcttgtaggtatcacatatccagatagtcatgtgcactacttaaaagcagaattgcggagtcgatgagttaatgatttaaaaattttgtttagattttgacaaattgtcctccaaaagaaaattacaacaagtttactctcacaccaagagtcctacacccttgctactctgaactttcattctttgctagtctaacaagtaaacaatggtgcatctcactgttgtggttttgatttctcagcattatttgaggattttccagggtccgggagttttctgagactgagtgtaaatgatccgcagacctcagatgagatggcagaggagggtggcagggaagactgaattcccagctgtgcacttggaaaaccgtggtcagctggggccagtccccaccacctgccatggctgtgaatggagataaggtctctgtcctcaagctgtcaggatgacctcaaatgagtctggagctgaactcagttcctgaccccaggtcctcgctctgtcagtgctgggctggtccaatctctgtaccaggtccttccaccccgcccctctgtctatcaaagtgagaactgagaaattctgaaggctcagaagcttagacactcaggctgtcaaagagcccagagattggaggctaaagacggccagggttggcggtgctcctcttcaactctgtgactctggtgtggcccagctccttcttgtaaaataagacagagaggccttatttatgcagagggcctgtataaaccgcagtggactgtgttggcagtgtgaggttgtgtgggaggacaaaccacatcctcagggcttgtgtcagtcactctggactggattcccagggcacatgtcctccacccagcagaagctgcacctgctcctacctgcgcctcagtaccggctccctcagcttggggcagaagcttctaaagactaggttggagtgccatggggaggggccatggaggaacagaggtgccagactgcaagtgaggacagcgatggcactacagggccacagcctggtttacctgccatatttccagttgtccttctggtgggtgccctgcccaggttgcagtttgaagagtgagcaggaaaggtgtctgtcgctcccacatctaggtaatgtaaaagctaaaccctccaggggaactgtaaaagttggggtactatatgggtggcctaagcacttgactcctcgggggagaagctgggggttgggagttttctcctgatgcgcagcagtgtacacggggtggtgtttgtgtgtgaatgtgtcccagcttttcctgcccatttcaatgtggagttttctcagttccccatgtgtaggagtctctccactagtttctgggtttctctcagataaaactgattcatgtgtagatgtttatttggtgcttccacaaagagaggaaaagtggagagcctcctgtagaattatcttgctgatgacaaaaacctggttttcctggttttaaacctaacttagcttcactcatgggtactgtgcagagctaggtggggggaaacagactctgagggataatttaccttgtataatggagcaagaattaccagctcagggactataaggaggattaaatgagatgtgtgtgaaatgtactacatacactacccgatgatatataaggtgagtcaggaatacaaatttatattttctgggtttttttttgtttttttgttttttaagacggagtctcattccatcaccaggctagagtgcagtggttcaatctcggctcactgcaacctccacctcctggttcaagtgattctcctgcctcagcctcctgagtagctcggactacgggcatacaccatcatgccaagctaatttttgtatttttagtagagatggagtttcaccatgttggccaggatggtcttgatattttgacctcgtgatctgcctgtcttggcctcccaaagtgctgggattacaggcatgagccactgtgccaagacacaaatttatattttctaatatcctcatgaaagaagtacacgacattaatgttcatgacattttattcaatgtaatataaccaaacttttctcatttcaacatgtaattaatgcacaataaagtattaatgaaacattttacattctttagtacactaaattctttttttttttgagacacagtctccctctgtcgcccaggctggagtgcagtggcgcgatctcggctcacggcaagctccacctcccgggttcatgccattctcctgcctcagcctcccaagtagctgggactacgggcgcccggcaccacccccagctaattttgtttttgtatttttagtagagacagggtttcaccatgttagacagaatggtctcaatctcctgaccttgtgatccgcctgcctcagcctcccaaagtgctgggattacaggtgtgagccaccgcacccggcctaaattttgttttgttttgttttgttttgtttttgagacagagtttcgctcttgttggccaggctacagtgcaatggggcgatttcagctcaccgcaatctcctcctccggggtttaagtgattctcctacctcagcctcccaagtagctgggattacaggcatgcactatcacgcctggctaattttgtatttttagtagacaccaagtttctccatgttggtcgggctggtcttgaactccctacctctgcctcccaaagtgctaggattacaggcatgagctacagtgcccggcctagtacactaaattcttgaaacagggcaatcaaattgctcatcaaattcaggttagcctcagctccagtgctcaggaatccgggggccagtgcctgtcatgcaggactccgcaggccctcaggaggccctctacctgatataggccctgaactacagccaggagggaaggtgaaagaggaagggaaagacagatcggtgtagggtgttgttaggggacaaggtcggatacagtagggggaggagaaaagggtgggagaagaggatttaggattctattggtctaatgagaaatggcataactataagacaatcctattcatgatgactacaaagaataaaatagaaggataaacccttgacagaagcaggaagcttgagcccaggaggttgaggctgcagtgagccctgtgctccagcctgggtgagagagtaagaccctatctcaaaaaaaaaaaaaaaaaaaaaactaaagaagtttacattaccttttgtccaggaggggactttcataagattataatcaatgacaaaatagacatatcaatagattaagcttcttaacattaaaaattctgcacatggaaatctttgaccaaataaaattgcaaacaagaaagtagaaacctattatctgcatctgagaaagtgcatgggtagggacccgtatctcaataggcaggataaaagttgtaagttatcagtttgaaaagagaatcaaacagctaataaacatgtgacacctaagtccaaaaataaagaaatgcatatttaagttaattaatttcttcctagtttgagaaaacaaaaacgaaagagcaagcacatcagctcaagactaatgaagtgttgttggaaccaaaactgtgcatgtgtatgtggtgtgcacatgggtgtgagtgtgtttgtgtgtgtgtgtgtgtgtgtgtgtgtgtgtgtgcagaaaaaaatgcctctggacattaacacagtaattctatttctttcaggaagctaccttatgaacttggtcagaaagttgtccaagatttcttttcaaatacatacacaaacttctggctctaagtccatcttgagactgtagactcccatcctcaccttcagaggggcattccatggggtgcccagggtgtgtgttgggagagaaccagattggagtcaaaggtcagggaaaggagcactggcctagagaataagtctcttgtaatgaaaggccataggacacagagccttattgtggagtcctaattagggaaagtgagccagactggtgggagcaggggaaagcaaaaagagaaagcaggtaagcgtgaaaggaaagtaaatcttgggggccccaaatcacttagctaaagggaaaagtcaaaactgaaaacttcttagggtaaacctgcctctcattctattcaaattcaccctctgctcactgagataaatgcacatctgattgccacctttgaaaaggctaatcagaaactcaaaagaatgtaactatttgtctcttatctacctatgagctggaagccccctccccgcttggagttgtcctgcttttgcttccagttaacccacctattctggactgaaccaatgttcatcttacatatgttgattgatgtctcatgttctccctaaaatgtataaaaccagctgggtgtggcggctcacacctgtaatcccagcactgtgggaggccaaggtggatggatcacctgaggtcaggagtttgagaccagcctgaccaatatggcgaaaaaccatctctactaaaagtacaaaaatcagccaggcatggtggctggcgcctataatcccagctactcaggaggctgaggcagaagcttgaacctgggaggtggaggttgcagtaagccaagatcacaccactgcactccagcctggtgacagagcaagactctgtctcaaaaacaaaacaaaacaaaacaaacaaaacaccaaactgtgctctgaccaccttggacacatgtcatcaaaacctcctggggctatgtcaagggcatgcattctcaaccttgccaaaataaactttctaaattaactgagatctgtctcagattttcacggtttacataaatctgcctttcttcgtggtccaggacacaaagccctcctgtgcaaataactcacaatcttcccgcactcagctatcatcagacacctgcaagtcggctcactgcaaccttggcttaccagtactgcacaaagccctcttcaacagttggcataaacactagcctataaaatctccagtaagcctttgttactttgcagtcagctcctcttctgctggcttgcccattgcctccttgctacacattttcctactttctctaataaatctgctttttttttttttttaagatggagttttgctcttgctgcccaggtgggagtgcaatggtgtgatctcagatcactgcaacctccccttctgggttcaagcagttctcctgtctcagcctcccgagtagctgggattacaggcacatgccaccactcctggctaatttttgtatcttctgttagagacagggtttcaccatgttggccaggttggtcttcaactcctgaccttgagtaatccacccgactcaccctcccaaagtgcttggattacaggcgtgagccaccgtgcccagccataaatctgcttttctttacctacaactgtcttggtaaaatctgttacctctgcgccactgggccagatactggtctctcccctgtgacacttatttactgctgggtgggataaagggaagaagaagagggagaatggagaaggaggaaaggcagggttggtccagagaggaggagagccgggctggaggaatgtggaggatggaaatggtagctcccagcccccaaggggcaaaggctgggccacaattgcccctttctgttttctaaccctgacccaaatttcactgcccacatccttcttagatgtaaaagatgcagtcccacggaggaagggcagagccaggaggcagtggggctctgggctcagagctcaggagtcaccttgcctgagaaagatgttctagctgagagggcctggccatggggtgggctccaggaaaacgctggttaggtctgggatagagcaaacttgaaacaaagacaacccctgccatggctgtgtggcgccaagacttggagatcaggggttaaatcctcatagacagtaggcggtggcaacacaagcagctctaactctgggggaagccatgttgcccaagcccaggcccctccatgctcagcctccatgcagctcacccagcccagggttccaagtgaggccatgggcagtgcaggcgggaagcaggaggtagcatggagcagccgcagccccacctcccctctagggaaggcagacagcatgggagcacgcctgggcctcctgggagctgtgggccagagggagagcaggtcctccagcgcaaggggagtgggaaatggctctcacaggtgcctgcagggctgagcaacctgggtccactgatggggatacagggaagggctgctgtccctctccccagagggaggagcagacaggagagaaacagggaggaggcgcgaattccagtagccaagaacctggtcctttaaaatccagggagtcataggcaggaaactccccccacacccccaccgccaggcgggccaagcctgaaggcagagaagggacaagtaaggaggcccagcaggaacgaagccctggcctcctgtcactcagagctgtgtcacagcaggagaggaggatggaaataaacgaacaccacacctttttaatatgaggtttcatatttattttggtcataaacatatgagtatttcatatataaccaggtgttatgtgctatttggcccgggtataaagcaaaacctaaacaaatcaaccaacgccaaaaaaccccaacaatttcatgttgtcaggaagcttatgttaaaggaataagcttaaacactgataaggctggtagtctagatgcatcttcaaggaaggcctctgaggaagggacaaaggagctgggaccggactggctctctctgagctttgagaccaagtctcctgcacagaaggcccagcaaaggcaaagactaggaggcagcagcaccctgtgtcatccagaagtgcaggggacaaggtgtgggacgccagatggaagtgggagaggatggaagtgcgaagaccggaaaggccatcccctcctaaaactccatggacacaacaatctgaatgtgcgaacttcaggcagttctaactttgtcccagccaaaccagtcccggaacaaaacacacaatgccttgagatggaaaagactgaaacccctagaatgactatatccgtaatttatcctaccacgactgggctactgtggagaagagtttgctggaaagaagctaaaacgattactgaggtttttaaataaaataatggaacgtgacacaaggacaaatgtgtcagccattttagatcccgttgtcacagtgtttaagaattgatatctctgagatgagtcagatgcttacagaggggccaagctcctcaaacagggaatctgtaccctaaaacgcagctcaggaatctctgccctaaaaggcatcccagggactcagttcacagaccaccagaagcgagaggggcccatccatgcctgagtcggcaaccatttcacaccattcccaagcaccgtccactcttccctcttgatgccatggcagatgccggggcagataaacacctgctctgccctgagcccaaatgaggctcaagattcactaacgttcaactgtaatggcgcttgaaagagaagctcttcgcagtctcggatctaacttaattctcactgtcctcatctgctgtggacaagtcggaagatgcagtcccatgactgtcccagcacgacaaaccagacacatggcttcccaaagataccaggctcttcaaaatcctgggcatatgtaaacatctacttataaataaataaataaatatttatttataaataaatatggctatatacctctaaaattaacaagtaagacaagctgccccttgagaagctgccagccatcaaaccctggtccagtctcagggcgcaggagggagaactggaatgcagtaagtgcctcccacagagggaggatttctccctccgtcactagttatatttttagtcatttttgactgctgatttgtatccaggcaacccatgtaaacagcctaataagtgcatttcctaaagtttttccatgtttacatcattatacaaaaatcggaaaagagatgtacagcctacagtagtaagcaatataaatgtttctctaattaaggtgggggtaagccccaataatcctatcttaaagctcaaaactctaagtcgaaccctcgtaagtccatatgctcatgacttagcatagggctacgtcttgataatctcatcattaagtcaaaaatatccgaaactgaaaatacaggtaataacaagataatcccgttctaaagttaaaaaactataaggcaaagcattgtggctgtgcggcatctgtagttagatgtcattaaatgcacacaccagtagagatggagcttgcaatataagaagcagaaaaaaagacttgtctcatgatgaagaactgcaaagaatgacatcctaaaaccactttttttctttttaaattgagatggagtttcactgtgttgatgaggctggtctcaaactcccgagctcaagcaatccacctgcctcagcctatcaaagtgctgggattacaggcatgagccaccgcatgtggcctaaaacgacccttaatacacaatcgtataactatgcagccaagaatctgatataaatttctcccgtttgcttatcacacgcagtatttcataaaaattactccaagtgcgttaacaaagttctaggaccattggtaagctgccccatattggatagtagagtttgttggggcatgggtcaagtactggactgtttcttccaggctgcttccctttgtaggagaaaaggtaaatgagggaagctctggtttcctgaagagattctttcacaggcaggacgtagcagagcctgcctcatcttcttcataaaagagcttttcggagcccaccagttggtcctgaattgtttcctttgcatgtccttcttccagtgttgccgaggcatccagcaaggtgctgactgagaagagagaagagatttagggtctcaatgctccaaggacgatcagcacaggatcgacatggggccccctgcttccagcagtgaaacctccagaagagccctctcagctatagggacagcagttaggacaccgtccctattccctgtcctcctgctgcgtctcaaggcacaaaacacttactgtcagcggagtcagcgtcattcactggaaccagcagcctcctcctctgacacccttcagcttctgcctgttcctgtaacacacagtggggaatgctctggtcagagtcaggagtcctgcagtctagtactgaccctgaccactagccagcaagagacctgcagcgctttccctcttgggtctccatggagatggagacaaacctctggtcctccatagctcttgggctctgtgtgctggtggctcattgagacataagtgacatgcagtaaatgctcactttgtaagtgttctgaccaactttgactataggcctgtgtaattatcccctgatcaagacatagaaactgccacaccccagaaagtccccttctgccccatctaatcaactcccacccaccctcacaagaaatgatcacttccttccagaattcttaccagcagagtctcggcagactatatatgagagcacccaggaaaacctaacaaaatgatttatcccaagactgtaaatgatctttgatcatcagtactctaccatatcaatagcgtaattaaataaaatggcagtctctatggaggctggaaagacatttggtaaaattaaacagcaattctgatttttttcaaacccttttagaatagtaagctgtgttcttgatgatgagaatttctatatgaaaccaaaagtgaatgccattgctaagagtgacactttggaggccttccccagaaatcaaatcaggacccaaacacctgccttccctaagcacagctgaatattgttctgaaaggtctggcctaggcaacaagatggaaaattaaaatgaggcaagacttttggaagagggcagacacaataatcattattttcaacgtcatttaaaacccctaagatgaaactacaatattgaaatagaaatgtatgtctggaggaatgttaaaaacatagcaaatgcaataaattagcaaacagaattacaaggttatccaactcataatggatacaaaatactaaacagccataagaaacaggaataatttatttgaagaggaacacaaatcacaactcagttaccataaaatacttgacaccaaatgttatctcctttgataaggaaatactgaatattaataaaatattcagtgtttctagattaatttttaattttaaagcgaattgataaaacggcaactgaggtttttcgggagggaaggatggaggaaatcttttaattctaaattttatctgggtaaaataatacattttgaagaagtatggaagaggtgtttgctcttttggatgttaaaaaacattagaaagttcccattggaacatgcctcaaaatggtaagagccatctatgacaaacccacagccaacatcatactgaatgggccaaagctggaagcattccccttgagaactggaacaaggcaaggatgctcacgctcaccactcccattcaacatagtactggaagtcctagtcagagcactcaggcaagagaaagaaagaaaaggcatccagatatgaaatgaagaagtgaaaactcttcatggacgatatgattctataccttggaaaccctaaatactccaccaaaaggcccctggaactaataaacgacttcagcaaaatttcaggatacaaaatcaatgtataaaaatcagtagcaccgggcaccgtggctcacacctgtaatcccagcactttgggaggccgaggcaggcggatcacgatgtcaagagttcaagaccagcacgaccaacatggtgaaaccccgtctctactaaagaatacaaaaattaacggggcgtagctgggtgcggtggctcacgcctgtaatctcagcactttgggaggccaaggagggcggatcacaaggtcaggagatcgagaccatcctggctaacacggtgaaaccccacctctactaaaaatacaaaaaactaaccaggcgtggcagtgtgcgcctgtagtcccagctgctggggaggctgaggcaggagaatggcgtgaacctgggaggtggagcttgcagtgagctgagatcgcgccactgcactccagcctgggtgacagagcaagactctgtctcaaaaagaaaaaaaatcagtagcatatctatataccaataatgttcaggctgaggaccaaatcaataacacaatcccatttacaacagacacacacacacacacacacacacacacacacacacaatacctagaaatacctctacccaaggatgtgaaagatctctaagagaattacaaaacactgctaaaagaaatcatagataacatgaacaaatggaaaaacattccatgctcatggattggaagaattaatatggctaaaatgggcatactgctgaaatcaatctacagatttaatactactcctatcaaattaccaatgtcattttccacagaattggaaaaaattattggaagtaactgaatcacgtggactggtttttccagttctgttcttgtgatagtgaataagactcacaagagctgatggttttataaagagcagtcccctgcacacgctctcttgcctgtcgccatgtaagatgtgcctttgctcatctttcacctcaggccatgattgtgaggcctccccagccatgtggaactgtgagtccattaaacctctttttctttataaattacccagtctcaagtatttcttcatagcagtatgaaaatggaataatacaactccccattcaacagctgatgcttcggatatttggctagccatatgcagaacaacgaaaactagacccctacttttcaccatatacacaaattaactcaaggtagattaaaagtttaaaggtaagaccatgaactataagaattctagaagaaaacctagaaaacacccctctggacatcagccatggcaaagaatttatgattaagtcctcaaaagcaatgcaataaaaacaaaaattgtcaagtggcatctaattgaactaaagaccttctgcacagcagaagaaactctccacaggccgggtgtgggggctcacacttataataccaggactttgagaggacgaggcaggcagatcacctgaggttaggagttcgagaccagcctgaccaacaagacaaaaccccatctctactaaaaatacaaaaattagctgggcatggtggcacgtgcctgcaatcccagcaactaggggggctgaggagggagaatcacttgaacccgggaggcggaggttgcagtgagctgagatcatgccactgaattccagcctaggtgacagagcgagagtacatctcaaaaaaaaaaaaaagtatcaacagagtaacagacaacctacagaatgggagaaaatatttacaaactatgcatctgacaaaggtctaatattcaggagccatatgcaacttaaatgaacacacagaaaacaaccccattaaaaatgggcaaaagacatgaacacacatgtctcaaaagaagacatacaagtggccaacaaacatatgaaaaaatgctcatcatcatgaatcatcagagaaatgcaaatcaaaactacagtgggataccatctcatacagtgagaatggcgattattaaaaagccagtaacagtaaatgctggcgagactatgaagaaaaaggatcatttatatacttttggtgggaatgtaaattagttcagccagtatggaaaggagtttggagatttctcaaagaattttaaaacaactactatttaacacagcaaacccactactgggtatacatagaaaagaaaacaaatctgctgggcgcggtggctcacacctgtaatcccagcactttgggaggccgaggtggatggatcacgaggtcaggaattcaagaccagcctgcccaagacggtgaaaccccgtctctactaaaaatacaaaaaattagccgggtatggtggcacatgcctgtaatcccagctactctggaggctgaggcagagaactgcttaaacctggaggggcggaggttgcagtgagccgagattgtgccactgcactccagcctgggtgacagagcgagactccctctcaaaaaaaaaaagggaaaacaaatcattctaccaaaagacaccactatccataatagcagtgacatggaatcaacctaggttcccatcaacagtggattggatgaagacaatgtggcatatatacaccataggttaccacacagccataaaaaagaatgaaatcatattgtttgcagccacatggatgaagctggaggccatcatcctaagtgaattaatgtaggaacgcaaaaccaaatactgcgtgttctcatttataagtagtagctaaacatcaggtacttacgaccataaagatggcaacaatagacactggggactaccagggcggggagggagcgagaggaggaaggggtgaaaaactaactgttggatactgtgcccacaacctggataaaaccattcatacctcaaatttcagcatcaaacaaacttacatatgtaccccctgaatcaaaataaatttgaaaaaggaaaaataaaaaatgaaaaaaagtttccttggcagtgtattatatgtaaagtaatccctgtaatgtaaacaaaatgtacatacgcttgtatgaatatacatggcatatgcataaagatttctacaaagaatcacaagaaattatctgttgtattcacctgaatgaagaagggctgggggctggaggaagtgttaggggactaccactatgactcagcacctttgttttttttttgtttttgtttttgttttgagatggagtctgactctgtagcccaggctggagtgcagtggcgtgatctcagctcactgcaggctccgcctcacgggttcacgccattctcctgcctcagcctcccgagtagctgggactacaggcacccgctaccacgcccggctaattttttgtatttttagtagcaggtggggtttcaccatgttggccaggatggtctccatctcttgaccttgagatccaccctcctcggcctnnnnnnnnnnnnnnnnnnnncggccctcccaaagtgctgggattacaggcatgagccacggcgcccggccgactgagcacctttctatagtgtggcagatgtgtggctctgcatttaccactttcaaaaaatgtgcagcgcggccaggtgcagtggcttatgcctgtaatcccaccactttgggaggccaaggtgagaggatgacttgaggccaggagtttgagaccagcctgggcaacatagcaagatcagatctctacaaattacaaaacaaaggtgcaatgcgattcagcagcgtggagtaattgttgatattttttgtttatttccttacctttttatacttcccttcattaaaaaaaatggggtatagttataggaaaggaagaaaatgggtggaaagtgatccttgtctaggtaagtatttgacaagtgatcaaagaggagccaaaagcagagaaaaataggagaatcagttcctaaacaggcgtggaggaaggagacagtgactcacaacaattcagggaattcctcacttcacacagcatcacaaaagaaatggcacctacgttccactggtgtatgctacaaaccaaatcattctttaaaagtccacaaaaaattaggtaggatcatcttattttatcctgaaggaaagaacttaaaaaaaaacaaatgtgtgtccagatttcacacctactcaatgtcatatcaaaactagtgaatcgatgtgaataactggatgtgtgtgtttctgtaatacaaaagcacttctacacactgactcagaaatcctacttcttcccagaagcctccttacatacttgatcagaaatctggacaaagatttactgtgaaatatgttcaatgtagtaagaattttgaagaacatttaaaacttccgctgtttcaagcaagggctccctgacttctgttaggagcacacgatggagactgtgcagccttattcagtcctcagtgaaccctgtgacacccactctatgcctgtggagatccaggctctggggacacagcaaggacaggacagggagtaagaagcagatgtcctgcagactggcacggtcaccacctcagtgcagctgctccgtcccctgcagtcccctgtctcccaaaggctccatgtccccttgggccaggaaagaggaggcactgccatgtcccactgtctacaaagtcctgtgcaggctgcacgccaggcagggcacagtccctcctcaactcaccagcagacgctgtggctcctctggcgactctacagtcacacctgttagctctgccagctcctgaccttggatttcctgctcagagacctgggtgggctgcaagtatctgttactcagggtctcgttgcgggcattgtcctccgccccaggaactcgtgaaggacatgaacgccgccggaaaaggaccttgggaagacaaagagcccactcaagtccacaccccgggctcagcttcagggtccccagtacacagctggacctgccatccccaaccccttccaatgaggtcaccccaggcagctgaggctcagcacatccaggaccccatgctgaggtgggtcaggtggtcaccccatccccatggggccagctgtggagtgatggtgtcaccgaggctgcaggaaggacagggctgcagcacggcctgctggtctgtgtgctgctcaaaatggccgtgtgtcccccacagtcagcccagatcccccaggccatgtcagagagtcagggcagccatgaggacaagggattgtgcccacccaggctcggcagtggatgggaagcagttcctgaacccacgaagcccccagtttctggagaaaccaactcactctgtgcacacgttcgggacctcctccaccacctggaaaagaagcagtctcctgagcaggcggggaggggcccatgcagcacctccctcccagaggacagtggggcgcagggctggctgggggctgggacactggacaaggagccctggggctggggacagaatggggccttgcaattaggggacaccctgaggaagggggatgagaaggggaactagagtaaaaaccaacacgtggaaaatctctgtgttctgctctgaccaaggctgaataaatcccacgaccacttctcatcctgacccttgtcacccagttgaggagctgactgccccctgcctggctgggcctgaagataggaggaactggccctgccctcctggagttggctccgggagatgaggggtcccccagccctgagagagggactgatgagaccagggtccttggggatacacaggacgtggggatggggcgatcacaagaaggaagaccaagccaggctggagacgcttggaccaggggcagggatggggattactgtctgtgggaacggagtgggagagggcagggcagacagtgcccagcgctcccaccctcagccagcacctacctgagcagatgcctttgaggtaagaaatgaatttcttccgacatgaaaagccaaccacaaccacagctaaaatgatgactaaaaccactatgatgataaggtagtgatagggagaggcaagcatccccaggatggtggtcactgtctcctccgctgctggggttttcccagtggaactggcagctgattcatttttgcacttgatgtcactccggggcgtacaattactgaccttgaccatccctctgggacacctgggtacacacagagagggagacagggactcttgatggaaagctggccaggtgggatgaaagaggagccaccctccctgcccaaagtccctgagaaggcgtcaggaggacaggctcctcgtgtcagcagtgggtccccctgtgctcccttcttgaggctggggaagggtctgagcatgcacacttcagcccctcggcctccctgctctggggtcagagctgtagatccaggagccttctgtgctgggcacacactgagcttccctgggctgcaggggaggcctgcgttaggaggagccgcactccaggggaagatcacaagcccctgtggccacaagctgagccccttcctccagttaacacacagtacaagtgagtcctcgccccaccctgtctgccgctggttcctcccaaccacagcaaacactggagggccagagaagagcaagttactctttgcccctaaaacccaaataggataaagaaggacttagtgagaaatcgggggccaggggtgaggccggctgggtgggctcaggtcctcatgggaacttaagggagctccacccatggccttattatgacttttgtgggctacggacacttttgtctttatgggtccctgcccacataaaaaatattaaaaattacattttttaaaccaacttagagtaaggaaaaatacaagccaggctggattcaagtgttttcttctgatttcaaaaggaaattacatttcctaggttgcctgaaaaggttcaagggacctagaaagtcacctcctgtgcccagtgaacaattcagcctggacaaagggactcctgctggggagggtatgggaaggggctgctgcagggggtaggggtggggacaggcagatggaccaggaggggccaacgcaggctcaggaaaccccacaggctcagggaggcctcgggcctggaggatccatggggtcagcggagagatagaggtaccaggtgaatcaggtcttttcaggttcctgaaagctgttgggagcccctggctgctgtcttaccctgttctacacgtccggcacatctcaggggagtttttatcctggaagcttcctttttcacactgacacacggtgtctctggtcgtggtacaggaacttttatttgtttgacctgacaacagagcataaggttttgagaatgtgtttccctgacatgtctgtccacccttcctcaccaccccatcccctcccactcagctcaactcagttcaccaaggagttctgagggctggtttctgcaccagcacactcgggactcatacaggacacccaccctgtatgtaaggaccaatacaaaaggaccgtgattcattatttattatatcaggttaggggaaaagcattgtttagatggcatggtcagtagcaagggaggcgcaagggcatcacctgagagactctgcaaggagaggggcccttgggggacttcccaaaagccccggccttgctggggaagaggaaggggcctgagaacctgaaggctaagtgaggccaagcacctttcaggagcacagagcccgggaggagagagcctggccacggagcagacctgtgccgctgctggaacccagccctgtccactgggccaggcctcctctatgctgtaatgatgcccccacccggctgcaggcaatagtttagaagatttcccagcctggtggcatgcattacagaaaagattttggccaggcgcagtggctcacacctgtaatcacagcactctgggaggctgaggcaagcggatcacctgaggtcgggagttcgagaccagcctggccaacatggagaaaccctgtctctactaaaaacacaaaaaactggctgggcacggtggctcatgcctgtaagcccagtactttgggaggccgaggtgggtggatcacgaggtcaggagatcgagaccatcctggctaacacggtgaaaccccgtctctactaaaaatacaaaaaaaaattagccgggtgtggtggcgggcacctgtagtcatagctactcaggaggctgaggcaggagaatggcgtgaactcaggaggcggagcttgcagtgagccgagatcgcgccactgcactccagcctggacaacagaacgagactccgtctcacaaaaaaaaaaaaaaaaaaaaaaaaattagctgggtgtggtggtgcatgcctgtgatcccagctacttaggaggctgaggtagaagaatcactaaacctgggaggcagaggttgcagtgagccaagatcacgccattgccctcaagcctcagcaacaagagtgaaactgtcttcaaaaaaataaataaataaaagaaaagaaaaaaaagatttctattttttttttttaatcaactagtcataatcatggaacagggcatgatgaagactaccaagttgggctagaacttggttccccgactcacatcggctacagctcccacctcatcactatgcactccacctctgggcaaggggtccacacattctgtacctgatttacaaactgtacatagcaggcaagaaggcaaattgttggaagcaatggtgtaatccacaccctctgtgcacgggttacaggctccagtatattctgatctatgagatcctgggaagggagagaaaagttaatgaatgagtcaccacagaattcccagaggctgacaatggctggcaaatttctcttttggccctcagtggaatccagacagagaaatctactcttcttggcttggtcttgtcatcaattctgcatctattacactattacatacctttgactggcactgctgacagaaatataatacaaatcacatgcaaaattcaaattctatgaaagccacattaaaatagtacaaagaatgaggtcaaattaattttaactattttttagcctaaaaatatccaaaacactacatttcaatatgtaatcaatataaatatttgaaatattttatctttttttggccaggcacggtggctcacgcctgtaatcccagtacttagggaggccaaggcggacgaatcacgaggtcaggagatcgagaccatcctggctaacacagtgaaaccccatctctactaaaaatacaaaaaattagccgggcgtggtggcaggcacctgtaatcctagctactcgggaggctgaggcaggagaatggcgtgaacccgggaggcagagcttgcagtgagctgagactgtgccactgaactccagcctgggcgacagagcaagactctgtctcaaaaaaaaaaaaaaaaaagaaaagaaaagaaaagaaatattttatcttttttaaaattttttttggagacagagtttcactcttgtcacccaggctggagggcaatggcgcgaccttggctcactgcaacctccacctcccaggttcaagcgattctcctgcctcagcctcctgagtagctgggattacaggcacccaccaccacgcccagctaattttttgtattcttagttgacacggtgtatcatcatattggccaggctggtctccaactcctgacctcaggtgatccaccctcctcggcttcccaaagtgctgagattacaggcgtgagccaccatgccacgcccagtctacttttttttttttttaacaataaaataaaataacaaaataaaatccaacctcatctacatgtgatctgcccatgctggtccacctgacctgtttgctgtccactcactatggtggccccatctctgctcggtatcccccagcgcctgcaccctgggactgtcattcctagggaggctgctcaggagcaccatttctggctctctgcacaactatccctgtccagctttggagactggccaaaatcaccatccccgagaggccccaccaacctcgtctctgtctcactcatcacttaatttcttcatggttcctatcaggaatttctgactgttattttgatctgtgtgtcttaatactatcccagagaaaaggttccacgagggcagggcctcttataattatcccattagcacggtgcctgactgacagaaatcatccaacatgtccctatggaataaagaaccagaaagtgcaggaaacagaagtctggaaacacatagagataagggcatgataaaggcatgataagctaagatatcagtcttagcttgtgccttcgggctagcactacagacccaggatcctgacccacctccatagattcagcttccagatctgtcctagtgccaggtcagtccccatgaactcaggctccaggcccttccctgtggacccaaggatgagacccatcacagcacctggctgacatctgcagacccaagtacaaggcctattccagtgccagttcagccctcatggagccaggcctcaggtcacctctctggatactggctctgaccacccttgaaccacaccacatggcctgcccagaatctgtgaacaggctgactggtgaagggcgttccctgacaaagccagtctgtaaatactggattaagtccctgcttcttcaaagtgcacattccaacatattgccacaggctcctgagcaatcagggaacagtgacggcaccaaagaaacaaaatgaagcacaagtaaccaacccgaaaggaatagacatttacaacagcctgacaaagacttgaaaacagtcatcttacagaagctcagtcagctactagagaatatggatagacaactaagtcatgtcaggaaaacaatacatgaacaaaatgagtagtttaatatacacagacaacataataaagaagaaagcagaaattctaaaattaacaacaacacaatatctgaactaagaaaattccacagagaatgtcaacagcagagttgattaatcggaagaaagaatcagtgagcttgaaaacagatcatttgaaattaccaagtcacaggaagaaaaaaaaaataaagaatgaaaaagagggaagaaagccaacagtaccaacggttactgtgaagcaaaacaatatatgcattatggtggtccaaggagcatcagagaaagtgaaaggaacagaaagtgtaattaaagaaataattaaagaaaatgtcccaaaacaggatgggaatggacatccacattcatgaagcccaaaaaacccctaacagataaatatgaagagatcttcaccaagacacatcttaaacaaattcccaaacatcaaaggcaaagagaattttgaaaccagcaagagacaagcaatgtacaaaggaacccctataaaactaccaaaggcttctcagcagaaaacctacaggccaggagagagtggaatcatacaaagtacagaaaggaaaaattccttgccaaccaagaatactacacctggcaagcctgtcctttagaaatgcagagcagtaaagactttatcagacaaagaaaaaaaaaaacggggggagttcatctttagcatgtattgccttacaagaaatgttaaagagagttattcaatctgaaagaacagaacactaactggatacacaaaaccatgcgaaaatataaaactaggtggttaaatacatggtcaagttcagaatattctaatacaatcataatagtgtacaaattacttacatcattactataaaagttaaaagcccaatgtatttttttaaatgatacttaatacaatttgttaaggaatacacaacataaaaagacgtaaataatgacaaaacataaaataaggcaggagaagaaaaggtgtcaagttttttatgagatcaaagataaattgttatcagtgtaaaataaagttagacatgaacctaacttacaaattcagtagtgtttttatacactgacaagaaactatctgaaaaatcccatttataatagctacaaaaaaaatgcttaggaataaatttaaccaaggtggtggctgtatttttttctaatttggtcttgaggtttctctctgtagagtggctataaattctagccttgccctgggggggatccaggagatttcatcatggatgttcacaggaaacttatttgtcccggtggactgtctaatgcctaattgggtgttcatcttgtacatgtcccttccacaagacaattacttttactagcagtagacctggtggctcttgtctgacctatgtccagttttaagttatctctactctttaggagacagccactctttaagagagccaagatggagaaggatgttaggttcagatgtgtcaattagggaaaacacagaggaagcaacacaacaaaacacaggaaacacagaagtggtgtattacttacagactccagagagaagaggatagcacactttgcagcacttacgggaagtggggagctatccagtccgaggacactaaccggtgtgtggggagcaagagacagagagagaggacccgtgggactacacctttataaagatccatgggcattataccccaggctttcccacagggattgtggaagacaacacctgcaaagaaggttcacactgctctgctgtgaaccattaggttttattgtagtcagctcctgtgggatgtgttgggtttggggtcagggagatgatgaacaaatgtgctagatcaaaaacaattgaacagggaaaggaattattaattgggcaaaagatgctgtggtatgattgggttttaaacaacttacattgggcctaaaaatggatgtcaaggcagcaactcttttaaataaatttgtgacagaggtggaagatgtgaaaactgtaaaatattgatgaaagaaacggaaagtaacaaaaataaatggaaagacagtacatgttcatggattagaaaactcaatattgcttaattgttcatatgacccaaagtgatctacagattcaatgcaatgcctattaaaattccaatgacattttttaccaaaatagacaaaataaatctaaaatgtgtatggaaccacaaaagacctcaaatagccaaagtgatcttaagcaaaacaaacaaaaagaacaatgatggaggcatcatactacctgattcttaaatatattacaaaggtatagtaatcaaaactgaatagtaatggcataaacgaagataaactgatggaatgaaatagtgaacccagatataaatcaatgcatttacagtcaactgattgtgacagataccaagaacacaaaatggggaaaggacagcctcttcaataaatgatgtagaggaaagtagatattgacctgcagaagaatgaaataagacccttatctcacatcatatgtaaaaatcaactcaacatggactaaagattaaacataagccctgaaattgtaaaactactacaagaaaacataggggaaaatcttcatgacgttggtgtgggcattgatttcttggctatgaccccaaaagcacaggcaacaaaagcaaaaatagacagatgagattatatcagactagaaaggttttgcacaacaaaggaaacaatgaacagagtgacgagacaacatacaggatgagagatcaatatccaaaagatccaagattttggttaacatccaaaatacacaggaactcaaacatctcaatagtatgcaatcaaataatccaattaaaacggacgcatgggcaagggacctgaagagacacttctaaaaagaagacatagaagtggccgacaggtatatgaaaaaaatgctcaacatcactaatcagggaaatgcaaatcaaaaccacaatgaaataccacttcacacctgtaaaaatggctattaccaaaaagacaaaagataacaagtgttgatgatgatggggagaaaaaggaacactggtacactgttggtgggaatggagattagtacatccattatggaaaacagtatggaggttcctcaaaaaacaaaacatagaataactatatgatccagcaatcccagtattgtgtatacatccaaaggaaatgacatcagtatgttaaagaggtatcttccctcccatgtgcattggagcattatttacaatggtcaagacattaatcaacctaagtgtccatcgatgatgaaaaggtaaagaaaatgtagtacatagacacaatggaatactattcagcctcaacaaagaaggaaattctgtcatttgtgacagcatggatgaacctggagatatcatgctaagtgaaataagccaggcacagagagacaaacacctcatgatctcacatatgtggaatcttaaaacttgatctcatagaggtagagagtagaatggtgattaccagcgctgtatttgcacggtgggttggagagatgctggtcaaaggatacaaaatttcagttagacagggggaaataaattcaagagatgtattgtgtgacatggtgactacagttattaaaacaatgtgttgtacagtcctgccttctattcacagggaatatattccatggaacaaactctgcacttacacaagtccctgatacaaattgggatagtattgcatacaccccaggtacatatgctttaaatcatttctaggttacttgtaatacctaatgcaatagacatgctatgtaaataagtgctttactgcattgctttttatctacttttattgacatgttatcattttcattattttttccacatatttttgatctgtgttggttgcaaccacggatgcaacacccacagatgaggatggctacagaacccacaggtgaggagggcaaagagggcttatcccagggctctgtatccatacagctgaaaattgctgagtagacttttaagtgttcttacaacaaatacacgataagtatgtgaattagcttgatttagccatttcacaatgcgtgcatatttccaaacatcatggtgtacaccatgaatatatacaatgtttatctgtcaactaaaaataaactgatttttaaaaataagagtgcacctgctggacactcctcctccttgaggctgcgcctctgttgctgtggggccactgtctgctggggaacttcgtcctgccgggggatggtggcagagtcaacccggacctgtggggacaaggcagagatgggcttgagtggcttccagaccttacctctcccaggctccgtctcacattcccttcaccccaagtgacaaaacccatgagagcctggacttttttcccattccaaactttcattcttttgcatccgtgtttgtcccctggcctgttaggtagctattttctataaagaaaaacacctccgtatccttttatcatattataacataaaatatatttaccccagaaaatatgagcagaagagtttttttttttttttgatagagtcttgctatgttgcccaggctagaatgcagtgtctattcacaggtgtgatcatagtctactacagcctggaacttctggcctcaagtgatcctcctgcctcagtctcccaagcaagttgggtaacaggaacacaccactgtagttggcaagaaaagattttataagaacacaaaaggccaggcgcggtggctcaggcctgtaatcacagcactttgggaggccaaagtgggtggatcatgaggtcaggagattgagaccatcctggttaacacagtgaaaccccgtctctactaaaaatacaaaaaattagctgggcatggtggcgggcacctgtaaccccagctacttgggaggctgaggcaggagaacggcgtgaacccaggaggcggagcttgcactgcactccagcctgggcgaaagagcgagactctgtctcaaaaaaaaaaacaaaaaacaaaaaacaaaaaaaccacacatatgagcccttcaagcagaaatagcatctaatgtatttagtttgaccaagtgtttaattgaccagtgggtgaatattctctctctctctctctctcgcacacacacagacacacacataaaaatacacatttttacaaatgagggttacaatataaccttaaagaaagtcaggatatagcatcaaacattaagtaatttctgcttcacaaaggaccttgacaagctgttcccactaaatatcaaagagtgacagaaaaagataaaacagcaattcagggattatggccatgatctctgtgttataaatgacgacgagaagacaactggagaatcggaatagagtctgcatattagatagtggtaatgtgttgatgttaatttccttgtttgtagaaagtacacactgaaaaattcaataatagctttcatcatgccaacagctatttttcaaattttttttgcatagtttttgtaacttttaagttgggagtgtgtaaaagtacaaaattaatttaattgtaaatttacatttaattaaatttaatataatcttgctcctgagaaaaaacaaaatggttacaataaaagctacttaccttgggctctgttcaactacctggctctcagcaagacaaaatgtagctttcttccacatgaaagcctgcctagtagttggtgacagtgaagctaatgcacatttcccaaatcctcccttctagagctggggtccctctaggttcaggcgatgtctctgtcacctttctctgctctcacacccttactccttttcaagagcaactattcattttctcaactctttttttttttttttcttttttggagacgggatctccctctgtcatccaggttggagtgcagtggtgtaatctctgctcactacaatctctgcctcccgggctcaagtggtcctccaacctcagtccctaagtggccgggaccacagacaggagagtgccccaatgcctgggctaatattggtgtattttatacagctggggtttcatcacgttgcccaggctggtctaactcctgagctcaagcgttctgcctgcctgagcctcccaaagtactaggattacaggcgtaagccaccacacacagtccgttttgtcagttctttttgtggtttctattctatttccttgatttatgttcctccttgttactttggtttaaatttatgcttatattttatgattgattaatgtagatcttcaggccataaatttcacatatttttctttttttgacagctttaacgagacacaaatcacataattagtaattatgattattcatataattcacccatttagtctacatttcagtagttttttaatatactcatagctatgcaatcatcactataatcaatcttagaatgtttttatcactccagaaaggaactgcatacccttcaggagtaactccccatctccccaatttttttaatagacacattgaaagctgtattatttcactccgagcactgttagccatttcccaccagttttgctgttatattattattatttattttgaaacattttaccttcccttttgatttcttctctgaaccacagattttttagaagtgtattgttcaataaccaaattttagaattccctatggatactattactgacttccagtctcgtttcattaagtttagaggtcatatcgcgtgttttatatcccagaacccagtctatcttggtgaaagtatcatgagcatagaaaggaatcagtgttcagtggatgttccactcctgctctttaaatgtcagttaagtcaaggtggttgatagtgtgcagatcgcttgccactttaccggggttttcatctgaccgttctgtcaattacagagaaacagctgatttaatctccttttcattctctttttgcatcatgtgttctgcagctgtattactaggcatatacaatttgtgattattattatactccttgaagaattaacctttttaactacaagggtcccttttgagctcccataatattctatgtcctaaaattgttacagtaggcagctagtcaggtatgagcagggtaggagagggctccccgcttctgacaccagcagtgttgggcgaccatcaggtggttgataaccgtgtctctaaagtaagaactggttacagccaatgccagaaaaaggcagtctcctaatacatagaaaacacctgaaactgatcagcagcttcccaataagatttcaggagtggggagaagtaaggcaagatcctggaagtaggccaacctataaaaccccaactcaggcagtccggctgtgcactgtttctcaagtcacctgctcggccatctttcaagttgtactttccttcttttctttccgttccttcctttccttcctgttctaaagcttttttaataaactttcactcctgctctgaaacttgcctctgtctctccttctgccttatgcccctcagtccaattctttcttctcaggaggcgaagagctgaaggtgctgtggacccatacggattcgccgccttcaacgtagggtaactcggatctcgtccaccgctaacaaaatcaacttcatgtgatactgagatagccacggcagttttcttggccttacactctgcgtggggtatctttttccatctatttgctttccacagacagcatctgtgtcttccttttaaggcccatctcatatagacaagatatagctgagtcttgttttttcagcccttccaaacatttctaccattgaactgtagtgctcagtggatttacagggagtgcaataattgttagtcaaaatagacctatacgtttaccatttaaactacggttgtctagtctaatttttttactcctttttcccctgcacattttaatgttaattaccttttagaattccactttaactgggtactgactttttatgcatacctatttccatgatctatgtgcaagtgctatagggaatacagtatacactcaagtgcttatattctattgaaggtttttttaaaatagatttattgtggtataatggatatgaaacaaagtgtacatttttgaagcatgtagtttggtaggttgagatgtacgtatacactgtggaactatcgccgcgataagataatgacatgtctaccgtcctgcagtgtttcttcatttttcaatgtaatcctctcttctgctttgctcctatgtccccagcaatgcttcttctgctttttatcacaatagattagttgtattttaataagatgaggaatcacatggtatgcattctgcttgtattccttcacacgacatgattttctgtgtgtgtgtgtgtgtctgtgtctgtggtttttggttttattttggtttttggttttgagacagcattttgctatgtttcccaggccggtcttgaactcctgggctctaaggatgcacccacctgggcaggactatacatgtgagccatcgcacctgcccacccaccctggcccattgactattatcagttaaaggctactgaaaaacagcaggcgcaataagatgctttgacctcttttgtgtttcctaaaagcaggagatgaaagtccccagggaaacataggacgatctccttatttttaaggatgagaagtcgaggccaagagattactgtgcagaccttgttagaacagaaccactcagctttttagcctccatatatttactagcttcttcacaagttacttggtccaattcaatatataagtaactgactctcactgcttctctgtgctaggtaaaacttgcattaaataaatgtgtgtgttggctgggcatggtggcacacacctgtaatcccagcattttggaaggctgagatgggcggatcacctgagctcgacttcgagaccagcctggacaacatgacaaaaccccgtctctactaaaaatacaaaaattagccaggcgcaagggtgggcacctgtaatcccaaggtactcaggaggctgaagcaggagaatcgcttgaatctgggaggcggaggttgcagtgagccaagattgcaccactgcactccagcctgggtgacagaacaatactccatctcaagaaaaaagaagtcgtacgtgcttttctcctgtgtacctgtcttatgtcaatttaattctcaggtccagccaaaaaaaaaaagcccttcaaggggagcttcgcttccctctatgactctcaatggtgactctaaccaaacaccatcctccacgccaacaataccacatcctatagccttgcaccaacacggcctctctggaggagggggaggcaatggtggtgagatctcaggcctccctcatgctacctcctattagttatatgattcctggtgtcacctcacccaccacactgtgggctccaggaagcaggattcacatggggttcatctgtcctccctggctccagcagactccaaagacaataaagagctcattgtctatttcctgggtgactcactttccccccaagcccatgaggtgagcgcagtggcggcctcagcttaccacctaaggacaggctccaggctgtggcacagggaggggactccgaagagccctgtggactctgctgaggacccataggagctcccagaggccaagtgcaggacagagatcagagaagcagctcctcagagaactctagcccttcagaggcccaaatatggctgctattattcagaaggtgaggacaaaaatgctggagacattgctcctgaatctcattttgccacctgtaaaacagggaaaacaacctgccctcatgtcccctggttgttaggaaaatccactacacgaagatgtacactctctggctgggagcaggataccagctgcccaacagcacaggctcggggcatggcactgtccccactgtctccatccccaacctggaagctagagcctcgctaccctgccactcctggatacaggacagagaaccagaactgggaccgtggcctctcagtaggggctgggtgagcagccatctgcagccacctggatggagacctttcctgctcatcttcaaactccaacccgggccggacacccaccagaagcacaactggaaacttggcaggtaaaccaggctgtggccctgcagtgccatcgctgtcctcacttgaactctggctcctctgttcctcgatggcccctccacatggtgctccaccccagtcttcagaagcttctgccccaaggccagggagcctggtatggaggtgcaagtaggaacaggtgcagcctctgctgggtggaggacatgtgccctggggatccagtccggagtgactgacaccagccctgaggatgtggttcatcctcccacacctgctaacacagccctctgaggtttacacagggctgctgaagatttttatctcctcttcactttacaggcaggagctggggccacaccagtgtcacagagctggaggggaagcacagcagggcccagctgttcccagcctccaatctcaggagtccttgagagcctcagagtccgagattctgggccgttggatcttttcgattcctactttgataaagagaagggcggggcggaagcctctgtcacacagattggaacagtccaacgctgacagagccaggacctggggtcaggaactgagctcagctccaggctcatctgatgtcctcctgacagcctgaagatggagaccttatctccatttacaggcgtggcaggtggcagggtactggccccagctgaccacggttctccaagttcacagctgggaattcagtcttccctgccaccctcccctgctgtctcatctggatcccccggtcatctactcccactaccaaaactcccgtatccttgaaaattcctaataccattaaggaatgaaagtacataacaatgtgatgaatcaccttttacttcctagactagcaacgaatgaaagctaagtgtaacaagggtgtagggatacaggcacatgtgtgaactaggtgtgagtgtaagctgagttcaatggtcttttggaagaaaattcgtaaacatctaaagaaacttctgaaatgatttatcccacggaagtagaagtaaaattctacttctaaggagttgcccaataagctggtgcgcatggacatgtggacacacgatacatacaagggtatttagtacaatgctgttggaattagcaaaggcaaatttgctttgggttatatcccatcgggatgggatataaccagctgcctctagatggcaacagtgaattaacctgtggcttacccatgtagtaaaatacaatacccttgtttaaaagaaaatcaatctgaatgtactgccataaaacatctaatgtgatttgtgctagctccaaaattttaaaaagcaactgtgcattgaaatgcatttaataaggcaagattgatggagggatcaaagcctcctttgggacgcatagagttcacattcccaaaactgtgaaattcaggttgctggtcttgtctacacaggtcatccacacattctctcttcagggccactgtcctgacacagccattcttctagctgcctcaggtaggtccacccactataaactattgtagaagtcagttgtgtaatttttgagaggtgaaaatgtcactgctgttctgaatttagtattacttcgttgaaagaaaacatggagactctcatggttcatgtaatcttgttttatcctccccgttttgttttttggtattacgtaagaaaccttagaaagcactgttggcagaaacgtcagtcactcagaaaaagtcctggcagtctgcacatcttatttttatgtccttcttgtgcaccccactaccaatctcagtttccaaacccaactcacaacgagaactttacatcttttatgcctaaggaaggggccatcccgcggtcctgcctatgggatacagaggggacacacgggtggcagtggaagacactgactgcaagcaccttggttaaccgcttcctgccactttcagggttctataggaaatgaaagttacaaaaaacagcgttggaaagctttttcacaggctgtttgttaaactgatctccaagaaacacgtgtaacagtgtaaacatagggttaattttgtttgtttgtttgtctgtttttgttaaggcagagtctcgctctgtcgcccaggctggagtgcagtggtgcaatctcggctcactgcaacctctgcctcccgggttcaagcagttctcctgcctcagcctcctgagtagctgggactacaggcgcaggctgccacgcctggctaactttttttttttttttttttttttttgagacggagtctcgctcttgttgaccaggctggagtgcgatggcgcgatctcggctcactgcaacctccgcctcccggattcaagtgattctccttctgcctcagcctcccgagtagctgggattacaggcgaccgccatcacgtccggctaatttttgtatttttagtagagacggggtttcaccatggtggctaggctggtctccaactcctgacctcaggtgatccgcccgcctcggcctcccaacgtgctgggattacaggcgtgagccaccgcgaccggcctgggttaacgttatgaacgaacgaacgaacgaacgaacgagaggcaaccgctctgtggcttcctgaggttcactccggggtttccatcttgactccctccctccgctgattctggaacttcctctggggcagctcagtgcggtcctcgccgcacgggacagccagggggagcgcgcgctctgctccctcgcggcccggtcgctcctgcccagcccgggcaccccactcttcccctgactccgacggcgggttcgtcctgcccagacatgcccggccgcaggcgacccgggccaagcatccccaccgtgtccccctctctccctgcccactcccggcgccaggtgcgctcttccccagccagggaccgcggcggagactcaccggcagcagaaccgcgacgatgaagacgacgaacttaaggatcttggagtccaggagccatggtctggttcccgacgctgtcctggctcctggatagcgccctgctcgagcgctcgaggcggtcgggacgctttgtccccaaagtcccatgagaagggaggagggtggatcgaaagcgccaaaaatcaatcagaaatcgtccccgtagtttgtgcgcgtgcaaaggttctcgcagctacactgccagaatagaacgtgctcctccgcttttataccccggaaaaaaggcgtggtcagttgtactcccttcccgcagtcacttccaggcactcaggctgggtctcccccagcacctccaggagggcccaggttgtgtgggtgggtgcatggacggacaggaactggctctttccggcagcggtgacccagggcctgcggtttgattccgggtcctgtccaggctgtaggcagcagaaggggaaggagctgaggcgctgcccgctgcgctgctgtagtctgggtagtgagctccagaggaggcactggaggcccatcctgagcctgctccctccccgggccgcctgtctctcctcttcttaaaccctgaactacttcctggcctcaggacttcagtccactcttagcttctgctcccactccctcctcccacagcggcctcactgaccagtgcactgatgccactgatgtctccagcctccttgctgctgtgacccagctccaagcttctctggcaggggcttggtatccctcagtagcgggtgcctggcaccaaggaggggcccagtgaacacatgagtggacagaatgaaggacacagaggccatgacaggcacctgcagaggctgaggagtaggtaggagggagaggaacgccgggggcatccctagccacaacctggcaccctttgcatggtcaaagcacaaacactccctgaccaaccttgagggctctagtattgaggccccatggagacaggggaatcaggggagtgccttccaaagtctgtccccaagtctattgtctacccaggtccaactgtctgaccttgggctacttacctccccatccagttgaacacactgccgctgtgagggcagacccaatgtgtggttttgaagggtgccagcttgtgaccctaagcagtaaggtcaatggcaggactcctagacccttgggatgagtcggctcctgacccctcacatggtagatagaagaggatagcgctatagaaatgaaggttttttggctcatgagaaacctgggaataaaatgtcatcctctccacaggcttggatttgagtgatggatcaccctgagcaccttccagggcccagacaatgacctagggtcagaaatgtgagccagggccgggcgcggttgctcacgcttgtagtcccagcactttgagaggctgaggtgggcgaatcaagaggtcaggagttcgagaccagcctggccaacatagttaaaccccatctctactaaaaatacaaaaattagctgggcgtggtggcgggcacttgtaatcccagctactcaggaagctgaggcaggagaattgcttgaacccaggaaatggaggttgcagtgagccgagatttgtgccactgcactccagtctgggtgacagagcgagactctgtgaaaaaaaaaaaaaagaaaaaaaaatgtgtgccaggtcccaggcactgagctagggtcagaaatgtgcgccaggttccaggcactgagctagactcagaaatgtgtgtcaggccccaggcactgagctagggtcagaaatgtgtgtcaggccccaggcactgagctagggtcagaaatgtgcgccaggttccaggcactgagctagggtcagaaatgtgtgccaggttccaggcactgagctagactcagaaatgtgtgtcaggccccaggcactgagctagggtcagaaatgtgtgccaggccccaggcactgagctagggtcagaaatgtgtgccaggacccaggcaatgagaaatgtgtggggtcaggaatgtgtgcggggtgcagatccaggcaggaggtgaaaggtcagggacttcaggaagactgacagcattaacacagagccaccagggcctgcaggaaagtccttagagcaccttagctcccttggccctggagggtggaccacacagtatagaccagaaaccagactgcaggtaacaacgcattctctgtgccctgtgtggagcactgactagggctaatggcaaaaggctgtgagcacctccaaggaactgggcctttagagtcaagtttccatttaagaggcacttactagcttgagatggaacactaactgaagtctcccctgtcactgaaggacataaaataatcttgaaacctgaaaaactgatgatgtcttcaggaatcttggaaaagctctaacggggaggccagtcccagaagagttctattacaaaatggattttttttttttgagatggagtctcactctgttgccaggttggagtgcagcacgatccaggctcactgcaacctctgcctcctgggttcaagcgattctcctgcctcagcctcccgagtaggtgggattacaggcacatgccaccacgcctggctaatttttgaattttcagtagagacgagggatcttcatgttggcccggatggtctcgatctcttgacctcgtgatccacccgcctcagcctcccaaagtgctgggattacaggcgtgagccacctcgctcagcctaaaaaatggaaatggttgatatgggatcctggtgcctgaggaaggcaaagaggagacactcatgagcagggagcctctgttcccctcagactgagtctggaactgggtgaggagctgctggattctgtggtcacttggacattgccctatacacagctctttacttactgaccaagagctacttagtttgtagacagtcattcctagatgaatggacaacatcctacttggaaggccacccctctgatggaagaaggcaaaggcaaattggctaggtgggttggattgcatgctattttcctagccttatggaagatttgaacagcagcaaaagcccctgtacttgagtttttttctggctcatggacagtcgtcaatgtcccggtcatagagttgggaaggagaatgtgaaagttgatcgcacaaattgggtcattcttgtcacacccaactaaaacagagtcaagaggccatggggaagaaaaatcactgtattacccccaaactgcaattctctgtaagtctggcagctgtaacctgaaactattaatagttctgtcttatatctattgacacaaccagctgctgctctaagaccagcctgacccactgcagtcactcaccagtcagagcatgccacttcttcaaattttacagcgccaatgaactttctgcaaaaaaaaatacttagtatttctcatttaaaaaaaaacatctggccgtgtgcggtggctcacacctgtaatcccagcactttgggaggccgaggcaggcggatcacgaggtcaggagatcgagaccatcctggcaaacactgtgaaacccggtctctactaaaaatacaaaataattagccgggcgtggtggcgggcacctgtagtcccagctactcgggaggctgaggcaggagcatggcat

SEQ ID NO: 12294 - DNA, 37622 bp, Human
  misc_feature (1)...(37622): n = A,T,C or G
aatcaactgtatttctgtatagttgcaacaaacaatttgaaaataagggaagctaaatcaattccattagcaatagtaacaaaaatagttagaaatatgtttacaaaagatatgaaagatttgtacatggaaagtttgcaaaatattgtcaagcttaagtaacaaatatctaaataaataaatttcatggattgaaagactcaaaattgttaaaatgtcaattattctcattcatctctacattcaatgcaatcccaattaaaattccagtaggcttttttaactgaaaaaaattattctatatttaatatatacggaaatgcaaaccatttgggaggtgggtagtagggggaggacttgaactgcctgatttcaagactgactatacagctcataattaggacaatgtggtaattagcatgagaatagccaaataaataaacggaacagaatagagtccggaaatggacacatacatatatatggtcaatttaatttcaacaaaagtgataaggctattggataaggaaaaaaagtcttttttttttttttttttgagacggagtttccctcttgtggcccaggctggagcgcaatggctccatctcggctccccgcagcctctgcctcccgggttcaagcgattctcctgcctcagtctcccggagtggctgggattacaggcatccgccaccacgccccgctaattttgtatttttagtagatgctgcgtttctccatgtcggtcaggctggtctcgaactcctgacctcaggtgatccgcccgcctcggcctcccaaagtgctgggattacaggcgtgagccaccgcgcccggtcgaaaagagtcttttcaacaaatggtaccggaacaccattaaaatatggagaaaaatgaacatcaatcagcgccccctttctcttacccactcctcagccccaaggtcgccctgggagttcttcgcaggcaggaccgtgactcgcgtggctttcgggaggctgattacccacgccccgtgcccgtgcagcgctgggtgcagaggaaccgctggaaggacctgtcccccgtgggacccccaccaagtctcatcccgtgtcatgtgccagatagtctcccgtggtttaaggactttcaagactcttaacaggttaggaaaatccagaagaaaggcagaattgggtccctcgggcttgcctgacaccagggacggtggagttgaggtgacatttcactggcatggagacctgaaaccaaaagcaggatgagccgggcacggtggctcacgcttgtaatcccagcactttggaaggccgaagcgggcggatcacgagatcaggagctcgagaccagcctggccaaaacagtgaaacccccgtctctactaaaaatagaaaaaaaattagccggacgtggtggcgggcacctgtaatcccagttactcaggaggctgaggcaggaaaatcgcttgaacctgggaggcggaggttgcagtgagccgagatcgtgccactgcactccagcctgggcgacagagcttgactccatcacaaaaaaaaaaaaaaaaaaaaaaaaaaaaaaaaaagggcaggctgaatcactcgccaggtagtgacggaggaggccgtaaaagcctcttagaggccagaccccgcagtggcctctgtgtccttcattccgccacccatccgtccaccgagcgcctgctgggtgccaggaactgggtcacagaaaggctgaggtcaactcccgaccgagaagcctggcgctgggaccaagtggcaaaacgactccgaatgcagcggcatccacgcggcggccgtggttgaggaacagaagctgagagcggcaagggcggtcacagaggaaggaagttcagggttagccaacaggagccgcaggtgccccgaaaagggggcggggtcaggggtgccctgaactccgaatgcgaagttctgtcttgtcatagccaagcacgctgcttcttggattgacctggcaggatggcgccaccaccagctagagtacatctaggtgcgttcctggcagtgactccgaatcccgggagcgcagcgagtgggacagaggcagccgcggccacacccagcaaagtgtggggctcttccgcggggaggattgaaccacgaggcgggggccgaggagcgctccctacctccatgggacagcacggacccagtgcccgggcccgggcagggcgcgccccagggacccaggccggcgcgggaagccagccctcggctccgggtccacaagaccttcaagtttgtcgtcgtcggggtcctgctgcaggtgagtccccaccgcggtcctgcctggggaaaagcgcgcctggcaccgggagggggcagagagagagggggacgcggcgggggtgcctggcccgggtcacttgtggcggggcatgtccgggcaggaggagcccgtcgtcggagtcggaggaagaacggggtccccggggccaggcaggagcgacccgggcctggaggcagcagagccccctcccgcaggaggctgggcccggggactccaccccgttggctgctgcctggcgcgtctccctcctgcccacacctcacgatgtatcgggaagtttcggaatcgatagagctcaagtgtgtaaacttccaagccaactcccagccacaccagctgcgtgaaggggagcgccattctccccactccctgattccctccccacccccgtccttcttttcttctcttcttttttttttttttttttnnnnnnnnnnnnnnnnnnnntcttttcttctcttctttttttttttttgaaacggagtctctctcttgtcgcccaggctggagtgtagtggcgcgatctcggctcactgcaagctccgccttcctggttcaagcgattctcctgcctcagcctcccgagtagctgggagtacaggctcctgccaccacgcccggctaattttttgtatttttagtagacacggggtttcactgtgttagccaaatccgcccgcctcggcctcccaaagtgctgggattacaggcgtgagccaccgcgcccggccctccatccttcttttcttagacaaattggttaaacacgcagcccggcaggaaaaagtaactttctctcctctgctcgttgtcttccgtttcgagtccactgagcacaccggcagcagtttccttccagccactttcttgcgcatcaacaggtacagggcagcgaattgaccaccacgaggcaggcagccaggagcggggcacgcccttccttcaggaggcagcgtttcctgtgaaagcaatcactcagtctggaaaaatgccaatgccttcagttctctttcaagttcattaaggctctaccaattgttctcatccagattccttctatgttaaggaaaaacaaaacgaaagctaagtacctgaaggataaaccagtcttacaagtgtcaggaaattttacgtgtttttgtttaacaaactaaacaaaatccaggaatccaatagcattttgaaatctccaaataattacagaatttatgttttaaacgtcagtttatgttaggtggaacccacgtttgactcttatttttaatacgcttattaaatggctttctttttgacaggctagtgcgattccaggtggatgtagggctcacctgtatagacaaggtgaaacatctgaatttggtggttttggaaatgtcacagtccgttggtgtggctataaaagaatacttgaggccaggcgcggtggctcacgcctgtaatcccagcactctgggaggccgaggcgggcggatcacgaggtcaggagatcgagacgatcctggccaacacggtgaaaccccgtctctattaaaaatacaaaaaattagccaggcgtggtggtggccgcctgtagtcccagctactcgggaggctgaggcgggagaatggcgtgaacctgggaggcggagcttccagtgagccgagaccacgccactgcactccagcctgggcgacagagggagactccgtttcggaaaagaaaaaaaataaaaaagaaaacttgacgctggataattttaaaagaggcttatttggcacatggttctgcaggctgtacaagaagcatgccaccagcatctgcctctggtgaggcctcaggaaacttccactggtggtgaaggggaaggacagctggattctgcccatcaggggaaggggtggggaggatggcaggaggagggggatgagatccggaagggagacggggaggggccaggttcattctaacaaccaggtgtcatggggaactaagattgacaactcctgggggaatgtgggagggggcggttatggcaccaagcctttcatgagggatccaccccaaaccccaacaggccccaccagctacattacggttcagatttcaacgtgagccctggcagggacaaaggacccgtagcagacaccaaggccttctgccatcccacaggaccctctcatcccaccatccctcagccttcttcctgtgcatttataggcaccttaacttttaaaattctgactgaagaacaaatcgcattggatgttttctatcagtacatgcaagtatctcattctttttaacagcatcataatatttagtgcatgggtgaaacacatggcgtgaaccacagttaattttaatcttccatcccatgggcaattgttaacattatgtcctgcttttgttttttctaattccagcagcattgtagtgagaacccttgtatgtgtcatatgtccatatgtcaatgttccctgaagtatcgggcagccctttagaagaggaatttttgggtacatgagctcatcaatgtagaattttgtttggatattgctaaattgtacttcgggagaagattgtgccagttttactctcacaccaagaatacaaaagtgtggccgggtgcggtggctaacgcctgtaatcccagcactttgggaggccgagacaggtggatcacgaggtcaggagatccagaccatcctggctaacacggtgaaaccccgtctctactaaaaattgaaaaaaattagccaggcacggtggcgggcgcctgtagtcccagctactcgggaggctgaggcaggagaatggcgtgaacccgggaggcagagcttgcagtgagccgagatctcgccactgcactccagcctgggcgactgagcgagactccgtttcaagaaaaaaaaaaaagaatacacaagcgtgcccgtgtccctgcacccttactacatggaactttcattctttgctactctaagaggtaaaaaatgatagacctcaatgttgtattttttgtttcagtgttattagagattttcaaggatccaggaattttttgagactgggagtagatgacctagagactccagattagaccgttggggagggagcagggaagactgcagtcgcacctctgcacttaggaaactgtggtcggctggggccagttcctgccacccgccatgcctgtgaatggagataatgtctctgtcctcagactgtcaggatgacatcagatgagcctggagctgagctcagtttctcaccccaggtcctggctctgtcaatgctggactggcccaatctctgtgccaggtccttccacctcgtctcgtctctctctttatcaaagtaggaaatgagaaattctgatggctctgaagcttagacactcaggctatcagagcccagagattggaggctgaagacagccagggttggccgtgctcctcttcagctctgtgactctgctgtggccccagctccttcctataaactaggtggatataaaagtctgcagcggccctgtgtaaaccacagtggtctgtgttggcagatgtgtgctgtcgtgtgggaggacaaatcacatgctcagggctggtgtcagtcactcaggactctggatccccagagcacctgtcctctacccagcagaggctgcacctgctcccacctgcacctccatactggctctctgagcttggggcagaaggttctaaggaatggggtggagcgccatggggaggggccgtggaggaacagaggagccagacttcaagttaggacaaagatgtcactgcagggccacagcctggcttacctgccacgtttccttccagttgtccttctggtgggcacccggcactggttgcagtttgaagagtgagcaggaaaggtctccatccatgtggctgcagatggctgctcacccagcccctactgagaggcaacagtcccagttctggtcctctgtcctgtatccaggagtgacagggcagcaaggctttagcttccaggtcggagatggggacagtgccatgccctgagcctgtgctgttgggcagttggtgtcacttagtctggaaaaatgccagtgccttcagttctctttcaagttcattaggacaggtgccctggggatccagagtcatgagtgactgacaccagccctgagcatgtgatttgtcctcctacacggcagcacacatctgccaacacagaccactgtggtttataaagggccgctgcagattttatatctgcctagtttataggaaggagctggggccacagcagagtcacagctgaagaggagcacggccaaccctggcagtcttcagcctccaatctctgggctctttgatagcctgagtgtctaagcttcagagccttcagaatttctcaatttctactttgctaaagagagaggtgaggtggaaggacctggcatagagattgggccagcccagccagagactgcacatcttcattcagggtattttcctaacccagggatgtggggattgttgctctcattttgtctggggagaaaatgagatttaggaggaggaagtccccagcatttgggacctggcctgcttgataatagcagctgcctgttggactgggaagggcctcttccggattcccaggcaggtatctgtgataatggggaaaggagaaagggtctgctttgtagggaagagcagggtgcactcggcacctcagacactcgcctgtggccaggaggggatgtgaatcatcacattttacagaggagaggaccaaagctcagagagggaaagtgtgtgcagctcagagggggaacgtgtgtgcacctggccacaggcaagtctgtccagagcactggtaggaatgagagaaactaggaatgaccactttaaaaacttagatgaagagaatctcaaagttaagtcattggagtttgttggtaatatatttgtgtggcttaggtcatgttaagtgcatcacaccctcgcccccatgtctgctgttggtctcagcactgggtggagggagcggggacagtcctgatgaagaggagaggggagcagcaccggctggggtggggcctctgccgctgcctcttcctgtgtggtttttcagggcttaggctgcgcctctcacctggcttgtctgtggggaggagatctttgttctctggctgcttttaagattttctccttaacagtgtggtttcagcacttcgatggtggcaaaaataatctgccggagccatgtctgtagcatttttggtctccccttctgtataatagcagccgtgttttggcctctgcagggctaaggtcctcgtagcagctgcttctccacatctcgccatgcactcggccttggagctcctggtgttcctcagcagagtccacagggctcttcggggtcccatccctgtgctgtagcctggaacctgtgacctgaggcggtgagctgaggccaccactgggctcacctcatgggcttggagggaaagtcactcacccaggaagtaggtgatgagcactttactctgagaatgtctgcgcctggtggtggtgggaggacaaatgagccctgtgtcagtcctgctccctgaagcccacagtctggtggaggaggtgtcactagggacctaaataactatcaggaagcatgggggccacctcccccaccccccacctccagagaggctgtgccggctccagggatgccatccctccctacttgactccagcagttgcaaggccccaggtcatggtattggtggcttagaggatgtggtttcattaaaatcaacattgaggggaatgattgtactaacaacagcatgtgctgaaatacagtacttgcgtgtgccaagctctgttcttagcacttcatatgtaaatgaacacacttaatcctcatacaaccagactgtacaggaaccctcattgtctttgttttagacaaacagcatgagactcagaacatttgttcagtagaggggctgggcaggaggatgagcaaccctcggggcagcagcagtgattgggtcactgggttctgctgacctttcccaggggagtatttggtgctttttcatgaggcctgcattcacccagcgctgggtcactgctgggggtacctgagaagtcatgtaaagccacctcttatttccagaatgatagacatgtttagagaagaagtggcttcccccagaccatgaggctggcccgagactacaagacagatggcttgcttcttaacccaggggtctttttataccaaaagaacaaagaaataaaaaagccacgaaagactcaaaggaagcagattttcgaccacagccaacctcagaacaattctgagttgctcattttaagatcaataaggcatttttttagggtgtgtatgcctgagagaggaaatcagtgtgaatatcaaacttgcctctgaaacagcctaacacaatgctaatccgagaggaacaaggcaaggaaaccccctggtgaatgactcatctcaggaagaggcagggcagggtcaggagagtctatggaggagaagacctggaacaagacctctctctcttgctctctttctctctctccctctctctctctcacacacacaaacacacacacaacctcacacccccatgagcccaaatctgtgaactgagaacctcacttctctgacctcaccttccatctcccttaatcagacgcccacaaacctcagagttgtgtcccagcatcacttgttttgactgccctccccgactgccttgacttcgtatctgcctaggaacctgcctgtgtggacttttccctctatgtggacctttccctctatgtctaccggtgtccctgccaccagtggcatttgtcacctctgcctgggcagcccctcgtgactcgggttattgatggctgtgcctcatctccctgggaactggaactgtcctaaggaaagggagggtcgtgcctttttcttgataccccacgattccttgcacagcgtttctaccaggcgccgacatgccctccttggatgaatgagtaacatgggttctaggaagcccgcaccaatgcagatgtgacgtcctcagcctttcatagacatgtttcatgtgagaggtgggaagaacagctgaacagaaggctgagcactgtccaggtccagagtcaccaggagctcgttgtcaggttttcacttgctattagtagagatttttttttaaggtactatttttagtgttagaagtgaattcaggccgggcgcagtggctcacccctgtaatcccagcacttcgggaggctgaggtgggcagatcacgaggtcaaggagatcgagaccatcctgaccaacatggtgaaaccccatctctactaaaaatacaaaaattagctgggtgtggtggcatttgcctgtaatctcagctactggggagggctgaggcaggagaatcacttgaaccagggattcggaggttgcagtgagcagagattgtgccactgcactccagcctggcaacagagcaagactccgtctcaaaaaagaaaaaaaaaatgaattcatcagaaggcataataatcataaatgtgtatatgtctaatagtagagctttaaaataaatgaagcaacgctcaaaaggattaaagggagatcatgtcacccccttctcagcaactgatagaacgatcagatgaaaacagtaaaataacagatctgaacattgtcaaccaccttgacttaactgacatttatagagcatatatgcaacatctatgggagattccttctcttctatgaacatggtacttcaccaagatagaccacattgtgaactataaaacaaatctaaatacatttaaaacaaaataatataaaatatgttctctgatctcaatgaaattaaagtgttaagcaataacaatatctagaaggactccaaaaatgtgaatattaagcaacatacttataaataactcatagttcacggatgaaatcaaagagaattcaaaatatttcttttttttttttttgaattggcttcttgctctgtcgcctaggctggaatgcagtggcgtgatcccggttcactgcaacctctgcctcccgggttcaagtgattctcctgtnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngaaaaaaaaaaaaaagtaataaaccaaactttaaaagaaaaaaagaacaacagcatgaaataccaatatcaagaattaatgatgggatgttattacaaactctacagccattaaaaggaaaatagtgggatcttatgaataactttatgccaatcaatttgacaacttggattaaatagacaaatttcttaaaaaacactacttagcaaaatagccacaagaaataaagataatttaaatattcctaaagctgtctatgaattggaattcattgtttgttttgtttgtttatttatttatttatttatttatgctattttttgagtcggagtctcgctctgtcatgcaggccggggtgcagtggtgcaatctcagctcactggaacctccgcctcctgggttcaagtgattctcctgcctcagcctctggagtagctgggattacaggtgcccaccaccacgcccagcatatttttagtagagacggggtttcaccatgttggccaggctggtcttgaactcctgacctcaggtggtcgcccactttggcctcccaaagtgctgggattacaggcgtgagccacggcgcccggcccccctgctcttccttttctaatttaactttctaatttaaaaaatctcccaattacagaaaagatgcaaaaattatactataccctttactttgaaccacctgagagcaagctacccacagaacgcacatcacccttatacacttgagtggatatttccaacaaataaggacattctcccgtataaccacaatacaatcctcaatatcagacagtaagcatcagtacattactaccagctaatcctcagaccccaatggttttcacttgtctttataatgtaatttattgcacagaaatcctgtcctgaataactatactgctctttcatctttttctgactctagtatttcatgggacattggcaggctgttttgggggacagtttgtaaagtgcctttttaaacctgaagttcattatttaatatttgattcagtatcctgctttttaaaaaatttacacatcacctaaccctcattagtaaaagcgtgtgtatgtctgtgtgtatgtgaacactgcccaatcacaggagaatatccatttttctcaagggtacatgaaacattctccaggacacactatatgttaggccacaaaacaagtcttaatacaattttaaaaattgaaataaaacaaactatcttttccaatcacaataaaaggaaattataaatcaatagcagaaggaaaactggagaatccacaaatatgtgaaaattaaaccacacttttttgctgtttttttttttttgagacagtctgtctctgtcgtccaggctggagtgcagtggcacaatctcggctcactgcaagctccgtctctcaggttcacgccattctcctgcctcagcctcccgtgtagctgggactacaggcacccgccaccacgcccggttaattttttgtattttttaatagagacgggttttcaccgtgttagccaggatggtctcgatctcctgacttcgtgatctgcctgcctcggcctcccaaagtgctgggattacaggcatgagccactgcgcccggcctaaacaacacattttaaaacaaccaatgggtaaaaaaataaatgaaaagggaaattagaaaatgtcttgggaggctgagctctgtagctcacgcctataatcccagcactttgggaggccaaggtgggcagattgtgggaggccccacccccctcaaaaaagaaagaaaatatcttgagacagatgacaggcacactaaaatctcagaactcaccactaaagaacttatccatgtaacaacaacaacaacaaaaagcagctgtaccctcaaacctatggaaattaaaaaaatgtttcaaaagaaaatatcttgagacaaatgaaaacaatataccataagttacaggatatgaaagcagtgttataatggaaaatgatagctgtaaatgctcaccacattaaaagaagaaataaatgaacaatctaccttttacataatgaagtagaaaatgaagagcaaacagctgggcgtggtggctcacgcttgtaatcccaacactttgggaggccgaggtggacggatcacgaggtcaggagatagagaccatcctaacacagtgaaactctgtctctaataaaaatacaaaaaacgtagctgggcatggtggcgggcgcctgtagtcccagctactcgggaggctgaggcaggagaatggcatgaacccgggaagcggagcttgcagtgagccaagatcgcaccactgcactccagcctgggcaacagagcgagactctgtctcaaaaaaaaaaaaaaaaaaaagaggagcaaactaagcccaaaccagcaaaaaatagatcagagataacagaaatagagaatagaaaaactgcagagaaactcaaagaaactgaaagttgacccttaagagagatctataaaatgtacaaacctttacttagatggactaagaaaaaagacagaaaacttaaataaccaaaaccagaaatgaaagaggggacatttaaaacaactttacagaaatccaaaggattataaaaaatactataaataattgcatgtcaacaaactagagcacattgataaaactggtaaattactaaaaacacactacctaccaatattcaatcatgaagaaatagagattttgaacagaactatagtaaggagatagaatccataatccaaaacttcccagcaaagaaaagcccaggaccagttggcttcaatgatgacgtctaccaaacatttaaagaactaacatgaattctcaaattcttccaagaaactgagttggagggaacactttctaactcttcgtgtgggccccgcattaccctgataatatagaagtgatgaaaggaggcctccatgtcttgttcctgatcttggagaaaaaacctttagtctttcactattgagtaggatggtagctgttggcttttcatatgtggcctccaaatgtaagatctataagaattatacaactcttgtaagaaaacagcaattttaccttggggtatatatccaaaagaattgaaagaaagggcataaagagattttgtacacctgtgttcatagcagctttattcacaatagctaaaatgtgaacacaaaccaagtgcccattgacagatgaatggataaacgtaatacatatacacacaatggaaaggaatgaaattccaatgcatggtaccgaatggatggatcgtgatgattttatgctaattgaaatatgacagcctcaagaaaaccataaaatactgtatgtctccatttatatgaagtatgtagagtagttaaattcatagaaacagacagtagaatggtagttgccacaggctgggggcatggggacaaagagacaaagatgagcacaaacaaatggttgagttttagaactgggagaaagatgcaagttctgtctaattttggaggcttgggggaatggaatgtgagattgatcttgtaatgggtgagatctggaagccactcatgccagtccctgctttgtccccacaggtcgtacctagctcagctgcaaccatcaaacttcatgatcaatcaattggcacacagcaatgggaacatagccctttgggagagttgtgtccaccaggtacattctaagactgatctctaatcctttacacctctcttttccttaccctatgctatatacaaaaattatctcaaaattcatcaataacattccttttccatgttcttcaagttttctgtttcctacagtttctggttcttctattcaacagatacttattgatcctttgccaaatccaaggttatgaagctttatccccatgttttctcctaagagttttgtactttaactcttgatgcattttcagttaatttttgtaaatggcatcagataagcgtccaactgcattcttttgcatgtggctatccagttgccattcgttgaaatgatgatttttcccattaaatggccttggcatccttgtcaaaaaccaattgaccataaaggtatgggtgtatttttggactctcaattcttttccattgatctatatctgtcctctttccagtgccacacagtcttgtagtgagttttgacatcaggaagtatgaatctttcttttttgttttccttttccagaattattttgtttatgctgggctttttgaaattccatattaattttaggatcagcttgccaatttctaaaatcagctgagtttctcacagggattgtgttgcacctgttgctcagtttagaggttcctggcatcttaacaatgagaagtcttttgatcccaaagcatgagtttttttgatttatttaaatcatctctaatttttaaaataatgtttcgtagtttgcagactataaattttgggttgattttgttaaacttattcctagatatttaatacttttttatgctattgtggataaaaccttttcttaatttcattttaggattcattgtgagtgtatacaaatataattgatttttgtacattgatcttgtattctataaccttgcagaacttgtttgttattcttaatgtttttataatggcttccttaggatttcctctatataagaaaatataatttgcaaatagagaaagttttaccttttcttttccaatctggatgctttttatttctttttcttacctaattgtcctggctagagcctccagtaccatattgaataaaagtagtgaaaacagatatcttttttggagaacatctttcagttgttcaccattaaatataatgttagctgtgggtttttgtagatattctttatcaggttgaggaagttcacttttattcctagattattttgtgatttttatcatgaaagggtgttggagttagtaaaatgctttctctgtgtttttgagataatcatgtgacttttggttttcattctattgatataatttgttacatcaatttattctgggatgttgaaccaacctttcattcctaggataaaacttatttggtcctggtatataattcttttttgttttgttttgttttttgtttttgagatggagtctcactctgttgcccaggctggagtgcagtggcgcgatctcggctcactgcaagctctgcctcccgggttcacaccattctcctgcctcagccttccaagtagcagggactacaggcgcctgccaccacgcccagctaattttttgtattttttagtagagacggggtttcaccgtgttaaccaggatggtctagatctcctgaccttgtgatctgcctgcctcagccttccaaagtgctgggattacagtcgtgagccaccgtgcccagcctataattctttttgtatgcttttggattcaacttgctagtattttgttgcaaatttttgcaacaatattcataagaatcgttagtctgtagttttctttctttatgaggtccttttctggtcttcatattaagctaattgtattagtccgtttatatggtgctgataaagacatacccaaagctggcaatttacaaaagaaagaggtttaattggacttaacagttccatgtggctgcagaagcctcacaatcatggcagaagacaaggaagagcaagtcacatcttacttggatggcagcaagcaaagagcttgtacaggaaaactccaccttataataaccatcagatatcatgagacttactcactataatgagaacagcatgggaaagacctgcccctgtgattcagatatctcccaccaggtccctcccacaacatgtgggaattcaacatgaaatttgagtgagaatgtatccaaaccctatcacccctggcccctcccacatctcatgtcctcacatttcaaaaccaatcatgccttcccaacagtcccccaaagtcttaactcatttcagcattagctcggaagttcaccgtccaaagtctcatgtgagacaaagcaagtcccttctgcctatgagcctataaaatcaaaagcaagttagttacttcctagatataatgggggtacaggcattggataaatacatccattccaaatgggtgacattgtcgaaaacaaagggctacaggccccatgcatgtttgaaatccagcagggcagtcagatcttaaagctccaaaatgatctcgtttgactccttgtcttacatccaggtcacactgatgcaagaggcgggttcccatagtcttgggcagctccgcccctgtggcattgcaaggtatagcgcccctcctggctggtttcacgtgccggtgttgagtgtctgcagcttttctaggtgcacggtgtataagttatcagcagttctaccattctggggtctgaaggacaatggccctcttttcacagctccactaggcagtgccccagtagggactccgtgtgggggctctgatgccacatttcccttccacactgccctagcagaggttctccatgagggccctgcccctacagcaaacttttgcctgggcatccaggcgttttcatacatcttctgaaatctacgtggaggttcccaaacctcaattcttgacttctgtgcacctgcaggcttaacaccatgtgggagctgccaaggcttggggcttccacctctgaagcaacagcccaagctgtaccttggccccttttagtcacagctggagtggctggaatgtagggcaccaagtccctagactccacacagcacaagaccctggactcctaccaggaaactattttctcctaggccttcgggcctgtgatgggaggggctgccatgatgacctctaacatgccctggagacattttccccattgtcttggggattaacactcagctcctcgttacttatgcaaatttatgcagccatctttaatttctcctcagaaaatgggttttcttttctagcacattgtcaggttgcagattttccaaactttaatgctctggttcccttataaaactgaatgccggccaggcgcggtggctcatgcgtgtaatcccagcactttgggaggccaaggcaggtggatcatgaggtcaggagattgagaccatcctggcgaacacggtgaaaccccgtctctactaaaaatacaaaaaaattagccaggcatggtggtgggtgcctgtagtcccagctactcaggaggctgaggcaggagaatggtgtgaacccaggaggcggacttgcagtgagccgagatcatgccactgcactccagcctgggcgacagagcgagactctgtctcaaaaacaaaaaacaaaacaaaacaaaaaaagaattatataccaggaccaagtaagttttatcctaggaatgcaacattggttaaaaacaaagaaacaaacaaataaacaaaaaaactgaatgccttttacagcactcaagtcaccccttgaatgcattgctgcctagaaatttcttctgccacataccctaaatcacctcttcccagttcaaagctccacagatctctagggaagggacaaaatgccaccactctctttgctttctttgctaaaatataacaagagtcacctttgctccagttcccaataagttcctcatctccatctgagatcatctcagcctggactttattgtccatatcactattaggcttttggtcaaagccattcaacaagtctctaggaagttccacactttcccacattttcctatcttcgtctgagccctccaaactgttccaacctctgcctgttatgcagttccaaagttgcttccatattttcaggtatcttttcagcagctccccactctactggtaccaatttactgtattagttttttttttttttttttcgtgctgctgatgaagacattcccaagactgggcaatttacaaagaaagaggtttaattgaacttacagttctacgtggctggggaagtcttacaataatgatggaaggcaaggaggagcaagtcatgtcttacatggatggcagcaagcaaagagagcttgtgcaggaaaactcccccttataataaccatcagatcttatgagacttactcattatcatgagaactgcaagggaaagacctgccccacatgattcaattacctcccattggatccctcccacaacttacgggaattcaagatgagatttgtgtggggacacagccaaatcatatcagtaatattgtccttatacaatgaattggaaagtgctccttcctctgctgtctttaaaaagggtttctgaataattggtattaattcttcttgaaatggttggtatcattcagtggtaaaggcatctgggcctcaactttgtttttctggtgaaaacatatacatgtatttagaattagccagctggattcagtttagatgatcccaattttgttggcaacatccaagacatggtaatcaggagccagtcgaacatatgccttcttctctccatcaggcctaatcagggtgttgaaccttggccacataaacatcatagagcttcttcacaacctgtttgatctggtgcttgttggttttaacatctacaatgaacacaagtgtgttgttgtcgtcttctatcttcttcatggcatactcagtggtcagtggaagcttgatgatagcatagtggtcaagcttgtttctcctgggggtgctctccagagtctcagtatcttgggccaccggaaggtgggtgatgtatggatattctttttttcatggcagtggacacctttctacactgccttcttggccttcaaaacctttgcatcgcttcagctttaggaggggcaggagcttccttctttgctttcagtgccatcttgtgaaaacgacttttctttaggagtagttttgataactaagtcaaaatctttacttgctatatgtctattcacattgtctctttcatcttgattcagtttcagtagtttgtgtctttctaggaatttgcccctttcatccaaggtacctaattttttgttgtacaggtttcatagtattcttttataatttttttatttctgtataatctgtagtaatgtgctctctctcatttctgattctaatacagtcatgcctcagttaatgatgggaactcattctgacaagtgcatcattgtgcaaacatcatagagtgtacctccacaaacctagatgatatagcctactgcatccctaggctatgtgatatagcctattgctcttagattacaaacctgtactagtagacaattgtaacacaatgataagtatttgagttcctaaacatgtgaacatagaaaaggcccaataaaaatatggtataaaaggttaaaaaagatgatgtagttgtctagggcacttaccatgaatggagcttgcaggactggatcttgtctgggtgagtcagtgagtggtgagtgaatgtgaaggcctgggacattcctgtacactactatggactttataaacactgtacatttaggctacaccaaatctgtaaatttttttttccttccttcaatattaacttcgtgtaactattttactttataaactttttaatttttaaaactttttcactcgttttaacacttagcttaaaaaacaaaaactgtacagctgtacaaaaaatgttctttctttatattcttattctataaacatttttgtatttttaacttaaacttttttttacttaaaaatttttttcttaaaaactaagatagaaacacagacattggccgggcgcagtggctcacacctgtaatcccagcactttgggaggccaaggcaggcggatcacgaggtcaggagatcgagaccatcctggctaacacagtgaaaccctgtctctactaaaaatacaaaaaattagctgggcatggtggcaggcacctgtagtcccagctactcgggaggctgaggctgaggcaggataatcgcttgaacctgagaggcagaggttgtagtgagctgagattgcgccactgcactccagcctgggtgacagagtgtgactccttctcaaaaaaaaaaaaaaaaagaaacacagacattaacctaggtctacacaaggacaggttcatcaacatcactgtctttcacctccacatcttgtcgcgttggaggatcttcaggggcagacacacatggagctgtcaactcctatgtcctctgataacaatgccttcttctggaaaactgcatgaggctgttttatagttaccttttttatttgtaagtaggagtacactctaaaataacattacaatgtatagtatcaaaaatacataaatcagtaagtcatttattatcattatcaaatattatatatagaacttcattatatgtgctatacttttaactggcagtgaagtaggtttgtttacatcagcattaccacaaacacctgagtaacgcattgacttatgacattactaagcgataggaattttcctcctccattataatattatgggaccaccgtcacatatgtggttcattgttgaccgaaacgtcatcatgcagtgcgtgactataatttgagtcttattttttccctgtgctaattttttaacacaattagttgtgccaatatatcgatctatttaaagaactagattttgagttcattaatttactctgttgtttttctgttctccgtctcattaatttctgctctaatctgtattattttcttccttctgcttgctttatctatagtttgctcttctttttcgagtgtcttagagtggattattaggttatagattgagatatttcttcttccttaatagacatttaggaaggatatttcttcttccttaatagacaatttctctgtaaacttcagctacgttagctgtatcccataggttttggtatgttgtgtcttcattttcattcgtcttattttctgatttctcttttgatttctttttagaccagttggttatttaggagtgtgctatttaatttttatatagctgtgatgttccccagtttcttcctgctattgatttctaattttattccattgtggtaggagagtgtattttgtattatctctatccttttaagtgtattgaggtttatcttatggccaagcatatggtttattttggagaatgttctatgtgcactttaaaagaatgtgtatcttgttttgattgagtagagtgttttatagacatctgtccagtctagttgttaatagtgttgttcaagtctactactttcttgttgatgttctttctagatttttttggtatgaattcctataggttaaggaaactatgctttgcagtgtggttttcattgcaagtattttctcctactttgttttcatcttagtcaagatttcttccatgcagttttcttcctaattttcatatagttaactttatgcaactttttagtttctcgtgagactgagaaggtcctttctctctccaaacttgtaagaaaaatttctcatgcagtacttgtgtgatttcatactttacagttgacaccttgatagacctagtctctatttccttatagggagagcataagcaagaagctttattatttttcagcagtaaccttagttgccccagcgccattactgaataatcacatttttatcatcgatagtgtcatcatcataacacatcagcaaggaagtttttccttcacagtggcacggtggctcactcctgtaatcccagcactttgggaggccgaggcaggtggatcatgaggtcaggagatcgagaccatcctggtgaaacctagtgaaaccccgtctctactaaaaatacaaaaaattagccaggcgtggtggcacgctcctgtagtcccagctactcgggaggctgaggcaggagaatcgcttgaacccaggaggcggaggttacagtgagccaagatcacgccactgaactccagcctggtgagagagcgagactccatctcaaaaaaaaaaaaaagcctttattatttttcagtagtaaccttagttgccccagcactattactcaataaccacatttttataattggtagtgtcgtcatcgtaacacattatcaaggaagttttttttccacagtttgggttttctaagagtatctttcaatatcagtaaatatgaatcagaggagagggataaataaatgggcactgaaaggggagagtgaggtcacctgaaggggcgaagccctggaggtgaaggtcgagcctccagacatgggctcccgctggcgacagctcctgcaggctgtcacctcagtgcctggagaccctctgcaatccagggcagcatgaggtaggccttctttctgtggatcattctttgactctgtatagggaggaccctttttccttccattttcctcccatggcaggtggcatgggctgtatctgaagccttcccctcatcgctgtattgtttctgcgcctgtttgtaccttctactgaccaagagctcactgagggcagggattaggactttttgtgagtttccagggatgcaggtggcattgccctggtctctaggcctatgtggccattaatcacttaaaacacagccactttgaattgagatgtgcagtgagtgaaaaatacactctgggtttcgaacacttagtattcaaaataaaagaaaatatctcaatgttttatcttgtttacatgttgaaatgctaatgttttggatattttaggtccaaaaagtacattgttaaaattaatttgacctcattctctttttactattttaatatggctctcatagaatttgaattttgcatgtggtttgtattgtatttctgtcagcagcgccagtcagaggtgtgtatagatgcagaattgacgacaagaccaagccaagaagatgggatttctctgtctggggtctactgatggccaaaagaagagtttcctagccaccgccacgatcctctgggaactctgtggcaattcattcattggcttttctctcccttcccaggatctcatagatcagaacatcctggagcctgtaaccggtgcacagagggtgtgggttacaccaatgcttccaacaatttgtttgcttgcctcccatgtacagcttgtaaatcaggtacagaatgtgtggacctcttgtccagaggtggagtgaggggcagtgaggtgggagtggtagccaatgtgagtcagggaaccaagttccagcccaacttggtcttcatcataccctgttccatggttatgtcttaggtccataaaatgaaacagaaagaaatcatttttataatgcatgccacctggtagtgcaaactatcagctccaagagggtaggggcatcattacagcacaaagaaggcctggctgagtggacagggctgagtttcagcggtggtacgggtctgctctggggccacgctccccctgggctgtgtgctcctggcaggttctcaggctcactcagccttcagtttctcaggcgcctccctcttcctcagcaggctgggtttttgggaagtcacccaagggctcctcttcttgcagactctctcacataccatgtgcctcctttgctactgaccatgcgatctaaatggtgctttttccctaatctgatgtaataaataatgaatcatggtccttttgtatgactccaagtgttggtgacagctgaagggtgggtgtcctgtgtgagcccgagtgtgctggtgcagaatctggccctcagaactccttggcaaactgagttgagctgagctgagggggagggagttggggtggtgaggaaaggtcaagggacacgtcagggaaacacattcccaaaaccttgtactctgtcatcagatgaagaagagagaagtccctgcaccacgaccaggaacacagcatgtcagtgcaaaccaggaactttccggaatgacaattctgctgagatgtgccggaagtgcagcacagggtgagacaacagccaaggggctcccagcagcctcaaagaacccacagaagcaaggaaccctaaaaagacccgagtctccttgtacccgtatctatcagccctgaccccatggtgcctccacccccataggtgtccctgagcctgtggcgtctcctgagcctgcaacctgcccctcctggtccatctgcctgtccccacccctgtcccctgcagtggccccttctcacccctccccagcactagtccccttggccaggctgacttgttcactaggcacaggaggccatgacttagggcccacaacagaggtacatgaaatattttatcttgaaatcataagaaaataatggtatagaatccagctggggttatatttatatttaaacaaattgagtcataaaatgtaatttttaatatttgcttttaattcaagaagacagaaatgcccacagcccgcaaaaatcataataaggccatgggtggagctccttcaagttcccatgaggacctgagcccacccagccagcctcacccctggcccctgatttctcaataagtcctgtctttttcctattttggttttggaagcaaagagtaattgctcttctctggtcctccagtgtttgctgtgattgagaggaaccagcagacaggtgggggcgagggctcacttgtactgtgggttaactggaggaaggggctcagcttgtggccacacgggcttgtgatcttcccctggagtgtgattcctcctaacgcaggcctcccctgcagcccagggaagattagtgtgtgcccagcacagaaggctcctggaactgcagctctgaccccagagcagggaggccaagggggtaaagtgtgcatgctcagacccttccccagcctaaacaagggagcatagggggaccccctgcagatacgaggagactatccttcccctgacgccttctcagggacattgggcagggagagtggctcctctttcatcccacctggccagctttccatcaagagtcccccccctccctccctgtgtgtacccaggtgccccagagggatggtcaaggtcaaggattgtacgccctggagtgacatcgagtgtgtccacaaagaatcaggtacaaagcccgctggggaagccccagctgcagaggagacagggaccagcagcccgagactcctgtcttttcctgtcttttctcaggcaatggacataatatatgggtgattttggttgtgactttggttgttccgttgctgttggtggctgtgctgattgtctgttgttgcatcggctcaggtaggtgctggctgagggcaagggctctgggcactctctgccctgccttcttctgttcccacagacagaaacgctcacccctgccccaagtcctagtgtctctggccgggctctatcttcctccttgtgatcaccccccatcctcccatcctgtgcaaccctagggccctggtgtcatccgtccctctcccaaggctgggggtcccctcatctcccagccaagtctgggaaggcagggccagttcctccactggtcaggcccatccaggcagggggcagtcagctcctcaactggatgacaagagtcgagacgagaagtggttgtgggatttatgtagctttgttcagagcaaaacacagagcagaaaacagtgatgttccacttgtttgtttttagcctacttccctttatgctccccgctcctgaaggatctcccgagttagcagggcctcatgtggatccccaggcccggggatctttgtccagtgtcccagcccccagcccacccctgcccaacactgccctctaagaaggagtgctgcatgggcccctccctggccactaagggaaccgtcttctcttctaggttgtggaggggaccccaagtgcatggacagggtgagttgatttctccaggagctgggggcatcaggggctcaggaactgcttcttgcccacagtgtagtccaggtgggtgggtccccgtgctctcatggctgccctgagtctctgaagtggcctggatgctgtgcattgactatgggggacacaggcccttttgagcatcatacaggctggtgggccattctgtagccctgtgcttcctacagcccaggtgagacccttaccccacagcctgtaccctggggatggggtgagcccccaagcccagcaccagggcctggccccagcagcaggtcctggatgtgctgagcatggacttcctggagtgacctcactgggagggggtggtggcagcaggtccagccgtgccctacggaccccgtggggagccctgggtgtgggcttctgagttggctctttgccttcctaaggtgtgtttctggcgcttgggtctcctacgagggcctggggctgaggacaatgctcacaacgagattctgagcaacgcagactcgctgtccactttcgtctctgagcagcaaatggaaagccaggagccggcagatttgacaggtgtcactgtacagtccccaggggaggcacagtgtctgctggtgagttggggacaggcccctccaagaccttgtaggcagggggtgaaggccatgcctcggctctcctggtcaaaggggaagtggagcctgagggagatgggactgcaggggacggggctgcgtgggaaaaagcagccaccctcacaaggggacaggcactcttccaaatgtctgcttcttagtccctgtcctgtccttgccatgtcctcagaaactggagctccagaggaatagagtgggggtcacagggtttgttgatgactgaataaggctgcacggtctccactgtgtgctcctacagaagttagggagcccttgctcataacagcagggattttaaatttactctgaaattattattgcattaaacatatttggatctaaatctctgcccaaatttctgcatatggttgtatggaggattccaagaagaagcacaatttccaagtcagcctgtaacagtgctgcttactgtgtacacgcacatacacgcacatgcacacacatgcatgtacacacatgcacacacacatgcacgtacccacacatacaggtacacacatgcacacagccccctagtgttggtttgtaccagttcatgtattttgatttgacattgaagggctttttcttttctttttttttcttttttttgctatttaggaaaacattgttttaaacgaacatttctttgttttcactgtttttgcgtaagatcagtgtcttgtctctcagagtctttatgagaaggcctgctctcctactcatgctttttctcacattcagacagtagattcctaatttcttcttgcccctttttgttctaatattttcaggtgtagaagctttaatttttaaccagtgaaatctgtagatacttttaccttttcattgctcactactgtagaaagaccttttgccaacacaagacgaactcctctaacttcttatggagatatttttttcaatgatgtgatttttgcatataactttataatctaaatggaacttgttttgtgtttcagtgcaaagcgaggcactccctgaattgttctagtcactgtctggtttttccaacccctttgagctgccgattctcccatttccctctgctttgggtccctccttaatcacaggttaaatgctcatctagacaatgatctccttccacctagactgttccattcagttcctttcttgcattagtacccatttattctaaccaaaaatgtaattaaaaaaaaaagaaggcaaacattaaaaaggtcaataatctccagcttgataaggtgctttgacatgaacaaatagtttatatatttaaaatgagaaaatttaaactatcaaaaggtactcagtaagtaaagagagcatcctccactctgcagtgccctgggtctttttcctcaagtaactatgagatatcatttcttgtgattctttgtccaaatctatgcatcagtgtatgtgtatacaaaagacattatattattaacgaatggtccccaaccttttggcaccagggaccagttttgtggaagacaatttttctatggactgggaggtgaagatggtttggggatgattcaagcacattacgtttattgtgtactttatttctattcttatcacattataatatataatgaaataattatacaacttatcataatgtagagtcagtgggagccctgagcttgttttcctgcaacgagatggtcctatctgagggtgatgggagacggtgacagataatcaggcataagattctcataaggagtatgcaacccagatccctgacgtgcacagttcacaatagggtttgcactcctataagaatctaatgttgccactgatctgaccgggtggagctgaggtggtaatgccagcaatggggagtggctgtgagctatgtgggaccagaggtttttcaccatctccatggtgacccaagggggaaagtgatgtgctgcaggtttccgggctggctgatggtcagagtcagtactagactgcaggacccctgactcagaccaaggcattccccactgtgtgttacagggaccggcagaagctgaagggtctcagaggaggaggctgctggttccagcaaatggtgctgaccccactgagagtaagtgttttgctcctggagatgcagcagaaatggtgggaatagggacggtgtcctaactggtgtccccattgctgagagtgctcttccagagcattccatgccagaaactgggggtcctatgctatagaccatcaagaccctaaattgtcttctcccatctcttcttcccactctacctcatcctttctgcaccctattaatgacactagccactctgtctatcctcttctccacctcctctcttctcctttgttgttcaggagaacaacagccctgaggggctgccctgtcctgcatggcaccactgacttcagtgggctaatagctctttatctgtgcctaagcccaatttgcagagctgttgtataaactacatactgattccaaagacttaatgcaagaaagaatggaaaatattccactcattattttgttaccgaaacaccaggtgttgggtctaggtcttggtgctcactgcacagagggccaatcactgagacaattagtattgacaaggaagaatactttcattgagtgctgtaggcaaggagatgggagctcagtctccaattcatgtcccctgatggactaaaactaggggtttatatagtagggataaaatgtaacaatgtgggccgggcacggtggcttatgcctgtaatcccagtactttgggaggccgaggcgggcgaatcacaaggtcaggagatcgagaccatcctggctaacatggtgaaaccccttctgtactaaaaatacaaaaaaaaattagccaggcgtattggcgggcgcctgtagtcccagctattcgggaggctgaggcaggagaatggcatgaacccgggaggcagagcttgcagtgagccaagatagcgctactgcactccagcctgggtgacagagcaagactctgtctcaaaaaaacaaaaaagtaacaatgtgtaagaaaacaggaactagggaggggtaaggaagcaatcaagatgaatgaggggtccagcatcccattggatgtagtgatttgtaagtttcagttctttgatactttgagaggcctgaaggtcatttcctgaaaaaggaactcagataaaacaaatgtaagatttgagctttaagaacagaagggtcaatttctatgtttatcaaaacaacaacaacaacaaaaaaaccttttgatggacatattgggttgatttcagttctccctttctatttatcaatcccacagtcacagagagtctggtcctggatctttctggctgcttcatggttgaggaggggcatcatgggaagcttcacataccatgggtgacctcatggccacccaggaatcaaaggttaatttaatactaaaagattgtgtttcttctgaaacacaatctctctctctcggccccacttccaccaaagacaaattatagcaggaccaatgtacctgcaaaataagtttagttccatatacgtggcctgattacccacacaaagtgcagcaaaaatcactgtccacataggctctcctaagttggctttgctggaacctctcacgaggccattgcaatcaaagccctgagaaaataaccattttatccaactgtgttccattgtaaaagaaaacgttgttattaaccatatgtaagcaaacacattgccatgaattaatagtcacaaataatttaaaaattctagagaaattaggcagagagagaaatatgcctcaaattctgtttacaaaagtatactcaatatacttaaagtatacttaaaggctataaatagcaaagaagaaaaaagttctccagactggaaaacaaaaccaaaagaatcagcaatatttcaaaccaacaaaagccatacgaattatttcagtcctctattagttcagtccactcaatcagctcctgcccagcttcatgtttggttaacaatcacaatctttatgaacacatcagtctttcttctttttttgttttgagacagagtctcactctgtcacccacgctggagtgcagtggtgcaatctcatctcactgcaacctccacctcctgggttctagcaattctcacgcctcagcctcctgagtagctgggaccacaggtgtgcaccaccacatctgggtactttttgtatttttagtagagacagggttttgccacgttggccagtctggtctcaaactcctggcctcaagtgatagacattcgcctgccttggcctcccaaagtgctgggattacagacatgagccaatgcgcctggccacacattggtctttcagttactgcactggaagttttctctgtaatccaatgacaacaatttttaattatatgaaaaatttacttaaaacatcccatttacatttactcaattctttcatttttaagtttatccagattgcttctgaaaattgagatattagacaccatcatttaaagttagttaatttctttgtcagccatttttttaatagccagtgaacatcaggtgctcacctaagagcttcaaagttaaatatatagatattttcaccaataagtcagaagactcagctgttttcattaaaccaacaacattaatttaatcttacttatcaaaagcttgactcaaagatcattttgttttggttgggcttgtagtcttaagtttttgtgccaaactgatatctcaaaatatctggcaaagacaaatataagcccagacaaaaatgtatgctgacaattctgaagacacttctgttttcttattttaccaataattttaaagctgacttgtttagtaaggatttacttaagtcacatgaacttgaaaattgcttggaattatttactttatttatgagtactcttttacttataagtcaatttggtagacacaacatgtaacttaataataaatgtacatacacataaacacatctagacctatatgcacacacaaagatccaatagcttttacctttgaactctctccatgagacagtaatacaaactcaccagtctacaaatatgttcacatggctgaaatttgttagctccaatagataattcagtgaaggttgtgaacccaaattttaggtaaagcagtttccatggcagtttgatttttaaaggccaaacctctgcagactccaaacagcatcgcagagaacaccacctaaaaccaactaatcaggcccaatgctgcttagaacagcaacataaaagcctggatacaggaactccatcctactttctcattcagcagcaaacttcagtttccaagcaatattggagccaaacagtattacaaaagaataccaagtttactgaattccaatttcccatgactctagcaaacacatagaaataatcaccaaaacataatacaactgctgcagcaacaaacaagctccaagagtgtccagactgaaacaggcagggtgcttcctctctccattggttaggtttgatcaacctgccaacaaaaattgctttcaaatttctcaaattgagaggagccagtcgtgctgcctggtacccacaaaagacactcacttgccctgaaacaacacacaattacaaacaagcctccaagagtgtccagactgaaaggcagagtgcttccctctcacagtcacttgggcctgttcaacctgcaaatggaaattcctttaaaaatttctcaaactgagaagagcagatcctgctgtctgggcccacaaaggacaatcacctgtctggatgcaaatgtcaaatttcaaaggcagttcttcggaagtaatcaggaatgtggttggggccggctgcagtgggacctgagagagactgaaactcacctccagccaaagttagcggggcaactgcttgggagggcttctgagtctcctggcccatggcagcagagccatgagcaacactttcccagccagggaaccaaaacctgttaccaaaacctcaggggtttggtctaggtcccgctgctcgctgcacagaaagccagtcactgagatgatgagtattgccaagaaggctttaatagggtgctgcagtggaagagatgggagctcagtctcaactgtatctccctgaccaactaaaactaagggtttatataggaggcaagaaatgtaacaatgtgtaagaaagtaggagctagaatggggcaaggaaacaatcaagatgaatgaggggtcccacatcccatcatggtctggatgtagtgatctggtgagtttcagttctttgctactttttttgagatgcctgcaggtctttcctgaggaagtaactcagataaaacaaatgttaagtttccagtcgttaaggaccagaagggtcaatttctgtttatcaaaaaaacctttctatgggacaattgggtcagtttcagtttttgtatactcattgcatattaaattatattttacacatattcagtaccacacattaaaatgaatgtcacttttttctttttatgttctttaaatgaggctgttagaaaacatagcttggtactcctggccccttctatccctgtggatggtggtgtgcagtgctttgcacacacatctcatttcattcaatccctggtagtcctgagatctgggcaggtttgctctgtcttcaggtttgcttcttggtcagggcctgcttgcccccacctagctctgccccagcctcagggagggcagaggtcccctgccccagaccctgcactttccacagatgcagaagtggccaccctgggacatgctcccatgacaagcgcagcccaggcagcccgcatcctctgagctcccgctgcagccactctccctccctccctcgggctctcacccactttgctttctgcctccgtagggtcaatccatcctccccaggtgggttctcagccctctctgagggcagattctctggtgaccttgacgcccgtcagcgccttgggggccacagaggccaggcagtgtgggtgggctctctgtggatgggaggtgggtgggcaatggagcaacaggtttgcccatgcagggggctctccaggttctctccttgggttctgggcctgatgtgggatcctctgccccttctgaactgagtcccaactcatctggctgtctctgtggctttctccacccagctctgatgctgttctttgacaagtttgcaaacatcgtgccctttgactcctgggaccagctcatgaggcagctggacctcacgaaaaatgagatcgatgtggtcagagctggtacagcaggcccaggggatgccttgtatgcaatgctgatgaaatgggtcaacaaaactggacggaacgcctcgatccacaccctgctggatgccttggagaggatggaagagagacatgcaaaagagaagattcaggacctcttggtggactctggaaagttcatctacttagaagatggcacaggctctgccgtgtccttggagtgaaagactctttttaccagaggtttcctcttaggtgttaggagttaatacatattaggttttttttttttttaacatgtatacaaagtaaattcttagccaggtgtagtggctcatgcctgtaatcccagcactttgggaggctgaggcgggtggatcacttgaggtcagaagttcaagaccagcctgaccaacatcgtgaaatgccgtctttacaaaaaaatacaaaaattaactggatgtgatggtgtgtgcatatattctcggctactcgggaggctgaggcaggagaatcacttgaacccacgaggcagtgagctgagattgcaccactgcactccagcctgggacacagagcaagactctgtctcaagataaaataaaataaacttgaaagaattattgcccgactgaggctcacatgccaaaggaaaatctggttctcccctgagctggcctccgtgtgtttccttatcatggtggtcaattggaggtgttaatttgaatggattaaggaacacctagaacactggtaaggcattatttctgggacattatttctgggcatgtcttcgagggtgtttccagaggggattggcatgcgatcgggtggactgagtggaaaagacctacccttaatttgggggggcaccgtccgacagactggggagcaagatagaagaaaacaaaaaaaaaaggaaaagcaaatccatctgatctcctggagctgggacactcttctgcctgtggacatcagagtctaggatttctagcccttggactccagggcatacaccagtggcctcccgaaggatctaaggattttggccttgaactaagaattacaccatcggcttccctgggtcttaggtttttgggctggattaagtcctgcttccagcatttcagggtctctgctgtgcagatggcctgttgtggaacttctcaacctccattatcagatgcattaattcctccaataagtcccatttcatatatagtcatttaccccacaacatttcagtcaagggaacagcatataagatggtggccgtccagtaagctaaggttaatttattaattatttaatttatttaccttgagttcaagtcacaattaaagtacatatacctttggaaatttggacttttgtatataaaagtacttttttttggcgggggcagtgggcagctctcatcctaaacaaatgtgttatttggtacctatgcaaagatttggttaaaagaaagaaaagaattgcttccataaatggagcattttcttagaaaaactggagcccatctaaatgtttttcaaggtcacgtgatctgagataatctttagtaaatagaaagctagtttaagtttcttggtttaattaaaacagacaattcttaagagttgtcaacattatttacagttcacacatacaacttctacctggatttactaatcaaaacacttacgtgtggccgggcatggtggctcacgcctgtaatcccagcactttgggaggccgaggtgggtggatcacagggtcaggagatcaagaccatcctggttaacacggtgaaaccccgtctctactaaaaatacaaaaaattagccgggcgtggtggtgggtgcctgtagtcccagctactcgggaggccgaggcagcagaatggcgtgaacctgggaggctgagcttgcagtgagccgagatcgtgccactgcactccagcctgggtgacagagcgagactccgactcaaaaaaaaagaacacttatgtgtctttaagatcataaaactgtaaattcaactgaagaacaaaatgcacaaggaaaagataaatttcttgatatatatgaaacacaagaaagaaaaagaagattgaaaagagccatatgttttcaatgtatgtttctttgtattttgtgtgtttttatgtgtttatttttgtgtttttttatgttatgtgatgtttgtgtatttttgatatttttataagatgtctacctcc

SEQ ID NO: 12295 - DNA, 9528 bp, Human
tgagttcaaattctgacttcaccccttaatgtgaagtgacatgggcaagttgcttaatctctctgtgcctcagtgtccttgtctgtaaaatgggcatcataataatagcgcctgccacattgggtgagtgtgagaatgaaggaattaatacatgtaaatcacttagactgtgtctggcatagaggacattctaaagaaaagttagctattatcattatattattatatgggtctggaattagttcctgaatccttctgagatgtgatgacttataaacgtaggttgagtttactcatgatagggtcatcgcaactatgcatagctaaaatcaaattttgcttttcaagtttgttttacctggagccctagagttcagggttatggtttcctttgtcactccccttgagggaagcttcttagtcacactctccttctctttctctgcactctatgcactctagaaaagctcctttttttttttcttcatccaggcagagaggcctactgggacttaaatccaaggagctgaaatctgttttgggatggggtggagtcacattctggaacctagacagagaatttctaagttccagaaagtgctgcttacttcgcatttcctctcccccacctttgcttttgaaactcctggcaccaatgctgccaaggctggcggagctttcctgagtggtgtctgccaaatgaggagtcaaggaatatctggaaaggcagcctccaggtccccgatgtcaagaccatttagaactgaaagtgtcccaatatcggggtacaggcaataagcattagttattaatcagcctgagaagttgattctaaaataggaggaaatgattcaattatttcctctcaagggattactcaatgttgtttttatgtttaaatatttatttgtcaacatcaagaattcttagtacatgatgcaccagcatttttgaacaagtcatagatttggccacaaatcaaatttcaggatgggaggagtgtctcccctttaaaatagaagagagtgagtagtctatgaggagggacctacaaagactggaaactattcttagctccgtcactgactccaagttcatcccctctgtctttcagtttgggtaagcatcaattacttatctaaaatttgtaataagaaaagtcttcataattcatgattgtgtttatctttatgttagtaaatttctatgttggttctattcttccccttatattttaagaaaagaagtaagaaagtaaatgattatttttctgaaagaaaaaattaatgtatttattattattcatagaccttcaactactcttagaaagcctttggtgactcctgggaacaagctgagtcaggaacaaaagtttgagggtttggggttgagaataggacaattacttggctaatgctttagtctagttctgattttgctactccttagttgctttgtgatgactacttgcacatgtgtctgtttgtgagttatttttgtgagcatgctgctaccagcctgtgtggatgtctgtggtttcacatgatacattttattttctaaagtctactgaattttatggtttttttttcaaaaatagaaactcatattctttccttcttaatttagtttctttcaggacattctcatgagactggtgaaatataactgcgaagtagcatgataactgtgaaatagcatgatcattgtgaaagctatatgacccaaaacttccataggaataagtgcaatgcttgcatatctgaaacctgctgttacatctctttgcacttaataaatatgtgttgactgattcattctcctgggtggtgctgagaaagtaaaaatcatggctgataaaaattctgtttatggttttgtctaacttatttttcagttgagatataggctactcttcccaactcagtcttgaagagtatcaccaactgcctcatgtgtggtgaccttcactgtcgtatgccagtgactcatctggagtaatctcaacaacgagttaccaatacttgctcttgattgataaacagaatggggttttggatcttagcaattctcacaattctcatgtattccacagcagcaaagtttagtaagtattgccttctaagtataatttaaatttttataaattaaataatttcaagaacatttaccttgttttaagcagtttgcttccagttgttccagttgaattgtaaactgaaaaatatattgcttttgtacaatcatttttcattacaaatctatcagaagaaattctttgtaatgaatatatcatcagtttggctttgcatattcaaatgcagcagaatttaatgtggtgcctgcacatgggaagtgttgtggatgtttattgactgacacacagtttgtttagatagataaggctgcttttccattggataactgtgggggatttagctccaaattaattcattaacatttcataagagatcttaacagttacttattctttcccaaggtatcacagtatatgaccggcttctaaatttaatcctagaagaaaatattgagagtataagaattatgatcttttcatttgatcatttcaggattgtctttatatcttttatttgcaggtaaacaatcatggggcctggaaaatgaggctttaattgtaagatgtcctagacaaggaaaacctagttacaccgtggattggtattactcacaaacaaacaaaagtattcccactcaggaaagaaatcgtgtgtttgcctcaggccaacttctgaagtttctaccagctgcagttgctgattctggtatttatacctgtattgtcagaaggtattatgcagaaggctcccatcttctttcaccctgctcccctttcttcagtggttgattgcctgagctgcccttgctttcattccttccctagtcctttctggaacagttaaatttataaaatgatttgaataaaagtgatttggataaacttctaggaatactatcaggttgaggtctagctcattctgagctatttggatttacagttgcagggattgatttgtagctgacttagagaaaaacctagctttcctagtgaccaagataactgagagcaattgcttacttttggctggaattaagaacaaactagcacagaaaatagtaatctggatgttttccatctcagggggcctctagtaggtgaaaaggggcttctaaccttcaagttaagccacagaaggctgatgagattgtgtgcctaaaaattaattacttttgttcacaaattgttaaatgttttgattttgtggctgtatttggcacacacaaaatgtcaaatgaattaaatcaaaaagcaggatgtattagttaagggcctaggtctgagactagacaagtgtcaaattcatgctctgccactagttaactgtgcgatgccagcaagttacttctctgcccttcagtttccttctctgtaaaatgcatataatgtaataatatatttcatctcaaagcattattgtgaaaataaactaaggtaatgtgtgaaaagtgctcatcatcatcactggtacagagtaaactctgaataaatagtaattatctttattacactgggattacagcattacagcagatgtagtgtatgaataaatggtgaagaagtcattgttagggctactatgggggctatgtttttagctcaagtgtaacaaaaaagtatttaaactctagattttaatgtttatttttaaataataaaataaccattatgtatattgatggtttttaagaagaaaagcaatattaagtaaaggctgaatttagattaagttatttcacaatgctaagtgactcttttaattgtctgacttattttaacagtcccacattcaataggactggatatgcgaatgtcaccatatataaaaaacaatcagattgcaatgttccagattatttgatgtattcaacagtatctggatcagaaaaaaattccaaaatttattgtcctaccattgacctctacaactggacagcacctcttgagtggtttaaggtaagaagaaatttggaaggaaatagatgaaaattacacaattaaaatagacacaagtggccgggcacagtggctcatgcctgtaatcctagcactttgggaggccaaggcaggcagatcacttgaggccaggagtttgagaccagcctggccaacatgaggaaaccccatctctactaaaaatataaaaatcagctgggtgtggtggcacacacctgtaatcccagcagcttgggaggctgaggtatgaaaatcacttgaacctagaaggcagaggttacagcgagcccagattgcaccactcactccagcctaggcaacaaacattctgtcaacagataaataaataaaagtgaagaattactgagaaggaaatggaatttcttatttcagaattgtcaggctcttcaaggatcaaggtacagggcgcacaagtcatttttggtcattgataatgtgatgactgaggacgcaggtgattacacctgtaaatttatacacaatgaaaatggagccaattatagtgtgacggcgaccaggtccttcacggtcaagggtgagctactgacattaatgagatagaatactacgtgaaagaagtcgaagtgggaacagcggtgcccttctggttgggtttcttgcacttctccctcctccctttacttcctcctgctccatcttatcttatacattctgaactatgacgcaaagaggttttctgaacacactatcaagatttaagaaatttcagggggaaattacattactaattcaaagccacatctgttctttattctttttttgtgacttaattttccaaagataaagcaatctgaatgctaacttaacttactttttttgaatggcaatacaactatttggagagcaaaaccagctttttttttttttttctagtttggtgtcagagtttctgcaaattaaaaaagagcttaatctttagtaatactcattggattcaaagtttaatgagaggctttgtgatggtatactatggtgtacataaatgttgtcgagtggtttttaatctttgtttgcaatactttcaacatcatcaatggccttgagtaagtcacttcattctaaaaatgtgttttccaagttattttaaattttataaaagcttatttaagggaaagatttcacaatcatagcttatcaatctacaaaggattggggtctccttagcacaagtcgatctacagacgtagatgtaatagcccctttacgtatgacagttttttcagggcaaagcaatattggagacaaatttttggagtttttcaatactccaccgctgtaaaataagcatcaccagaccacattcctatcagtgcctctttctgtttaatatcaacccttacagtggtccttaatcacactgtcattaaataaatgagcatgaagggatggaggattgcagcagtgctccataagcactgcccgtctttcagccttagtggtcacaggagtcagaattccgtacggggaagatttcactgaggatgggccaccctagtggagaactgcgagcaaatctgtggactcatccatttattattttcatgggtcttttgaaatcttctctgtagtcttattcttattctgtagaagagtagttttctaacaactactaggtcatgtaattagttttatgggttggatctgcatttgtttaagtgatatcagagaataatgatattaaagagcatcataggtaataaaagaaagttttatttaagtgcctttctgtttcgtgtgtgtgtgtgtgtgtgtgtgtgtgtgtgtttgtcattatgggttattgtcagaagaacttgaaaaacattgctatgaaatagaatagaaacatgaaaatacaagctttatattgactagcattcaatgctctcctaatatttatatttctttttgtctttaagatgagcaaggcttttctctgtttccagtaatcggagcccctgcacaaaatgaaataaaggaagtggaaattggtaagaaaatttatcagaatgctgtaaatattgcctggaaaaatccttccatatgacccctgttctgaattcccttagcaggggtcaggcaattagcataaggaaccttgaggagtaagtgaggtgacatccctgaaagcacctgccccaagcatttgctaatattgggaacagggacacagcaattgcagtgtttacatttgtttattgtactttgtaattcatgatgctttcatgtatgcatctaatttcatcttcatctctatcccagagcttgggatggagacctgcagggtgttcattctgggcaatggtagccagatccagtaaaacatgtttatcttcaaagtagcttatggagagatgaagagagttctgtagaaagatgtggaagagggcagttggaaagaaactctaatttctagtagagggcaatccttttactagaaatcctttgtaatgtggggttggtgaaggcagaatcattggccttgttagtttcccatgcagatgagaatatagtgggagctgagcttcaaacccagctgggtgaatgaaggtaatggaagcagggaggaggcaagagaggacatagaaagaggaaggtgctagagatgagggagggaggtcctggtggggtgcatactaagtgttcagtaaggttttttttttacattaaatgggataaaatgccagtcgcagaagttaattttattggtgaatgtccttactcccctctaggaaaaaacgcaaacctaacttgctctgcttgttttggaaaaggcactcagttcttggctgccgtcctgtggcagcttaatggaacaaaaattacagactttggtgaaccaagaattcaacaagaggaagggcaaaatcaaaggtatttttatattgaagagaaccatcctcttccccttgcacatggtttgcacctgcaaagtaggcattaaaagtaacaggttgctttcttagtttcagcaatgggctggcttgtctagacatggttttaagaatagctgacgtgaaggaagaggatttattgctgcagtacgactgtctggccctgaatttgcatggcttgagaaggcacaccgtaagactaagtaggaaaaatccaagtaaggagtgtttctgagactttgatcacctgaactttctctagcaagtgtaagcagaatggagtgtggttccaagagatccatcaagacaatgggaatggcctgtgccataaaatgtgcttctcttcttcgggatgttgtttgctgtctgatctttgtagactgttcctgtttgctgggagcttctctgctgcttaaattgttcgtcctcccccactccctcctatcgttggtttgtctagaacactcagctgcttctttggtcatccttgttttctaactttatgaactccctctgtgtcactgtatgtgaaaggaaatgcaccaacaaccgtaaactgaacgtgttcttttgtgctcttttataacttgcattacatgttgtaagcatggtccgttctatacctttttctggtcataatgaacactcattttgttagcgagggtggtaaagtgaacaaaaaggggaagtatcaaactactgccatttcagtgagaaaatcctaggtgctactttataataagacatttgttaggccattcttgcattgatataaagaaatacctgagactgggtgatttatatgaaaagaggtttaattggctcacggctctgcaggctgtatgggaagcatggcggcatctgcttctggggacacctcaggagctttactcatggcagaaggcaaagcaaaggcaggcacttcaaacagtaaaagcaggagcgagagagaggtgccacactgaaacagccagatctcatgagaagtcactcactattgcaaggacagcatcaaagagatggtgctaaaccattcatgatgaactcacccccatgatccaatcacctcccaccaggctccacctcgaatactggggattaccattcagcatgagatttgggcaggaacacagacccaaaccataccacacacattatcatcgttaaactttgtaaagtatttaaggtacatggaacacacgggaagtctggtagctcagcccatttctttattgcatctgttattcaccatgtaattcaggtaccacgtattccagggagcctttcttggccctcagtttgcagtatacacactttccaagtactcttgtagcatcctgtttgtatcatagcactggtcacattgccttacctaaatctgtttgacagtctgctcaacacgactgcaagctccatgagggcagggacatcatctcttccatctttgggtccttagtgcaatacctggcagctagccagtgctcagctaaatatttgttgactgaataaatgaatgcacaaccaaattattgataccaaatgttttttttgtgtacatttctacttctctagctataagtcttaattatacaacaaaatactatttttatatttatgtttggtaaattcaataactttcctcatcatttggaaagtcaaattgtttattgcttccctacagttttttctgaatctagcaggattttaacgatatcattataatttgacacaataaaaggacaacatgaaactgatgaatctttattgggttaatttcagacactatataatcttttaaaaatgtaacattcttttttatatataaataattggtggcatcacaaatagccaaagcagggtggagagagtgatccttcctgggtgcaggcaagaaggggatatgttttctacagagttttcaaaacagtgataaagctgtctacaagtcattgtgctttttatcatcactatgcccagacaatgtgaaacatcagagatgaagtgctcttcccacagaggtggactgatccttctccccactcccttggtgtgtctctgaatgcaatgttgtcttggaaaacagctttccaagcatttcactcctgagcacttgccagtttcctcacttgttcttcacatatccaggcaaagacatcctgtttgctatatgaagcattgtatcccgtataaaaggaaggaaagagagaaatatatttttacactcatcactcctcaggggctgtacaatcatgtagaaattgtttaatgtgcctgtcaaatagccaaagagtgttaaaccctgagttcccacccatgtgtgtggtatggttaggattcatccagatacacagagagaggcacaacaggaggagaaaggataggggtgtggggacagcgggcccccaatatggtgtaatcgtggcaggtctctgcctgaagtgctatgtggggtttttcttgttttaattttgactttaacccctgatttgtaagtttttcataaaataaacagaatcataactcatgtagatggctataagtgccgtagtgttctgtggg

SEQ ID NO: 12296 - DNA, 2913 bp, Human
caggcgatgcgagactgaaaatgatcaagtccctgctcacatttttgggatagaggtaggaagaaagggcaagaaagacttaacaaacggtggagattcgaacgtattatgggagctctaagaaaggaaaggaaagcgggaggaggcttagtggagaagacgacatttgagccggcctggaaggtggaaaagggggctttagagtcgcccttcccccaggtcggcagctggagctcagcccgggcaggcctgctgctctcccggcttggatcccctttcagcccattcatccgggcctgggccgggggtgggcgggcagacaatcagacactgttttatcccaggcatcggctccagcctcccgcttggcgcccgcaacgcggggccgccggggaaatgagtctctcgggactccctgggagcgtaagcgttcgaggatctgaccggagggccgggccggaaagcttgagagccttcgctcccgcaggtgaggcgcagaaaacactccctcggggaagtgccagccctccttgcagccccgccctccggcccgccgccggccttcggggccgtagcggcgcgcagggcccgcagagaccgagacctgcgcactacaactcccaggaggcctcgcgaccagaccgccgaggggccactagagaagggtgcgtctgcggcgaatcccgtcgcccagcgcacggcagcgggtgtgcctgagtgcgcgtcgcctcccaaccagagaggacgtggcatacggcgccaccggaagttccggcaagtgggccctgaggctggccccagcttccgggttggtcgcgcgccttcctgcggctaagatggcgacggagcatcccgagcctcccaaagcagaattgcagctgccgccgccgccacctccaggccactatggcgcctgggctgcccaggagcttcaggccaagttggcagagatcggagctccgatccagggtgaggaacacaggaagtcgaggggcctttacgggcctgcggagaagcggagcctggttacccgggagactcgggtgcgaggggcggaggcaggccgctggggcctgacctggccgggctggcctgccccattgatcgtgtactttgccctgcaggtaatcgcgaggagctggtggagcggctgcagagctacacccgccaggtaggtgttggcggcgggacgtcaggataggccgagcttctccaggagaccttatataccccatcacggctcggtcttcattctttctttatctcggcacagcaaggcggaggcttgccctttttagcttgttcttgcctttgccagcttagttgtaatttcttgtatccatcttggtcctcttcagtgcccagccagagcgctggcagacaggcactgggtacgttttgttgaatgaattgggagcgaacgtcgtttagtgaaacagctagttttggactgacctagagtcctttctcttttgcagactggcatcgtgctgaatcggccggttttgagaggggaagatggggacaaagccgctccacctcccatgtcggcacaggtagggagattcttctgttttttaagattccatctgctgatccttttgtagttcatgagcatgatgattgggtgttcacgtgcatgtgtgagatgtgacacccttgcacattactcgcctgacctgagtggggaaaaaaaaagattccatatgttcagggtagcccttcctctcacttgcagttgttgggcagggaggtactgccatgacagaattgtgagctcttcagttctctctttgatgctgacacttgcctccttttccactgtctgcttctccaaaagcagcttgtggccgggtgcagtggcgcatgcctgtaatcccaccacttcgggatgcttagatgggacgatcgcttgaagccaggagttcgagaccagcctgggcaacatagtgagactctgttactacaaaaaattttaaaaattagctgggcacggtggcacgcgcctataaagtccctataaagaggctcaaggattgctggagccctggggttggaggctgcagtgagctctggttgcgccactgtactccatgtactccatcctgggtgacagaatgagactttgcttctttaaaaaaaaaaggggggaggtgatgggggaggggctgggagagtgtcagaaaaaatagctaatgcatgccaggcttaatacttaggcagtgggttgataggtgcagcaaaccaccatagcacacatttacctatgtaacaaacctgcgcatactgcacatgtacccgaaaacttacaataaaataaaattaaaccaaaaaataggaaaaaaaaaaaagaggcagggcgtggtggctcatgtctgtaatcccagcactttgagaggccaaggcaggtggatcgcctgcggtcaggagtttgaaactagcctggccaacatggcgaaactctctctactaaaaatacaaaaattagctgggcgtggtagcacatgtctgtaatcccagctacttgggaggctgaggcaggagaatcacttgaaccctggaggtggacggtgcagtgagccaagatcaagcccctgcactccagcctgggcaatagagcgagactgtctcaaaaaaaaaaaaaaagaggcagggcatggtggctcatgcctgtaatcccagcactttgggaggctgaggtgggcgatcacttgaggtcacgagttcaagaccaacctggccaacatggtgaaaccttgtctctactaaaaatataaaaattagccgggcatggtggcaggtgcctgtaatcccagctacttgggaggctgaggcacgagaattgcttgaacctggaaagcggaggttgcagtgagctgagattgcgccattgcactccagcctgggtgacag

SEQ ID NO: 12297 - DNA, 10827 bp, Human
acctccatctcttgggctcaggtgatcctcccacctcagccttccaagtagctgggactacagtgtgcaccaccaaccccagctaattgttttttctatttttagtacagacaaggtttcaccatgctgccaaggctggtcttgaactcctgggctcaagcaatccacccaccttggcctcccaaagtgttggggttataggtgtgagccacagtgcctggccctatctctactagcttcattccagtgagatatagaaacattattcctatatatccctattcacttttcacccttttgtggtattattgttatatgttttacatctattaatgttacaaacccgaaaatacattgtatgattgttattttactgttttcattttgttagcccaatgcagcttacttccacccacctcctttgtgttgtcactggcaaatatattaaatttctacaggttacaggcccaataatacactttatgcacactcttttataaattgccttggtcaatttttgctttaaatcttttataaattgctgctttaagttaatgtttttaaaaaaggaaaaaattattctatgttttataattacaactttcctccttaagcaataaaagagccacagatatggggaattacacagacatcacaatctccaccacgctgtggtgtgccccgtgcagtcccgcccactcaacagcaatttgtttaatcctcacaacaaccctcacaattagtcgttgttagctctgttttacagatgggacaaatgaagctcagaaagggcttctgggacacatggatggtaagagactaagtgagcttggggcctacatcttgtttttttttgttttttgtttttttagatggagtctggttctgtcatccaggctgaagtgtagtggtgtgatcccaacctgcatcctccacccccccggttcaaatgattctcctgcctcagcctcccaagttgctgggattacaggcatgtgctaccacaccgagttaatttctgtatttttagtagagatgaggtttcaccatgttaggcaggctgatcttgaactgctgacctcaggtgatccaccaccttggcctcccaaagtgctgggattacaggcgtgagccaccaagcccaggctgttggggcctacatcagtcagactcagagatcaatgctctttccacagcacgacatccttccctttactcaaccaagatacataggaatgttcttaagaaaattctactaagagactcaggcaaataacacccaggctttctgagaaaagactgattcttggaaaagatgatgctgtaccaggactacctgaatgaaaactctgctaagagactcaggcaattaacaaccaggctttctgagaaaaggctgattctcagaaaagatgatactgtaccaggactacgtggttgacgtggctgcccactcaacatcccctgtgccccatgtgagcatcagatggggcacacatgtatcctgggcacctcatcatggtatctggcctggcacgagtgcttcccatatgggctgagtgaaaggttgttgcccccccagggacaggtggcaggagtagagccagtggttggcagaactcgtccttgaggcccacacagatgtggccaaggagctgcatagctgagtgggggaatctatgtgtggctggcccctaggcctagcaggtggattcacaatcttgtctgttttccccactgcccccttcccctgtcctctgcctgacagcttgtcctgtgcattctgaactttgtcagatgctgggcagcaaaacaagcagcttcctcacctcccaaagcctaatatccatactcctattgttgtggccacagcctataagagaatctggcagaatgaggctgtgaggataggcaggcagtcaacagagagagatgtggtccaggccaggtggagctgctggtagtccctgctttcctggtcctgcccaccctgtcctcccatccctatacctttaaacctcacactgactgaaccctcaactaatgttcatttttttaaatatggaaaataccactttgagaggctgagtcaggtggatcacctgaagtcaggagtttgagactatcctggccaacgtggtaaacatgctactaaaaattgaaaaattagctggctgtggaggtgagcacctgaattcccagctactcaggaggctgaggcaggagaatttcttgaacccaagaggtggagactgcagtgagccaagatcatgttattgcactccggcctaggcaacatgagtgaaactccatctcaaaaaataaatacataaataaatatggaaaatatgtggccgggcgtggtggctcacgcctgtaatcccagcactttgtgaggctgaggcaggtggatcacttgagatcaggcgttcaagaccagactggccaacacggtgaaaccccgtctttactaaaaatacaaaaattagctgggggtggtggcacaggcatgtagtcccagctacttgggaggctgaagcaggagaatcgcttgaacccaggaggcagaggttgcagtgagccgagatcgggccactgcactccagcctgggcaacagagtgagaccctgtctcaaaaataaataaataggccaggcacagtggctgttgcctgtaatcccaacactttgggaggccgaggcaggcggatcacgaggtcagaagattgagaccatcctggctaacatgatgaaaccctgtctctactaaaaatacaaaaaattatctgggcgtggtggcatgcgcccgtagtcccagctactcaggaggctgaggcaagagaattgcttgaaactgggaggcagagcttgcagtgagctgaggtggcgccactgtactccagcctgggcgacagagtgagactctgtctcaaaaaaataaataaataataaaagtgggtcttgttttttgttttttgtttcggggtattttggttagagacagagtcttactctgtcttgaccgcctgggctcaattgatcctgctgcctcagcctcccaagtagctgggtctgcaggcatgtaccagcacatctggctgactttttaattttttgtaaagacagggtctcactatgttgtccaggctggccttgaactcctggccttaagcggtcctcctgccttggcctcctaaagtgctgagattacaggcgtgagccaccacaagttaacacgttatgctggggaggagttaggggagagattttctttgtagagacctgttacctcgctgtgagttctcaccccacttctttcccctcaagcctgtgggcatgagaccatggggaagatgagtggtgctttccaccataggaggctcagccagccagagcctgactccaccccgccatcgtgagtggggcagaaggggctgcaatgggatgggccacacctctgctgaggtggggcaagggatattggaggtttgcccatgtagaccccacaggataagtggcagaggcaggggtggggggtcatcttgggccttcattagaggagcacagagcccaggcagcaatgattgggcagtgaatgccacattccttgggactgaggaagggtcacaaggatgggaactgtgggagaggagtcccaaataaagagcatctccgaagaactcagaaaattgactgtgaaagaaggaggtttaaccatctgtcaggcctatagagcaagaggctgtgggccaagggagaagttctctgttcccctgccttttcccctccccagcacagaagcccaacagaccctcttttcacaaagatgggccaggaccccagactttgggggtacacgagagaggaaacatcttaccttttttttgttctttgagatggagtctcactctgtcgcccaggctggagtacagtgacgccatcttggctcactgcaagctccgcctcctggtttcaagcaattctcttgcctcagcctcctgagtagctggaactacgggcgcgtgccaccacgcccggataattttttgtatttttagtagggacggggtgttagccaggatggtctcgatcttctgacctcgtgacccgcctgcctcagcctcccaaagtgttgggattacaggcatgagccaccgtgcctggcctatttatttttgagacagggtctcactctgtcacccaggctggagtgcagtggcccgatctcggctcactacaacctccgcctcccaggttcaagccatcctcctgcctcagcctcctgagtagctgggactacaggcacacactaccacgcccagctaatttttgtattctttgttttagtagagacggggtttcaccatgttggccaggctggtctcgaactcctgacctcaggtgatccacctgcctcagccttccaaagtgctggtattacaggcatgagccaccacacccagccccatcttacctttgactgaagatgggactgctgtctccttgcttccacctcccacacttgctcctgtggctccaaacttcaaacaggatctttctttgcctggcccactcctcctcatcctttacttagaagattagatcttttccagggaatcttcattcccaccacccggctctgggctcactcctcgggtgcccctctgggctcccacattacggttgctttcaggtccagcttccgcatgtggactatgaaactgtgaggacagccaagggtcagcatgtgcgaggaaaggcagggaagaggctagacgaggcactggggagcagggaggcccaagacccttaaatccacagacaggaagccctggctgaagggccaagtaaccaggtgttctacttcaatcttggcacccactgtatgcttagaccttgactcacacatgttcagctttaagccactgcacagatgagcaaacggggcggagattgcaggctgatcagtttgaagagccaagatcatctagcgtgacctgttgcccaaggcagagacaaggctgtgggctggtcagaagctggttacaattcctcccgccccagtacttgctggcagggattaagagcagataaaagtgtgctcacacactgtagacacggctaccatgccatccacagtgttgccatccacagtgttgccatcactcctgcccacagcaggagctggctggagcatgaggtggattctgtgctggagcctcaccctctgcctgatggcgcagacggccttgggtaagacccccaccccttcccgagagtgtcaggcaagacgggcacaagggatggagggacaggccccagttcaacctctcctggggacagcagggcaggagcacttagacaaggcctgggcaaatggagggtagggtttcaggacactaaaccatctaccagctgggagtctggacaagtcctttagcctccctgaacctcagggcttctctgtatttcctgcctcccggcacaggtgaaggggtctgagaacatggccacatcttttcttccttcccacctttttccttccttccatccttctttccttctcctaagcaggaggcctgtctctgccccctctctgctacatgaacctctttaccaccttcaaatttctccccaatatctttctttttaaaatgagtactacactttttactgtgaaaacaatctaatacattaacaaaagtttactgaggtataagatgtatacagcaaggtgcacacatcttcactgtataattatatctattatactaattattatatatatatatatggtaaccattatccagatcaacatctagaacatttccagtgggttaggcatggtagctcatgcctgtaattccagcactttgagaggctgaggtgggaggattacttgagcccaggagtttgagaccagcctgggcaaatagtgagacctagcctgggtaaatagactctgtctctatttttaaaaaacattttttaaaaagtttttttaacttacaaggatacacctgtaatcccagcactttgggaggccgaagcgggcagatcacctgaggtcaggagtttgagaccagcctaaccaatattattaccccgtctctactaaaaatacaaaactagccaggcatggtggcacatgcctgtaatcccagctactcaggaggctgaggcaggagaatcgcttgaagccaggaggcagaggttgtagtgagccgagatcgtgccattgcactccagcctgggcaacaagagcgaaactctatctcaaaaaaaaaaacaaaaaaccatctccagcgtcccatgtactccttctcagtcaatactcaaagttaccactagtctgacctctatcataaataaattttgcccatatatacatatatccattattttaaatttgaaggaaactttgcttactccgcttttaacattttggcgcattttcttttcatcttttctttttttttttttttttttttgagacggagtctcgccctgtcacccagactggtgtgcaatggtgccatctccgctcaccgcaacctccacctcccgggttcaagcaattctccccacctcagcctcccaagtagctgggactacaggcgtacaccacaagcccagctaatttttgtatttttttagtggagatggggtttcgccatgctggccaggcaggtctcgaaattctgacctgagatgatccacctgcctcggcctcccaaagtgctgggaccgcaggcatgagccaccatgcccaacctcttttcaccttttcattgtgtatttatctatagctgtactattagaatgtacacaattttaagccaaatggggtggctcatgtctataatcccagcattttgggagtctgatgtgggaggattgcttaagctcaggagttcaagaccagcctgggcaacataactagagcccatctgaacaaaaaatttaaaaattagccaagcatggtgtggtgcatgcctgcagtcccaactgctcgagaggctgaagtgagaggctcacttgagtttgggaggtggaggctgtagtgagctatgatcatgccactgccttccagcctgggcaacagagggagaccttgtctcaaaaaaagaaaaaaataagggaaagaaaagaaaagaaagaatgaatgaataaacacaattttatattctggggtttttctttttttttttaatttaagttattaccaaaagcagtttaaagtttgagtctgtagttacattggccttgcttggtccccagatataaatgatgcttccagtattcactatggtatagataaatttagttcagaaaggtctttgttttcatgtgtttctgactattttcacaggggagagacccagaagtggaattactgagtgaaggcatgtgaacttttcttttcttttcttttcttttcttttttggttgttgttttgtttttgagatggagtctcactctgtctcccaggctggagcacagtgatgcgatcttggctcactgcaacctccacctcctgggttcaagcaattctcctatctcagcctcccgagtagctgggattacaggcacgcaccaccacgcccagctaatttttgtatttttagtagagacagggtttcaccatgttggccaggctggtctcgaactcctgacctccagtgatccacctgccttgacctcccaaagtgctgggattacaggcgtgagccaccacaccagctggcaagtgaacttttcatggctttgtatacatttcgccaaattattttcccaaggcattgtatcagtttatcctccaccaacagtatatgtgaatgtccttttcactgtatcttcaccagaattagatgccatcacttttaaatttattaggtctaagttgtaactcctggttttagttagcactttatgaccaccagtaaggtggaatattgttttcataggtgcttacatgctgcctctgggtagcagagctgggatggggaccactccatggcagctcatgctcaggggtctagagcactctgctacatggctaggtgccccttggaggctagggagccgacagaaaaacatggtttaaggcactgctctgatgtaagatacttttctgtgtgaccttggccaacttatataacccctttgagcttcagcttccacatttgtatagttttgtaacaataacatttgccctataaggttttcagaaaaatgaggtgaggctgggcgtggtggctcatgcatgcctgtactcccagaactttgggaggccagagtgggaggatcacttgaggccaagagttcaagaccagcctgggtaacaaagtgagaccctgtctctacaaaaaagaaaaagaaaaaaagaaaaaaatgaggtgagataatttaaagtgtttggcagagcacccaggctataatgaaggcccagtaaattatagctattggctattccaccatgagtggaccctggattcagggcaaatccaggtaatgggttagaccttggcctcctggctgtgtcctgtgagactgcaggctggtcacggcccccctctgggtctttgggcctcccccagctcctcccaagtccagtggagaagcccatgtgaaagagctttgtaaactgcaaaggctgcacaaacgggagatttgagctggcccttgccgctgctggcctgcctccatgtttgaagggtctccattgcagtcacttctttttgcccagatattgcttatgtgagacctgtagagacctgggggcatgggcagagaggcatttttggccacctgcagctgggagtgtgaaggtgtgctctattgcatcaattccaaatcctattccaaaaaccatttgcatcaaaatctggggaggtttgcaaccctgagattctcatcagagagtgtggggtggggccaaggaatacatatttttgcaatgatcctccaggtgattctgatgcacagataggttcgctaattacttggatcaggtctgctttctgtcactttacagaatgagctccataggaccggagcacagaacaatttagtttgggtttttgttgtttgttttttggttttttgtttgtttgttttgagatggagtcttgctctgttgcccaggctggagtatagagtgatctctgctcaccgcaacctcctcctcgcgggttcaagagattctcctacctcagcctcctaagtagctgggattacaggcttgtgccgctggcctggctaattattattattggtttttttttagtagagatggggtttcaccatgttggccagactggtcttgaactcctgacctcaggtgatccacccgcctcggcctcccaaagttctgggcttataggcgtgagccaccgtgcccagcccaattcggttttgataaaaggaggagggggcaaatagacaagggcacttcaggaagggacattggatgtgaggcttcaacgactcttggcaataggagtggggcaggatgacagcctggaagaggaagaaaagagtatccacgggaagtcggattcaacttggcctatttcatatctatgccaagagctggctatggtgtaagtttgcttgcattgtgtatgtgtgcttgtgtgtgcgtgtaataagtatgctgtagatagatttgttgtcacctatgtacaactgcacttgtacgcatatgtatgtatgtatatggacatgcattttactcttctgtttctgcatgtttcttggagtgtttgtttgtctgttttgagacggagtctcactttgtcacccaggctggagtgcagtggcaaaatctcggctcactgcaacctccgcctcccgggttcaagcgattctcctgcctcagcctcccgagtagctgggattacaggtgcccgccaccacgcctggctaatttttgtatttttagtagagacaggggtttcaccatgttggccaggctggtctcgaactcctgacctcaagtgatctgcccacctcggcctcccaaagtgctgggattataggcgtgagccactgcgcctggcctttttctgcatgttcctttgtagatgagctgtgctcacatgtacctatatcataaattagcatgtacatgtgagtattagatgcgagtatgcatatgagtaagaatgcatatatgcgtgtatgatttcttcctagaaacatgctgggctaatgttaacaacaagaacagaggcgtaggccgggcgcggtggctcatgcctgtaatcccagcagtttgggaggctgaggcgggcagatcacaagttcaggagatcaagaccattctggctaacatggtgaaaccccgtctctactaaaaatacaaaaaattagccgggcatggtggcgggtgcctgtagtcccagctactcgggaggctgaggcaggagaatggcatgaacctgggaggtggggcttgcagtgagccgagatcgtgccactgcactccagcctgggcgacagagcaagactccatctcaaaaaaaggacagaggtgtagctatattaatatcagacaaacagaaatcaaaatgaataatgcatttattgccattaaatgacgcagagaaatagcccatataatagacataaatttttatttatttatttatttatttatttatttattttttgagatggagtctcactctgttgcccaggctggagtgcagtggcgcgatctcggctcactgcaacctccgctcctgggttcaagcaattctcctgcctcagcctcctgagtagcagtattacaggtgtgtgtcaccacgcccagctaatttt

SEQ ID NO: 12298 - DNA, 115963 bp, Human
  misc_feature (1)...(115963): n = A,T,C or G
aaagtaatggattggattgaggatgctgccccagggcttgctggggatactttatgataccatatacactgtaaatagaaatacactttctaatatctgagaaattcaatattcagacatatctggctccaagaatttggataagggactgtggacctgtagtagattctgtttcctaatcacctgctgtgtttcagggtctttattaataatctttgagattggcatagtgacttctaggttactcaccattcacagaaaagataattagaatccagatagattaacatagcttccttctgcccattgctacaaagtacagcttaagtaggaaataagaaaaataaatctaagtgcagttacaggctgacgcattatagtgcctaacagtatatttgtagaagtaggcatgggagagcaggagcaaagattggaaagtgctgttcaccattagggtttataagtttcagtgtgaagctaagtacttttgattgtgggtaagaggacttaactggccgttttgaatcctttcatagctccagtgtctccataaaatactcgtaataattaaagagagttaaaagaaagatggtgcccatgtctactttttatattagccagtgatacggttgtagcacctttaatttaccactgaaagacattaaaagctaagtcagtgttcctggtactgtgaaagcaactgtattagtccgttcttgtactgctataaagaaatacctgagactgggtaattcataaagaaaagaggtttaactggcttaaggttccacagcctgtacaagaagcatggctggggagacctcctcaggaaacttacaatcatggtagaagacaaagaggaagcagtcacgtctcacgtggcaggaacaagaggaagagagaggtggggaggtgcttacatacttttaaaaaaccaaatctagcgataactcactcactgttaggagaacagcaccaagggggaaacctgcccccattgatccaatcacctctcaccaggcccccacctggggattacaatttgacatgagatttggacagggacacagacccaaaccatatcagcaacattcttgaactttcttaaaatttcttgttcgctatttccaagtaggaataaatgagaaagaaattcttggagaaaaatattctcttaattaagaatgcagatgtgatgtattagtgagaaaaatatataaaaaatatataaaaatgtataaaaatatatagaaagttattagttattttgctttggaatttcttttttaaagaggcagggtcttactcttttgcctaggctggaacgcagaggtgtgatcttgactcattgtaacaacctcccaggcacaagctatcctcctgccttagcctcccaaatggctaggactacaggcatgcaccaccatacctggctaattaagaaattttttttgtagagacaagtcttgctatgttgctcaagctgttttgaattcctgacctcaagctatcctcctgcctctctttctcaaagtactggaattacaggtgtgagccactacacccagtctggagaattttttgaatacatttaaaatcttctgagacaggcgctttatatatccatcttgagtcttttacctgaaagaaaagcatttaatcatatacacatgacttatacttgcacttctctgagaaaatgtttagcttctgtggatgtataaattctagtgtgttttgagaatacttgatttttgtttttctattatacatttgggtttattatatacaatttaaattttgatcagttctgtgattgcagtgtacatgatgcgtgtttgtatttagatgatattgaggtttatagattatttacaaaaactgtataccactttaagtttctatgatttatttcttatatatttcttatttccctgcttactttaaactgtcaatatcttgcttttgtcagtatctgtaaagtacccttctgatctcttctaatttattgattctgatcagttagggctttagaatccacttaataacacaggcttatggacattaatttatccgtccatccatctgtcaaatattgattaatgtttattaatatatgctaggctctgggtaaacattagtgaatgagccctgtattgtccctgctttcatgaagcttagagtctagttgatttttttttaagtttaaaaagtaaaaataattttcaccaacctgataattaaaaagtaaaaatatatgaaatattctttatctaaaactgttaaattacctggattaaacttttccatcagtaatatgaattcagtttaagtaagatttgccatctgaatcatttttatgaagcttttctaaaatgtcttattatttaaaacttattgattacaggaaggcaaacaaatgaagagacacttcacattatattaacattaatgttaacatcttttttttttttgaaacggaatctcacactgttgcccaggctggagtacagtggtgtgatctcggctcactgcagcctttgcctcccaggttcaagcaattctcctgcctcagcctcctgaatagctgggattacaggcacatgccaccacgcctggctaatttttgtatttttagtagagacagggttttgtcatgttggccaggctggtctcaagctcctgatgtcaggtgatccgcccacctcagcctcccaaagtgctgggattacaggcatgagccactgtgcctggccattaacatctaattatgcattgagtttgtgccagaaccgggactttaatttgtgcctactgatttctcccagtccagtgctctttgcattgtgttatgtgactttttaggacaatgttgtcatgtaaactaaaaaaaaaaaactgaggtaaatagcgtattgtaactacaaaggagactgtcgtaggtactgggagtctcagtgttcagaatacttctattttatacttcatgctgattttcgccttttaagggtggcagctaggcacagctgggaggcctaaccttttgcatattgtatcttctagtttgtacctgttcaagctaggcctggcccctcagattcaagacctatatggaaaggttgacttcacaggtaaggagttagatacttggcaggaaatgcttgaattatgtggaaatagcctggagagccagcagtaccaattttgaagacctagggctttaaaaatacactggcagtggaggtgaaaaaaatacgaataacttgcttctctaatgtggggtaaagaacactaaacttgaaatttcaagctctgttctctcacttaataatgtgaacatgattagtgagtctcagttttcttatatgtaaattggggataacattaacatatataaaacataataatgttaacacataacactaaatgttcgggtatgttgaaaaaagctttataactatctttccctttccattccagcaagcatctgttgtgggcaaagcaagagggagagtggggagtgagatgacacaaagatgccaatttagtaattttaaaatttaagcttatttgggtgggtgtttctatgtgtatttgctatagccagatgcttgaagagatgaggggttggggagaaaaagggcagtggtaatactgtttaagggtaagatagattcaagtctttcaaagtggtgattattttgtaggcttgaaagtttaaaaattggtaagaaagtttttgtccatgatattttttccttccagggaagttattcaccagacctggggaaaggaccagaccttacatgttttctttatcatttggctttctgccttagaaatgaaattgttgaatagcagctaatgattgtaaagactgagataactgacttagtttgtgattcacttattgttgagctcacgttaaagctgttccatttataagttcattgtaggaaatgccataagtagcaattttgaaaaactatttcctgtaggaccttctcactttatagttatttttgatgcccttgataataataacgtttgactacattttatatactagttactgtgttaagtgctttccatacattgtatctttatatccttataaaaccctaaaaggtaaatgccattttatcccattgcatagttgaggaatatgtttccttctcttggttatggaagggtgcttagcttgattgactgattattaattccctcctgtagaagaagaaatcaacaacatgaagactgagttggagaagtatggcatccagatgcctgcctttagcaagattgggggcatcttggctaatgaactgtcagtggatgaagccgcatgtaagaagagagaaattttgtgggttcaactgggattgttgccactatttccaataattaattctatagtgatgatctaggacattatgaatcttgccagcaagtttaagtccacagatgtagttgtaaacacatagtcttccatgctgttattatttggaaatacatgattaattctgattaaagtgaaagcatttagaaaggaagtcctggctgggcgtggtggctcacgcctgtaatcccagcacttcgggaggccaaggcgggtggatcacctgaggtcaggagttcaagaccagcctggccatggtgaaaccccgtctctactaaaaatacaaaaatttagccgggcatggtggtgtgcacctgtaatcccagctactcgggaggctgaggcaggagaatcacttgaacccaagaggcagaggttgcagtgagccgagatcatgccattgcactccagactgggcaacaagagtgaaactctgtctcaaaaaaaaaaagaaaaaaaaagaaaggaagtcctacatttccgtggctcattgagtttcttattgttttatggtgtttacttggtaattaaggcagatatctccagagcaagtgttccttgcaaggctctcttatgagtgtttctctgtgagattctaaattcaccatcccagacatggatcacagatggagctgtggctttgcatactgtaaggaagaggctaggctcatagcctggcccagggagccagtcttcgaaccccagttgttatttctctgtgaaaaggagcctctgtctctaatggggggtgcaatgttgctttctgttgtgatatacatcctgtaatctatataatctcagtgtttttgttggtttgtttttttgtttttttttttagtacatgctgctgttattgctattaatgaagctattgaccgtagaattccagccgacacatttgcagctttgaaaaatccgaatgccatgcttgtaaatcttgaagagcccttggcatccacttaccaggatatactttaccaggctaagcaggacaaaatgacaaatgctaaaaacagggtaaaaatgcaacatctattctttctaattaatttatattattccgtcatttgatatggctccagtttaaacatcagttttattgagatgcagtttacatacaacaaaattcaccggattttaaatgtacagtttgagttttgaaaagtatatgtgatcatttaaccatcactcccagaaagttccttagtgcacttttgcaattagtttccaccttacccacacccctgagcccaggcaactaccagtctattttctattgctgccattgacctttttaagaattttatacaaatggaatgatgcagtatctaatcttttggtgtgaggctccattttgacctctgcttcttgaattttatataaataaaattctagagcgtagccattaaaattaatagtgccctttggaaagattatctctaaatattaacatagtctttcctctttcccagattctctggggtaaaatgtttgtgtacagttgttatgggtatgtggaagttagttaaatgattctgacttgaaaaaactgaatctgaggatctcatttcccgaggtcaggagtttgagaccagcctggccaacatggcgaaatcccatctatactaaaagtcaaaaattagcccagcgttgtgttgggctcctgtaatcccaggtacttgggaggctgaggcagcagaatctattgaacctgggaggtggaggctgcagtgagccaagactgcaccagccaggagacagggcgagactccgtctcgggggggaaaaaaaaaacttcacacaaatttatccaccccttgttaaaattagtggttgatgacaaaacgaagacaatcctgctctcagaacattctttgtatctcttatcatagagcagggatttcagtttcccagttaggtgccaaactggcctgcaggcaagtagctgctgccctgcctctgcctatgtcaccagtgagactccaggattgtggatctgtatgtgcccattctgctcagatctgaggcaaggatgtgctgcccctaatcccagcactttgggaggccaaggcgggcagatcacttgaggttaggagtttgagaccagcctggccaatatggtgaaaccctatctctactaaaaataccaaaaaaattaactgggcatgatggtgcacgcctgtagtcccagctactcaggaggctgaagcaagagaatcacgtgaacccaggaggcagagtttttaatgagccaagatggtgccattgcactgcagcctgggtgacagagtgagactctgtctcaaaaaaaagacagaatctcgctcagtcacctaggctggagtgcagtggcacggtcataactcactgcagccttgaacttctggggaaagcaatcttactgtcacagcctcctgagtagctgggactacaggcatgtgccaccacattgggctaataaaaaaaagttttttgtagagatggggtctcgctatgttgcccaggctgatctcaaactcttggcttcaagccatcttcccaccttggccttccaaagcactgggattacaggcatgagttactgtgcctgctttgttctttataaagggtcttaagctacacccatattcttggtagtgttatggtgcaggaggagcacacgtgtatttatgtggtcttcttagacaccttaagctaacttaattacgctttttactcatcctcagacagaaaactcagagagagaaagagatgtttatgaggagctgctcacgcaagctgaaattcaaggcaatataaacaaagtcaatagtaagtatgttcctgaatcaggcacctaaagggatattataatataatgtgaatgttgatctattctgggacttacaacatagtttgatttacttactttagacattcgtggatttgtttagcaataattgcttgttaacaatcttttgtgtttctatgcctccgttttaattatttatcttcagtcagccgcttgttcctacactgacagtagcatcatagtagtctgtttggctacagtttcactctttcaccctattacatgcttttaaatattattttcctggccaggcacagtggctgattaatcccagcacttacatatctgtaatcccaggactttgggaggctaaggcgggtggatcacctgaggtcagaagttcgagaccagcctagccaatatggtaaaaccccatctctactaaaaatacaaaaattagccgggcatggtggcgtgctcttgtagtcccagctacttgggaggctgaggcaggagaattgcttgaacctgggaggcataggttgcagtgagctgagatggtgccactgtactccagactgggcaacagtgagactctgtctcaaaaaaaaaaaattatttttctatttttttaaagtaacattatatttttgtttttcctttaaagaataatgcaagctgtctagaaataaaaaataaaccacaaaaattagactccttcacttagaaataatcatcacttaggaataatcattactggcatttttttgtatgtccttcaaaactgtgtgtgtgtgtgtgtgtgtgtgtgtgtgtgtgtgtatatatatatttttttttttctttaagagacagagttacactttgttgtttaggctgcagttgcgattatggtttactgcagcctcaaactcttgggctcaaaccatccttctgtttcaaattctctagtagctaggactacagtcatgcgctgccacacccagctgatttttaaaatttttttgaagagacagggtctcgctctgttgcccaggttggtgtcaaactcctgatctcaagtgatcctgccaccttggcctcccaaattgctgggattacaggcatgagccaccttgcccagcctccaaaacatatttaaacaaaaatgagattatacttttaatattgacttttatatatgtgttacttttgggaaattaatttattgaaattatcattttgtcactactctgctaaagaactcaccatgactacttcatacttgccagacaaaatgcagatccctagcctagtgcagttctttatgcaatatttcatgcatacagctctttgtagaagctcatttgcctaattacctcccatactcattctgtacattttatgacttaaaaggaatctgggccaggcaattccagcattttggaaggccagggcaggtggattgcctgagcttaggtttgagaccagcctgggcaatgtggcgaaaccctgtctctacaaaaaatacaaaaactagctggacgtggtgacatgcgcctgtagtcccagctacttgggggctgaagcaggaggattgcttgagcccaggaggttgaggctacagtgagctgtgttcgcaccactgcactgtagcctgggcaacagagtgagaccctgcctcaaaaaattaattaattaattttttttttttaaaaaagaatctggctctgaagtggtactgacctggtatttgatctcttgttcctctgttaaaagctgtgtaacattgggcacctgcagtagcgttgttagacatataatacgagatagtgtatgtaaattgcctgctatttagtaagtactcaatgaacattaatattatcgctatgtcatgtaatctccctactgtaatgccttcatgcctcatctcttcctaatccaaattgtacccatcattcaagatccagttcaattttcacttcagtgcctgtcacagttcaatatggttgactttcaaatctcctgtgtcgtacacaggctcatccctataaatttgcacttaattatatattgtcttgtattgcttgatctttatttctgacatctttgtaaactccttaaagtagagattacgtattctgcttcttttgaagtcctcctaattcctagcataggtttagactcaccaaaaaaactaaaaggtttgatttcaaccaactaggtcaggcttaatcttgttttgctcaagatactcataacaataataatagtaattgttctcattgttcatttggagggccaaatttctcatttgaactaatactaataactagagaggatttagaagattttaccaattgcataggattggagttttaagtcctgaccagcattctttttttttgggttttttttttttttggagacagagcccaggctggagtgcagtggcacgatctcggctcactgcaacctctgcctcctgggttcaagagatttcttctgcctcagcctcctgagtggatgaccagcattctttgtattctgctaccttctggttcatttaggataatgaccttcctagcagaataatccattcaagtgtggatggtatcttgtgctgaatctgtattaatccttaagtcagcaaatataaactggagtgtccttatggttggttctctgtgagaagaaagtccacgatgtttcctgttgcatagagtacataaaatattttttgttttactgagggatttttctctaccttactgtttggtattttataacctttatagttttaccttgctaattgtataagaatcagttgtgagcacatgtaaggaaataataatatgttcttaaaatgtcctattcatattattattatgtagtcagaggagcaaaataataaaaattccctcaaatacctttcagtatagtggggaagatagacatacaaatgagtacttttagggcagcttgattagagcaagatgccaagagcacatgtggtgcagtcatagaataaagaagggaatgatgacttctgcttagaagtttgagcaggttttcagtgtacatggatcttcacagggatccttaggatagataagagggtgaggataaggcagaattccctataaaaggacagtcttttcctaattgtagagaaagtcttgaggcaaaggaaagttagatgccaggaggatatagggacttcgggttccaggaattaatgtaattatagataagattctttgcctagagcattcgaaacagcaatgaggccattgatgctgccccaggagaaagctgcaggccaagcagttaaaaattagaaaaagtttttattttattttttgttaagtagactaaggaaaattagagttatataactaaagttcagtgagagaaagtatttaagtaatgttccacactttattatgtttgcaatataaatgtttatagatattcatttaatatttacatatttaagtagtatgtgtacacttctagaaaaagcaaaatttactagatgcttttgtagatagataatctaagactctatgctatatacctagagaaagtctagtttgttatctacattgattttattttctgtccctagctactatgaaagctccttgaggacaggatatttgtttttttcacaattatatttgcaacatatagcagatcctcagtaaatatcattgaaggaatggatgattagttggctaacagccacatatacctgcagacatgacttgagaagccaccaccttggtatggtgctcagttgaatggcaggtatgaatattaggaagaaataaacagtatcttaggagcctacagtgagacctcacatccataccaatgttttaaccttttcttccgccctttttttaaatagttctagtctcctcattgcccctacttcccattttctagtttgagactttattttcccttgggctgttttgattttctttataacagcttattaattttattttgttttttactaatgaaaacatttgcaattgataagtactattatgccccagatatttttatttttggtattttattgatttctttttgctactgtgataaaatcagatgtttatctgtgagtggtggtagggacaggcattttctcttcaaaaaataaggaaacggaaagtaaaaaagtaattatgattccttagtggctatcatttctgaaatcagaaattatcttattctgtctttcaggctaagaatacctttttgttttgttttgttttttttacaatatataaagtgcttttatgtatatgattttatttaatcttaaaaatattcctatgacggaaggtatcttcattatcattttcagatgaaggaacatctgggttttcattgtcatgtattgtattatagagcttgtgtgacctcaggttctatgattagaagagagaatgtggaaaggggaagatgacccctttcactctgcacaggttggaccacccttgatagcagggcactgactgttgtgggtggagtgtgttcaggaagtatcagggtaatgagaggattcaaaatggtgctatgtaagacatggttaaaggaaataaggctgctagtaaggcatttgctgtcatagggaggggcagtggaatgtattcagtgtgaactttagggttggagctttaaaaatatttttgaaacaaaattgtccaaagatgtagtaagtggccacgggagatactttctcctgtttggtagtctgtaagtataatctggacaactacttggcattttaagggaatttaagcgtcatgttggtctggattggtggctccatattggtgctgagctgtctacatttggaagtttttaagtaggctgggagtgtggcccaggaatctgtatgaaatctgatgaatagcttgttgggaacccctggacttgatgactctaaggttcttttccaatcccaagatcttatgcttctgagaatcacagagtaaaggctctctgagttatatttccttatctggaactgagattggttttggggaaggaaaactattctaggctcttctgttaacatagtcctttcacaagcttttgccttttttcctcagcattttctgcattagcaaatatcgacctggctttagaacaaggagatgcactggccttgttcagggctctgcagtcaccagccctggggcttcgaggactgcagcaacagaatagcgactggtacttgaagcagctcctgagtgataaacagcagaagagacaggtaaacatagtctggattgaagctgcaagagtttgtatatatccattcgaatcccatgctgtcatttaaagatatatatgctgcctttgtttttcccccaatacgactttttcctctgcatataaattagtttaaaaaaaaatcctcaggtaaaatacacattgtcttcagctcacttttgcttttagagctatgaatcctcttttaagataaacagacaatacccacccatccccagtctaatcactccttcacttcagctgtctctctctccaactaaaagacattggggaaaacctgaatatttttgcattcttacgtcaggaatttgcactttaaaaaaaaactgcaccttattagtttgctctggccaaagctggaaaagtacttactgtgcagtcagggtagcttgtgtgggattgtatttcgtgggttttttttttttagaacaaacatgaggggctttcttttttgtctaaataagggcaagtatacattttacaaatatccagcgtacgttggtcaaagtaagtagcattaacgtgcttaagattctacaaacactttttccttagaactttttgaggcttttcatgtaatatgtttaagaatgtactggtatctgtaaagtcactctaccccagctttggcaaaggcatttggctctacctggggctgccaccttggctgcatgtagcctgagctgtcacttatgactatggctctctctgtccctagtgactgcttttgagagatgagaaccttaaggcctggagtcataggaatgagtaatctttacataattttctttgctttgctcagagtggtcagactgaccccctgcagaaggaggagctgcagtctggagtggatgctgcaaacagtgctgcccagcaatatcagagaagtaagagtccattgaaattgtatgggaggaaagttgtggctttgtgttattgaagggtctgaggttagcttctgtcatcgtcatcacccactctgagcctactagccataaccaactgccaggtacttttggtggcaggagggttcctccagtttgttgttgtggtggttttaattgctgtgtaatagttgtacatattttgagggtacatgtgttttgttttttaaaccaaccaagaagcactgacaccaaccaagaagcactgacgtatgatattttgatacatgcatacaatgtattatgatcaaatcagggtaattggaatatttgtcacctaacgcatttatcttttgttgatgttgggaacattccagttcttctgttttgaactatacattattgttaactatcatcatcctactgtgctatctaacactagacctattccttgtatctaatggtaattttgtacccgttagccaacctctctatgtcctcctccccactacccttcccagcttctgggaaccaccagtcaactctacctctgtgagatccacttttttagctcccatatatgagtgagatcaggaggtatttgcctttctgtgtctggcttatttcacttaacataatgaccttcagtttttatggctgaataatattccattatgtgtatacactacctttttttttttttttttttttttttttttttttaccatttattcattgatggacgcttaggttgatttcatatcttggctattgtgaatacagctgcagtaaacatgggagtgctgatttcctttcttttggccatatacctagcaatgggattgctgaatcatatgtagttttattttaattttttgaggactctccatcctgttttccgtagcggctatagtaatttatattcccatcaacagtgtatgagccctttctctgcagccttcccagcatttgttattttttgtctttgataaaagccattttaattggggtgagaaagtatctcattgtggttttgatgtgtatttccctgatgattaatgatgttgagcattttttcatatacctgttggccatttgtgtgtcttcttttgataaaaatctattcagcttatttgcccatgtaaaaattggattatttgtggggtttttttttgtttttttttttttggctgttgtttgaatttcttatatattatggttattgttctcttctcagatggatcgtttgcaaatgttttctcctgttctatatgttgtctcttcactttgttgttggtttcctttgctgtgcagaagctttttagcttgacatagtcctgtttgtctatttttgctttcgttgcttatgcttttaaggtcttagctaaatggctttgcttagaccagtgtcctgaagcatttccccaatgttttcttccagtcgcttcatagtttcaggtcttagatttaagtctttaatctattttgatttatttttgtatattatgagagatagggatctagctttattcttctgcatatggttatccagttttctcaacaccatttattgaagagactgtctgtctcagcccattttacgtggctataaagggatacttgaagtggggtaatttattagctcacagctctgcaggctgtgcaagaagcaaggcaccagcatctgctcagcttctggtgagggcttttgtgctgcatcaaaatatgaaggagaagatcaaagggcaagtgggctcatgtgaagagagactgatccccggggtagtgagtaggggtcctggctttataacaacccattctaatgagaactgatccgttctccccaagaaccaatccaatcttgcaagagctcactaccatgagaatggcacaaagccgttgatgagacatttgctcctatgacccacacagctcctactaggccctgcctcccaacaccaccacactggggatcaagtttcttctttttttttttcatacccttagggtgatgtcaggtatcagatttcaatgtgagatttggtagggacaaataaaccaatccaaaccatagcactgtcttttccctgatgtgtgttcttggtgtctttgtcaaaaaatgttctcctcatggctgtaaatgtgtggctttgtttctgagttctctatggtgttctgttggtctgtgtgccctttttttttttttttgagacggagtctcactctgttgccaggctggagtgcagtggcacaatttcagctcactgcaacctctgactccctggttcaagcgattctcctctctcagcctcctgaggagctgggattacaggcacgtgccaccacacctagctcatttttgcatttttagtagagacggggtttcaccgtgttgaccaggatggtctcgatctcctgacctcgtgatccacctgccttggcctcccaaagtgctgggattacaagcgtgagccaccgtgcctggccaagttactccagttttaaaggtagaactggagtcaatatagcctcactttggctcgcacacacttcatgatttgttagggaaatatctggaggaggtgagacttaagggatcgctaagatttggatggtgaaagaggtgagaaaagaacgtcctagtgcaggacaatgagggaaaaaggaggtgggagcggaagtacaggtagtgaaagatgtctttgaggaatggtggttagaatacaaattttgtaaatgttttgggctgagttgtgtaagatcaaggggtggaaagattgtagaaagctttgaatggtagcttaagaagccaggcagtaggagaaggaagaggtggtttagatgggaagtagtggtagcatataggatgaattgaacgggaagaaaatagggatgaggagaacagttaggaggctgctttttgaagaaaacatcttgattgagacatggttcacataccgtacagttcacccttcttcagacaaaggaggctgcttttttaaagacgaaagttccacttcaaacttcatggctgatagccacagaatgtgatatttttcccatgaagattggcaccttcttcccctgagggctctctaagcccactgcgtttctgactcctgttttttacacaggattggcagcagtagcactgattaatgctgcaatccagaagggtgttgctgagaagactgttttggaactgatgaatcccgaagcccagctgccccaggtgtatccatttgccgccgatctctatcagaaggagctggctaccctgcagcgacaaagtcctgaagtgagttcactaaacctgtcctgtttgtgagcaaagttgggtggacgtgagtgtaatacccacttcttcctgtggttaggtagaacttttttgcataaacttggttttcttacagttttattaaacttataactccctgggtcttggagaatgtctttcctcactgttttcccttctgtccctttctgtacagcataatctcacccacccagagctctctgtcgcagtggagatgttgtcatcggtggccctgatcaacagggcattggaatcaggagatgtgaatacagtgtggaagcaattgagcagttcagttactggtcttaccaatattgaggaagaaaactgtcagaggtgggtgtccagagtgaagggaataaatccattacgtagctgttaaccctgtcttttgtatgtcagtgctccgattttctttgcaggcattattactttatcatggtcatacttttgtttggttctactttgattcacttaattctttgttatgctgaaaaatatgacattccgttcctaaatatataagtaggcttaaatatgttacatagtcaaaataacactatctctgacaaagttaaataatactttttaaatatcatctaaccctagctagttcattttcattcttcatttgttcccaaactgtcctttatagctgttttgttgaaaacaagatctagcctaggaacatgtattatatctggctgttgtgtcccttgagtatcttttaatctagaattgtccctttcttcatgagactgacttgttaaagggatgggaccaattgcctattttatggatagttctagttgctttctcatatttgccttattcctgtaaattggaaattaaatttctaggcttgtcacgattcagttcaacatttttgatgatgtgtatttcatattgcctcatatcaataggcatataaaacccacttttcccaccatcccaccattagagatactaagattgatccctggattagggagaccacttatacttccattgcgtatttacgcttttccctcatcactagaacatcatctcttttgcaccgtcaaaatatctagttttccattaagcattcacgtgatatttttaacccaattgataatctttcctaaatcagtaccttcagtaaaagttgctgaatgatgatttgttgctctgtcattcctcctgcatttattagctcatgtgtagcctttttttcttgtctatggaggaattgcttgaactgctgcctttaattctagagttagtcttaacatggaatttagaatatgtaacaggatattgagaataagtgatttctgttgcatttttgcactttgtttaaagtaactgtgcagttccaaaactggtcttgagaatatatcaaatggttgggataccctagcaatctttgttccttgaatatttaaacatgctgtgcttaatgctctttttacttgggggtctggggcaggtatctcgatgagttgatgaaactgaaggctcaggcacatgcagagaataatgaattcattacatggaatgatatccaagcttgcgtggaccatgtgaacctggtggtgcaagaggaacatgagagtgagttatcttcctgtcctccccaaataatgtcaccattaatgatgatgtgattccatgaagtggttcaaaatactactcctagaaggatttttgggtgagagattgaaaatatctatataacacaaaaggctaaagttggatattgttttgagaacaccaggcaattgctataattaggtatatgtccagtaagaactaaattttgggggaggtgaattgaacatgatctgttatttttaaatgctgttataacaagtagtcctgacactacatggaattaggttgaattgcacaggttgtaggcatggtcctccacaagactcctctcacttcagacacaagctgaaagctgcagggttcccaggccactgtacttctgaacaactggctgcaaatttggaggatcccttctacccgctcaggtttaataatttgctagaatgactcacagaactcaagaaaatgctagacttacgattaaaattttattacaaaatatgtaaatcaggatcagctgaaagaagagaatcatcaggcaatatctgtgagagtccccaatatgaagcttctgtgttctcaggatgtgtcactctcctggcacattgacgtgtatcaccaaccagggaaacacacctgagttttgggtgtccagagtttttatttgggttcgttacatatgcgtgattgatagtattggctttgcgattaaactcaattttcatttggcctctgctccctggagaatgggaggccaggctggtatcacgtgactctatacctcagtggttgatctttccagcatggccagcctccatccttaaactctcatgaggccaaccaggagtcattggttggcataaattcaggtgtgggcggaggggcccaccatgaatcacagaaacatacctatcactcaggatatcccaagggtcttagacgctcccccagagacaaagaccagccagactttttattatacagcagagtccttacaaaagcagtacggctgcctaagatacctggggagtgaacgttcctaattttaatttgtatttcctgggagaaatattcaactgacttggtgggaagagccttgcttcgcattagggagccctgcgcttggatctttcttctgccatttgtttgctgtgtaatcttggagaagagattgctaagccttgttatttcttctataaaagtgttgaattagatgactttttaagaacccttgaacctttttaagactcttcgtgaatcctttgtgactcaagaatgtttttgattacacattccagtgtacctgaaagctatacagtaaggccagtttcataaaaatcctcatcgcttttaagttagagcaattaaaaatgaaacaaaaggacttgagcattcaataggaatatgaatacaagtgagtttagttgaaataaatactaattaaaaaatgaaaacagtgctgcttaacggatggtaagttgcagtttgaatcatggttactcttaggtggatttatgattagttagcatgttccatgattgatttgtttatgtacttccttaattagaaaaaaaaaactttctgtctctttatatttagggattttagccattggtttaattaatgaagccctggatgaaggtgatgcccaaaagactctgcaggccctacagattcctgcagctaaacttgagggagtccttgcagaagtggcccagcattaccaagacacgctgattagagcgaagagagagaaagcccaggtgagtggcatcggaattgttctttatgttcagagcacctcagccctcctagaacaaaggtagaggtaggaatatcttccttgattcattcagtgaatgccttctgggcacccttagattcaaagcactggagggacacaaaaatgtgagagacataggctccacctactaggagctcatgctgttttacacatttgggtttttgttcttttgtttgttgttgacagtcttttgtgtctctttcagtaaattctttactgaaatataagatccagggctgggcgcagtggctcacgccttgtaatcccacagcactttgagaggccaaggcaggcagatcccttgaggccaggagttcaagaccagcctggccaacatggtgaaacctcatctctactaaaaaaaaaaaaaaaaatacaaaaattagctgggcgtggtggtgcatgcctgtaatcccagctacttggtaggctgaggcacaggaattacttgagcctgagaggtggaggttgcagtgagccgagattgcgccactgcactccagtctgggggacagagtaagactccgtctcaaaaaaatatatatatatatatatgtgtgtgtgtgtgtatatatatatatacgtatatatataatatacgtatatatacatatatacgatccagaaaaaaaaatatatatatatgatccagaaaaatgaacaaggtagatgggtatgcaattgcataaattttcaaaaggaggcacacctgtgtatttggcagtcagattgtagaacccattaccagcaccacagagaccttcctcatatccccttccacccttagccaccctccatttggtggtaagcactattctgatttctattaataacaccacagttcatttccgtccacttttgagctgtatttaagtgggatcataccttatgtgctcttttgtgtctggcttctgttgccctaaataatgttaatgatatgcatccatgtggttgcatggagccatcctttgctcattctcattgttgtgtactatttcattgtgtggttatatgttattggtgaagttttttgttgttttgtttgttttttcagactgttgtaaatagggcttctttgttttttttttgagacggagtcttgctctgtcacccaggctagagtgcaatgacgcaatctcagctcactgcaacttctgcctcccaggttcaagcaattctcctgcctctgcctccccagtacctaggattacaggcgagagccaccatgcctggctaaaattttttttttttttttttgtattttttgtagagatggggtttcaccatgttggccagtttggtctcgaactcctgacctcaagtgatctgcccgcctcagcctcccaaagtgttgggaattacaggcatgagccactgcccatggcctgtaaatagtgcttctatgaatttttaattttggttaaaaacatatatgtgcatttctgttaggtatacattttggagaggagttatggccatagggaacacatatatgaagctttaatagataatgtcatgaaggttttttgtgacaacttaattgaaacgtaattcacgtatcaggtaattcagcgtcagtggactttagtacgttgatagaattgtgcagtcatcaccacagtcaatttttgaacatttcatcaccccaagagaaactcagtacccattagtagtcactcattttcccttaatctcccccagccctgggcaaccatcagactgctggtttgtctatgggtttgtctattctgaacatttcatataaatggagttatgcaatgtatggtcgtttgtgactggcttcttttagcttagtttatccaagctgtagcagtagcacttcatttctttttgttgctgaataatattccattgtatgactgtaccacattttatttatttattcatgagttgatgacacatggattatttccactttaccacattttatttatccattcatgagttgatgacatatgaattatttgcactttattcgtgatttgatagacacttagcatgagtgacagctatataagttgtatcttcaatctacttccctttttagatatggaagccgacctagcttattctccgaaaccccactcctctgacagtcagatataaggctccctttggactttcttagcagcaaaaacaaacattactaccactagcatacatagaatcattgcagcctgacacattagagattctgaatcagtagaattagactttaagcttaggaatctgtattttaaaaatgactttttcattgttctgatgaccagccaagtttgggaaacactaatctaataaaatgaatcaaagacagagacttccatttctagcttccctagagccaactacttcttatccgagtaagtaaaatcagttgatctcaatttcctggctatgaaatagcagttgtgattcaaccctctccacagcatcaagtgacattctgcataattatatctcttaaatgaaacctggtagtatctatcagatactacacttacatgattaggacatggtaatgtcaactactgccatgccaatgtaatcaaaggagatcagtcaacatcataatattaccaacatataaaattgcccactcctctacccttcaccaaaacttacagagcccacacgagtgtcagtgtgcaaaaagctccaatacactaaagccttggtctgtttttatacgtctggctactcagaattaaaaatttcttttagcccttccgcttgctgcctcacttcaggagtcttctgaaggctatggttctatccagttgttgttacttagtaagcactgaaaaggaggtcaatcacaattagaaaacagatgttaattatgctttaatcaacaattatttgagggcctactacatacaaggcaacttcctagacagcaacagcataaaaagaggcataaaccttgtcaatttcctcagcaaactaggtagcgggtaagacaaacattttaaaagatgagtttatgttacaattactttaacaactttatcttcatagtagcattattcctgatagccacagtggaaaaaaacagtatgtctatcaagtcaggaatagataaagtgtaaataattcaaaaggctgtgtgtgcgttttgtttgggtcatcggagtaaaactttttgaggatgtgactatagagtttgaagcatttcctttgctgtggaataacttttcagacttcatcaaaggcggaggaagtcgggggagttaaaggaaaaattgcttaacattgccaggcccagctgggtgaactacacattgggtggaattgttttttgtttgtttgtttttggtttgggttttttgttttgttttgttttgttttttgtttttggcatcacctgagcatctaagtctccatcagccatttgggagtgtttttaaaaatatttatcactgagttacaaatttagagagcaaaagatcttaatttaaatttggtctgtagttttattttcttctgatatctttgtgtttggttttggtatcagggtaatactggcctcatgacttgaagtgttccttttatattttcaaagagtttgtaaaggattagctagttctttaaacatttgttacaagtcaccagtgaggccacgtggtccggagttttttgtgtgggggatattttttgttttgttttgagctgcagtactgtgtaggaaaggggtcccgatgcagaccccaagagatggttcttggatctcacacaagaaagaattcagagagagtccatagagtgaagtggaagcaagtttattaagaaagtaaaggaataaaagaatggcttctccatagacagagcagccctgagggccgctggttgcccattttatatttcatgatgatatgctaaacaagagctttatcagatcttttctgagcatgtgcacagcccacacatgcactgtggcctcctagatcccatccaggaatatgtcaagttgtcagagctctccatgaacatctcattctccagcttttccttataaggtttttagttagtctcttgtttgcctaaactgttatccttaatgtttttgacaattgcttttggagaaaaggctgtttgcagtggatgagctcttggtcaggtcaaataaagacagccatgcgagtgtgacctctgaacaggtcagctaatgacagttctttgggaatggggctttgaagggatggtaggaggggcagattggaataggggagtttaaagcaccacagaactcactgttcttactgagtttcagctgtttttcttgaatgcattctccaatttctgcaagcctttggttaatttctaccgtattgaaaaaactggccgggtgcagtggctcatgcttgtaatcccagcacgttgggatgccaaggcgggtggatagtttgagcccaggaatttgagaccaggctgggcaagatggtaaaaccctgtcttaacgaaaaataaaaatattagctggacacggtggtgtgcacctgtggtcccaggcacttgggaggttgagatggaaggatcacttgggcctagggggctgaggttgcggtgagccaagattgcaccactgcactccagcctgagtgacaaagcaagaccctgtctttaaaaaaaaaaaaaaaaaaaaaaaagggctgggcgcagtgcctcatccctgtaatcccagcactttgggagtcccaggtgggcagatcacctgtggtcaggagttcgagaccagcctggccaacatggtgaaactccatctctactaaaaatacaaaaaattagccaggcgtggtggcaggcacctgtaatcgcagctacccaggaggctgaggcaggagaatcacttgaacccaggaggtggaggttgcaatgagcaccactgcactccagcttgggtgacaagagtgaaactccgtctcaaaaaaagaaaaactgatgctggtgattgtttgccagtgtaccaatgttttttgtttgtttgtttttcatggtggagaggattttcagaggtctttaccattttcactaatgtcacgtttctcttcattaaatttagtgtttgtgggactcttgataaaagtggattactagtcgtgagtagtacagtctgaatgcaagacatggatatcagggctcctcaagaactcattttataattaagaatatgaatgacttaggccgtgtgtggtggcttacgcctataatcccggcactttgggaggtcaaggcaggcggatcacttgaggtcaggagtttgagaccagcctggctgacatggcgaaactccatctctactaaaaatacaggtgtggtgtacacccctgtagtcccagctactcaggaggctgaggcaggaggattgcttgaacccgggagtaggaggttgcagtaagctgagatcataccactgcactccagcctgggtgacagcgaagctgcatctcaaaaaggaagaaagaataagaatgacttaaatcggctgggtgcggtggcttacacctgtaatctttgtactttgggaggctgaggcaggtggatcacgaggtcaggagatcaagaccatcttggctaacacagtgaaaccccatctctactaaaaacacaaaaaaaaaaaaaaaagaaaaaaaaaaaattagcccggcatggtggtaggcgcctgcgcctttagtcccagctactcgggaggctgaggcaggagaatggcatgaacccaggaggtggagcttgcagtgagccaagatcgggccactgcactccagtctgggcgacagagcgagactctgtctcaaaaaaaaagaatgacttaaatctctctctgacctccatgtgtgtatatgcacttatgcacacatgcttatatacatgtagctagtaatcagctggttcacaccagcacagctgtaccagttgttaggacattgaaattcttttattttgtttggtacattgttactgtcccaaccctcccatatctttgccatcactccccaactctaattgaaatcccactatatggcaactaaaccagcagtgaccataaggactctgctccatcctgattggtcagtgcttatgttgtgtagttgataaacgtgttgtacagatttgtgtatgtgtgtttatgtgtgtatgtggtatatatgtggttatatatttatatatgtaatattgggtctatcatcacacatgcaaaccaagccacatagtaagtaaagtctttttaaaaagttttgagtgatgagaagtgccctttagaggggtgtgtgagtgtgtgctttccatatatacatgtacataacatagtcattcctttgcctcttcccccttttcctgtgtttgtggcttcttcacctcttctacctccaatcattgcccactctttttttaaattctgacttctggtccctatctctttacctcttctgaaatgcaatcagcgtgtttctaagtgtcagagttgttagggagctgtgcttgaatatatcttagatagcatttttacagcaaatctgttttctctccataatatctagcctgggctttaacactctgctcagtcatttgagttaatctttaggtaatctctttaaaacaaattttaccagaaggatttgggttttgtcattttattcagtctaattggagcagaaagaacctgttctttcttcttacactgggatgaggtgtagtgtatgctgtctctctttccttcttcattctggtgaggggcttttctgtattaatgtttccctgaaacacctgagacacccatccattcactttttcttgcctttcatactattgctctattgcttatttcttaaggagtatgtatgaaaggttttactttaatctgcatggggcagggaagaaagaattctgaatgcttagaaaggttctacctttctcaatgcaagggaggttgtgctaagtctcacaactttgcttacagcagattctgctcagatatctgttgtatgattatcccagaagtgaacccaaaatggcttgattctgtggaaatgcttctgtttttatgatacgaggatttttctgctgcttctcttggagactagaccatcagccctctcgcttatgacttcacaatttaagttgtcacaagcctgcagctgactcattgtattgtctcacattggaactattgtctagtatttccagtagttattcttaggactctaggggatggtgtgtggtcattttctattttcagtaatagaaagcgactagtggtaggaaggtactaggttctgcagcttttaagtgatttatttgttcttgcattctatttatctgtttactctttccctttcccaagactgtgagcttcttaaaattgggacagtgcctcttagaattgtaaggccagcacctaccataattaggttaaatgatctttctaaaagactgcatttaagagaaatcactgctttcaatttcagatgctttcctttggccttatcctgtcacctgcactctttataaattgcagggattgtggctgcttcactatatggagtgaaatgttgtgtctttctctaataaaacaggaggaaagccaagccttccctaaggttttgtgacttcaactgttgggcagtgaaacgtttcactttgcctcaaagctcagaccctgcctcatttaggcacatagttatggtgatttactaagttctttattctgcctcattcatgccttggcaaattatattcacatcgagcaatctaaatgaatttttgagctgctatttataccaactgctgttagctcaagcctcaggagtatgttaattttgttgggtctgcgtagatcaccacaaacatgactctcacaacctggccactttaaaacctgaagtgccttgtcttttctagagaagattgccccagtaatctgctgaattgatgctctctgtaaagaccttacaggcatcttaataaagaacccccactcttttgagatcgttgaaacctacataacctcagtatgaccatggaaatctaatggggtatcagcagtggtttctgattctatcacactgagagtaggtagaagtagaatcctattgtgctaactctcagtaacagtagtgactacctggggctaatccataagctacttccccaaattgaaatatggcagccacattcttgaaaattggaagataacggccaggcgcagtggctcacacctgtaatcccagcactatgggaggccaggacgtgcagatcacaaggtcaggagattgagaccatcctggctaacatggtgaaaccccgtctctactaaaaaaatacaaaaaattagctgggcgtggtggcgggtgcacgtagtcccagctactcgggaggctgaggcaggagaatggcgtgaacctggaaggcagagcttgcagtgagccgagatcacgccactgcactccagtctgagtgacagagcgagactctgtctcaaaaaaaaaaaaaattggaagatattagaggaaggtatttctactaatctaattctgtttaaaatgccattcagagcaaatggtcaccaataagcgcctttaaaaaagaaacttgtcttaacgaatttaggaagaggaaagtaagtcacctccactacatcatacatcatctctatccacaatagtcaactcagactatgctgtgaggcttttgttagctgtactaaggaaagtaatcacaacattcattatatttctgtgtgaaaatttgcttttaagttcccagcaactgatttaacattcaagttttaggatatcagctagtgagaaatgtagattgcctgtagtgacttctggctttaaatgtgatgagtcaaagattctggttaaagtaagacttgacagtcttaaaaacattagtagtcatagagaacgttaacttcctctgaacattgttggcaaaggaggctttcaaataagtactgcatattcatatatataccctggcccttgtcaccctgttaaagtctctggaccccttcccagtctgtctgggcctcttgccccttctagctgttcacaacttcctgaaccacttaaattcatctttatataatcttcacctacatgtgagccatttcccttatcttatgacctttaccagtttgtttgtttttggagaccggtctatactcttgactggagtgcagtggtaagaacatggctcactgcagcctaacctcctgggctcaagcaatcctgcctcagcctccctagtagctgggactataggcgtgcaccaccatgcctggccaagctatgtttgtttgtttgtttgtttgtttgtttgtttgtttttagagagacggggtctcactatgttgcccaggctggtctcgagctcctgggctcaagcattccttctgcctcagcgcccccaaagtgttggattacaggtgtgagtcactgcatccaactttttaccagttttttgatgcctccttcttccatttgactaacccacgtgtctcatattttttaagcctgttcttccatatttaattgagtctaggaagcccccttcttcacatgtatgttacatgtaccctgatttcatgactttaatattttgcttttaatgatatgtaggaaatccaggatgagtcagctgtgttatggttggatgaaattcaaggtggaatctggcagtccaacaaagacacccaagaagcacagaagtgtatgtatcacctgttttatttctgttttggtggaggctggggtgacaaggtgctccgtacagcttgaccaagataggtatgggggaacaatttgccagtagatatagttaggtgaagcagtatgtgaatttagacactctctaaactattctggtaacagttctttcccgaaatagttgccttaggaatctttgccattaatgaggcagtagaaagtggtgatgttggcaaaacactgagtgcccttcgctcccctgatgttggcttgtatggagtcatccctgagtgtggtgaaacttaccacagtgatcttgctgaagccaagaagaaaaaactggcagtaggtgagttctgggataatacatatgtgccctgaagctaacccttgagtatatgaggggacagatgtagaggaaagggataagctatagggaaagaccttttagcatagatgtacagtacttaggctcattttaaaggagataaaatccctatttttgaaaatatccttccccccccccttgtggacagctgtgttaataaggccaattttctgagaatgtgggaaagattaaaatatttaactgtttatctttcacagagtagcagtagctctgattaagcctataggcaattaaaagtagtttgtctgtaaaaagagggaaagaaataagatttcttaccccattttatggacttttaaaaattaaaaaactgggccgggtgcggtggcacacgcctgtaatcccagcactttgggaggctgaggcgggcagatcgcctgaggtcaggagttcaagactagcctggccaacatggtaaaaccctgtctctactaaaaatacaaaaattagctgagtgtggtggcgtgtgcctgtaatcccagctacccgggaggctggggccggagaatcgcctgaacccgggaggcagaggctgccgtgagccaagatcatgccactgcattccagcctgggcaacagagcaagactctgtctgaaaaaaaaaataataataataaattgaaaaactggagaggctgaatggttgcacattttttaagacagacaggccttaaactttggctttggagtgaacaaagttaatcatggttaattccataattggacttcataggtattttcttcttatagacataaatgagctaaattagtcattacaaagccataatttaatgggagcttagcatgcccctttactctcacagatccaaggagcagcttttggagtggtcttcatttagactgtgagactaactaataatcctgcagttctggacgtacagctggggagtgtggctctggatgtcttctatctttcctttattttctgccaggagataataacagcaagtgggtgaagcactgggtaaaaggtggatattattattaccacaatctggagacccaggaaggaggatgggatgaacctccaaattttgtgcaaaattctatgcagctttctcgggaggagatccaggtaggttacctttcttcacgtaagaagaagctgagagaaagtgttttcaagctataatattaattaagaggaacagggcatgtggtcagaagccctagactaaaattgaggttatgtaatgagctgttttgcggtaatttttttgtagtagttgggggagtgactgaggcctgaatttgtaaaacatctgaattatagaattaagtgatataaaccatatgctaagaaaagttagatgatctataaaagaaaaatgaaaagttgctaactccattaaatgcaactattttaatctctcccagtttatattttcagtctctcttctaactgttccacaaattatattagctacaacctgcactttcaaataaagttagcattttcatagagcttttaaagtactttttcatcttctgtgtctttgtgtctttgcttatactgttccattcaacagtttttgtttgtttgtttgtttgttttttgttttttttttgaaacagagtctcactgtgtcacctaggctggagtgcagtggtgcattctcggctcactgcaacctccacctccctgggttcaagcgattcttctgcctcagcctcccgaatacctgggattacaggcatgcaccacacctggctaattttgtaattttagtagagacgaggttttgccctgttggccaggctggtcttgaactcctggcctcaagtggtccacccgcctcagcctcccaaagtactgggattacaggcgtgagccagcacacccagcccattcaacagttatttgttgaatacctcaaatgtagcaggtactcttctaaggaatggggatatagtcatgaaccaaacaaagtctctgctgtcatgagatgtctctcccctgccatctatatctgtcaaaattctttccttccctttgtactgattgttggtatcataaaagaaaaaaattcaggctgggcatggtggctcacacctgtaatcccagcactttgagaggctaaggcaaaaagactgcttgagcccaggagttcaagacaagcctgggcaacatggtgaaacctcatctctgcaaaaaatacaaaaattagctgggcatagtggtgtgtgtctgtgattccagctacttgggaggatgaggcagaaggatcacttgagcccgggaggtcaaggctgtaacgagccatgatcacagcagtgcactccagcctgggcaacagagcaagaccctgtctcaaaaaaaggaatatttaatttaaaaattcagtcctccaagcacacccatctcaagtcacctcctctatgaatctttttaaaatttcctttccttacccccttcatcttcctttgaagctcccaaagaacttggtattcattcagaatttaatgtacttggattcgaattttagtgacatttgtgcttgtctatgccccctagtagtttttaaggtgagctgctaagtttgcagtactttctcaaaggggaagttacattgtcattgatggactgttgaggacttttaagttttaacttggtgctgcactcctgttacttaaaccagagttgtttaatgaatgttaaaggggaggaatatatactgggggaagatgctcagtaagctcctgtaggtcgttagacatattactaacagacattcaggattcctagagaaaaacgacagtaaaagattttcaaaaggtcatttacttccctttggcaatatttcccaaatcgtgtgtggaacaagtcaaaaatacacctgtggaaaaactgaaatagtccctttatttaggagttaacatcagatgggtgatttctaccttgtggttaaagttctctttatatggtgggttacagtctcttacccttccagtgtttcatcttcattgctaatgatttcacaggtgatgaaatttaaattcattgaactctgttctgggcattgagaagacagaaatatgtatcagagagtctctaccttccattgtttcacagtgttgtgaaaacagcagacacaaaaccgagtactgtaatgtaaggcagagagaagtggtgctctaatcacagcacaataagggaagtcttaagggaatttttcattttgtcctggagtaacatagcgtagataatattttagcagctgaggaaaaaaagaaaaggctgttctagacagaaagggaaagttaaggatgagcttgctgaaattataaaaaggaagtaggagagaaaatagaaaaggaaaaagcacagagtactgaaaggacatggaccactgaaggagaggcgaatggtgtattacctggcacgtggtaggagtggcaggacaagaggcccaggttgaagcttgagggcctaatgtgctgtgctaaggaattcagggtacaacttctagcagagtgatttttaactcttgttagttcagggacacctttgagaatcttattaacctccacagaaacactcatgtttgaatagtgttttgcatatatggacctaagaatttaaacagggaagggatgctacctcattttcagcatgtgacctgacctcttacctctcctgccaacaatagtggcgatcacatatagatcctcccactctactcaccactctgtactttgaacttacttggattttcactgattccttcttcattttctctctggaggaaacagctatcctttctaaagctcattattgatcttactgcttgatttcatcctctcccagttccttgcagaccttgtactttttgtgctcttcctccagtgcttgtcaggatttaatgtctgtctgaatcacctgggatcttgttaaaatgaaggctctgattctagtgcgaggtctgagaaaatctgtttctgacaagctttcaggtgatgttgatgctgctggcccaaggactgtattttaagtagcagcctacatacttaagcatctttatttcccacatctttgaaaaaataataatacaaaatttttttaaagcccatggaatttccctgatctggcctcacctacattcatactcttgctaagggccttgaaagttagtctactcgtcactaattcactctctgttaccatccacttcttggctcacagcagtgtggtttcctgtccagcttttacttagtaaaactcttattttagaattcatcaataaccttttaattgccaaattcaattctgagcactcatcatatttgacttgtcaaaagtctcttcctcaaaccctcaattcctttggcttctgccatccaactctcttctaattttcctgcttctaaatgttccttcttaatctctcttgctaccttcctttctcgacctctgcttgaattatacaaagagtccattggctgccttctcctacacattcttcctgagtgatctctttcaagcctgtggctctagcccttacccttgtgcttgtgactcctaaatctgtacctccagacgttagcccttttccccaccaccaggtttttgcccttcattttgcagtccagaagtccagcagacacctcaaacacagtttaacaggaaaaaaccagaggctgcaatagtgtataaggttgtatttttatctcacatgaaatgattctgcagttcagcagtccagggaaaatgtggcttcatggtatcatctgtcccaggatccttcatctttgtgctctgtcattcttagcatgtggcttccattctcaaggtcaccttgtcacctataatgacagtttggagctttgaccatcaagttagcagtccaagcaggaagtaggaagaaggggaaggagagcaaaaaaggtgtactgtcagctgtctgtttctctcaaggagctttctcaaaggtcttgccatactactactgctcacagcgcatgacctcgctctacctcatgaagtcttttttttttttttgaagcggagtttcgctcttgttgcccaggctggaatgcaatggcgcgatcttggctcaccacagcttccgcctcccaggttcaagcgattctcctgcctcagcctccccagtagctgggattacaggcatgcgccaccacacctggctaatttttgtatttttagtagagatggggtttctccatgttggtcaggctggtctcgaactcctgacctcaggtgatccacccacctcagcctcccaaagtgctgggattacaggcgtgagccaccacgcctggccactcgtggagtcttttaagtgcatacagtgttgcccagaaaaaaaaaaaaatcgaggctctggtaccaaggagaaaggagaaggtagatgtggataagtaactagatgttcctaaccattcttactgctgctgcccttgttcaagcccaggccatctgtcacttggatcacaatagcagcattgtaattcacccacttggttgaagtctcttctcactctaatctgtcagctgctttcctaacagtattgtttttctaaaaataatctccaccctgggcaatataatgaggactcacctctacaaaaaatattttttaaaaaattaaaattagccaggtatggtggtacacttgtagccccagctactcaggaggtgaggtgggaggattgcttgagcccaggagtttgaggctgcagcgagctgagattgtaccactgcactccagcctggatgacagaatgaaaccttgtctctaaagtaaataataaacatctgattgttttattcctttgcttgacaaaatttcctggctgtccagtatctttagtaacagtccaaaccctctaggctacttttcaagaccatttgcaatctgcctggagaagcaattttcagtcctcacctctggtctctccccctgagatgtcctgcattgtgacattctaggggtccctcggtacgtggcacacagccctgttgggtacctgtcactctgttcttgtctacagtgaccccagatcagccagcacagtgcccagcctagtcagtgttggataggtagataagtgagatgacatatgaagtaaaagaagatcaagtttttgtttatgaagtgttttctaggtgggaggacgtgtgtgagaacaacctagtcctaaaaaacagacctgagggctttattcctgttatgtagctaatgatctagtatagacttaggaagcaggaggtgttagcttgtgtgctgtggatgatacttcgtgaaaacctgcatccattcttgcctgtgaatgtctttgaatgtgaccactgctttttcagagttctatctctggggtgactgccgcatataaccgagaacagctgtggctggccaatgaaggcctgatcaccaggctgcaggctcgctgccgtggatacttagttcgacaggaattccgatccaggatgaatttcctgaagaaacaaatccctgccatcacctgcattcaggtatttcagaacctatcacacagacagcaagcgggcatctagagcaggggtaataaacggtcagctgtcaccattgactgtctgagtgtgttttttgagtgctggactcttagtcttctctttcctttgacaggtacctcctctttactaccatttaactgtagtgtgcctacaggtgtttaatgctggcacagtggcagttcttgggtacctcttcctctcttcttctaagactgtacctttctgtaagatttgaaccttgagggaaacaactgtggtctggcttcaatgataaggtagcacaatgtcctggaaagaattctgagttaggaatgatggctgcactactgccagacagtggtgaatctccaagtctttgtccccatctgtaaaaggggaatgccccattgtatcttatcttcctcacctggtttgttgtaagaagccagtaaatgaatctgtatggctgcactgtaaaaggtgtgcagggctgtgctgacgttggggaagtagaatgtagccatcgtgttcttccagtggagggatggcccgtgcccttgttcccctgtcactgctggaagtggtccttcctaaaacttcatcatgaaattgcacttggatcatgtatcaagatgaaagtttttttttaacttccattgatgcttgggaagtaatatgtcttctgtaacatttgactgtttcagtcacagtggagaggatacaagcagaagaaggcatatcaagatcggttagcttacctgcgctcccacaaagatgaagttgtaaaggtatggtagcctgaacagggtttctccatgaggggcacaggtataacacgtgttgagatgaaggactcttctaatttccaggatcccttttccacagattcagtccctggcaaggatgcaccaagctcgaaagcgctatcgagatcgcctgcagtacttccgggaccatgtaagcacccttggatcatacaggccattaggagcaattttgccatatttttggtagacagatgaacagagaaatttcttcttttttgttccttagataaatgacattatcaaaatccaggcttttattcgggcaaacaaagctcgggatgactacaagactctcagtgagtaactggctccgcatgaagagttgaggcagtggctgggagccaccaagttcagggtattctccacagacctcttttgttatcctgaaggcaaggcttgggggagagggtgtgacctgtgacataagcccctttgctaacatgtggctaggtgtcttgttggcttgttgcattaacctttatcataacatagcaatagcctgacacagaagactgcacctgatagttgtcttagcacatctcaaaattaaatgtttatgaatagactactttttcaagacaatgctatttcctgagacgtagtactttttctgctaactccattctttgatgcatactttctgtcagtcaatgctgaggatcctcctatggttgtggtccgaaaatttgtccacctgctggaccaaagtgaccaggattttcaggaggagcttgaccttatgaagatgcgggaagaggttatcaccctcattcgttctaaccagcagctggagaatgacctcaatctcatggatatcaaaattggactgctagtgaaaaataagattacgttgcaggtatggcccagtgccagcgggggccttggaacggttcatcctgctttgtaacccctgcattcccctttctgactggtggggagggtggaggctgactttctcctcagctactgccataagagctttttttttttcttttgactgagtctcactctgttgcccaggttgtagtgcgatgtgatctcagctcactgcaacctctgcctcccaggttcaagcaattctcctccctcaacctcctaagtatctgggattacaggcacgtgacactatacctggctaatgttttttgatttttggctttttttttttttttttttttgctgacggagtttccctctcgtcgctcaggctggagtgcagtggcgtgatctcggctcactgcaacctctgcctcgcaggttcagcgattctcctgcctcagcctcccaagtagctgggattacaggcgcatgccactacaccctggtaatttttgtatttttactggagatggcgtttcgccatgttgaccaggctggtcttgaagtcctgacctcgggtgatccacccgcctcagcctcccaaagtgctgggattacaggcgtgagccacgacacccggcttttttgcatttttagtagagacgggggtttcaccatgttggccaggctggtctggaactcctggcctcaagtgattgatccactcaccttggcttcccaaagtgctgggattacaaacatgagccaccatgcccggccatcataagcttttaaaaaagttatgtaagacaggtcaggcatgatggctcacacctataatcccagcactttgggaggccgagaagggcggatcacttgaagccaggagtttgagaccagccaggccaacatggtgaaaccctgtctctactaaaaattaaaaaaaattagctggacatggtagtacatgcctgtaatttcagctactcaggaggctgaggtggaagaatcgcttgaacctgggaggcagaggttgcagtgagccaagattgcatgactgcactccggactgggtgacagagtgaaactctatctccaaaaaaaaaaaaaaaaaaaaaattatttaagacataaaacaacttaattgacaaaattttgatagagaaaagaagataaatgtcttcccctaatttcacctaccccagtcattttgtatcttacattcttacttcatattaaaggataagactctttccctatgataagtagtcataatttttttttaattttattttttgaaacagagtttccctctgtaccccaggctggagtgcagtggcatgatcatgactcactgcaacctcgacctcctaggctcaagtgattctcccacttcagcctctcaagtagctaggacgacaggtgcatgccaccacgtctggcaaattatatttttataagagatagggtatctttgtattgcccaggctggtctcaaaactcctgggctcaggtgatcctcctgcctcagcctcccaaagtgctgggattacaggtgtgagccgctgcacccagccataaatattatttttaacagtagcatattagatttttagaagatatactatgatttacctctttttcccctagtatttgacatttaggttgttttccaagcgtttattataaataacattgcaattaatgtttcaatatatatgtagcttttattgtatttaagacttatttttataatagactgctggaagttggtttgccaattcagtggacattcttatggctcagattctttgttggaacataggaatggatttgactggtgtactgaaaacaggataaagtgtagtggtttttaaatattcagtgggaatctgccagtgcagtacaccttcatgtgagtttgcacatgctgcaaaacctttcctcaatgcccagaggttcatctttgaaagctttctgatctatttattggtttttgtttataggatgtggtttcccacagtaaaaaacttaccaaaaaaaataaggaacagttgtctgatatgatgatgataaataaacagaagggaggtctcaaggctttgagcaaggagaagagagagaagttggaagcttaccagcacctgttttatttattgcaagtaagtggctcctggaatcagtgttataaaaatttagtgaatttatttttccacaagaaagccttaccatcgatctctctggaagtatttttgacttccactgaggggtgagtgaggggcactgtaacatgttaatttattaatcttttttctcatatgtattgtagtccttcaattttaaataattgaatatatcttgccagcctttatattacctacaaatgacttatcccttggttttatttcagaccaatcccacctatctggccaagctcatttttcagatgccccagaacaagtccaccaagttcatggactctgtaatcttcacactctacaactacgcgtccaaccagcgagaggagtacctgctcctgcggctctttaagacagcactccaagaggaaatcaagtatgaacagatttcctcagggcacaggccccttcccactatcagaggggctcccagtttgagattcatgccttcctgatcttttcttgatctcaattaatttatgaaaaatacttactctaaagaagcatctaatttttaaataactgatataaaatcttgctgcttctagggaagggataaattaactttaggaacattctgtattaaggtataatttcaaaaagtaatctgaacagaaagaattcacatttttatctagtagcggacccaatcatgaccacgattgagcgtgcagctgcaggaacattctgtgagtgctggggaatgtttcgagagaaactgtttcagggagataggatctttaagcaggaaggatcttttaagttgatgggttttgtgacaagtttaaatttttatctgatgttttataggtcgaaggtagatcagattcaagagattgtgacaggaaatcctacggttattaaaatggttgtaagtttcaaccgtggtgcccgtggccagaatgccctgagacagatcttggccccagtcgtgaaggaaattatggatgacaaatctctcaacatcaaaactgaccctgtggatatttacaaatcttgggttaatcagatggagtctcagacaggagaggcaaggtatgttaaccataatgacacttttctttcatgttgttatagtctttccctcttttttcccctctctttatttataaactaatattagttcaaatagtttttcttttcttttctttttttagacagagtttcactcttgtcgtccaggctggagtacagtggcataatctcagctcactgcagcctccacctcccaggtctaagcaattctcatgccccagcctcccgagtagctgggattacagttgcacgctaccacacctgtctgatttttgtatttttagtaagactgggtttcaccatgttggccagactggtctcgaactcctgacctcaggcaatccatctgcctcggcctcccaaagtgctgtgattacagctgtgagccaccacacccagcctcaaatagtttttctttagaaaactgtgctttctaagttgttgacctagtaataaattcacttatttagcaaatatttattgagtattaactatgtgccaggcattgtgttagagatgtgtacagtaatgcaataatgagtgaaacagacatgcttcctgccctctcttcatagttcattgggtggaagagacaccaaccaggtacataaaaataaaagcataattaaacattgaagaaagttttatgaagttttatgtacggttctttaatggagactttataagagggagctaacataaggtggttagggaaagcctatcccggaagataaaatttcatttagctgaggccctaaagctaagatgaacccagccttactaagagctaggtgcagagtgtttatgtctgaacactctaagctggagggtgtaggacttaaatggaccctggcataactagggatacagttgaatgagaaggttcatatagattgggtgagatcactgtgtttcattaaaggaaaaagaaaacggtgtggagtgagcttccctgaaatatcgtgagttgggctaattaaattaacgtattacaggagatagctgagctagggccatagcgtaaccaccaacattcatttatctaaagcaaaagtgtgccaatcaaatattggtaatgctgggaaaagggagttcagaatgccaaaacgtttctggttttatttgtcttgggtgaggacccagaggggtgggagatggaggtgtgagcagcatggtctgttgtggttttttcttgttgtggagtagagttagatcatgcatgaagctctctgggcataggtggagtagcagctgtccacaccattgctattcaaagtgtggtttgcacaccagtaatggaaaatcatctgtgcacactgtttagtttaactgatactttttttttcatagcaagattttcttaatgaaggaagtaatgtattgatttacattctgactcattgtctttatcttgtctttgatcagtttgtagactggcactggtccacactttgaataacactattcttcattctactttccatgtacccggatgccaggcaaacagggagttttacgctgggtggagaacggaacattctgctgactccttgaaagggcttatctcaccagccatggtagctcacgactgtaatcccagctctttgggaggctgaggtgggaggattgcttgagctcaggagtttgagaccagcctgggtaacatagggataccttgtccctacttaaaaaaaaaaaaaaaaaaaattagctgggtgtggttgtgcacacctgtagttccagctattccagaggctgaggcaggaggataggttgagcatgggaggttgaggctgcagtgtgccttgatggcgccactgcactccatcctggttgacaaaaaaagaaagaaggggcgtttccttattaggaatcatttggcatctgattggttctcagtaccatgtaggtctgttatcaggactcagatcattgcaaaagtctttttaatttttttgcctgcatacctgaggcccacatccaggaatgtggtcagccaagtgcaatacttgtctgggaagttttgcctgcaacccagggcattccttgccgatagccccatgtacactggctccgggcttctcagttatttcctctgatggtccatgagtcagtcattttcagatccaaagcccgctggacatttcaggattggttttcttgtgggtacctataagaaactggtgtcttattttgcctttcataaaatggaaattgagccaggcatggtggcatgcaccagtagtcccagttgctcaggaggccaagacaggaagatcgcttgagcccaggagtttgagcactgcctgggcaatgtagaccccatatcttaaaaaaaaaaaaaaaaaaaaaggaaattgatttgaactctttttaagataccagtgactgtgagggatggtggtgtggtggggatctgtcctgcaggtaagcatcacaggtcccttagctttcttcttttacttcagccaccatacacgtagcaaactggaatcttgtcacctcttgggaatgttctttcctaaaatctcaaagttaatgttctgttctatcaccaacgttttttagcatattgattcccttgctggttactacttttaaaactcatataaataataaaatatacaatattctttattgttaagttccatgtatttatttatttctcatagaatgtttctgttgatttttgcagaatttttgtgttcatagtctaccaattttaatttagccatgctatgacaaatgaagaggggtatccctatctacttgtatttttctttttgttgttgtggttgagacagagtctcgttctgttggtcaggctggagtgcaatggtgtaatctcagctcactgcaacctctgcctccctggttcaagcgattctgctgcctcagcctcccgaatagctgggattacaggcatgcgccacacgcctggctaatttttgtatttatagtaaagatggggtttctccatgttggccaggctggtctcaaactcctgacctcaggtgatccacccgcctcggcctcccaaagtgctaggatgacaggcgtgagccaccacacccggcctctacttgtattttctaaggctgccataacaaatcacctcaaattgggtggcttaaaacaaccgaaagtcatggtctcacaattgtggaggccagaaatttgaaaccattatcatgaagtcgaggtgctggaagagccacgctccctgcagaggctctagtggaaactctgtttcttgactcttagagcttgtggtgactgttgacatccctcaacttgtggctgtgtggttccagcctctgcctttgtggtcacattgccttctcttccccttctgtgtgtaccaaagctctctctgcctcttttttttttttttttttttttttttaagacaaggtcttgctcaagcagtcctcccacctcagccttcctagtagctgggaatgctagcatgtgctgctgtgcctggcatagcactcctatccttgaagacctccttctggtttctaacaaagtccagatttgtcagtatcatatacggggtctgtcatggcctgctccctgtctgcttttccactgtcatttctcctgtctccccttccttcctagaagactcttcctctccttttttcctgagttcaagcatcccttcgttttggaagctttccttgctttttccattctgagttgaagccctttccctatggtcctgtggcacttttggtgaactgatttacagcacaataggtttataatcatctgtttgtgtgtcgctcccaccagactgtaaaagactgaagagaaggtgtcatgtcttgtataacttttattcccaagtgcctgttattgtgcctggcacacaattcaggcacctgattcacagttaaaaacctgcgttcagattctagacttatcacttaccagccccgtgaggatgagcttaagctatctaatatttctgggtcttatagtttatgaaagataagacacttgcttcaggctgttcctggctgttagtctaacatagttgggtataatttctgtcttcccagcaaactgccctatgatgtgacccctgagcaggcgctagctcatgaagaagtgaagacacggctagacagctccatcaggaacatgcgggctgtgacagacaagtttctctcagccattgtcagctctgtggacaaaatcccgtgagtgccatcagttgtcatgacccccagtagaacccagcactaagtgcctttctgctccttggcccttctcactaagttttgtccatcccgcagttatgggatgcgcttcattgccaaagtgctgaaggactcgttgcatgagaagttccctgatgctggtgaggatgagctgctgaaggtaagaatctcatagccggcagactcctgccctttgaggacaaagcaataaaaccagggctgaccatagatcattactaactgcctaagtgtaggttctggcagtagcttaccattgattgtgagcttttgaaagcaattgtaattggtaaatggtacctctcttaggatgaaacacttcctatagtttggcacacaaacatcaaacaagtagaaagatggatttttcctgttttcagatgagtttctttgagtcctatcttttcgctgtagtattgttccctctgctggtgacctggcgaatagtagcaggcacagttgtttctgctaaggctgttgctgataactctttcttactcagctatgctcttctcttttctttttttttttaatctgaatgcttttttcttctctctcctagttctgtgctttcctacagtgaggcctcgattctagactttctgttcaggtgaattaattttatttcttctgaatgaaactctaggggaaatgctgtgactgcccctgaattcttctgtggaagagatgtgtgttaagtgaatttaatttcagaggcatgaacttggcctttgaagtctgcagcatgagaatgttgggaggtggggttactctatgctgattgggtcatgttaaggaatttagctatgtttgttagctttttataaggaaagcccatctacatgaaagtacaaagtgcatgtgggtgacagcagccttatttgctaccatgatatgtgaacaaaagatgccctgaaatacttaataacagactttaagtgtgtcatttttaccttctgaatctgctctttcattaactactggcagtagttttcagttctgttctcattgttttcctgtattgaacaaagggatatttcatttagttccaggccatgagagagagtgtgtatatgtgcatgcatgcgtgtgtatatgtattttttatttattttttcctcataggactgcattttctgcttttctttgctagcaaagtcatttatagcttccttggtggtatgtcttttaatacccatctttctgtttcgtctgttccagattattggtaacttgctttattatcgatacatgaatccagccattgttgctcctgatgcctttgacatcattgacctgtcagcaggaggccagcttaccacagaccaacgccgaaatctgggctccattgcaaaaatgcttcagcatgctgcttccaataagatgtttctgggagataatgcccacttaagcatcattaatgaatatctttcccagtcctaccagaaattcaggtaaggggaaaggcacaagtgcttaagagagtctgtggatgtatttttattgttgaggggaaaaataagattaaaaaccacctctcactttccccggactgccatatgtagaagacgtgtttgatgtgcccaggattccagaagatgatccatttactttgaagagaattttcatatgaaatagatagtagttaacacttatgaaatagatagtagttaacataaaaataatgatgattatgcatttagtacatgttaccttgtaatcagagaagaattggagaatgcttttaatttttgtaaattaacatctagttttgaattcagtgcttcagagcactgtcttagagatagaattggttctcctaatggtgtctggaaacttttaagtcatggtgcaatggttcttatgggtaaaactaaaactacaaactaggtggagaaagaagttattcgaaccactatcccaaggttgtcaagcacagcaaacacacagcactttctcttgaagtaactgttgactggcttctgtttgcactcattgtgtgagaggtttgtgaaatgtcctcttgccaacttcatgtgtatgtccctttttggggggctgcctcctgtgcttatttcagacggtttttccaaactgcttgtgatgtcccagagcttcaggataaatttaatgtggatgagtactctgatttagtaaccctcaccaaaccagtaatctacatttccattggtgaaatcatcaacacccacactgtaagtatttttctttaattacttaatttcattgtccttaattattatccctggctgctgcttatcatctctggtagccaggtgtctaaccttcctgtaatctaactgacaatgcatctccttgatgtctctttttttgcttgttattcttttttgtttatttatttattttttgagacagagtctcactgtgttgcccaggctggagtgcagtggcgcgatctcggctcactgcaagctccacctcctgggttcacaccattctcctgcctcagcctcccgagtagctgggactacaggcacccgccaccgtgcctggctaaattttttgaatttttggtagagacggggtttcactgtgttagccagcatggtgtcgatatcctgacctcatgatctgcccacctcggcccccaaaagtgctgggattacaggcgtgagccaccacgcctggccttttgcttgttattcttaacagtatctactgctaagtttctaaaaggtcttcccaggccacctgcatcagaatcctatgggctgatagttaaaaatgaagtttcctggacaccgccccaggcctactgaatcaaaatcccactaaatttatctattgccttaataaaatagtgcttttactcttctttctttttaccctagctctctgcgttatttttctaacatgatctagaatactagctttctctgtgtagccttggagtggatttttcccttggaagctggagctccatgtttcttcagatttttcaaatcattttttcccctctggggacatggacatgtaaaacaggaacaagggcatatgttaaaatgtaaatgaaatttcaggttactgtcatttctgagggcatcactggggataatggcaccttgaagactttgttgagtgcccctacaataattataacattgatttggtatacttttctctgaattaaatcatgtcatacactggaaacattaagtaaaagcgtgcacgtgacttatttgaactggcagtagggtacattgatgactttgggtattgaactttgagtttcagtgttttgtgggttttttgtgtttgtttgttttgttttgtttttttgagatggagtcttgctctgtcactcaggctggagtgcaatggcgcaatcttggctcactgcaacctccacctactgggttcaagcaattcttctgcatcagcctccctagtagctgggattacaggcacacaccagcacgcccagctaatttttgtatttttagtagagacagggtttcatcatgttgtccaggctggtcttgaacgcctgacctcaggtgatccacccgccttggcttcccaaaatgctagaattacagacgtgagccactgcacccagccagtgttctttctcaaacagggcacatttgaatcctttatggccatgaggttaagagaataccagtatttcctcttcttatatcataacataagtcattcaacagagcctggtgtggtgccttatatatcatattgtttatttgggttagtttgctgaggatttgcttgttgtttctttgaatataggaactttgttggaacctctttgtgcagatcattgttagacattctagggagggacgggctgaagagttgaatgtataaatggagttgatcattggtgtttgcagctcctgttggatcaccaggatgccattgctccggagcacaatgatccaatccacgaactgctggacgacctcggcgaggtgcccaccatcgagtccctgataggtagagttctaacttttgcctggaagatcaaaagggaatgtgacagaaaagtgttgtaattgtcacctcctctattttttgcactataccaaactctggatatacattgagaaataaaatagatgtgatcctgatagtttcataagagagaaaacaacaacaacaacaaaagcccagatgtgatcaatatctataaggaactggagtcagaggaaaagatcattttaaacgcagatacatactgccagcttgtgtttttttaaaaaaattgcagatacataaattaaaagtcctctaaaggaaagaatttttttgtttgtttgttatgagacagggtctccctctgttgcccaggctgaagtacagtggtgcagtcatagctcactgcagcctcaaattcctaggctcaagtgatcctcctgagttgtttttttttttttttaatagagatggagtctcactatgttgcccaggctggtctcgaactcctggcctcaagccatcctcctcctttagccttccaaagtgctgggattgcaggactgagccactgcacccagccagaaagaatgttttcagagagaattgtgatattgtagtgttgaaatgatttctcaaacatttatggagttattatggatcccttgcctttatcatttggcataacattttatttctcagtaaaagttgttctcgtcacactgtatgtgttaggtgattcaagtattatcttagacttgcatcatcttatatttgtattatttccccccaatatctcctctctttattacgctgactctttccaccctcccaaaacttcaggggaaagctctggcaatttaaatgacccaaataaggaggcactggctaagacggaagtgtctctcaccctgaccaacaagttcgacgtgcctggagatgagaatgcagaaatggatgctcgaaccatcttactgaagtgagtatcaaaagaaggaagaatgaaatgaatgtaatctgaaggtttcttggcctttggagaggaacctgctgggtcctacctgaaatgaccatcctgacctctcgtacttgtcataatcccagtcaccaatcacctcgcatattgtacttggtacaggacttatctgccttattttgctaatatgctacagtgaaatgtaaatcttggaaatcctaaccctcgtacctacttatggaatggctgggtaaataagccttgtgccttgagtactgtgtactggcagctgccgcttgggacttctgtgaggtactgtttgtgctgctgctgctgctgctgcttcggtccacttgagaggaactagaacactggtaatatttaaatgcctcccccatctcgtttcagtacaaaacgtttaattgtggatgtcatccggttccagccaggagagaccttgactgaaatcctagaaacaccagccaccagtgaacaggtaaaatttagggtctaacatactcctttgtttggtagataagctctcccgataggcgcatgtcagagaaaggaggggagacacaaataacagttggtagcctaggggtgagcatgaatgtaactgggggacagtggtagttatggctcgtctgagaaagtttttgcttcctgagtccaggtgatgtcctttggacaggaagctcactggcacttgcatgcagaatcattgtgcccatcccgtatatccatcccttggtatccacaggcgattctttccagcacccattctccccacccccggccaataccaaaatccatagatgttgaagtcccttatataaaatggtgtagtatttggccgggcatggtggctcatgcctgtaatcccagcactttgggaggctgaggtgggtagttcacgaggtcaggagattgtgaccatcctggctaacacgtgaaaccccgtctctactaaaaatacaaaaaattagccaggctaggtggtagatgcctgtagtcccagctacttgggaggctgaggcaggagaatggcatgtacccaggaggcggagcctgcattgagccaagatcgcaccactgcactccagcctgggcgacagagcgagactccgtctcaaaaaataataataaataaataaataaataaataaataaataaaatgttgtagtatttgcatatacttacgttctcccatatactttaaatcatctctagactacttataatacctactacaatataaatgctgtgtaaatagttgttactgtatttttaaaatttgtattattttgtattgttgtatttttttttcaaacagtttcagggttggttgaaaccatgaatgtgtagggttcactgcaatttattgaatattatatattttgaattctgttacatgccttggtagatagaagaaaagtacagaatgtggctcctaaactcagtgaacccatggtcttgttggggaaatgtgacatatatacctgaaacagtgatgaactgtttcaaaattaactatgttactgactgaaaaataagagaagtttcaggaaagaggccagtgaagcagtgcattaggaagcttcctaaaagaagtggaaccggagccagatgtataaaggtggaaaggatttgggtgtgcatgtaagacaagagagggcattcgaggcaggagagcgatgtgaacaaaggtacaaaggagggaagagcatgatgcgactagactacatgtctagaatggagctgtgggtggaggtgagtagtgagaaataaaacatgagaccaaattatttagaactcacaaactagatgggaatttgtcactgcagagataaggaataaagagcctctgtaaggttgaagaccatttaataaaagttaattaattcagcagtgctattagagcagatgtagttgagtcatataggtgtgtgataaggtccagtggggtgggcagatggttgggtcctggcattttgtagggttggatgagtcatgtcatatctaagacccttgtttcttttttttttttttttttaatttgagacagagtctcactctcactcaggctggactgcagtggcgtgatcttggctcactgcaacctccgcctcctgggttcaagcgattctcctgcctcagcctcccgagtagctggactacaggtgtgaaccaccacacctggctaatttttgtatttttagtagagacaggatttcacgatgttggccaggctggtctcaaactcttgacctcaaatgacccacccactgtggcctctcaaagtgctgggattacaggtgtgagccactgcacccggccatagacctctgttctcatttgtcaagtaaggaaagtaggtcaagtcattcattctcaaattttaagcatggtaatctgtttcattaaatgacaacttagctaaaagcccagtatatagagcaggtactctgctactctggagctactctgatagccagcaatagggcatctgaaatccagccctataggactctgtgatgcctctggcaaactcttgaggctgcacagagaactatttggaaaccattgttttcaatgaagtctcagctgtcagttgctatgactgattactgattagatatgtgtgaaaggcaagtaaggacatgtaaaccaatacttgaaacatgttgaacctagaaagaaatttgaaataaggaaggaggagccagtctttattgagaacctagtatgtgtttggtgctctcacctctgttctttaatttaatccttacaatattcccatgagtcgagtcttttcatccttattttgcagatgaggaaaccaagacccttacaggttaactggctaagatcatcagcttgcagtgacagaaccggaggtggatccagttctgtctgcctccaaagcttatgctgtttacattatgtgatgcagagtagtcttgacattagaaaaaaggggactattgggaaagggaattgctccagttagggggaattacaagtttgaactatgagccatcccgaatgtaaacatcccagtacaaacagctcagaatatggcaccagagccatggtcacaaagatttaggatctgtcaacacagaggcagtcaatgaagtattgagagtaaacagagagaaatggtcacagatcacatagaagtaccaaaccatgcatagagcaagaagacagtgcagagaagatgagcaaggtgacagaaaaggctttggattttggacaggggaatggtaattggtgataagagcagtaaagaagaaagtgctgaaagaacgaaacagtgagtgtagatcatatgttggacagggacagacaatggacggtgactatgaaggatggcgactatgaaggatggcagtatcaagggaaggtgtttccctgttagattgtggtgtctgcagaatgtttgaaagcagaggcaaggctcgagcatgattccaccttgtgacaaagtgacacaaagaattagcaaggatttactaagcactggtcttgttgtattagtatagttataacatttatacagctatgtttttaataaaattaaatggcttccatgtctcaaaatgtggtagagaaaaatgactttgtagccagtagagtccagtctcggtgattgtacctggagtccaggaaagaagccctaagcacctaagcagttgtgtgatttgtttgtttgcttgttttttgtttttttgagacggagtctcgctctgtcgcccagactggagtgcagtggcgcgatcttggctcactgcaagctccacctcctgggttcacgccattctcctgcctcagcctcctgagtagctgggactacaggcactcgccccatgctcggctaattttgtttttgtacttttagtagagacggtttcaccgtgttagtcaggatggtcttgaactcctgacctcatgatccgcctaccttggcctcccaaagtgctgggattacaggcatgagccaccgcgcctagcccagttgtgtgattttgtagatatcatctcttctaggtggaaagagatgtgcctctgcttcatgcaatttttcatctatcatttggcagggggcagaatttgtttccttctgtttcaaggttggagtttaagaactgtataagttcaggtgcaaatgtgctatataaattcaagtttaggattagtgtggtaaacttgctaagaacttctttttcccatccgtaggaagcagaacatcagagagccatgcagagacgtgctatccgtgatgccaaaacacctgacaagatgaaaaagtcaaaatctgtaaaggaagacagcaacctcactcttcaagagaagaaagagaagatccagacaggtttaaagaagctaacagagcttggaaccgtggacccaaagaacaaataccaggaactgatcaacgacattgccagggtactgcattcgggggacagaggggacccggccttgttcaaagctgagaggctcgagagacagtagctgttcacataacagcatagcttcagttcatgggcaaattagtgccctcctctatgagaaaccatatctgactctccagcatgagggccttgcccgacctgaggtggcttattccatggcctaaattactagggagaggaccttaactggagcctcctatgaccttaaagaatttgtcttcagccttaaagaattcttccagatctttttcatgattactgtgaaatataaattcacatcaagctgattaaatcgttgatttgtatgaatcatctcaagcgaggggctttggtgaggactaagagtttaggtgttctgtgctgttgcactaagataatattatgcacacctgagaactggtagttgatgtattatagttctctttttctccctttcccaacaaaatatttaagaggtccaaaccagctttgcaagtaaattctaaaaatgtgtaagtctaaatgtaacacatttccctgctagaagatacaaatgggggaagaaaatttgagatctgaatttctctgttaatttgtgaaaacaaattactgcctgttgaatgtatggttaggtcaggcaccgtggctcacatctggaatctcagcactttctgagaccaaggcaggaggatcgcttgagaccccatctctacaaaaaaaagttttttaattagccagatgtggtggcatgtgcctgtaagtcctggctactctggaggctgaggtgggaggatcattttagcctgggaggctgaggctacaggaagccgtcaaccactgcacactcgagcctgggcaacagagtgtctaaaaaaaaaaaaaaaaaaaaaagtaggtagtcatatttaaggcagagttaagcattgctgggttgtagtgtgaaatgataatgataactgtcgttatttttctaactttaataattatgtctcaggatattcggaatcagcggaggtaccgacagaggagaaaggccgaactagtgaaactgcaacagacatacgctgctctgaactctaaggccaccttttatggggagcaggtggattactataaaagctatatcaaaacctgcttggataacttagccagcaagggcaagtgagtattttttctttttaaagaatcaatgtcagaattagagtgaggaaaaagcagaggcaactgaaatgacactggaaatttttacttaaaatacactggatctatttattgcattagtcttttattttacctctaatcatttgtgtaattgcctaattccatttgtaagtgtatgatgtgaatagtgggtgggggatttcatggatgcttatcgctaagtattccttttgcaaaatatcttcttggggcctgtcaaggtggctcacacctatcatcccagcactttgggaggccgaggcgggtgtgtcacttgatgtcaggagttcaagaccagcctggtcaacatggtgataccccatctctactaaaaatatacaaattagctgggtgtggtggcacgcacctatagtcccagctacttgggaggctgaggcaggagaattacctgaacctgggagatggaggttgcagtgagccacgattgcatcactacactccagcctgggcgacagaacaagactctggaaaaaaaaaaaaatcttcttggccttagaaattaaaatcatgaaaggagatcatctgctggtcccagaatcacttaaggaatattatacaaatttgggtccccttgctcctctctatacttcctggggacaagatcacaggctctgattttttttcctgggtgctgaggaaagtctgatccagccttcttggcactggccacaaactatcagcatgcccatgttacagggagggaattgaaaacccagagaggtgggtgataagagcaggttttacttgcagggtagtttattatttattcctaactttttattttaagagttttcaaatctcagatcgaatgaatagaacaataagcacccatgtgcccttcacctagattcacccatttttaatattttgccatatctgcttcccatttccctggctcttgcatgtcctctgtttctctctttccatggaagactctctggggtcaggcatgggtgatggaagggatgaaaaacaggcccacctaaccctgcttgcagatctgactcctgtgagcttttgatgtgttttcattgttccttgtgcacttcctgactttctgacacaagatgtttcatgttcaacctgtagtttcccctccccagggccagaatgaactgtttctccaagcatgcctggtttctttgaatgaagaatggtatttagaaaccaagatctagaactaggtgtgttcactgccagatttgtcatggcctccaggccttctaagcagacagacctagattctcatttttttttaatgctgcatattattccattatgcagatagatataacagttgacttcagcagttctccattgatggacatttaagttgtttccagttgtttgttattattttttaaattctgcagcaaataacctcttgtacatatgtcattttgcaaatgtgggcatatttctgaagttagcacttcttgccttgattatcctaatagcctcctaacctgtttctttttccttattttcattcatctgtaattgctgtgctggcttaaacgcttttaaaaagtatttgatgacattttaattttttccctacacagctgaggggcgtagagtaactccttcactcctgggattcagtaccattccctcagctggcatacgaagctctcctagttacttgttaggtacttaagttcccagaaggacatgggaggattaagacactgttaaattcatgggagtgttctcaaatataatttaaactaaaaatagaagcaatttagtaatatttcccctgttttgcagagatattgcttaggctaattctaacatttgtttgccattttagagttggtatgttacttatgcttatgtctggaagtttggtttctgacatgtttccttcagttaccaatgatgaagattcagagtagatggttacttatagaaagtgacatgatgtgatttttacagagtctccaaaaagcctagggaaatgaaaggaaagaaaagcaaaaagatttctctgaaatatacagcagcaagactacatgaaaaaggagttcttctggaaattgaggacctgcaagtgaatcagtgagtctttgctttttgttttataagttgatttttatttctacatttatcacatctttgcctttttgtcttcatttctcttttctggatggttacttttagtattttttatgtatttatatatttttatgtgtagaattaggcctcatactcagagttaatttgtcataaaagagtttttcttttccttgtttgtagaacatttgtctcaggtcatgttcacttatttgggtctgatcttaatttttcctcattaaagcaggaagccattccttggatttcttctgtttctgaaccaagaataaattaagagtaacaataagaggagtttgctttattccacttatagctaggaaccaggcacttatcttcatttgcttttctgggaagtatcagcttgctttgcacgtggttcatggacctgacatgtcatcctcccacaggtcctgggcccagcgtcattagcaagcatttattgagcatctgctcagtcagccctgtgacctcaggctactgatctttctcttcttttgtctgtttagggggggaaaaaaaacaacttttaaaaaaagaaccttttacatttttctaattctaaaataatatgtattcgttattaaactttgaaaatacagtaaagcataaaaaagaaaacacctgtaattccacaagccagagataaccactgaaatcgttttaatgtatttttttctattcacataaagattatacacgactcacccacttatgtatttaactactttatatataaatacatatatatatatttttttcttcttcttctttttcttcttcttttttttttttcacggagtctctctgtcacccaagagtacagtggcgcgatctcagctcactgcagccttggcctcccaggttcaagcaattctcccacctcagcctcccaattaggtgggactacaggcatgcaccaccacacccagctaagtttttgtatttttagtagagatggggtttcaccatgttggccaggctaatctcaaactcctgacctcatgtgattcacccacctcagcctcctttgggattacaggcctttattattatgttattattattattattattattatttattattataggtcattatcttccactactgttcaagtgcctacctctatttgcctttctgtcttctttttaatttgctcctatgggcttagaaactaaatagccaactaaatctggtaaaattatttatcacttaagataaatatgtttaaggaataacccgtgaggcgttccagttgaataagatgcatgtgtgtttcagtgcatgggtttttgtgacttctttaactctcagtgacctttttgcatctttcatggttctcagccctgttcgtaataggtaaggcagctccatagttgagttctggaaatctggggtgctatactttgatcatccagagaacagcataatccctttttttttttttttttttttttttttttgagacggagtctcgccctatcaccagactggactgcagtggtgatagggtatggtactcagctcactacaacctctgcctcccgggttcaatcaattctcctgcctcagccttctgagtagctgggactgcaggtgcatgccactatgcccagctaatttttgtatttttaatagagatagggtttcaccatgttggccaggatggcctcgatctgacctcgtgatccgcccgcctcggtctcccaaagtgctgggattacagatgtgagccactgtgcccggctgcataataccttttccttttggccccccaaaatttcctggcacgtaacatattgtgaatgagtgataacttaaatacgttcaataataacaatttatctttggtaatactgagtgtgcttatatacacagcacctactctttctagaaaacctcctcccttggtgctttttatacggacccccttttgtttatttacttctcccagtcctcaaacatgcatgtattcaaacacatacaccctctccttccccagtgtcctccgttttctccttttatcattaggtttcctttttggccatgtggaagtgaagagaattcctatgatgtcatcccttcacacgccacttgtggaactcctcagtggttcctctttgataggatgtaagtgctgcaggcagagagaggttgccattcctctctccaagtcccagagcagatggtacttgggcttggcaatctgtgctgcttcagctgcagaagtacttttgacctgtattttctgcagcccttttcactcttgaagacttggttcatctcctttccccatttcacagaatatttttatatgagaatataaaaaccatacccttacgatgttatctttcaacaggtttaaaaatgttatatttgaaatcagtccaacagaagaagttggagacttcgaagtgaaagccaaattcatgggagttcaaatggagacttttatgttacattatcaggtgggtatgcaccagcaggaaccaaaaactttctggatgagattcttgtccaagtaggagaaatagataaagaggagactcatctgaggaaagctgtctacattcagcagtgagctaggctccacactgcggggaaagaagctgagggtttctgcatgtctggtttggtgtgtgcgctctggagagcttttgcagatgtcactcttcagaaaacatttagctgaagcttccacttagtgctgccactaaatcgagctgacaccttggacttgaacaaaatgcagaagtacacatgctgacactgcagaattctaagcccactcagtagcttgaaatctttttgtcattttgatttgatataggtacttaaaagttagatacattctgacaaggtgtgtgtaaagtttatgtttgtaaactgaattctatcttaaatccaaaaagaactcgggagtaattcatttttgtagcataaagatccctaagttttattttgaaatatctgatttttacacgttaaaaaataacagggcatcgagaggattcctaggtgacatccagactcctttagctttgtgtgtgtggcaccggttagtctgcttctctctcctttcttgcactgcttcacacagccatgccctgccagcccgggcaggtgccttcctgtcaatgtacatttgggcttctgctcatgctgccctccctcccctcccctgcctcccaaccccgccccttttgttcctccatggagtacttccatgggtgtgcctcccccagccaagccataataggtggtttccccttcgcttctgtagcccttgcagacatcctctgtttacagtaggtgttgacttacttcccctctccccgctaaagccataaactccttaaggacaggtagcatttcttagtcatcttcgtttccttctcaatgaccagtagaccattaaaacatgttagctaaacaaatgtgaaatgattttgtgatgcacacagctaactaaagtacttccaccaaaaaaaaaaaagaataggaacctcttattccctcagtttcaccaaattatttttttaatttaaaattttttatttacgtggagttatcagaacatatttttatttttaaattttttaaccaaatcatgttaggccaaccagtctgcctgtggtaatttattaatttatgtacaaattcattaaatgtggggtaactgccaggtgtggggtattctgttaggcacaggtcccagcagccctcatggagctgctaggatttttccaacagataattgaacttgtggggtcctttctttttttggaggtgggggcagagtctcgccctgtctcccagactggagtgtagtggcgtgttctccattcactgcaacctccacctcgtgggttcaagtgattctcctgcctcagcctcctgagtggctgggattacaggcgcacaccatcacgcccggctaatttttttttttttttgagaccgtttggctcttattgcccaagctgcagtgcaatggcacaatctcggctcactgcaacctccgcctcctgggttcaagtgattctcctgcctcagcctcctgagtagctgagaatataggcgtgcaccaccacgccccaacgcccagctaatttttgtatttttagtagaaacagggtttcgccatgttggccaggctggtctctaactcgtgacttcgtgatccgcctgcctcggcctcccaaagtgctgggatgacaggcgtgagccaccacacccggccttgtggggtcctttcaagacttttgacccttgctttctcatcaccactcttctaaagttcagaagtgagaccactcagatttcttaaacttgttcaggacaatggtgaaagtagcaggaaaagcgggagcattgcagtcagatctggatttatcgcctccatctctgtcctgttgtgcaagtcatttaacatctctgagtctcagtagctcatctttaaagttagaataatcgcacctcataaaaatttttgtgaggactttaaaagatactatgtaatgtgcttacacaatgccaagcacatggcagacacctaataaaacatcaagttctctcttttccccttgccttcgggatagaaagtgttctcatatggaatagaaattaagaatctatcagatagtattaaggtgacattactagccttatctcatttccccgtgcttagtatatttcatcataggtttaaatgcttcaccttttccagatttattaaaactagtgacccataacatggatgaaatgggaaaatgtcattgtgacttctgaaataaaaagcttagatgtgtgtggcaattgaacatgtttctttttctttccatgtatgatgaattttgatatgaacaacatgacttcctaactccaaatcaaccagaagcctcccttggccaatgtgccctattgctccagctctcaggctggttgtgcagtgggtagttgcctagcgtggaacttttctttcgccccagttcacatctggcacacaaggcaggcctcagtccatctggatccctccctacattgtgtcctttttccttgttccacagacttgattaactgtcaaaatgttttgttttgttttgttaataggacctgctgcagctacagtatgaaggagttgcagtcatgaaattatttgatagagctaaagtaaatgtcaacctcctgatcttccttctcaacaaaaagttctacgggaagtaattgatcgtttgctgccagcccagaaggatgaaggaaagaagcacctcacagctcctttctaggtccttctttcctcattggaagcaaagacctagccaacaacagcacctcaatctgatacactcccgatgccacatttttaactcctctcgctctgatgggacatttgttacccttttttcatagtgaaattgtgtttcaggcttagtctgacctttctggtttcttcattttcttccattacttaggaaagagtggaaactccactaaaatttctctgtgttgttacagtcttagaggttgcagtactatattgtaagctttggtgtttgtttaattagcaatagggatggtaggattcaaatgtgtgtcatttagaagtggaagctattagcaccaatgacataaatacatacaagacacagaactaaaatgtcatgttattaacagttattaggttgtcatttaaaaataaagttcctttatatttctgtcccatcaggaaaactgaaggatatggggaatcattggttatcttccattgtgtttttctttatggacaggagctaatggaagtgacagtcatgttcaaaggaagcatttctagaaaaaaggagataatgtttttaaatttcattatcaaacttgggcaattctgtttgtgtaactccccgactagtggatgggagagtcccattgctaaaattcagctactcagataaattcagaatgggtcaaggcacctgcctgtttttgttggtgcacagagattgacttgattcagagagacaattcactccatccctatggcagaggaatgggttagccctaatgtagaatgtcattgtttttaaaactgttttatatcttaagagtgccttattaaagtatagatgtatgtcttaaaatgtgggtgataggaattttaaagatttatataatgcatcaaaagccttagaataagaaaagctttttttaaattgctttatctgtatatctgaactcttgaaacttatagctaaaacactaggatttatctgcagtgttgcagggagataattctgccttaaattgtctaaaacaaaaacaaaaccagccaacctatgttacacgtgagattaaaaccaattttttccccattttttctccttttttctcttgctgcccacattgtgcctttattttatgagccccagttttctgggcttagtttaaaaaaaaaatcaagtctaaacattgcatttagaaagcttttgttcttggataaaaagtcatacactttaaaaaaaaaaaaaactttttccaggaaaatatattgaaatcatgctgctgagcctctattttctttctttgatgttttgattcagtattcttttatcataaatttttagcatttaaaaattcactgatgtacattaagccaataaactgctttaatgaataacaaactatgtagtgtgtccctattataaatgcattggagaagtatttttatgagactctttactcaggtgcatggttacagcccacagggaggcatggagtgccatggaaggattcgccactacccagaccttgttttttgttgtattttggaagacaggttttttaaagaaacattttcctcagattaaaagatgatgctattacaactagcattgcctcaaaaactgggaccaaccaaagtgtgtcaaccctgtttccttaaaagaggctatgaatcccaaaggccacatccaagacaggcaataatgagcagagtttacagctcctttaataaaatgtgtcagtaattttaaggtttatagttccctcaacacaattgctaatgcagaatagtgtaaaatgcgcttcaagaatgttgatgatgatgatatagaattgtggctttagtagcacagaggatgccccaacaaactcatggcgttgaaaccacacagttctcattactgttatttattagctgtagcattctctgtctcctctctctcctcctttgaccttctcctcgaccagccatcatgacatttaccatgaatttacttcctcccaagagtttggactgcccgtcagattgttgctgcacatagttgcctttgtatctctgtatgaaataaaaggtcatttgttcatgtttgtgtttttctcagtttcattgttaacagttcctgctaaacaccttgactagagtgagatgtatcagttaaaatcacaacagcagacaaccccttccttttaaaggagaaaacgtaagtccaccatcagatcattgaatgtctcaaagtgacttttaatgtgtgaacgtgtgactttagcctttttaatgaatatgcttaagttatcttcaccataaaaagaagggtgttgcgggaagcaaacattatatgtcacttaattctgattgacgaacggtggaaagtttaaaattgcaacagcatttaaccttttttgaccagcatactgttgttgagcacatagactgtgccccttagggggttcctatgtcacttgcaagtcaccagaaaagactaggggatgttgaatgtggaaaaagtaaatcacagcagtaaaaaaagaagaaaaggggccggcgtagtggctcacacctgtaatcccgacactttaggaggccgaggcgggccggatcacctgagatcaggagttttaagaccagcctggccaacatgacgaaacccctactaaaaatacaaaaattagctgggtgtggtggcacacgcctgtaatcccagctactcaggaggctgaggtaggagaatcacttgaagctggaggcggaggttgcagtgagccaagatcacaccactgctgtccagcctgggagacagagcgagactccatctcaaaaagaaaagaaaaggcttccttgtcagagggcagccttacttaaaaatacaaacgtacataagcatcctgttgtgttggtaaactgtggccagactatattggaaaattagtgacaggttgaaataaggggggaaacggaataattctaaaatagggaaaatgaaaaattggaggtgatggtttgtacgagtggttggagatgaccgcatgctcctctgaggaagagtgaggggaagagcatggctctcctggtgggactctggaaggtacccttctgagccccaggtttctcgttctgaaatggaaaggatgctgtctggtagctttgttattgaaacctgaaatattttaataatatgctctatattgtcctgcaaagaaatcaagggagttagaaaagtgcttatcaggactgggtgcagtggctcatgcctgtaatcccagcactttgggaggccaaggcgggtggatcacaaggtctggagatcgagaccatcctggccaacatggtgaaaccctgtctctactaaaaactacaaaaaaaattagctgggcgtggtggcgcatgcctgtagtcccagctactcaggagaatgaggcaggagaatcgcttgaacctgggagacagaggctgcagtgagccgagatcatgccactgcactccagcctgggggacagagcgagactctgtctcaaaaaaaaaaaaaaaaaaaaaaagaaaagtgcttatcggccgggcacggtggctcacacctgtaatcccagcactttgggaggccgaggcagggagatcacgaggtcaagagatcgagaccatcctgggtaacacggtgaaaccccatctctactaaaaatgcaaaaaatcagctgggcttggtaatgggtgcctgtagtcgcagctactcaggaggctgaggcagaagaatggcatgaacccgggaggtggagcttgcagtaagctgagatcgtgccactgcactccaacctgggcaacagagcgagactccatctcaaaaaaaaaagcttatcaaggtatagcaacattaaataagaaaaataagagggaaaatcagagtaggggctggacgtggtggctcacacctgtaatcccagcgctttgggaagccaaggtgggtggatcgcttgagatcagaagttggagacaagcctggccaacatgttgaaaccctgtttctaccaaagatacaaaaattagcccgcgtggtggtgcgcacctgtagtcccaactacttaagaggctgaggcagaaggattgcttgagcctaggaggttgaggcttgtggtaagccatgattgcaccactgcactccatcctgagtaacagcaacaccctgtctcacaaaaaacaaaaagaaaaaaaagtaggaaagtaagatggaacccagagcaatggcagagtgaatgccatggagtcccagctgctgctggtggtgccactgcgccaacggggagggagacggggttgtcacagccctgctgctcattcttttgcctgtgtatccctgaaaataatttgggaaaacgtatacatcccttcacacattttaagtttgacaaatacatttttaatgtttaaatcaagagtacctgctagcatgtgaattttaatataaaaatgaccataaaaatatcgaatggaacccaccttcattcatttttaaaggtacatgaacaaagctcttagttggaaatttcttttttatttcttttttattttattttatttatttttgtttgagacagaagtcttgctctgtcgcccaggctggagtgcagtggcgtgttctcagctcactgcaatctccacttcccaggttcaagcgattctcctgcctcagcctcctgagtagctgggactacaggcggctgccaccacatctggctaattttttgtgtttttagtagagacggaatttcaccatgttaggcaggtctcaaactcctgacctcaagtgatccgcccacctcggcctcccaaagtgctgggattacaggtgtgaaccactatgcctgcccctggaaattttaaatctttacaaatttaacgttttttttctctactctgcttccttcagaattttaccctagtgaaatattttaaaggacatcttatttttggtcatctgtaacaaaaataaaaatttgttttcgtgaccataagcctattaacccaatctagaaaaacattttgcatagttacagttattagtgcatatttgattgcagtaatttttttttttttttttttttgagttggagtcttgctctgtcgcccaggctggagtacaatcttggctcaccacaacctccgcctcccaggttcaagcaattgtcctgcctcagccacccgagtagctgggattacaggagccctccaccacgcctggctaatttttgtatttttagtagagatgaggtttcaccgtactggccaggctggtctcttggctaggctggtctcgaactcctgacctcgtgatccgcccacctcggcctcccaaagtgctgtgattacaggtgtgagccaccgcacccggcccagtaatgtaatattttatcttgacaattctaaaagatatttgaaatgcatttttttattttgtcattggtatctaatgaaatgcatttattgatgagataaatgaaagtcttttaaaatgaaagtttaaaaacatggtagacaaatattcttgctagaatgagatggggctcatgaccaattctatttctatttttcatttttataactgtaagctccgagaaacactggggtgtttcattacagcagtgtcacacatttctcaggactccttagtaactaatccaaaagactcaatgatttataataagttataacatgaataggttctccaactttgttgaaagcaaaagttaaaaaaagataattacctaatttggagaatttattatgcatgcaaacattattcactttctcaggacttgggaagtagacaaggggatttaccaagacttttaaagtaacccaattataactctttttttcttttttttttttttgagatggagtctcgctctgtcgccaggcgggagtgcagtggcgtgatctcggctcactgcaatgtctgcctcccgggttcaagccattctcctgcctcagcctccagagttgctgggattacagatgcccgccaccacgcccagctaatttttgtatttttagtagagatggtgtttcaccatgttggccaggatggtctctatctcctgacctcgtgatctgcccgcctcggcctcccaaagtgctgggattacaggcatgagccgcggcgccagcctatactcataactctttaacttaaagatagcttatttaatccaatatgttaatacgcttgggaaaacagaaatattttaatactcctttggtactataattttttaacttttattgcagggaactttcaacgtataaacggggaataatgtaatgagcacccatgtgtccatcatgcagcccagcaattatcaacacacagttaagcttatttcacctgtacctctgcccaaaccctcttgggttactttgacaaaacccaggtatagtatcatttcaaccataaatactgcagtacatgtctctaacacagtttttttttttttaatcacagaagatatttggctgtttggaaatatttttaattggcctgacgaaagaggtgctactggcatctagtgggtagaggtgagggatgccacttgacatctttcagtgcaacaggacagcccactgcaaccaagaatgatccagcctcaaatattaataatgcctggggtgagacgctgctcttacagataaggacttaaaaaaaatccccatcccatcatcacacctaacaaattattttaaaatatcaaattattttaaaatatcacaccgtttaaatatcaccatttacatttttaatttaaatttttaaattttaaaatatcaccgtttaaatttccccattcatcttatcattgttcagtttgtatttttgaatcaggtgccagacaagatccacgcattacatttagttgataggtctcttaaatatcttttccttttcttttttttttgagacagaatctcactctgttgcccaggctggagggcagtggcttgatctcagctcactgcaacctcagcctcccaggttcaagtgattctcctgcctcagcctcccgagtacctgggattacaggtgactgccaccacacccggctaattttttattatttttagtacagacggggttttgccatattggccaagctggtctcaaattcctgacctcaaatgatccgcctgcctcggcctcccaaagtgctgggattttacaggtgtgagccaccacgcccggccatatataattttttgaatgctcaaattgtcccctctttgaccaataaatttccttcacagtgactgttgagtacttttgacgtgaccctagtaatctttgatagtttccttgatttctagcataagacgttccaggctcatcttattgcatttctcaaccccagacctggaatccaccatttttctgtggagccctggttactgttagcgggtaatggtatttcaaggatgcagtctgggtgggtgctaggggtgttcctcaccgttagattggtcattgtgtcctttttttttttttttttttctagagacagggtatcgttctgtcacccaggctggagttcagtggcgtgatcttggcccactgctacttccacctcttgggttcaagcagtttttctgcctcagactcctcagtagctgggatacaggcatgtgccgccatgtccagctaatttttgtattttttagtagatatggggtttcactaagttgtccaggctgatctcaaactcctgacctcaagtgatctccctgcctcagcctcccaaagtgttgggtttatgggagtgagccacggcacccagccttttttttttttttccttgcaatgtatttgatgctaatcctgtagaatcacattctgggtttctcatgtcatcctgtggatcagactcagtttcaatcttgtggcaagaatactttggttttcctattacatcatgtcagggcttatgtttttatgatgtaaaggctgatctttggattcagatgttgccagcttgacccattcattataatttcccatcggctttcaccacgtatcacatggattcagcagccactggtaatggctgcctacatttatttatttatttattttactttttttttttttttttttttttttttgagacaaagtcttgctctgttgccaggctggagtgcagtggcatgagctcagctaagaggcaggttcaagtgatcctcctgcctcagcctcctgagtagctggaactacaggcacgtgccaccatgcccagctaattttttgtatttttattagaaacagggtttcaccacattggccaggatggtttcaatctcttgacctcatgatccgcccgacttagcctcccaaagtgctgggattacaggcataagccactgcacctggcctattttttttagtattttttcactttttttagagacgaagtctcactatgttgcccaggctagtctcagactcctgtgctcaagtggtcctcctgccttggcctcccaaggtcctgggattacaggcgtgaaccaccatgcccagcctcttatttcattgggggttgcaaaatggtgatatgctattaatatcattccttctttatttaacagaattctccttaaaaaaaaaaaaacttcctctcttcaactattttgttgccttgtagaacattcattcaggaacagatgatgagtgcttgattctctccctttgtttactagttttcagaataagctgcttccctagtgggctctaaatgaccagggagcctttgtttttcaaaaatcataatgaacccctggctttttaatatattccatgtctttcaatccactgtatgtatatcgatatacatattcataaaaattcttttttttcttgagatggagtcttactctgtcttccaggctggagtacaatggcacgatctcagctcactgcaacctctgcctcccaagttcaggtgatttctcctgcctcagccacccgagtaactgggatacaggcatgtgccaccaagcccagctaattttgtatttttagtagagatggggtttcaccatgttggccaggctggtctcaaactcctgacctcagatgatcttgggattgctgggattatagccgtgagccactgcacctggcctctagctttttcttctttttttaaatttttatttatttatttatttatttatttatttatttttgagacagagtttcactcttgttgcccacagctggagtgcaatggcacgatctcgactcacagcaacctccgcctcccgggttcaagcaatcccgagtagctgggattacagacatgcgccatcacggccggctaatttttttttttttttagtagagatgggggtttctccatgttggtcaggctggtctcgaactccccacctcaggtgatccgccctcctcggcctcctaaagttctgggattacaggcatgagccaccacatccagcctaagctttttcaatggaaaatttttaaaagagaaaaacacttcgtgagtttatgacaaaacaattttttaatataaaatacttttacctaatgtatgtgagctcagtgaaaggaaaaagtgccttgagtagtagcatttgccaattctgtggtatgaatacttccccaaagctgatttcaagctaccaacttgatgttgttggtcacagaaagtagagctgagaagagacgcttgcaatcagctcccataagctagtatcaatttttttttttttttttgagatggagttttgctgttgtcacccaggctggagtgcagtggcgcaatcttggctcactgcaacctccgcctcccaggttcaacagattctcctgcctcagcctcctgagtagctggaattacaggtgactgccaccacaccaagctaattattgtatttctagtagagactgggtttcaccatgttggccaggctggtctcgaactcctgaactcaggtgatccaccagccttggcctttcaaagtgctgagattacaggcatgagccaccgcgcctggccgagtaccaaattttattccaaggacgtggggcaggggggcaattgatggatttgaagaagagcaagaagaggtcagagatgtgcaggatggatgagggcggggaggctaggtgcgaggttgtgctggatatctcctttttgtccgttgagatccattctccacccctcaccctcccctgtgccctgggaagctggccacatggacggcatcgctgtctctctccagcttctgcgtgggtttggccaacaggaagcactaccaggagaccggaggtctggaagaaagcaattctgccaggtcactaggaatcagctgcctctctctaccaaagaccagagctcctgtcaggcagctcccttcagacaaccacctctccccactgcagtaagcaatcccacacccaattcccttcaggcctagaaagctaatgattcctgctgtaactagcctcagggggtcctgccatatcgctaaaccccgccctgtctctttattaacttctcttcaaattactcaattggattatgccacctgtattctgctgggtccctgactgatacacaagagtgagaggtgacagcgtgctggcagtcctcacagcccttgctcgctctcggcgcctcctctgcctgggctcccactttggcggcacttgaggagcccttcagcctgccgctgcactgtgggagcccctttctgggctggccaaggccggagccggctccctcagcttgtggcgaggtgtggagggagaggcgttggcgggaaccggggctgcgcgtggtgcttgccggccagcgtgagttccgggtgggcgtgggctccgcggaccctgcgcttggagcggccggctggccccaccgccccgggcagtgaggggcttagaacctgggccagcagctttgtgaatacaccaatcgacactctgttatctagctactctggtggggacgtggagaaccttcgtgtagacactctgtatctagctaatctagtggggacgtggagaacctttgtgtctagctcagggattgtaaactcaccaatcagcgccctggcaaaacagaccactgggctctaccaatcaacaggatgtgggtggggccagataagagaataaaagcaggctgccggagccagcagtggcaacccgctcgggtctccttccgcactgtggaagctttgttcttttgctgtttgggtccccactgcttttatgagctgtaacactcaccgcgaaggtctgcagcttcactcctgaagacagcgagaccacgagcccaccaggaggaacgaacaactccagatgcgccaccttaagagctgtaacactcaccgtgaaggtctgcagcttcactcctaagccagcgagaccacgaacccaccagaaggaagaaactccaaacacatccgaacatcagaaagaacaaactccagacgcgccactttaagagctgtaacactcaccgcaagggtctgcggcttcattcttgaagttagtgagaccaagaacctaccaattcctgacacaagaggaccaattaaggcctcaattagtgagggatttggtggcctgaattagacagtggttgttaggatggaagaggtggtgggagaattctagaggtatttaggaagtagaatggattcactgaacattaggggaaggaatagtggggcatagggctggcaagtactcctgaagaagtattctgtgatcaaggaagtttgggaaatgttgtattctgtcatatttggaagtcacaacacatatgtaaaagcccttagggctgggtatggtggctcacgcctgtaattccaacactttgggaggctgaggcaagtggatcacctgaggtcaagagtttgagaacagcttggccaacatggtgagaccttggctctactaaaaatacaaaaaattagctgggcatggtagcacgtgcctgtagtctaagctactcaggaggctgaggtaggagaatctcttgaactcaggaggcagatgttgcagtgagccaagatcgtgccattgcactccagcctgggcgacagagtgagactctgtccaaaaaaaaaaaaaaaaaagctctgagaagttctacagtcaagaaacttgcttagctttgtgtagcatagctttccccaaatgtatctgaccacacaatcccctccctcttaccctttagaaagctcctattagccatcagtgaaactcatgttccatggaacacattcttcgaaatcctggagaaaagaggaagctagaacagaacccgactttaagctttcaacaaatggtaaatattacctaggaaacagaaaagcaaaaatgtgcatttgtatgccacatttgtcaaagaattttggactccattctacatttctattttggtaagtttgtttaaaacttttgttcttaaattgcagatacttgttctgtgtaaattttgtccccacttgtctagaaaataattttgatgtgatgtataagaatgtgcacttgataaacttatgatagttgctcatagccactggcttttgtttctggagaaaaatattcccaatgcctatggggacggaggtacagagacctttatagtgggagctgaaaaggcacatgacagaaaaaatgatgtgatgagaattaaagtcaaactcctcctgtttaatgctaactcagaggccaggcacggtggctcacacctgtaatcccagcactttgggacgtcaaggcaggtggatcacctgaggtcaggggtttgagaccagcctggccaacataatgaaaccctgtctgtactaaaaatacaaaaccttagcttggtgtggcagtgcatgcctgtagttctagctactccgtaggctgaggcaggagaatcacttgaacctgggagggagagattgcagtgagccgagaccaagccactgcactccagcctgggtgacagtgagactccgcctcagaaaaaaaaaaaagcaaagcaaaaaaaaaaagctaactcagaactagctcccagaaaaaaaggagaaccagtgtccaaacacccttctccactaaaaggaaccagggctccatggagaaatggctgattctggggccaagcagacaaagtacaacatgagcctaaaatattgggtgcctagacaggaagaaatactaaaaaaaatggaaacatggtaaaaggatgcagacagtaaatctgggataattttaagtactaaaataataacagtaattgcaggggtctgtcccgcagacccaacaacagatgaataaagtacactgacacagatattctgctttgccagtccagctgagcatctgggccacttacagactccaagaagagtgctataaagagtagcagccgtggcctccaccatccagggagactcacatttgttcagtaaagattaattgacaaaggcttgagtcaacacagctagagggtaattgacattgccaacctcctgagtagaaagcaattaagcacccacagtagatcaaaggttagtcttaggaccacatgagtaaacaagctagtttagataaactcccccacatttctttgtatctactttaatctatttaaaggtaaagggactaggctgccttcagccagatctattaccacaattatgcaaactctcaggccttccaagagggtttgtggctattataactaaaatttttcccaccagcctgactgaaccccaaccagtaatgaattataacccattaaaattagaattcatgagtccattctgatataaacaaataaatgggaaaggggcaataattatcaatgcatactaaaactagtgggtacaagcttgtggaataacaggatttttaaattttatttatttatttatttatttatttatttatttatttatttttgagacaggatctagctctgtcacccaggctggagtgcagtggtgtgatctcacctcactataacctccacctcccaggctcaagcaatcctcccacctcagcctcttcagtagctgggaccacaggcacacgccaccgtgcctggctaatttttgtattttttgtagagatgggggttttgccatcttgcccagcctggtcttgaactgctgagctcaaacaatcctcctgcctcagcccgaataacannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntagcactttgagaggccgaggtaggtgggtcacgaggtcaggagttcaagaccagcctggccaagacggtgaaaccctgtctctactaaaaatacaaaaaaattggccaggcgtgatgacacgcacctatattcccagctactcaagaggctgaggcaggagaattgcttgaacccggaaggtggaggttgcagtgagccaagatcatgccactgtgctccagcctgggcaacagacagaccaagactctgtctcaaaaaaaaaaaaaaaaaagaaagaaattctatattggagaaacctggcagacatcaccttaaccaaatgatccaagtttaatatcagtaatgggacaccttgacatcgtgtccctcctgatatggctaaagtgagaacacagcgttgctcctgtgtgattcctgccaaaagtgcataatctgaaaagaatcatgaacaaacataagacaaaccctaattaaggaatattctacaaaataactgacctgtcacttcagaaatttttggtcataaaagacaaatagactgaacaactgttccagattaaagtatcctaaagagacatgatacctgaatatgatgagttgtcctagagtgtcgtttgccataaagaatattattggggtggggcacagtggctcacgcctgtaatcccagcactttcggaggctgaggatggcagatcacttgaggttaggggtttgaaaccagcctggtcaacatggtgacaccccgtctctactaaaaatacaaaaatcagttgggcatggtggcagtcacctgtaatcccagctactcgggaggctgaggcaggagaattgtttgaatccaggaggcaaaggttgcagtgagctgagattgtgccactgcactccagcctgggtgacggagactccgtctcaagccaaaaaaaaaaaaaaaaaaaaagaatattattgggaattgagacactgagccaaaattttaataatatctataaattagataatagtattatacaatgttaataatttcctgactttgataattatgctgtgattatgtaagagaatattcttgtttttatgaaataaagtatttaggagtaaaggagcatcgtatcaacttactcttaaatggtttagaaaaaaatgaacatatagagagagaaatgatgaaactagtacagtaaaatgttaacatttggaggacctgggtaaagagtatataggaattctttgtgttattgcaacttttctttaagtctgaaattacacaaaaataaaaagttttgtttttgattttgtttttgttttgagacggagtctcgctctgtcatccaggctggagtgcagtggcataatctcggctccctgcaacctctgcctgccgggttcaagtgattctcctgcctcagcctcccgagtagctggaattacaggcacctgccaccaagcccggcttatttttgtatttttagtagagacggagtttcatcatgttggccagtctggtgtcgaactcctgacctcaagtgatctgccggcttcagcctcccaaagagctgggattacaagcatgaacgactgcgcccagccaaataaaaagtttttaaaagaaatgaggatctttacctaaccatatcaggaatagtttggctacaagaaatgcaaaaaccagtggggcgtggtcatgcacaccagctacttgggaggctgaggcagaacaattgcttgagcccaggagttcaaggctgtggtgcactatgatcgtgcctgtggatagccactgctctccagcctgggctacgtagtaagatctatcagaaagaaagaaaaaggaaggaagaaaggaaggaggaaggggagaaagggaggggggtgggggagagagagagaaagagaaggaaggaaggaaagaagaaaaggaaaactcagcagtttaaacaaacagggttacctttattttacataataagtttacaagaaaacagttacaagttgatttagctactcaaaatgtgaacactgatcgagcttgttttctatcattctgaatattgaatgtttttatgctctctcttttcatggttgcaaggtggctccattgctccaggcatcatatttgcattcaagatagaaagcagaaaggggctggttgcagctggatatgttccttttttttgttttgttttgtttttttttgagatggagcctcattctgtcacccaggctggagtgcagtggcgcgatctcagctcactgtaagctccgccttccgggttcatgccattctcctgcctcagcctcccgaatagctgggactacaggcgcctgccaccatgtccggctaattttttgtattttttagtagagactgggtttcaccatgttagccagaatggtctcgatctcctgaccttgtgatctgcctgcctcagcctcccaaagtgctgggattacaggcgtgagccaccacgcccggccggatatgctccttttatctgaaaaccaaaagtttcctagaagctttccaatgggctttcccctaagtctcaataactatgctggtcacactacctactctgtgaggtgaggctgagaagtggtgtctgtctttatggtggctgcaacagattacagggagtatttgcatatcaagaagctgattattttcaatttcaaaagtacaggccatattagttatttaacccagtctgtgattccattcttttttctttctttttttttttttttttgagacagagtatcactctgttgcccaggctggagtgcagtggcgtgatctccgctcactgcaacttctgcctccagggttcaaacaattctcgtgcctcagcctcccaagtagctcggattacaggcgcccaccacctcgcctggctaatttttgtatttttagtagagatggggtttcaccatgttggccaggctggtctcaaactcctgacctcagttgatccacccctctcagcttggattacaggtgtgagccactgcacccatcctctatgattccttttttttttttttttttttttttgagacggagtctcgctcttgttgcccaggttggaatgcaatggcatgatctgggctcaccacaacctctgcctcccaggttcaagcgattctcctgcctcagcctctggagtagctaggattacaggcatgcaccacgacggctggctaatttgttttatttatttttagtagagacagagtttctccatgttggtcaggctggtctcaaactcccgacctcagttgatccacccaccttggcctcccaaagtgttgagattataggtatgggccatcacgcctgactgataccattcttaacagcagtatttcctaatgtttgacccatagaccacctatatcagaatcatttgttataaaggcacaatcctgtgccctagatcagtaaatcacggtctttgggtttgggaagtaggaatacaaaatttaaacaaacacctgtattccaacaaggtcatagaccaaggtaaaaggaaacacctagaaatgcggatccaacataatgctggttccaacacaatagaaatgcacagttgaggctgggcgtggtggctcacgcctgtaatcccagcactttgggaggctgaggcaggtggatcacctgaggtcaggagtttgagaccagcctggccaacatggtgaaaccctgtctctactaaaaagcaaaacctagctgggcgtggcggtgggtgcctgtaatccccgctacttgggaggctgaggcaggagaatcacttgaacttgggaggcggaggttgcattgagctgagatcacgccactgtactctagcctgggtgacaaaagtgaaactctgtctcaaaagaaaaaaaaactgcatagttgagttcacaaggaaaccctcaagtgactgaaaatcaaatggtaaatatatggttatctatccaacaacccgggaactttaggtttttgcttgtttgctcattttaaatggactaaaatccatgcgttgtccagatttccctagtttttacctttttctcttctaggatcccactcaggatacattacatttagtcatcatgtcatcttaggcccctctttgctgtgacagttggagttcagtttttgacacccacttggtaaaaggagatgatggacttgcatgagtcagggagttagacctggaacccaagccaggaccctcaaaaggttatactcaaggaaaatgtgtgtttggggaggcaatcctctatgggccttgagaattcctgggcattcttgctagttatccacaaatgcaaagctctgatcacacttcactgggccatttatcagagttgtgtttgcagtgagcaactttgggtaatgaggttatgtcttcttctgggacaaaaagtaggttattcctctcccataacagaacagaacccattgtatgtgtaggcatccatctgtatcatttctgtgggacttggtgggcaagaggaattgacacaaaaatgatcctcatgctactttgtagtgagtaataaagtctttgtctccgacccaggaatatcatgcctcctgcagtcatccatgaaaataggaacaggtgtaggctaagtgctgtggctcacacctataatcccagcactttgggaggctgagagggggctgattgcttgagcccaggagttcaagaccagcctgggtgacatgtgaaaccccatctctacaaaaagctacaaaaattagccaggcatggtggtgtgcacctctagtcccagctacttgggaggctgaggtggaaggatcagttgtgcctgggaggttgaggctgcaatgagccatcattgtgccactgcacttcagcctgggtgatacagcaagagacatagctatctaaaaaaaaaaaaaaaaagtaacaggtaatgtattagtttgtaagtagagtaaaattccagatccgaaaaggtaaaatctatccactggcaaagttaacatgggagcttgactgtctctggctgggctgtgggagggaaaaaaataaaaagccctttgagaaatcaaaaatctgctgtgtatggtggctcacacctgtaatctcaacactttgggaagctgaggtggggggactgcttgagcccaggagttcaagaccagcctgggcagcatggcacgatcctgtctctacaaaaaataaaaataaatgaattgagagtggtggtacatgtctgtgcccccagctacttgggaggctgaggtgggaggattgcttgatcccagaaggttgaggctgcagtgagccatgttcacaccactgcattccagcctgggtgacagacagactccaccttttaaaaaaatgggtttttaggtatgaatttataggatccatgtaataaaattcctttgtctagtaactgatatcctgtgactcacgaaacagaaacaaaactatacttgagtcatattcctactacccaggattctcacaggaaaaaaaatttaagcccccttaaagatagaagcatagttaaaaacattagaaaacaatccaccagaagcaacagccagcagatacaacaaataggtttagagctcccaaatcctgagataatagaactagatgctgagagaaaattataaaaattagtataactaaaagcataaaagaattaaaaaataagaacagagaagcattctaaataaaaaggaggcggatttgaaaaggaattaaatagaattttcagatgggaaaacagtctgtgaagaagaaaaaatggttaaatgtgaacctgaacatggttcactgcaaccttgaactcctgggctcaataatcctccatcctcagcccccgaagtagctggcactatagacatgcaccaccacactcagctaattatgtttattttttattttgtagaaatggggtcttgctaggtccaggctggtttcaaactcctggcctcaagtgatcctcctgcctcagcgtcccaaagtgctgagattataggcttgagccactgtgcccggcctgccttgacttttaacttctgtccaggtaggggctttccaggggcaggcctagccatggcccgccacacaaggatcaatggtaatcaacaaagcagaacatagcaagctgacaccaaagtgcctgagaaccaaagtgaaggggaaaagctaataagaagcaagctgatttccactcgagaacttcagaaggaccagaggcaccaaaagaggggagcgacagggctgaaagcacaaagattgatggaaactgtgcaaggaacagttagatgcccagatccactccccaactgctcaaagctaggtgactacttctcctctccctaactgtacacaagatgtgaactctggggcaattgagccagaaagattctgcacttagggtgagacagggcaaaagctgggatggaggtaccatctgaaaacagggggattaagagaaagtctacacatcaaacactgagacctgcagcttctcttttctctcttcccatttagctcccagaacactagcagccaggcttacatacctggacagaagaatggacgattcttcaggcagaagaaaattgacctgtctgagagaaaaataaacagaaaaacccacatataaacaaaagaaaacccagaccaaaccctagagataccgatatttgggggacatacggtgcaaatagggctgggcgcagtggctcatgcctgtaatcccagcactttgtgaggccagagcaggcagatcatgaggtcaggagttcaagaccagcctggccaacatggtggaaacccgtctctactaaaaatacaaaaattagccgggcatggtggcacgcgccggtggtcccagctgctcgagaggctgaggcaggagaatcgcttgaacctgggaggtggaggttgtggtaagctgagatcacgccactgcactccatcctgggtaacggagtgagactccacctcaaaaaaaaaaaaaaaaaaaaagcaaataatttagaaatgtataaaatagaagataaaagttgcccaggagtccctacgttcccaaaggcaactattgtgagccacatcttgatatgtttataacaatttttctatttaagtataatgggtccgagttaagttcctgtaacaaaggctaaaataacagggctttaaacaaaattgatgtttatctctcagtcacgtaacagtccagaggcagcccagagctaatattgtggttccccagtgctggggacccaggctactttgctaccattgtgctggcattctcaacacatagttttcatctcatggtctaagatggctgctctgtctgtcagtctttagagatggggtcttgctctgtcacccaggctagaatacagcggcacaatcataactcactgcagcctcaaactcctaggctcaaaccatcatcattgcacaaacagcaaagcaatgcattcaaagatctaaatggaaagcatttccagggaggctctcttcttagccaaactaacaatcaaataggagggtaaaataaaaccgtcttcaccaaaaccagcctcctgggtagctgggactacaggtatgtgccaccacccctggctaatttttattttgtaaagatggggtctctctttgttgcccaggatggtcccgaactcctgggctcaagtgatcctcctgcctcagtctcccaaagtgctgggattacaggcgtgagccactgtgcccagctgctgctcccaatcctgtcacaatatccacatggcagtcagtgagaagacagaagagaaaaaagaaggccattttttctttcatataaggacagaatcccagagttgtccatattacttctgctcacaccccattgggcagaacatagtcgcatgaccatagctatttgcaagggaggatgggaaatgtagtcttcagctggctttagttgggcctagatgtgctcagctaaagctcaggatttcttttaaaaaaggaagaaggggccgggtgcagtggctcacacctgtaatcccagcactttgggaggccgaagctggtggatcacctgaggtcagaagttcgagaccagcctggccaacatggtgaaaccccgtctctactgaaaatacaaaaaattggctgggtgtggtggtgcacacctgtaatcccagctactagggaggctgaggaagaagaatcgcttgaactgaggaggcagaggttgcagtgagccaagatcgtgccactgcactccagcctgggtgacagagcaagaatccgtctcaaaaaaaaaaaggaagaaggggagaatgaatattgggagacaatcagtgatctttgctacaaaacagacacacacacacacacacacacacacacacacacacacacacacacatatatttgagatggagtcctgctctgtcgcccaggttggagtgcagtggcacaaccatgactcattgcaacctcctcctccaggattcaagcgattctcctgcctcagcttcctgagtagctgggactacagctgctcgccaccaggcccggctaatttttgtatttttaatagagagagggttttgtcacgtcggccaggctcgtcttgaactcctgacctcaagtgatccacccacctcggcctcccaaagtgctgggattacaggcatgagccactgcacctggccagatacacatatatattttaaaatcttttatttccagaaacaatctatacatatttagtgtctctgactaatggagagtcaaagatcaccagaggtttgaggaaagcctgcagaggaagatcaaaatgaacaaacaaataaaaatgaattcagacaaaacaaaaggtgacaatgtaaaaagtagaaaaaaagtaaaaacagaagtaacctaaaattaatatcacatccatgaaatgagtacagaatgctattcaaaaaagatattttagggaaacacagagagttcttattaatccttttttttttttttttgagacagggtcttgctctgtcacccaggctggagtgcagtgacagaattacagctcactgcaacctcaacctcccagactcaagggatcctcccacctcagactcctgagttgctgtgactacagtcacataccaccatggcagactaacttttttttttttccatagagatgaagtctcactaccttgctcagtcttaatcttttcaattgaaagataatggtagaggctgggcacggtggcttgctcttgtaatcccagcacttcgggaggccgaggtgggaggatcacttgaggtcaggagttcgagatcagcctggccagcatggtgaaaccctgtctctactaaaaatacaaaaaaattagctgggcgtggtagcaggcacctgtaatcccagctactatggaggctgaggcaggagaattgcttgaactcgggaggcagaggttgcagtgagctgagatggcaccattgcactacagcctgggcgagaagagtgaaactccatctcaaaaaaaaaaaaaagataatggtagaaataaaagtttaacagaaggattggaaaatgaagctgagaaaatatatcaggaaataggaaaataacaaaagacaagtaaatagaaaataggagacaaaagataagaaaattagaagagcaatctaggaggcccattaactaacaaaagttccagaaagatgccaggtgctgtgactcatgcctgtaatcccagcactttcagaggctgaggagggtgaatcgcatgagcccaggagtttgagaccagcctgggcaacatggtgaaaccctgtctccactaaaaatacaaaaaaagttagccaggcatggtggtgcgtgcctgtaatcccaggtactcaggaggctgaggcaggagaaccgcttgaacccaagaggcagaggttgcagtgagctgagattgcgccactgcactccagcctaggtgacagagcaagactccatctcaaaaacaaaaaacaataaaccaaaaaaaaaaaaaaccaaaaacaaacaaacaaaaaaacaggtcacctacaaaggaaaaggaaaccgaatgtgagtggccttctcagtagcaacactgaaagtgagaaaacagtgacccaatgcattcaaagatctaaatgaaaagcatttccagagaagccctactcttagccaagctaataatcaaacaggagggtaaaataaaaccatcttcacacacagtctcagagattttatctttcacgtaccctttttctctccaggaaactattggagaatgtactccaccaaagtgaaggtgtacacatggcaagacgacaacctgggatccgggaagcggaggtgagaacacaggaggcggagggaagcttggggtgatggtgagggggactgcaccacagcagtgctgcaggctggggaacagcccaggatgcagccagagggcacagcgctccagaaaagaagcttcccccaaaaccagtcattcatagattcagtcatatgtttcatagctctgtcggagtttgggaaaggatgaataatggcttgagagaaatctaagcaaatcaataacagaggcaatttttaactccaaaaagaaatttgtaccaaaatagaactatgctacactatgtgaacgcttaatattgccaagcacagtggctcatacctgtaatcccagcactttgggaggccgaggcgggaggatcccttgagcccaggggttcgagaccagcctgggcaacatggtaagacttcatcactacaaaaactgaagaaacttagccaggtgtggtggtgcgtgcctgtagtcccagctacttaggaggctgaggtgggaggattgcttgagcccagaaggtcggagctgcagtgagccaagatcatgccactgtactacagcctgggtgacagagtgagaccctgtctcaaaataataacaataataatttaaaaaccacttaatattgatttaccaagaatgatcacataactacattgaaagaatgaggtcagggaaaattatatttttgttggggcataaaatggccaaatcatcattttctatggtagaaaatgaacagttaactatctaaaattttaaaatatcataaaacagcaggattaacttcatttaaagtaggacttgggggccacgtatggtggctcatccctgtaatcccagcactttgggaggctgagtttgggggatcacttgagcccaggaattcaagactagcctgagcaacataggaagaccttgtctctactaaaattaaaaaaaaaaaaaaacaagccagggatggtgccacgcacctgtagtcccagctactgaggaggcgctgaggtgagagtgtctgaggctgcagtgagccctgatctttccattcactgcactccagcctgggtaacagagcaagagaccctgtctcaaaaaaaaaaaaaaaaaaaaaaaaaaggacttgagaaatctttttacgattgtaagcctataaatttcacttcttaaataattcacattttttgattagaaaattatcccagcttctcaggaaactgaggcaggaggatggcttgagcccacgagttcaggtccagcctgggcaacacagtgagaccctgtctctaaaaaaaaaaaaacaaatgtaatatgattaagttaatcaaataagaacagaagtagaatgaatatactccaaatcagattccagaaacatggaaccagagtgcagctatgacaggtgcctatgctggtgaattggtggacagataatggtagatttagcttaatactcatctcatctctatatatatatatatatatatatttgtttttgtgagacggagtctccctctgtcacccaggctggagtgcagtggcgcgatctcggctcactgcaagctccgcctctcggctcacgccattctcctgcctctgcctcccgagtagctgggactacaggtgcccgccaccaccacgccccgctaattttttttgtatttttagtagagacggggtttcaccgtgttagccaggatggtctcgatctcctgacctcatgatctgcccgccttggcctcccaaagtgctgggattacaggcacgaccaccgcacccagcctttcatctcaatatctttctacagtcctccctacattgcacaagctgaaaggtcgaatctacatttcctagatgaccttgtggcagggattttggacacaattttggtttttccaatcatttcctctcatgagatgtataaggtggaggtgaagtgaagtctgtgtgtgctatttatgctggggagtgctgtggtggaggtgtttgatttttttttttttttttttgagacggagtctcgcttcgtcgcccaggctggagtgcagtcgggtgatcttggctcacagcaacctctgctcctgggttcaagcaattctcctgtctcagcctcctgagtagctgggactataggcgcctgccaccacgccctgctaatttttatatttttagtagagaccgggtttcaccttgttggtcagactggtctcaaactcctgacctcaggtgatccacccacacctcggcctcccaaagtgctgggattacaggtgtgagccactgagcctggccttttttttttttttttttttttttttgagacggagtctccctctgtggcccaggctggagtgcagtggtgtgatcttggctgactgcaacctccccctcctggatttaagcaattctcctgcctcagcctcctgagtagctgggactacaggcacacgccaccacacctggctaatttttgtatttttagtggagacagggtttcaccatattggtcagggtggtctcaaactcctgacctcaggcgatctgcccgccttggcctcccaaaatgctgggattacaggcgtgagccactgcacctggccgatgcttgatatttctgcagtggcttctcatcatgatgatacctgtatggttcaagagctggtaagtgtagagacagctttccaatttagtagatggcttcctgatttcaaaagaggcagtgtctcctttggtggctcagtattgcagcatagctctcaaagtcattcctcaaagttcaacctggagtcggttgcttcagccctccaaacaagtctggaagtcattttataccctgtaatatattcttttgtacttaaaccatctagaatggttctgttctctgaaacttgacccaaacaatgtaacagaaaagcagaaataaaatgtaaagaaaaatgctaggcgcggtggctcacgcctgcaatcccagcattttgggaagccgagacaggtggatcacctgtgatcagcagtttgagaccagcctgaccaacatggtgaaacctcgtctctacaaaaaatacaaaaaattagcctgcgtggtggcgtgtacctgtaatcccagctactcaggaggctgaggcaggagaatagcttgaacccaggaggcagagattgcagtgagccgagattgcaccactgcactccagcctgggcgacagagcgcgactctgtcttaaaaaaaaaaaaaaaaactagccgggcatggtggcgcaagcctgtaatcccagttactcgggaggctgaggcacaagaatcacttgaactcaagaggcagagtttgcagtgagctgagatcaggccactgcactccagcctgggtaacagagcaagactccgtctcaaaaacaaaccaacaacaaaaaaaaagcatggtaaataacacaaaatacaacagaaaaaaaaatccaattataattaataaaaatagctaaattctagctaacagagatatattttcagaatacattttctaaaaagtccagttataggctatgtctgagagacaggtgaaaaacataatggaatattatcatataaatgaattgacacaaatatatctcgaaaacataatggagaatgaaaaaagatgcaaaatgattattcagtatggtgtcatttttgtaaagtttaaaaacaaaattaggtattccatatagcattgctggatccccacatcatatgtaataaaagtataaaaacacaaactggaatgatatgtaccaacttgagcacggtgactatctgtggggcggaagaagaaatgagagtggggccgtcgttatgactaattttgtatgtctttaataaatcccaagtacatgcagcaaaatgtattgatgtctgtttaatcttgatagtggggggcgtgggtagtattaatattattttccgtactcttccgtaggcctctaatatttccctctttacagaacactgacacacgctcagggctccccgggacatctttgtgcacatcaacatttatgctgagagtagcttctggactccaaagaggaaactccccgggcactgtggcccacgcctgttatcccagcactttgggaggctgaggtgggcagatcgcttgagcccaggcgttcgagaccagcctgggcaaaatagcgagacccacccccgccccccattgctacaaaaacatttacaaactagccgggcgtggtgacccccgcctgtggtcccagctggtcgggaggctgaggtgggaggatcttttgagcccgggaggtcaaggccgcggtgagtcgagatcgcaccactacactccagaccgggcgacagagaaagacatccattcactcccccaaaagaaggggaaattcgctgaggctgagcgctggtttcccaaggtggggctggcacctgctgaagctgccacaggagtggagaggccgtagggagacttggaaagaacctggaaagggggccggggctatggagccaaggctgcagcagggctggatggtgtttgtagtttgtgcagaataggaggcagtttttaaagccgagatacagctctggttgactggagcggggaggggtgggtgtgagaggtcaggaaaccagcggctggaggccgggggcctggagcggcagggctggcgggcagacgttaggccccaggcaaaatgggcgcaccccctgcgggggcccgaggtgacctgctcgaggtccggtcgcccaggttccacctggagaagaaaatcttcgtaatttggctgggggaggggggatgcgggcacaggctgtgttctccacgtcgcgtagacgcagaggccatccctgggtcggagagtctccgtggagtggcaccccagcgttccccgtacgccggggccgctttgtcgggctgacgggggtccctccgggtggccgccggcggcgggtcccgagccagaccgggaagcggggagcagccctcagcccgcgagcgcggggccggggcagactggaggccgggcgggccccgccgagggtggggcggggccgggcgcacgggggcggacctcggcgcgctcccggccgctcggtggctccggggccgcggcggctcctctgccgggtcgcgccggacgactggcttcgggcggcggccccggcggcctgtggacggacgggtgggccgaggtacaggccccacggccgccgtctcccgcttctgcccgcgcagagtccgcgccatggccgcctcgccgggctcgggcagcgccaacccgcggaagttcagtgagaagatcgcgctgcacacgcagagacaggccgaggagacgcgggccttcgagcagctcatgaccgacctcaccctgtcgcgggtgagggcccgggccggcgcgggcgggggcggccacggccgcgggcgggacccgcgcggcgggtgagaggttgcggggccaaggcgatggcggggccgggcgggggccgcgcccgggaaccggcggctgggagggggaccggagcggccgcggcctcggcgtttccccgcctggcgacacccgctagccgttcgcgatcccgggctgaggtgggagggtcgcccggccccgtgtgcgggaagatgggcaggggtgaagcccgtggaggcgggcggccgtgcgagggcggcctgagggggaggaggacgaggagccccgagaggaaatcgcaaacagctcggaggccggccgggtggcgcggcgcggcttctggtcgctccgaacatcccccaccatcgagccctgctgttctgccggcgtggaaggccgcgggcaccccagggtcccacgcgctcgtggggggagctctgtgcacaagtccatccagggcccggccctggggtggctcgggttgttggaaccacgacgggattccgtgtcgagtgtgaggctctgctccttttactccttggaggtgctttatcgggtccagtttactttgttcggcccgggatatttagtgagaactgacaagcgtcgctggtgactggagagggacctggaggaatgagtaaggcgcgagccgggacaaacacctggagaggttaggtaaccgctgagtgaggcagtggaggatggagagccaaccggagtgtccgcgcagggttgcagagaaggggggtcagcaggagtggggctggccttgaggatcctgaatgctgaccttggaggaccatcgggaggatgggggaggatctgcagattctgggggactgaggcgggggagacagtttgaaggagagctgagagcagagttgcaaaccagctgagttgcagacacattattttttggccagcgcagtgtttgggaaaaattattgaatctgttgccagaatttttaaattggaagacttccacacaaaatccaaatttccgtattatttatttattattatttatatatgttaaaaattgggagacctggtaacactaatcctgaattcctacatgacagctaccgacctgctggagctgggtgatgatgaaagggagctgagctgagctccctttcaaatggagtaagaactctagtttgccaccgtccactctctgtcacagtcccccaaggggagattaggtgacagttgccatttatactcatgatggtgttttctttcagtgaagttaaggaaaaagtgaaatatttcctgtacttacatttctgttcacattgagaaaaaatatatatagagagagaaagaagctgaagatttcaagaaaatgttttcttataccctatcagcttcactcattttttacctgcctggcatccactggcatttacatctgtgaccttggttagattcagagatgaactcgataagctcagagcacgttgaaaagaatgggtgggtgaaagctgaggattagtgttggggcctgtgttgttatgtgtttttaaatacatactgtacattgtttatgtacaaatacatgcactgtatatgtctgtatacttatggcggatccaatctttcacccaattcatgaatcttctttaaaatatccctgacaggtgtggccatgagtaatatacagactctcttttaaaagcaaaaatttttcacagatcctcactgtttacttactttcaagtaaaaaaaaagtgtttacttactttagagaccctgctatagctcagggtctcttgaatttagcaagcctaatcaactgtggcccatatgataattcagtcaccactttattctaattactacaaaattatggtgtcattttgcccttcacctggtacagggaatcatttacatattaattctgcccgtgttttcttcttggccagttaccagtaaagtaacactgcttggctccaccgtgttcataaacacatctgtaaatgataacactgaatttggctactaatgtttgcttatttaaaaatcttaagggttattttcataaagaaatcacaaaattagaatacttctcatagagaactcttagattcccagcatgtctatgaagaatgcgtctctaaggatccaaagatcccagttggaggagtatctgcctagttcataattggtaactgggtggcagatatactgacttttcattactagcccatgacagacatgctaattcctgacttttcattactagcccatgacagacatgctaatcgatagggcagacattactgatctatctagatgctctttcccctctgagcctgtgttgggattcaagttcttctctacatgatcaaagcaatccttcagagttggccttacttacctattcacctaggcgttacttatcctattcacctagtgggtaggatagactagactgtagaggattttctctagctttagaagtccggcattatcaggaagcagtgggaaaattttgagaagggagtactaggaggaggagttgagtggtggtacctggaatggtaaagagagggaagaaagtggggtcgggcgtggtggttcacgcctgtaatcccagcactttgggaggctgaggcgggcagatcacgaggtcaagagatcgagaccatcctggccaacatggcgaaaccccgtttctactaaaagtacaaaaattagcctggcatggtggcgtgcgcctgtagttccagctactcgggaggctgaggcaggagaatcgctcgaacccaggaggtggaggttgcagtgagccgggatcgcaccgctgcactccagcctgggcgacagagcaagacttcatctcaaaaaaaaaaaaaaaaaaaaaaaaaggccgggcgcggtgggtcacgcctgtaatcccagcactttggaaggctgaggcgggcagatcacgaggtcaggagatcgagaccatcctggctaacacagtgaaaccctgtctttactaaaactacaaaaaaattagccgggcatggtggcgggcgcctgtagtcccagctactcgggaggctgcggcaggagggaggctgcggcaggagaatggcgtgaacccggaaggcggagcttgcagtgagccgagatcgcgccattgcactccagcctgggcgacagagcgagactccgcctagggaaaaaaaaaaaaaaagggaagaaagtggttgcaggtatgcctgggaagaggctgttctgttgttcatttattaatgtattcatttgtcagtatttgagtgcctactttgttgttaatggggtgtgtgtttgtgagggagaagagtgaaaacatggggctgtcctttaaagatcttactgatttgttccacaaatttacttactgagtgagtccttagtgtgtgccaggggttaggatggacactgggtatatagtaatgagcaagcaaaacacagtgtcccagtggattttaggatttaatgaggaagacattcatttaataagtaaggacacattttggtgaatatcaccaaaacagaagtaggtggagctctggacctgtatggtagggaattctcacctcttccagtggcctaaaggctcagggggagtgggggaggcattcgagggtttgtgtgttgagggagggaatatgttgcaggtacagagaacagagattcagtaaaagaggatgaggaggggatgtgagatgaggctggaggcattcatagggatcaggttgtagagacaggatttggaacttgatcttaagggcaatgggaagtcactgaaggggttaaactatgtgagatttgcttttttaaaagattcctctagctccagcgtggtgggtagaagagaggaggaggaggattttagtaggagatgtgatagtggcatttactaagatggtggcagtcgggaggcagagcggtgagcagattgatacttaggaggtggaaagggccagattttgtgaatgggtgaggaaggtgagaaagagggagggctggaaccatttcagggtgttcttcattaagtggacactggcaggagcaggtttgtgcggaaatgctgagtttgaggtgcctgtgaggcacataagtagagatggtccagcaggcagctgtttagatggttttgcagctcgagaaggaaggctgagctactgagaaaaatgggggaatttttgttatgtagccacagaagtagatttggctgcctaggaagaattgatggaacagatattgtaaactggtggcttaagttctgtattttgccctctaacatgtttttggttttggcccaaaatgtggttagttggttggttggttggttggttggttttaattaggactaacaatgaatattgggattttatagtaaaatctggactttggtttcttttgaaaaatgagataatccaacgacactcacccgacatttctggacggcaccagttgcctggagctgaatggtggctgccccattagaaaggccatggatgtggtcttcagtttgccacagtccctaccaccctctaaggtattctttgcagtgatcccagactgcttcacttagattccctgcttggcagctgtaggcatttgagtttgttacccttgtcagaaggtgaactgtgaggccaggcgcggtggctcacgcctgtaatcccagcactttgggagaccaaggcaggcggatcacctaaggtcaggagtttgagaccagcctgaccaacatggagaaaccccgtctctactaaaaatacaaaaaattagccaggcatggtggcgagtgcctgtaatcccagctactcaggagactgaggcaagagaatcgcttgaacctgggaggcggaggttgcagtgagccgagattgtgccattgcactccaacctgggcaacaagagcgaaactccgtctcaaaaaaaaaataaaaaaagaaagtgaaccatgaggagggcctaggagaagccaaaggaactaaggaactacaccatttgaaagggaggtggaggagctggccaagaaggcttgaagagcaaccagaggggcaggagaaagccaggagtactcttatgaagaggagggaatgccgaccagctgagcctagtgctgctgacttggtctgacacaaaagatgtgtcctttggtctagtcatgtggaggtcatcagaggaggtcatcagtaacctcggtgagagatgctgtattctcagggtgctgggtgaaaggctaattgtgagacgttgaggagtggacgggggtggggaatggagatagggttggaaacttattccagaagtttggctgtgaagagcaacttgtgttgcggaaccagaggactaactcagcatatcaccctggagtgttgattggacttgaatatttgcgcagactcattattttcatgtgaaaataaaccaatgataagacaatagatatgtcatagattagcgagctctcaggatggaggagagagagaagatggaaatattaggtttgggctaaatattgaggactttccttttgcgaggcactgtaatccctttcacatgttgttatctcacatagtcctcaaaatgagcctatggtgtgtatatctggaattttcctcatttttgtggatgagtaaactgaggcttagagaggcatggttgcagagctggtaagtggtagagccagggtttgaatctagctatcacagtgaatgtctgtatacttagctactttaatttccctcataaggatcttcagctgcttttactccctgctgtaaggtatcagtatcatttgttgaaaagacttttctttgcccattgaattgctgtggcaattttgttgcaatcagttggccatataagtgttggtttatttttagactcttttctgttccagtgatttgtatatctgtctttttgacaatagcacactgtctgtatattatagctttataataaggcttaaaacctggtaatttaagtcctctaacttacctctttttgaaaattgctctggccaggtgccatggctcatgcctgtaatcccagcactttgggaggctgaggcgggtagatagcttgagcccaggaattctagaccagcctaggtaacatggtgaaatccgtctctaaaaaaaaaaaacgaaaattagctgggcgtggtggtgcgtgcctgtatttgggaggtggaggttgcagtgagctgtgattgtgacactgcactccagcctgggcaacagagaccctgtctcaaaaaaaaaaaaaaaaattgctctgactattctaggtcatttgcacatccataaattttagaattatcttgtcaatgtctctgaaaggacccgctgggattttggattgtaatcgtgttggctattgtgagacttttctcaacaaggaattaatgaggcctggatctcatttcctgtaggcattaaagaaaattccactgagatgtgtgactgtaggccaaaggtcactaactcagtaagtgaggcaggtaaggaaaatgaatggaggggccaggaatgagatgatcatggcagctgatcctgggccatcgtgaagggataatagggtacagtgaggacttggcaaacacgatctaagggggtggcctcttctcagcttcatccagcgatgccatgcaagaacatgggttcagtgttgtctgatctttcaatcaggagaagttggaaatccatatttttatgcagtgtcctgattttttcaattgaaatttaatacactgaatgggtcaacatctggtgggtaaacagaacactctaggtgaaatgtggcctatgggctgccagtctgtgacctcggccttaggctaatcattctttggttcacatgttcatcatctgtaaacatgaaggtgttgaagacagtctcaaagttctttttctagctcagtgagtctaaatttcaaaagaggaaaatgtcaaaataactcagagtttgaagaggtagctgagatcagcaataatgataatatcttaagaagttgaccagagctttacatttgacataccactcttgtatctgtgtcatttaatcctcactttatcttgtgcaggaggcatcagagttgtttgcccaaccacacgggagttgcaggttacaaagtcacatcatccgattccaggtccagtgctttttgtttttttagagtctcgctctgtcgcccaggctggagtgcaatggcgccatctcggctcacggcaagctccgcctcccgggttcatgccattctcctgcttcagcctcctgagtagttgggactgcaggcgcccaccaccatgcccggctaatttttttgtacttttagtagagacagggtttcaccgtgttagccaggatggtctcgatctcctgacctcgtgatccgcccgcctcggcctcccaaagttctgggatttacaggtatgagccactgctcctggccttttttttgagacagagtctcactgtgtcacccaggctgtagtacagtggcatgatcttggctcactgcaacctctgcttcctgggttcaagcaattcttctgcctcatcctcccaagtagctaggattgcaggcatgcaccaccacagctggctaatagttagtagagacggggtttcaccgtgttggccaggctagccgtgttcttttttaacagtctttgaaggcttcggaaataggtgctttgggagggagagcagttatgggggattgtgagacggccttcagctcagttgagggcaggtccctatctggatttataacttagtttggttgaagtgtcaaggcttttgggtaagagttgaagcctttgtgagaactctctgaaggcaggaactttagcatacattcatcttagtaagccagtgcctggcatactacctgacacacagttaagtttttgtatcagtaaatcaatggataaattgatccttcaaaaaagaaatcaaaggctttaaatcaagatggctgagaattttgtccagagaatttcaagaatagtcagatgcttctgataagtacttttagaatgttaagattgaaagctgagagactttattcctataactccactcctagatggaaaaaactcaccatgtcgtcctcctcatgtttgactctgagatttgggttttgattaataggttataactgtctccctgtgcagtacatttaagaaatcaaatacagcaggtataagggaagttaaagccactgaaggatttcgtatgcctttaaaatttccaaacaagtataagtctttatcttttgagaatacatattgaaatatggagtgataccatgtctgaaatttctttcagtgaggcactgcgggtagtggagagggtaaagatgaaagatgattgtatataagttggtaatttttaagctagaagatggatagatggggtttcattatacttgtctttatttcacatatactatttgaaatctttcataataaatgtaaaaaggaaattatcagagagcttcataggttcaacaatgcttttggtaaaccaaacttcacctttttttttttttttttgagtttgtaattagtatgatcatcgagggaaagatgggacaaaggaaaagagcatggcagaaatgggcatatgggctttgaggctgacagccgtggctcagcctcctgctagccacgtggcaagtcactgaacttccgagtctgggtctccaggtctgtaacagcaggagagtacagtctcatttgcatggttgtggggaggattagggatgaagtgggccaagtgtccgagaacagcacctggcccatcctaggggcttagatctggtagtgttttattattgttagagacagagagtgatgaagggtaaaaatctgccccagggctctcgtctataaccctttcttctctatatgaattatagtgccaagggttatgtaaccatggagctaatttattattttagaaacagaactcttaaagaccagatcagaccactttgagatttacaagaactgtaaccagtttattgctttttgaaaaatgaagtaaggaagaacttacaaagaaaggcatattaaaatggtgggatgccattttatacctattgaattgacctccttccttaccccaattaatggtaatatccaatatcaatgagtttttttggtgaaacttttctcatatgtatattagtaaactctttgggaaagcatttcggcagtatacgttgagagccaccaaaaggcccatatccagagatttagtaatcaccctttggaaggtgttctaaggaaataattcagaagaactgttatatacccactaaaaattactctgtaatagcatagaaaaggcttatgatgagcatgctaggttgtacctatcttatgatcacagctatgcagtccttaccataaatgtaaacggaggctggaaaagagcatgaagaagggaaaacagctaatgtgttagggttgtggatagtagcttagtttttctttcagaaattcttttattgttgttaaagattatgccagtgtatccaaacatacacactcaaagaccttgcaagaggacgttactatcatggtatatgggacatttggaacatgggtaagctctttccgaaaatagagtaatcaaaacccagaaagcaccggaaaccttgagggtgtgatcacttacgtcgagaagaaattgaaacaagactttcattcttgaaccgttcccctacaaaatactatactttgatgcttctttagatctttgctgttacctctcagcgttcttaaatcactttgtttccaggttcaatttcagaagcttcagcaactgcgccttacacagtaccatggaggatccttaccaaatgtgagccagctgcggagcagtgcgtcagagtttcaggtacctccagatatgtactttcttgaagctgaatggagtgtaaaaaatagacaaagattatcactaaaaagatgagatcttgaaggataagctgggcctaggtacagttcagtcttcttttggaaagtccattaatattctctctcatagtttctacagcatacgatagtgttatttcacaaatggctgaaggcagcactggcaagtagaattataacacaagcatatgtaatttaaaatgttctagtagctacattaaagaagaagaaacacgtggggttaattttaatatctatatttttcaaaatgcagctttctcatctataattttaatattacttaaataaatgtttggctgggcatggtggctcacacctgtaatcctagcactttgggaggccaaggctggcagatcacctgaggtcaggagttcgagaccagcccggtcaacatggtgaaaccccatctctactaaaaatacaaaaattagctaggtgtggtggctcacagctgtagtcccagctacttgggaagctgaggcatgagaatcgcttgaacccaggaggcggagggtgcagtgagcagagatcataccactgccctccagcctgggcgacagagcgagactgtctcaaaaaaaaataaaaataaaaaaataaatatttaatccaatatatccaaaatatgatcattttaacatgcaatcagcataaaaaaactgagaaatctcacatacttttctgtgtactatgtctttgaaatctgttgtgtattttatactcaaagcatactttaatttggaccagccgcatttcactagtttcatgtggctggtggctaccacatggctcagtgcaggtgtaagacacagataagtagtctgtattgcatttagattactgcagtgtcctcgggtgctttcatcgttcacatcagtggaaagccttgttcaaaccaatgtggaattggtgtttcagacaatggtatatggcactattgttaagacctgaattagacctgcttagatatcccaatctgtgaaacattaggagcctgtcattctaattatgcaatttaagattcggtgttaaagttgagatataaactttaagatgaagcattaattgattgtttggatgcctgaccattttaaaagcactgtcttatttctttgtggtagaaactgggttcacttttttgatgatgtcaaataaagccaaatgtattatttaagttggggacttccatttgagagtgctgatgggaactccaaatataatggtgattagaaaaagtactacatgaacatatttgtaccctattgcaccggaatcttgtcttcaatataatgacaatggactctttaccatattactgcctgtattagagatctaccttcatatatcaaactaccttatatattaacccactgggttatttagtatccaaataacataggtctctgccttatgcgggatttcatacttcaggaaatacagcattgtgcaagtttgctgtgtctgagatcccaattttgtgctactttattgtcaactttagaggaatatagaatttactatgatgttcccctccggttgcattggggaatgggataaaatgataatccttggccttcccaggattcttttttttttttttttttttttgagatggagtctcactctgtcgcccaggcaggagtgcagtagtgcaatctcagctcactgcaacctccatcacctgggttcaagcattctcctgcctcagcctcctgagtagctgggattacaggcgtgcactaccacgcccagctaatttttatatttttagtagagatggggtttcaccatgttggtcaattggtcttgaactcctgacctcaagtaatccacccaccttggcctcccaaagtgctgggattacaggcatgagccaccgtgcgtagcccccaggattcttttcatactgtttttgttttgttttgttttgtttttctttgcaacagtcacaaacttacacaatacttggaagtatagtccacttaatttttttttttttttgagaccgagtctcattctgtcgcctaggctggagtgcaatagcgcgatctcagcttactgcaacttccagctcctgagttcaagagattcttctgcctcagcctcccaagtagctgggatcataggcgtgcgtcaccacgcctggctaatttttgtatttttagtagagacagtgtctcaccatgttggccaggctggtctcgaactcctgacctcaggtgatccgcccatctcgtcctcccaaagtgctgggattacaggcatgaactactgtgccctgctgacataacttttttttcacttgggaataagttcctgacctgatgccccatcaccccctaatatttcactgtgtttttcctacaagcaaagacgttgttctatataaccaaaatacagccatcaagataagaaaattaacagtgatccattattacaatctgatcttcagactgcattcaccaaatgtccccctgctgtcctctgtagcaaaaggattcagttcagaatcacatgcagttattgcctgcagtctccttcagtctggaacagcttttcagccttttatttttgacattaattcaagtactcttaacgtttgtgatcctgtcacatttgaagattacaggccagtttttttgtagatataacccctcaattggggtctgcctaatgtatctttgtgatttgattcagactatgcatctttggcaggaataacgtagaagaagtgaggctgttatggtatcacattagggacatgattttgatgtgtcctgttaatgatgatgttctcttttatcaattaaggtggtgtccaccaggcatggtggctcacacctgtaatcccagcattttgggaggctgaggcaggcggatcgcttgagctcaggagtttgagccagcctgggcaacatggagagaccctgtctctactgaaaaaaaaaaaaaaaaggccagatgtggtggtgcacgcctctggtcccagctacttgggaagccgaagtgggaggattgagtgcttgagtccagagagcagagatttcagtgagctcagatggggccacagtactccagcttgggtgacagagccaaaccctgtctcaaaaaaaaaaaaaaaaaaaaaggtggcctgtctgtcaggcttccccatttaaagtaactcttttcccctttgtaatgaataaatattttgcgaggagatactttatcctgatcttcattaaactttcaatctatacattcattttttatctctcggtatatggttttatgattttctattttattcaatctattataatctattattttatttattcatttttgaagcaatgaaagcacagatttattgaaataaaagtatgctctacagagtaagagtgggcttgaagcgcaagctaatctattatttttattttgatcttcacattctccccaattaggctggtgggagccctcttccgaactgagaaaaattcttgaaaaactgaggagagtcccagagcacagattttttttaagtaaatgtttttgaggtattatgtaaatacaatataatttataccttttttaggtatacagctctttgccatataatcaccaccacaatgaagatgtagaatagttccattaccccaaaaggttcccttgtgtctgtttgtaagtattctccatcccccacctccagcctctggaaaccaccatctgtagttttgactcttccagtgtcctattagtggaatcaaatgtccgtagtcttttgagtttttctctcacttagcatttgagattcatctgggtggttgcgtgtgttagtttcctagggctgctgtaacaaagtaccacaaacttagtgccttaaaacaacagaaatttattttctcatgttctcatgttctgagtccagaagttggaaatcagcatggtgtcagcagcaccatgaacgctctggggaagaatccctccttgtctcttcctagcttccgtggtctgcggcagtccttaacttgtagctgcatcacttactctctgcctctgtcatcacacgactttcttcattgtttgtctgtgtctgtgtttaaatcttcctctcctttttcttataaagaactagtcattggatttagggcctaccctaattcaatatgatctcacctttgcttgattacatctgcaaagattctgttttcaaataaagtcatattcacaggttctggggcttaggacttgaagatatctcttttggtggccataatttaacccactacattgcattgatcagtagttcatttctttttattgctgagtagaattccattctatggatgtagataatttatgcattcatcagttagttgatgggcatttgggttgtttccaccttttggcaattatgaataaatattctataaacattcacatacagtttttatgtaagtagctagtagtggaattgctagatcatacagtaagtgtatattaactttagctttataagaaatcgccaagctgttctccaaagtggctctactgtttcacattcttaccagcagtgcatgagagttccagcgaccctgtatctgctctagcacttggtatttcagagtttcaaaaaaatggtggttaaaaaacagaacataaaatttaccatcttaaccattttttaaagtagtttattggtatcttctaaaaccatttttaaatgtatagttcagtggtattacatacattcatattgtgcaaccaatctccagaattttttcatctgacaaaactgaaattctatgcccattcaataagaattctccatgttcccttcccaccagcctctggcaactactgttttttctgtctctatgactttgactattctaagtgcctcatatgagggaaatcatatactatttgtcttttttgtgactggcttgtgcttagtataatgtcttcagggttcacccgtgttatagtctgtgacatgatttccttccttttcaaggctgagtaacatttcattgtatgtggatgccacattttgttccattcatccgctaatggatacttgggttgccgccacctcttggctattgtgaataatgctgctatgaacatgggtgtgcaaatatctcttcaaggctctgctttccattcttttgggtacatactcagaagtaggattgctgaatcatatgacaattgtggttttaatttttttttttttttttgagactgaatctcgctctgtcgcccaggctggagtgtagtggcgtgatctcagctcactgctgcctccgcctcccaggttcaagcagttctactgcctgagcctcctgagtagctgggtttacaggcgcgccccaccacacctggctaatttttgtttgttttttttttttacttttgagatggagtctcactctttcgcccaggctggagtgcagtggcacgatctcggctcactgcaacctccgcctcctgggttcaagcaattctcctgcctcagcctcccaagtagctgggactacaggcacctgccaccacgcccgggtaatttttttgtatttttagtagagacggggtttcactgtgttagccaggatggtctcgatctcctgactttgtgatccgcccgccttggcctcccaaagtgctgggattacaggcgtgagccactgcgcctggccttgtctagtttttaaattgagttgttaattttcttaatcagttgtgagagttgtttatatattctggataccagttctttatcagatatgtattttgcaaatattttctcccagtctgtggcttgttttttcattttctcaagtctcgaagagtagaagttttaagttttgaagtctagtttatcaattgtgttattttatgatttgtgcttttgtcttatctattaataagagttcttcatctaactcaagttcccgaaggttttttttctatgtgtttctctattagttttatagctctgtcttttacacttaagtaaattatgagttaatttttttgtgtggtacagggtttgggtttgaggctcactcattttgcatagggatgttaaattgttctagaaccatttgatgaagactttcttttccctattgaatgccttggtacctttgttgaaaatcaattgaccatatacatgtgggtctatttccggactcttctgtgtcattggtttctttgtctgtcattttgctaataccatcttctgtgtcattggtttctttgtctatcattttgctaataccacactgtcttgattactgtacctttataggaaggcttggaattaggtaatgagagtcgtctttgttcttttttgaagctgttttgcttattttcattcctttgcttttccataacattttagaatcagcttgttaatgtctataaaaacacctgctaggattttatttttatttttttgagacggagtctcactctgttgcccaggctggagtgcagtggcacgatctccactcactgcaagctctgccccctgggttcatgccattctcctgcctcagcttcctgagtagctgggactacaggtgcccgccaccacgcccagctaatttttctgtatttgtattagagacggggtttcactgtgttagccaggatggtctcgatctcctgacctcgtgatccacccgcctcggcctcccagagtgctgggattacaggcgtgagccacaacgcccggccaacacctgctaggattttaaacaggattgcattgaatctatagataggttggggataattgacatctttataatatggagtcttccacgaagaagacttccatgtacagaaaaacagatttttattgaagttcagttgcttataatcatttatatacaattctccttttatttttattatattgatatatttttgattgacaaaattgtatatatttatggtatacaatacgatattttgataaatgtataccttgtggaatggctaaatcagacaaacatatgcatcctctcacatcattatcatttcttttgtggtgagaatctgctctcagcaatttgcaatatatgatacattgttattaactttagcaatcatgatgtactatagatatcttgaacttgttcttcctgtctactccttttatgtttgtaaatcactttggagtttacaaaatgctttcatatctgttattttacttcatcctcttactacaacattggttggtaagtgtagtactattttaatatactaaagaccaattttctatcctaatggaggatctcaaagtgcattctttttttctaacccaatgagcccttatgcaaagaacgtagacttatcagatgagtaaacaaaagccaacttttcaggctgccttctgataatctttagcaaggggcagaccatcagtaaaggggtagctagggttatagccctcatgtctctaggcagggcctggcacacatacactgagggcagagaggaggaagtgggcattatcttcttctctgagagcgagggctagggctgtctcttctgcttagtggagggatagcatgttccagcctgtgtaacagctagggcacatgttgactgaatggcttgtcaggcagctgtagagagagggacaaagggcttctctctgtatagggctttgtaggtatagttgtagcttttcgtatccttttttttttttttttttttgtgacaaggtctcaaggtcacccagctggagcgcaatgatgtgatcttggctcactgcaacctccacctcctgggctcaagggatcctcctgtctcagccccccagggtagcagggagtacaggcgtaagccaccacacccggccagtttttgtatttttgtagagatagagtttcactatgttgcccaggctggtctcgaactcctgagctcaagcgatccacccgccgtggcctcccaaagtggtaggattacaggtgtgagccaccactcccagcctcgtatcctttatataacctaccctagtcctttcaaatcatatcactaaaaactaattgtactttttacatctctgattaactacattttaacaaaattgcatcatgtcatgtgtaactgagggcttttaagttctaatttagggaacaatctgatggtcaagggaagaaacccttataccaaggcagtttgcaaaggcctggagggccaggtccagcaaggtggttttcctggggcccactaccaatatgagtagtataatgaggcccagagttcgcatagcaagtaagtaagagaaccaggacttaaaaatcatgtctttgacttccagttccatttccatggttttcctttactgcatttcctttcaagttttcataaggttctttaaaggaaaaaaaaagattggcaaaaagatacatcagttaaacaaaagaaaacctaagtagcagtattaatctcaaaataccactactaaccacagctgacatttattgagtatgtgctatgtgccagacactgtgttaagctctctatgtagatggtaattgtcatagcattatatgacttttatgtgataaaacaacatagcaacaaattgcaaaaaggaaaaactccaagaaatgagaattcgacaatagcacaattctagatttttaattcactacgactgagccaatattcaaaataaagataataaagagttacaccattaacaaatcagaattactgtataccaaaatttattccctagagtttattctctaaaaaggtaagatacctttctagatatttctagactcattttaaaagcaatacttctttttctgattataaatgtaacacttgcttattacagaaaactggttacatcttttttcaccatttggccttttctttcagtagttttgcagtgactataaatattttttaacaaaatcagcctcatatgtatgtatagttttgtattttccttctatgtgttcaatggttttcagaaacagtatttctagtgactacatgctattctgtcacatggatatgccacagtttcactgcccccttattgtttgggttgttttcactctttgttcatggtgtgtgtgtgtgtgtgtgtatgtgtgtgtgtgtagtgtaaattgatcacatactgggccaaataaattctcagtaaattaaaaaaggagaaattgaatctgaacataattaataaaattgcaattaataattaaatttaaatttaaaaatccagctatttgaaaattttaaagcctttttaataactattagatatactatcaggcaggctgggtaccatggctcacgcctgtaatcctagcactttaggaggccgaggcgggcagattgcttgagcccaggagttggagaaagatagtgaagagctagaagaatgccttcactttgaaaatctgaggaatgccttggatccctcctgaggaaaatatgtaaatatgtatacatgctcttattcacttattttattttattctttttcttttttttttttttttgagacaggtctttctctgtcacccaggctggagtgcagaagcgtgatctcagctcactgcaacttctgcctcccaggttcaagcgattctgctgcctcagcctcctgagtagctgagactacaggcgcctgccaccatgcccggctcattttttgtatttttagtagagacagggtttcaccatgttggtcacgccagtcttaaactcctgacctcaggtgatttgcccgccctggcctcccaaagtgctgggattacaggcgtgagccaccacacctggccccattcacttcttttaaaaaagttttattagtgaaaatttcaaacagattacactcatttttgcttaaattttgatcctgtgtcaagaactcttggcctaggatgacttacatttgtaagtttgtattaaatatttaaaaattggctgagtgtggtggctcacgcctgtaatcccagcactttgggaggccgaggtgggcagatcacctgaagtcaggagttcgagaccaacctgaccaacatggagaaaccccgtctctactaaaaatacaaaattagccgggcatggtggtgcatgctgtaattccagctacttgggaggcttgaacccgggaggtggaagttgcggtgtgctgagatcgcaccattgcactccagcctgggcaacaagagtgaaactccgtctcaaaaaaaaaaaatcatttcccttattttcctttacctgtttttttttttttttgagtctataaaatgtatttgatggaaaattgtggaaaatgttttagtaacttagtacaaggttaaacaagcagatggcactgtcatggagttatttgaagtatatttgctgttgctattgtcccctttaatactcaagcagccttttagcagcctttgaaatctcatttgtcctcatgcagataatccagttctgtgtgcatatttgcatgtcagatctcgaaacctgcttttttttttgttatttcaaggtaatataaagtagcatataggtaccaccatgcataatccagaacccctttgctttccatggaagccaacctctcagggctcctgccccctcactgaggatgcaggcctgggaaaggggatcagaaacgggtttgtagggaaggatgagctctgcctgtcctgttgcccagggagcactcctaataatgccaaggagctcaattccaagcaggtgagaagcttacggaatgaaacaagagaggctgattctcattaaatattttcaggttgtgtagggcagaacaatgagatgaacaaagcaccgatctgtcctctacttcctttttctgaaaggaagaggtgaagtttcttcatgccatctggacagtgttggggttacataattagactcctcccgactgagtctccttaggtaaatcacagaattctctgactcatctagaagtgatgataatgacggttacttgatagagttgttcataaggatctaatgaatgcggaataaatgcatatctctggaaactaaagtactaagcaaaagtcagtagtatagtaatacaaatcgtgcttaggaacaattgtgaagtaggaagtttgtctttatcactttctacctctttttttctgtgctcttcttactgtctccccctcaccgctgctgtccaatatgttagtcactagtcatttgtggctatttccattaattaattgtatttaattaagattaaatacaattaaaaattcagttccttggttgcattaagccacatttcaagtgctcaggaggcacatgtggctggtggccaccgaactggacagcactgccccctattttgagaagtgggagagttcttggaggaggtaggcattctaatgctgcgttctaggtcccagtttcagcaccggattaagtcctcaccttcccttaagagcccagggctttaaggtgatcttcccttccctgctcgtctttatcagccaatcagatttctatgccttggttgaagtgtttcttttagtggtaagcaaagcaccctgattaagttcatatcaaaaactttgaacctccacttaactgctctgagtacatgcatttcaaaaaaggatgcccccaaaatcagatctccgcttggtagaatttctcactgtaaaatgtggcggttcctccgaaaggctgtgtggtaggcgcgcgcttacatgacacacacacacagattaggtagtcttctaaaggaacagactgaccctgcctttcaaaagacgatgcccacaaaatcagatctccgcttggtagaatttctcactgtaaaatgtggcggttcctctgaaagggtgtgtggtaaggcgcgcccttacattacattacgttacacacacgcacacacacacacgcacacacacacacacacacaaatgtcttctaaaggaacagactgaccctgtgaaggtgttgggtgt

SEQ ID NO: 12299 - DNA, 37475 bp, Human
tgcggaagaaaacatagaagcagcagtgccagaaaacaagctgacattagacagtctgacagaaggcttctgactattcgggaccgcttttgacttcttttatgatatgggcccatctatggtatgatacaggcactaaaactaaaacaaatggtagaagtaagaaggggtaccatatagaaatatttttagagaaatgaacaagcaaaaaagtcagacaaaaattaaatatacttctgaaaagttacaccgactgtgcctgtctcttccaccttcccttcaacctcctctatctcttcttccccagggacccctgagacagcaagaccaactcctccttatcctcctcctccttagcctacttaacatgaagatgatgaggataaagacctttatgatgatctaattccacttaatgaacagtaaatatattttgtcttcatcatgattttcttaataccattttattttctctagcttactttcctgcaagaatatggtaaacaatgtatatgacacatagaatatgtgttaatcaactgtgttgttggtaaggcttcctgtcaacagtaggctattagtagttgagtttaggggtgtcaaaagttatgcatggattttcgactggttgaggggacagcactccaaacccctgcattgttcaagggtcaactatattcagtattatgtaagtatatatgggaaatgatcagcaggattatttaatgtgtgactctagaggccaggttacctaggaatgagctagctagcatgaggactcgtctcagttaaaaaaaagctcctccaggtctcaggggtagtgtccccagccttctcattactccccaaaacagctgagtcaaacttaaatattcatttctatccccattcccagacaacatctcccatacacacattacacaatcactcttattcttgttaaccaagatgaagaccctctacaagaaatagtcctgttacatctagctcaactccacctaagcctgcctctgcacctgctgtctctcatgcccaggagtcacagtctttgccaagtgacactgctggcttttaactcagttccctaattcactgtgtgatatagggaaaagtcacttcctctccttctgagccagtttctccatctgcaaaatagattcaatagtctaaaaatcccttttgacttcatttttatcaaacactttttgtgtccctaataaggtgtgatcataatcataatgtttcatgatgatatcatggaattatacataattatatgtatgtagttatactatattatatattaatatattatataattatatattattgtatcatatataaatataattatatattattaatataatacttaatattgattatgttaaataatatcacatgttgattatacattataatacataatcatgtacttgtgatcattttatataactataattatgtaattttaattgctatgtttttttaagctcctaccatatgtcaaaacatttttcctctttcatatcccccatcgccattcacctaataatggtaattcattctttgagcctgtctcaggttggttgtcagtttctttaggaagcctactccaacttttcttagcctgagttagatgcccctattcctctcatagttccctgtatttttcctattgcaatgcttattacattaaattggaactgcttatagagttgttgattactccaaaaaagagtataaatgccatgaaaggagggtgatcaattgttttgttgctctgtatattgccagcacccagaagagggcctggcacatagtaggcacacaataaatatgtgttgaataaataattaatgctaggcactttaaattggaaaaaactagcacagtaatacaaagaccaatgttaactaaatcagttaacatgcacttcctttcttaaatgtcgttataaaaaggaggaagaaaactcaagtgaaactgactctgctagaacagtgccgtgcttttccacagaaggttagaccctgaaagagatggctcagcaccacctatggatcttgctcctttgcctgcaaacctgtgagttctgacccttgctgatcgcctcctagttttccataaagttttaaaaattgcccttaaggaagacattgaactgtctttttgatctgtgtttagcagaacaccctgggtctcagtatctactgtactcaacaggatccaactggctggggagagacttaaaattcaaacctaagtgtttaggttcagctttaaagtttatattactgagttatatttctgagatctggagatctcagtttccaaaggtctgaggcaaatccttctcagaggaatcagcacttggtaaacccacccaaaaagcctggcaaaagaaagatcttctaaaagcttgaatgacttacaagcaatttcttcttggcattcaattgtgatggcgtttgagagagaaaaatgtctttcctaattatagttgattgttctatcaggttagagtgatggatgactcatcgttatcattgttgagcctcatctctataaactccctttattttcaaaacacagagctattactctgcttttatcctcaacaaactctaaaataaatgaggaagagattactatcccattttttacaaatagtctcaaaaaagagttggagaacttgaattaaaaaccctatttttcttacttatggcataacagtaaactaaaagaacgacatgaatattgattgttatttgtacaaagaaaattgtaacattaacatagatctgggagtgctgtgtcattgtacatgttatctccttaaatacaaacaattgctctaacagaaatttactatgtttggaacttctagatctacttctagtatctcttgccagttctgaaaatgcactagcagaattctggcatgagttagaaccctgggaacctagtacgtttggattttctgtaaaggtagaatcaatgcaccgtgatctctctggttcctttggccatttcaagctatggctcctttaatttgaacttcatggagattgtaaccactagtcagaccaaatttttggagcctctgctggtcgctctagaatggcagacagaaaatgcaagtagatgaggaatggtactagggatgtccctaatcttccagagagagaccagacaaggtagcatttgataccacttaatttgcaaaacattctacaatgtttatgcctacattcttatgtcatccatatgaaaaccattgagatgagcaagatagacgttattaatcccattatgcaagaaaaataataaattaagatttaggggtttaaaaattcacctgaaatttcactacctaaattggtagagctggaaatagacattggtttttctaattccaaggttaatcccaatcccattggttcttctttctgctccacctgacctcttcactcattgctttcaaatttttgatgctcttcaaaaggttaatacctgctaagataaaaggtagctctaggatacacttctttcatctactgaaactgaaataaagttgtcaaatcagctagtagtgaattgtttacaagttttgtgacctagacgaagttacattcctcctctgactcttgtttcagcttcaaaatggggaggtattaatacagtagaattgttttgagaatcaaaatgatgataatgcatgtacaacacttgccatggtacctgaatatagtaagtgtttaacagatatcagctaatgctactatttttcacactcgcttttcattcattattaggaagagccatggctttaccacacagagatcctgggcaggactcctctgtcagggaattgtccaaggaacataaacaggagaaaaggtggtgggagtttgagcttaggtgttggttgtctgggttctggaaaaggaaactaggagtgagatattcatttcatcaaggatccatgaaaggggaatgggagcttgtttttataaaagtgaagccaggagtactttttacatactgtccacctttactgaattatctgtttgcctcttaaggattattctgcaaaccttttctgagcacaaaaatataccatgaattcctcctgctgctgttcctggtagaggtagtcccttacattcagtattgggcttaggagtctacactttacacatttccctggaattcagagcagttgaagaggctgagaagcagtggagagatgcagggagaaatccccatttcccctcagaaatcaccgacataaggaaagtctgagtgtgcaaacttatgactgttccatgttggaaaagttttctctgagtcaaaattcacagtcttatgctctgatgccaactttctgatcatgactttggaaacaccatgactctgactgtctctccacataccctgggagacactcccactctgagggtaggagatgaaggagtccaccagttttaatccttgcccaccccctctacatatactgtctcatactcttaattcttccttttctctgccccattcgtatttctatttcttcaactccctgtcttatctcccatcaataatagtaataagtaaccatttatggagcaatcactgcatattcagcattactctaagtagtctacagttattattttgtttaatccttacaatacactatgagatagatacggtttatgtgcacatatacagatgaaagcattgatacacagagagtcaaaggccacttaaccaaaaagtgaaagaagtagaatttaagcttcagagtccttagacttcacctctgagtcatgctgcctccacccacattgatgctgaagtggagtaaattactctccctactattaatgtttgggaatatgtcagtaaagagtgatgatttatttatttctgtcaagacaggattattcggatagaatctgtgcctttctctatacccacccacagaggaggaaggagctgttggcaggtccttgccaataacggaagtttaggcagggcagtgaggcagaatacccaagcaaacaaccatctccagacatatttcaaataccgttcactttaatattattcaaatgtgatttgaattagtttctttaaacaaataaaagtccaatatcagcatgatgttgatgtcttgttggatgttaaacatggtcatgggcatttcagcagttgagacctaaaattctaagaaatgagtgggctcactatgggtaactggaccccaaccatcatcctggggctcagagacaggaagcatacctgtggaagtatgctgacaaaacaacctgccactgatctgaagtccttgcattgaggggtcttcaagataaggacaaggcctctgtattagaatgagatttaagcagatgactaccacagacattcagaaaagggctcaaaagcagaaatccagttatagaaatggaaatatattacatatgggtaaaactgcttatcaaaaacccagcttccaaacagagggtggaaagctgttccccctgtgataactcaggccttcagtggaaggcagtggaggcctaccttgtcagctccaagtgcttgaagcagtcctggagatcaatatggaggccaacaaggcagccagagcaccttcgcaacaggagcctgatggtcagtgccaagccattcaggctactggagtattcctaaatcaaacctttcttgtcttggaccttaggaaagggatggacctgtaagtttggagatcactgggctcatctatgtgaaacttggaaagaggtatgagcaatcagctgggggctgatataggtggaactgactaggtactcttgtttcctttgttatactcagtgttcaagtacacgctaatagagggcagcaatgttaaaacggatggctatgatctcatgtctgttttgagattttgtgtgtgtgtgtgtgtgtgtgtgtgtgtgttttgaaggaactgattcaagtaaacctaaatcccaataaaggtgatataaagtaaaactcccaggggaaaacaatgtactattgcatgggggtagtaggttcctttttcttaaaacctcatgatcaaggactttccgtcgctttggagaatgacacaaaatttctgcctgcccagccctgtgcttcctcttcccctctatgtcccttcactcagtgtgagcagttataatggactctcttttgggcaccacatgctaaagctacctctggtcactctcccagacctacaatactcagcgatgttccacccccactttttgactctaggaggcagtgggtggagaagaggagaggaagtttagctagtgccacaaaaaaagaacaagaaatgtttgtctggaggatcctaagaaagtaagggggtggaggtgtctgttaagcaactgtgcagtcttccccatttccactcttattaatagctacttgctgactttaacatctccccaataccccaactctaatttttcccttcgtagttgtctgaggtgttattttagtctctttgaagatgtttatttgttttacatagcaaacatatatagtgcctagtatatgccaggcactattctaagaggtctacaaatatcaattcatttaaccctcataatatttttatgaggtcaaatattgtgctactattaccttcaccaatgtgctaatattaccttcattttaaagctgaggaaactgaggcacagagaggttactgactttccctggggttcatggccagtccctgacagagccaggattctagcccaggcaggctaggtctcagtgactaacccatggtgacatacaggtgattccacaaggcaaggctctccttaggaccactagactctcctccattagtacacacacttgagagcaccctcatgtcatttaatcctaataattcctcaaagtggcaggacagctctgttttatttcttttaccaactagaaccctctgacttagcaagtaagtgacattcatggtcatttagctagtcaacaacagaccctagactcaaacatgtttcctaatccctgattcaggacacttttactaactatgctgtgggtccccattttgtggatctaaaaaattttcttcacaaacagtatagaatatagaaagaaattgcagttagccatctgattcttgttaataatcagtttaaatacttgacctttcacatcaagacccagagatcagtaaagagtcctctcttgccttcactctttctcttgctgagattttctgccttgtttttctattgttggaaaagattaattgagtcagttgcaaaaaaaaaaaaagctttgtttttttttgtttgtttttgttttttgttttgagacagagtcttgccctgtcacccaggctggagggcagtagcacaatcgtggttcatggcagccttgacttcccaggctcaagtgatcctcctgtctcagcctcccaagtagctgagactacaggcatgcattaccatgcctgactaatttttttttattttctttttcatagagatgggatctcattgtgtttcccaggctggtgttcattttttcaacaaacatttaataatcatccactagttcttggaggaacagtagtgattgaaacagacaaagactcacattcttgataattgcattatagtagcagtgtattgaggggatgggttgggagacaatcaataaataagcacaggcaatgctttagtggtgataactgcagtgaagagaaggatagtaaggcaaggcaagagagaaggatggggtggggattgctgttttaggcacagtgaccaggaaagctctttctaatgagatgatgttgggagaaaaccctgaacaaagtgggggactgctgaaaagagtgtggtaggaaaagaggagaacaacaggtgcaaaagctctaaggcaaagtgcccttggcctgtttacagaacagagggagctgatgtggttggagtagggaagtaggggaagatcaggcagagcctagtagtgatggttaagattatgaaaggagaatagagagctccccagactccaagggtacactgtgttcatttttaatagaaactaaggagaattatggggttttaggtctatataacctctccattgtcatccatatttgactttggattccacccaaaacatcagtaagtgttgcttgcccagccttgaagaattttcctctcatgagttaaaagcctcatacctcaacaatctttatacaatctatatatatgggtttctgattcttttctatttgttttttgttttttcaaatattcttctttttctcacgatccctattgtcttcttctagtcagtggctttgagctgcctaaccatgaaatgtacatttgtaaaatccatccatatccctaggatcatccagggaaacagggttatcatcttagacacagaaaggtgtattgcattgggaagggtgccccagcccaatccaggaggggaaggcaacctccagtgagcaaccagtcctcagtgatctctttcaacactggtcatcctgctccctgagtcctgggctccctctttgccatagctacctaagagtcacagtgaacaggtttttccatctaagcctgcaccccagggtttcagccttttcttgcctttgcttctcctctagaggtatggcctttctcctacctttcccatttgtgttctggcataagaaggtcacgaaatcacactctttggaaaaggttgtaaatgtgggttaccacttcttcactgggctctcaagggtagttagcaaacacttgatccccttcatcaatctcttgttgactccctatggtgttccttatagtaacattcccccccccaatttttacattcaccaaaataatagcaactaccatttatatgtgccaggcattgtgctaagtgctttatcttcgcaattgcatttaataattatccacactttacagatgaggcacctgaggaacagtgaatttcaataattttctcaagataacacagctacgttcaaatattcctagattcaaaatctgcacctttagtctgtatacctcctagctggtcccactcttgcctcctcactgttgccagttagtctcccctcctacattactgaagagatgaaggccaccaagaatgactatcttccattttatcctatctattccaaaatgtccactgtgtattaagcaccttctatgtgtcctcaaaacaattctataaggcaggcattattatagcccatcttgtagtcaagtaagatcagggcctcagcaaatgtcagggattgaacatgagcacaagcccacctggctcaaatctatgctcactctacttcaccaagcagcctcttcctatcaccgtctttaataacatctcaaaatacctttgctctttcacttatcctttcctttcccctttccacttcaggtgagggtgtgaccctccttaaatctacagcttccactgcctgccctttcctttccatcttttgttccatgacaagcattagtagcctgtgtatcttgtgctgttctgcataccagaggtttaaggcaaggcccctggactcagtcattcacagtgtccagaacacagacacgcagattgatgaccaccacacaatgtggcaagtgctatgagagggaaacctggagttccagagaggccatgagcaggagcatctaacctagagcaggcccactggggacatctctctctgcttaccctccctagctcctcccccccaacccccagtctcttctattttaaaacaaaaataaattagtttcacctgaccttctagctactgtcctatctcatcacccttctttcactgtcaagtttttcctccatgctttaccacctactctgtcagtcccctagactctggccttccatcgagttgtcttacttgtactacattctcaaaggccatcaataacctcgtaacgggcaaacccagggccattttcagtctttatcccgttgaacgctgaatcattagacatcagtggcaatctcctccttgagactctttctcctctctgtgatatggcccactattggtgcctctcttgcactcttactgcttggtctcttctgtttcttttgatggtgtctcttctataaatgtgagcactctcgcagggctcagtcgtggacttcaggcttactcttcctgaatgaccctcctctccttcacccacgccatttctgtggatgatctctaaacccgctggatttcagtgttacagtaagtaccagagacactaaaataagaatggcttaaacaagaaagaggtttatttcttgctcatgtaaaaaagtgcggagttggcagttcacagtcagtagaatagttcacaaggtcattggggttccaacttctatcttcctgctccaccatcctcagaacttggcttcctcctcatgactcagaatgtctgtctaagatccagctgtcatgaccttctggcctgcaaaagcaaggaagagatgaaaacagcaaatttccctctttttatgtatttatttatttattggttttcttctgagacagggtctcactctgtcacccaggctggagtgcagtggtgtggtcttggcttactgcaaccttgacccccttgggctcaggtgatcctctcatctcagcctcctgggcagctgggactacaggtgtgcaccatcatgcccaggtatattttgtacttttttgtagagacagggttttgccatgttacccaggctggtctcgcactcctggactcaagcgatccacctgccttggcctcccaaagtgttgggattacagatgtgagccaccatgccaggttcccactcttcttaaagacacagaagtcatatacaacacttccatttttattctgttgggctgaacttagtcatatgaccaacgttagctagaagaaagcaggacaatatagtctttactctgggtggctctatgccctgctaaaaattagtgattctattaataagaatgaaggagggaacaaatattggaaaacagctagcagattctgccacagtgccccaaataatacttcaagtccattctctctccttatcttccatcattccaagagcttacttacatggtccaccatcatctgaagtttaatatttctaacactaaactttcttccccctttgacttctttccatcataaactttatgagtttttcaatgacataaagtagaaactcaaaatatattgatgaacaattgaattctagcagatgcctctttatttcttgcctttctttgtgttatcatcaaatccagcccttcctttccattcccattatcgtcccctggttcatgcccagaagactacagtatccctaaatggcctctctgatgcagcctctccttcctgttttcctccccacacatcattactacattacaatgactaaaacattattttaatcttcactcgcaaaaaccttaatagttcccctctgcctctgatggagacctcaaactcaaggctgtctcaaatctaaacctaatttgtatctccagctgtacctctccccactctgatatgcaaatctatattcatccaattaacatcacaggttctgcttctaaacttttgttcaggatccgaggacttgagacacccctcctttccctttccatcaagtagaattctattcagccttcaaaatcctcctcaaattctactttctttgagatgttttttctaaccactacagctcagcaatccctcccttcttagaattcctaccgtaatcactgtttctaccattcacttgaatttattattcactatctcatattgcaaaggagaattgtgtgtgtgcgtgcgtgcgtgcgtgcgtgtgtgtgtgtgtgtgtgtgtgtatcttatttccctaaccgggtatcaaattccccccgaaaggcagagaatctgtctttgccatagactagcatagtgcatttcatggtaagtcctcaagatgtttttgtgccacaagttatctctgaaattagattttactaaggtcacttccagtgataacataatgttagagtccctttagcacccagaaaaataaatattgggattgattgatatggacactctttcttttaaatcttaaaatcttttaagagcagaataaagtctatccagggtacctgaaactgtccctccaggctttacttgaattagcccttaaaaatggcttttgatatatgctccagtatggccccggcatcaccaacgccatcataagggtggcctagggcaggcccaaagggcatgtaccaattgttgaagtgatgataaagaacatacgatgaatgttaatatatcagtatcaactccagaaataactaacatttattttaccttgatgatcagcaaagcatttctactcatattacatcatttgctgctcaccaaacaggacaaatagcataattattattttcattctatggatgaagaaactgaggttcagaaaggttttgtgacctgtaatcccagcattttgggaggctgaggcgggcagagcatttgaggtcaggagttcaagatcagcctggccaacatggtgaaaccccgtctctactaaaaatacaaaaactagctagccgtgatggcatgcacctgtaatcccagctacttgggtggctgaggcaggagaactgcctgaacccgggaggtggaggttgcagtgagccaagatcactccactgcactccagcgtgggtgacagtgagagagtgagactttgtctaaaaataaataaataaataagaaaggttttgtgacctcgttaaggttgtccagttcataagtagaagtacttgcacctacaccttctgcctccctatctttccactgcatgcaatggttttgcagctgcttctctcagagcacagttggagtgtttgaaggtggcagaatcttcatcttaaacatgtgcaacccctttgccttttccagcaagcaaagtattcttgccaacaacaccagcagcacaaataacagcttcccccagctttgcctacccaccacccccactgcctgattgctctttgataccccaccaacacttcctgaatgacttgctacaggagatgagacatacttttaaaactgcaccacacaccaaccactgtggctgctcaacggccctaatattaagaaggtctcagccttaacaatctacctacatacttcctggggtttagtgagagaacccagcaaaattacgagtctgtggaatctatgttctgtctctctcctcacacctaatctcaatccacagagtggtgtggcaattaagcactagggcctgacttcaaaaaagacttgagacgtgggagatctgagaccaggactggctagataatttgcgaggcccagtgcaaaacgaaaatggagggccccttgtttaaatagtatgtagaatttaaaggtggcaacgcagccttaagtccagttcagggtccttttgaattcagggttctgtgcaactgcatagatcacatgcccatgcctggaccatccagggattcacgctgggacactccaaatacccctctcctagaacccgtcagcccagaaaaacagtttatctgggaagaattaatgttcttaaattttggcaaactatgactcttaccaccaaaggcagcattagcctctttctgacccgctaccccaatggcttatttctattgcttttaccatttagcactcatcgtgttgtattgtctttcacttgtgaccacatctgtcttattttctaggctgtgagctcctcagggctgcaacgatgtcctgtttatccctgtgtccctaacacagcatctgacacataattagcagttaataaatgtttgcagataagggttcccaatttcccccttcctactcccactccacatactccccaccctgttgtatcttctgtacttagccaacccccaactaaatcctcaggccttgtcccggatactgctcctacgggaaaatctctgttggtcagaaaggaaagagctttacatcagctgttcctggggctctttcagtggttgctgagctgaagagcaagggtagccatagtgagacaacaccatcaggttaagaaatcgctttttttgtgccactttcaagggacgtgtatactttatgatccttattcttccgtataccaagccttggataaactttagggtcaacctgaacccacttatgtggaaaactgatgtctggtcatcagagcctacatgcaaccagtacacaccagaaccgctcaactagtttgtttatggctaacaccctttctgattggtcaaggcccacgtcatattggttattaaatactttggatatcatctatgcttgccccaaacagtgtttctcactaaagagccctcattgagaattataggataatgaagaagaggaggagaaagagcagaaaaataatgtcttgaagttacattgtctctcattttacaaactatatattaaatcagtttatcttcaaaagtgatagaggagagaaaagggaggagaaaataagcttttcatcttcccatgttacattttaaaagtattcatccttaagttttcactaggaaatgttccctcgattcccagaacagatcaagtccccttgctggtctctctcaaatcaccataatgcttacatattttgtgcctatccatttgtttctatggttatctgatcaacattggtatcttcctctgattgtaagtctcaaagagcaagaattatatctgtttcttctcgccgttgtatcctcagctcctcgtatcttgtttaaaagagtagatgtccaacaaacacttacattataaattaaattaacaaatacccaccatagtatctggagcaaaactgatcctgaataaatacatgcaaccattcacaaatgtatgaatgaataaacgaaacttgcttacttcagaagttgttccaagagagtctaggaaactcatgagtaaattctatcaattaattccacaaatatttattaagccccttctctgtgttaggcactcttctagagactaggaatatggaagtaaacagaaaaatatccctaaaaatcaccaacttagggaatattttctccagagactccaaagcactctctgcttctatcttccaagaaaagagacaaaagtgttacttgctttttacagagatcacaggaaaataaaaagcaatgacccaagagtccatcagccaagatattccaggttcttgttctagctcttccaccacttggcaatatgatcttgggaaagaagtgcacctaatatcttagactacgtggaggcttatggccttcacctctcaaatgccttctagctttcagagtctgtaagtctaggtaaaaatatttttaacaaaatggatctctagtgagaaacttagtttttgaatgagaatgcgttagaaaatttagttgtcataacatattaaatacacctagagtagaatgccaaaaaaaaaaaaaggcatcctcaagaaactgggtgaactgcatttgtggcagctcctcagggagctccaaggccaaaaagattaggaagtgaaaaagctgcaacagtcagatggctacagttttctttttatgttctcagggccggaagcagctggaaaagactcagaaatcttcacagtgaatgggattctgggagagtcagtcactttccctgtaaatatccaagaaccacggcaagttaaaatcattgcttggacttctaaaacatctgttgcttatgtaacaccaggagactcagaaacagcacccgtagttactgtgacccacagaaattattatgaacggatacatgccttaggtccgaactacaatctggtcattagcgatctgaggatggaagacgcaggagactacaaagcagacataaatacacaggctgatccctacaccaccaccaagcgctacaacctgcaaatctatcgtaagtcatgggaagacggagagcttgtgttttatttttactttgcaagtttgctatctgaaacacatctacatttctgataattgggtcccctaaatctttttatatctataaatacttacatattgatacatcaatacttataagaggatgtagtcttatttcagtcctgactttgcctgtttttagctatgtaattcttccatcagtagttggtcccctgggccttggttttcttttttacataatgtcaatgatcatactactcacttcccagggttatcatgaggatcaaatgagatagtgtatgcaaagtgctttaaaaaaacttttcattttgagatcatgatagatgcaaagaaggtacaaataaatatacagggaggttctatgtacccttcaccctgtgttaacaccttgcataactatagcacaatatcaaaaacaggaaattgacattagcacaatctatagagcttatttaggtttcaccacgtatgcatgcattcatttatgtgtgagtatgtgtgtagctctgtacaatttaatcacatgggtagttttgtgtaaccactaccataatcaagattaaccatcacaagattccctcatactctccctttatagccacatctccatctttcccttccccagtccctgaaaaacaaccagtttgttcacatctacaactatgtcatttcacacatgttatgtagatggaataatgaaggacgtatctttttgaggttgggtatttttcacttagcgtaatgtcactgagattcatccaaactcttgtgtgtactaatagtttatacctttttattgctagatagtattccacggtatggatgcactaggttgtttaaccattcacctcttgaggaacattttagttctttccagtttggggctattacaaataaagctgctgtgaatatatgtgtacacatttctgcatgaaataagtttttatttctctgggataaatgctcaagaatgtaattttatgataagggcatttacagctttaaaagaaactgataaactattttcaactttccattctcaccaggaatgtatgagtgatccagtttctctacatcctcactagcatttggtgttattatttttcattttggccattctgatgggtgtgcagtgataactcaatttagttttaatttgaatttctagtagttaatgcaaagtgcttttgaaaggtaaaatattataactatttgttatcatcattataattgccacaattcactgggagatgtgcgtgctttgttttgcaagctaccccaagtgtggtctgtagactggcagtatcagcatcaactgggagctttttggaaatgcgaatgttcaggtcctccccctgacctttgtgaatgaatgaagtccaggaatctgtgtttaatgttatctctggattattcccacctgtgccaaagtttgagaaagtacggacctagtgctgccctattcactatggtagcctctagacacatgcagctcttgagcatctgaaatgtggtgagtccaaattgagatgtgctgtaagtgtaaaattcataccagatcttgaaatcttagcaccaaaaaaatatataaaatatctcaataattttcttttttttcttcaatgtttattttaagttcaggggtacatgtgcaggatgtcaaagtttgttacataggtaaatgtgtgccatggtggtttgctgcacagatcattccatcatctaggtattaagaccaacatccattagctaaccttcctgatcctctctctcccccaacccctctccaacaggtcccagtgtgtgttgttcccctccatgtgttctcatcattcatctcccacttataagtgagaacatgtggtgttcggttttctgttcctgcattagtttgctgagggtaatggcttccaactccatccatgtccctgaaaaggacatgatcttgttcctttttatggctgcatagtattccatggcatatatgtaccacattttctttatccaatctatcattgatgggcatttgggttgattccatatcttagctattgtgaatagtgctgcaatgaacatacatgtgcaagtatctttataatagaatgatttatattctttggggtatacacccaataatgggtttgctggaacaaatggtatttctgcctctaggtttctgaggaatggccacactgtcttccacaatggttggaattaactaatttacactcccaccaacattgtaaaagcatttctttttccctgcaatcttgccagcatctgttgtttcttgactttattaataattgccattctgacgggcaggagatggtatctcattgtggttttgatttgcatttttctaatgatcagtgatgtttagctttttttcacatgtttgttggctgcatgaatgtcttcttttgagaagtgtctgttcatggtttttgcccagtttttaatggggctgtgtgtggttttttttctgtttgttttttccttaaacgtttgtttaagttccttgtggactctggatattagacctttgtcagatggatagactggaaaaattttctcccattctgtaggttgtttgttcactctgatgatagtttcttttgctgtgcagaagctctttagtttaatcagatcccatttgtcaatttttgcttttgttgcaattgcttttgacattttcatcatgaaatctttgcccgtgcctatgtcctgaatggtattgcccagattttcttatagggtttttatactttggggctttacatttaagtctttaattcaccttgaattaatttttgtttaaggtataagggagtggtccagtttcaattttctgcatgtggctagccagttctccctgcaccatttttaaatagggaatccttttcccattgtttttgtcaggtttgtcgaaaatctgataattgctggtgtgtggtcttatttttgagttctttattctgttccattggtctatgtgtctgtttttgtaccagtgccgtgctgttttggttaccttggccttgtagtatagtttgaagttgggtagtgtgatgcctccagttttgttctttttgcttaggactgtcttggctattcaggctctttttcatccatatgaattttaaagtagttttttctaattctatgaagaatgtcaatagtagtctaatgtgaatagcttagaatctataaattactttgggcagtatggccattttcatgatattgattcttcctatccatgagcatggaatgtttttccacttatttgtgtcctctctgatttctttgagcagtggtttgtagttccccttgaagaggtccttcactttccttgttagctgtattcctaggcatattaatctttttgtagcaattgtgaatgtccttcactttccttgttagctgtattcctaggcatattaatctttttgtagcaattgtgaatgggagttcattaattatttggctctctgcttgcctgctgttggtgtataggaacattagtgatttttgcccattgattttgtatccttgaggattgctgaagttgtttaacagcttaagaaaatattggcctgagattatggggttttctagatataggatcatgtcatctgcaaacggagacagtttgacttcctctctccctattcgaataccctttatttctttctcttgcctgattgctcttgccagaactttcaatactatgttgaataggagtgatgaaagagggcattcttgtcctgtgctggttttcacagggaatgcttcctgcttttgcccattcagtatgatattggcgtgagtttgtcatatgtggctcttattattttgaggtgtgttccttcaatacctaagttatggagagtgtttaacatgaagtgatgttgaattttattgaaggcccttctgcctcagttgagatgatctgtgggttttgtcttcagtactatttatgtgatgaatcacacttactgatttggatatgttgaaccaaacttgcatcctagggatgaagccagcttggtcgtggtggataagctttatgatgtgctgctggttttggtttgccagcattttactgaggatttctgcatcaatgttcattaaggatattggcctgaagtttccttttttggttttatctctaccaggttttggtatcaggatgatgatggcctcagaatgagttaaggaagagttcctccttttcaattttttggaataattttagtagaaattatgccagctcttctttgtacttcttgtagaactcagctgtgaatctgtctggtcctggcttttgttttgttttgttttgttttgtttttggttggtaggctatttagtactgcctcaatttcagaacttgttattggtctgttcaaaaattcaacttcttcctggctcagtcttgggagtgtgtaagtgtccaggaatttatccatttcttctatattttctagtttatgtacatagagatatttatagtattctctgatggttgtttgtattgctttggggtcagtgatgatatcccctttatcattttttattgtgtttatttgattcttctctcttttcttctttactagtctagctagcagtctctctatttttctcattttttcaaaaagccaacttctggatttgttgattttttgaatggttttttgtgtctctgtctccttcagttcagccctgatctttgttatttctcatcttctgctagctttggggtttgtttgtttttggttctatagttcttttagttgtgatgttaggttgttaacttgagatctttctagctttttgatgtgggcatttagtgctgtaagtttccctcttaacaatcctttagcctgccttgcagagattctggtacattgtctctttgttctcattagtttcaaagaacttgatttctgccttaatttcattgtttacccaagagtcattcaggaacagattgttgaatttccatgtaattgtgtggttatgagtgaatttcttaattttgagctctaatttgattgtgctatgatctgagagactgtttccctgaatgatttcaggtctttcgcgtttgctgaggagtgttttacttcctattatgtgatcaattttaaagtaagtgcatacggtgttgagaagaatatatattctgtggaattcgggtggagagttctgtagaggtctacaggtatacttgatccagagctgagtttaggttctgaatatctttgtaaactttctgccttaatggtctgtctaatatggtaagtagggtgtttaactctcccattattattgtgtgagagtctaagtctttttgtagatctctaagaacttgctttatggatttgagtgctcctgtattgtgtgcatatatatttaggatagttagcactatcctaactatcctggtaaagggtagttacccattaccatcatgtaatgtccttctttgtctttttttatctttgttgctttaaagtctattttgtcagaaactaggattgtaacttctgcttttttctgtttcccatttgcttggtaaatttttccctatccctttattttgagcctatgtgtgtctttgcatgtgagatgggtctcttgaagacagcatacaaatgggtctcagcataccagtttgccattctgtgattttttaaattgggggcatttagcgcatttacacttaaggttagtgttgttatgtgtgaatttgatcgtgtcatcattatgctagctggttattttgcagacttgtttatgtagttgcttcatagtgtcactggtctgcatacttcagtgtgtttttgtagtggctggtacctgttttccctttccttatttagtgcttccttcaggagctcttgcaaggcaggcctggtggtcgcaaattccttcagcatttgcttgtttggaaaggattttatttcttcttcacttatgaagcttagtttggccagatatgaaattctgggttgaaaatggttttcttcaataatgttgactattggcccccaatctcttctggcttgtagagtttctactgagaggtacacttttagtctgatgtgcttccctttgtaggtgacctggcctttctctctggttgccttaacatttttactttcatttcgaccttggagaatctgatgattacgtgtcctggggttgattttctcatggagtatctcacttgtgttctctgcatttcctgaatctgaaggttggcctgtcttgctaggctggggaagttctcctggatgatatcttgaagtatgttttccaacttagttccattctccccatctctttcagctaccccaattggtcataggtttggtctctatacataactccatatgtcttggaggtttcattcattccttttcattcttttttcttttttcttgtctgcctgtcttatttcagaaagatagtcttcaagttctatgattctttcctccacttggtctgttctgctgttgatacttgtgatcagtatctcgtgttgtggttttcagctccatcaggtcggttttgttcctctctaaactggctattctggctatcagctcctgtattgtcttatcataattcttagcttctttgcattgagttagaacatgctcctttagctcagcaaagtttgttattacccaccttctgaagcctacttctgtcaatgcagccatctcagcctcagcccagttctttgcttttgctggagaggtattgtggtcatttggagaagaagaggcatcctggctttttgagttttcagcatttttgcattaattctttattatctttgtgggcttatctactttttatctttgaggtcactgaccttccaatggggtttttctgaggtcttttttgttgatgctgttgttttctgtttgttggtttttctttcaatagtcaggctactcttctgtggggctgttgcagtttgctgagggtccactccagaccctaattgcctcagtttttcctatacctggaggtatcacgagtgaagtctgcaaaacagcaaagatggcagcctgctcctttttctggaagctccatcccaggggtgtactgacctgttgccagcctgaatacacctgtaggaggtggctagggacctctgttgggaggtctcaacctgtcaggaggaacaggatcagggacccacaaaaagaatcagtctggttgctttttgatagagcaggtgtgctgcattggaggctcccttccttgtccagactctctggactctccaaagccagcaggctggaacagctgagttgactgaatggcagaaatggtggccgcccctccccataggagctctgccccagggagaattcaaaactctgtctgtataaccctggctagagtggctgaagcccctgcagggaggtcccacccagtgagagtaaagcagcagtctgatctggcaaagcagctgtgccgcgttgtaggggacccttcctcctccagatcatttgaactctccaaagctggtaggctggaatggctgaagctactgaaccacagagatggcagacgccccctcctcagtaattttcatattagggaaaagaaatttttgttatattgggttaaatataatgcataatttaaaagtaatattacctgcttgttttgacttttgaaatgtgattattagaaaatttaaaattacataagtgactcacattacatttcttttgggcaacactagtttctagcatagagaacaccttggccatttctcaaagatttcactgttcatctgcctcattgcagaaaaacacagaaatgtgggtaatccatgttgtgacagatgcaattcaggtatataggtcacccactaaaatgcaagttccataaaggcagggactttgtatattgtttatcactgtattcccagcaccaacatcatcaggtacatagtggatgctccagaagtatttgttgaaaaagaatgaatgaatagtattattcccaggtttcacagtgcttagcaattgtgaatgttcgattaatataagatgattgaatcagtttctataccgatggacagcatagcggaaagaacgctaatgttgggattaggcatactttgccagctgtatgatcttgggcaagttgtttaacctctctgttccaaagtttcctcacttatagaatgtagatcgtaattgatggtattaaatgagataatggtagttgagctccctagtatagtgcctgccttaaagtaaatgctcaataactagtaatcattaattttttaatccttatcccttaaaaaaaatctcattatgaaggacttcctagatgaagaaggctctgaactaggcttgaataatgtagtcaaagagccatacccaaatgtcaaccctttagaaaatatttaactcattcgagaactttagctgagaaaataaagatggtattcaattttaagatattgatttttaaccctttatatgtttaattttgcctacccaatcttcagaaagtcttctaccacgtgcaattaggacacagtacagtaatatcttagagaaagctgtactgtatatacaataaaatctgtaccttatgggtagttagctgggaaaataaagagaaggaaactaacatttattgaacatcatttatgtgtttggcattctaatatctattttaaaaatatatagactatacatatttaagcactgtatgcacaaaaagagcaaaagataatacaatgagatgtaactctctcttctcagaggcagtggctgtagccagcttcttctgtgtcttccatagataattaatgtgcataccagcatagacagacagatagatgatagataagtaaataggtaattagaataatctttatcttcaaaatctcatttaatcctcacaacaattgtatttagggaaaaatttttaccctcatgttataaataagggagctgaagctccatgaatctgtataccttctccattattccatagctagagagcagtagagcctggattctgaaccaggtctccagtggcttccacaatcttggcttgggaggatgaagatctgtcggccatgactctgactttctcttcccagcatctttgtgcaggcaacacctctgttcctgctgagaaaagtgagatgggatcctcttctttaccactgtcccctacctcaacacctacccccaacaattggtaaacaccaagcactccctaggcatttttgtaaatcaaatttctaaagaaacacacacgcacacacacaaaattttgttcactttctactaattgatatcgtatcagtcactattatagttaatccaggtctgtaccccaaacttgttttgggtttattccaagtcttcactaattctaatatggaatagatccctctaaaagattgttaggaccagaatttctggctagcttggaatcaaacatttttacagcttcttactgttcatgttgagttccttcacaaacgcaagataatggttcttatatcttgtgtctacacttctgaatttattgcctttctagttgtgcaccagttccttctgactcctctattcccttcctcacatagctacagtggaagaaacaaaccccaccacagcaactttgctgagagggcgctgaacttattaactccaaatgtggtcattttcttattcctggtaaaagaaaagaccttaacgcttccccatgccagctccagtcctagctatcacttgaattattattgttctttagtaaccctttactagccttcaacttttatagtttactttttgattgcttaagtaaaaacattttaatgaacttttaaagaaattatagctttccaccatggatagtttttaaaaaataaagaaaatatacatacaccagaaaacagaatgaaaaaaaattttaaagattattttggctgggtgcggtggctcacacctgtcatcccagcactttgggaggccgaggcgggtggatcacgaggtcaggagattgagaccatcctagctaacacggtgaaactccatctctactaaaaatacaaaaacaaaattaggcgtggtggtgggcacctgtagtcccagctactcctcgggaggctgaggcaggagaatggcttgaacccaggaggcggagcttgcagtgagccgagatcatgccactgcactccagcctgggtgacagagcaagactccgtctcaaaaaaaaaaaaaaaaagattatttcatgtagttgtgtgctgataaatatttaattagctcttaattgggtgtgtgtattcatatatatatataaaatttatgtttagtacaaattttattgacttgaaggatgtgtagcacacagtttcattaatgataataaatatataatagtctttattgtaaattctatatagaatttattttgctgagagggcactagaggataaattccaattattcttacagaatgctttcattgatttttgctaagcatttatatccctaatcagcttatagttgtaattgatgtatgagtatagttccaacacaaacatcggttgatattttcatttcagttaaataataagaaaaaagtgattcaacaaagacatatatattggagcttcatttgtttatcaatgacacgagcgacttctttgctgaattggataatggtttccaaataccagaagaatacttcctattttttgtgctattcacaatgtaatggctacagatattatacaattttaagtttcatctgcattcctccattgctatcttaagtctagagcaacaatcatcaaaacagtaaatcgagtcctagcttatagcaattgcaaatttctgtggggtaatactcctaccatggctgattttaagacatgcagaattagaaagacagatactctgttaacaaaggacagatacaatagatgtagataacctcgagagcatagacagcaggaaaatgtcaaaaaaaggattagaaagtgatgagttttgaggatttattatctttatttttaacataatttatttaattatgtttttataatttaatttttaatgatggcttgcaaatttctgagaatttaacaattggctcccacaaactagtacaagccagctccagctcactattggctcatgtgtttgcccccacaggtcggcttgggaaaccaaaaattacacagagtttaatggcatctgtgaacagcacctgtaatgtcacactgacatgctctgtagagaaagaagaaaagaatgtgacatacaattggagtcccctgggagaagagggtaatgtccttcaaatcttccagactcctgaggaccaagagctgacttacacgtgtacagcccagaaccctgtcagcaacaattctgactccatctctgcccggcagctctgtgcaggtaaccagctctgcccatctctcctggtgagtctcagagatcactctgaggagctgcaaggtctgaacgtgggccacattctctagggagatgtgcttcctttatctttggcctggtcactgagggcatcacctcccaagaagcctactgggaaagaggccaaagccttctgagagatgctagacatttctgggtgttctgtggcagcccctgatcaactctctgattcaatttctcatcctggcttttaatagcagaaagtttagtttccctaggagctttggcactccttcggagggcacccaattttcataatgcccctgactgtgggcaaacctgcccagcctcttgggcctatttcctgagaatcaagactcactgcatcttctatttccagacatcgcaatgggcttccgtactcaccacaccgggttgctgagcgtgctggctatgttctttctgcttgttctcattctgtcttcagtgtttttgttccgtttgttcaagagaagacaaggtaggattttcccagaaggtaaaatgtggaaactcaccttctctcctcctgggactgaagccatttatccaaggtttagctgaaaggcccattgttccagggaatctgcctttttccgatctccaccccaccacctcccagaatgatggctctgaggatggtatgacattaccctgaatggtcttcagaatccattcctgagatcaccagtagctggtgggcccagaacatgggttcgagcttagtacatacatgaacaagctgtgcttcactgtacgagtgtgttcacctttccagctcagggccctcacatgtgaaatgtttggactagaggatctccagggtcacttccaatttcattgtattttgattatgactattggagagtcattgagaaacatatactaatcctgtactccatggttgtcactatgtccctctgaatccctctggatcattctgtagttgtgccattctccattcagaaaacctgatcttagaccctcaaggaatcattataccctccgattcacccacatcccatgtccacccaagaacttccttttcccaccaatcacaataaaaaacatggaacttctgcttccatgttcctgactctcctttgggtctgattcctcaggttcctgcttgaacaccttcactaagaacccttgtaagttctcagccacaaagttccttgaataacaattgggagggatggggagttcccaacagagtggttaagactaagcacgtgatttgcagtcagtctaggcgtgaaagtcccagcttgaccatttatcagctaccagtttttttatcattgtaagcttccattttctcagttgtaaaatattcacagtaataaggtgtgctgtatatacttattaagtagattaaatggaattagaaatacaaaatacttggcccaattcccagtacatagtaagtacttgataaatgttagctagtatactgataactgattggcctggggcatggtacggaggaggcattctaggggggaggggatttgtgacgtgtgccatactcaaatggcctcacaatggggagaaggcatagcctgcttgaaccacaggtgatctgcaaggtccctcaaagagatattgtcttcaatccctcgctgactcttgggaagagaaagggctattctttgcatctataaatgagacaagagagagcactcagtttgtctcatactcaccaaataagtgataggactaaactctgaatgttggagccctgtaatactgctcagctcagacctgttatttgtaggtatgttggtgccctggattatgaaggcccaaaattctggccttcttttttcaccttgaccctaaaatgttctgtgttagtaccaaagcaaaggagtacactgacgtgaatgtctcttctagcctatacattcttaaaaggaaagacttgtctactgtcttttcttctctggggcctcacacagagcctggcacatagaaggtgcttaataaatgtttattaactgtgtgaactggcagggtgctgtggctcatgcctgtaatcccagcgctttgggagatcaaggcatgtggatcagctgagctcaggagttcaagaccaacctgggcaacatggtgaaaccctgtctctaccaaaaatacaaaaaatttgctgggtgtggtggcacatacctgtggtcccagctactcagaaggctgaggtgggaggatcacttgagtccagaagatagaggttgcagtgagccatgagttggtgcaccactgcactccaacgtgggtgacagagtgagaacttgtctcaaaaacaaacaaaaacagactgtgaatcaatcaaacaagcaataaatgttcatgaaacatctactatgggcttaacattgagatggttacagcaaggtctgcaccaaaagaatgtaaaatagtatataactagaaagaatcaatcaagttaaaaaactaagaccgtgacatggaaagtcaactagccatgcaagacagtcagtggtaagtgtcagaaacatgaagggagatcctgggtagaagagctacatttgactggccacacagggaggggttggggaaattgtctttggcctaatctggactctagagtagaagagaattcccattgacctgtgggtgaggcctcagccaagtgactcctgagacattctgaggatccaagcatccatttcaaaggatggcagccatttaatccctgggggcttcctttcttcatcttaaaaagagaacattggaatagatcattgctaaaaaaaccacctttcacagactgtgggtctatatttatttgtgagacagatgctgcctcaaagaaaaccatatacacatatatcatggcttcaaggaacacccagccagcagagtccagaatctatgatgaaatcctgcagtccaaggtgagctgatgcaattcatggacacccctgtgccaccatctccatgacagggagtcatgggcagccattgcctctgcttgttgttgtctagaaagcagccacggccaagagtccagaggttccaaccaggaaataccatgtcagggaagtgatgccacggatctttctatgaggacaggaacgtgacccattgtcaccccatggcagcctccatgggctgaggcactgagtgtcccacagtgggcccggctccaggttagatgagccatgactaggagcaaggcgccccctagaggggccacacaacagaggagctactggagtgaggtgagggctgctatgtgactaccaacgtggtgaacaggttgctaagggggctacgaggcaacagaactgacagacaagttcccttgaatgcccctcctggtctagcagcagcggcttgctttcctcagactcagagtcactgttccacacccctcctcccatccgccctttacctgcctgcccctccctcccctccaccctggatcgccctctcctgtgtccccaccagcctgcctccttaaagtctgcaaggaatcaagggggagactgaggtctgcctggtcagtctagcgctgtgcttggactgatagggcagctggatccatagagcccatggaaagctaaaatcctgactgagcaggactcatcctgaaccatgggatccctcctcttggcccctgaggtttttcacccccgagaccctgcccaactgctacccattcacccccaccttatcccttcctgatcctaagcctctccagagttggatggaggcagaactgaggccaaaggggaggccacccagtaaatgtgggaccagggaaggatggtgggtagaggcagaattaggaaaggggacttgtagatgggcctgggctccctcactgaggggaagatgtgtgttttacaggtgcttccctccaaggaagagccagtgaacacagtttattccgaagtgcagtttgctgataaggtaacccctttctggctttttatccttgctttcctaactcttccagccattctggtgcacccggtccatccaaccaggggctagctggttcccctgggactccttgtagttctcaggacccactgcctaggtttttggtctatatgtacttccacccatgcacaaagccccactccctaggtcaatggccatccacgagttatcttacttgggatgctgatcccacccttcaaatgcagaagtccctatgcctctgaactacggtatgggaactccatcccgtataatacctggggtcactgctagctcacagtgtgaaaatgagaaaacaggtgcttccctctgagcaaacacaggcccatgccagatgcccagatgggtgcaatggagcagaagctgaatttcagttcatttgctccctcagctgctcttttaccacacgcagcctgcacaaccatttgtagtgccaagtgccttgtgccttatgcctgtgccttatgtccttctctgtcatatgcaaagccctctgacaggactttaaattttggggatctaaggagggattgtcactatctgaaggtcctcactgctgctacaatcaggacagctttagggttgcttaaagaatcatgttttctaagtattcctgtttaatagctgagttaccaagcaggaagctaaactgagtacgaattgagagtgatcctataaggcaatagggaggacatctatgagctcgacaagcagggcagtgctacttccttttaaggaggacttgaagcacagggcagtttgcttgaaaagataagccaaatggactggacaaccagatagagggacatttactttcttagtgatcaggagagggaaggagggaaagaaaaagaaggggaggaatgaggaaagaagaggagaagaaaaggaggacaggcaagaagtgagggtcagggtgcccagcatatttgtgccaggatctcaaggagagttggaggaacaagagtaacttaacttagaaggagataaaattcgagggattaatcatggaatcctggattgtgacatctcaagataaatccttaaagacaagttagataacaattattgggtcagtatttaattgaaaacctaagactcctcaaaccaatgggaagattgtttgcagccctctaaatgcctagagcacaggagatgctggcagtgagtccccactatgtataggtgaaagtggagttattgggatacaaaaaaactaggggtcaactaggaacaaggaatgcaggtagcttgaacctgaatgttgcctcaagtctataatcaaaatccattccaaatatgcccccgcccccattccctcccattgctcttttctgggctaagaagttaattgctcagggcctcccaaatggggggtagctggagcagacatgagggactcagcaaagaacaaggccctgctaccccagatttccccagcatgaggcaaatctaaggcattcccccgtgccatttgcttaactcctctgggaacttgcaggactggagttccccagcagcacctctcagttaacattttctcacgcttctctcctgcacagatggggaaagccagcacacaggacagtaaacctcctgggacttcaagctatgaaattgtgatctaggctgctgggctgaattctccctctggaaactgagttacaaccaccaatactggcaggttccctggatccagatcttctctgcccaactcttactgggagattgcaaactgccacatctcagcctgtaagcaaagcaggaaaccttctgctgggcatagcttgtgcctaaatggacaaatggatgcatacccttcctgaaatgactcccttctgaatgaatgacaaagcaggttacctagtatagttttcccaaacttcttcccatcatagcacatgtagaaaataatatttttatggcacactgggataaacaagcaagattgctcacttctggaagctgcatatgactagaggcctcttgtgactggaggtaacaaccctgcccagtaactgtgggagaaggggatcaatattttgcacacctgtaataggccatggcacaccagccaagatgctctgctcacagtcagtatgtgtgaagatccctggtgcgtggccttcaccacgcatcttgagcaaattaggaaaatgtacccttcgcttgaggcagatgcagcccttcccccgagtgcatggcttggagagcagaatgtgggctgcatataagcacactcatccctttgtctgggaatctttgtgcagggcataacaggcttagtaagtccaaacacagatgacagtgctgtgtgggtctctgtcagagttgtggctctcagccatgtagacacactctccaaatggagtgttggaaaatgttctttctgcagggtctagagactgctgggacacttttcttggagtgctacttcagaagccttataggattttctttctggccaagatttccttctgtatcactccaagcagcctcagcagaagaagcagccatgcccagtattcccactctccaaaaggaactgaccagcttatatttctcacacttctggggaactgggtataatccaaccatcaaaatagaagaccttgcaagaagcagagtcattctccagaaggaacttgggagatgatggtgcagatgatgaaactgggttcatcccagttccaaagactcagagaactagagtttaagctgaggcagagtgccgccaccctggcatgccccacaaacagatcaccagccagcttacacaggcattaactctcctcaatgaggaagaatcattcacaactgagcaagacattcatatgatcatttaaggaagtgtttcccttatgtgttagcaagtataatcggctaactcctaaatcccaatgaatagtcctaggctggacagcaatgggctgcaattaggcagataaagacatcagtcccagtaaatgaatccatagactcatctagcaccaactaccattagcactatgttaggagctgcaaggccccaaagtagaagatgtgcataatgtctgctcttgtgtagctcaggagacaattccagcacagacactacagttaacgctgaactgcagctgcaagtaatagcatgaacagtcagaaaaataccttatgagggggcagggctgaagctgggccttgaaggatggatgaaatttggatagagaatgaggaagacagagggcctccaagtgagagaagcatgaaaaatgagcaggggcctggatcagtggggtgtattcagagcacctctccagatgcaccatgcatgctcacagtcccttgcctatgtgtggcagagtgtcccagccagatgtgtgcccccaccccatgtccatttacatgtccttcaatgcccacctcaaaaggtacctcttctgtaaagctttccctggtatcaggaatcaaaattaatcagggatcttttcacactgctgttttttcctctttggtccttctatcactaaaactcatctcattcagccttacagcataactaattatttgttttcctcactacattgtacatgtgggaattacagataaacggaagccggctggggtggtggctcacgcctgtaatcccaacactttgggaggccaaggcaggcggatcacctgaggtcaggagttcgagattagtctggccaacatggtgaaaccccatctctactaaaaatacgaaattagccaggtgtggtggcacacatctgtagtcccagctactctggaggctgagacaggagaatcgcttgaacccaggaagtggaggttgcagtgagctgagatcacaccactgcactccagcctgggagagagagagtgagtctccatctcaaaaaaaaaaaaaagatagaagccaataagcatggtgcaatcaaattctggcaagcattaaatatcaggatgcagctgggcacggtggctcacgcctgtaatcccagcactttgggaggccaaggtgggcagatcacttgaggtcaggaatttgagaggagcctggccagcatggcaaaaccccatctgtacttaaaatacaaaaaaattagctgggcgtggtggtgcacacctgtaatcccagctacttgggaggctgaggtgggagaattgcttgaacctgggaggtggaggttgcagtgagctgagatcctgccactgcactccaggctgggcaacagagtgagaccatgtctcaaaaaataaaaataaaataaaataatatcaggatgcatacatcagaggctgttcctagtgtaaaggcactttggagggagaagactttcagagttaggcagaccaactaagaggtcagctgaagcacctaaccagttgtaaggaggtgaaagacagcaccccaagaagagatgtgcaggaaggaggaaagaggcttggtcataaaggatggaggaattccaaagtgacactgaacaggctgcgtttatcctaaaataaaaccactcctcactctgtggatgcgttgaagactcattcccaaacatctttattctctaacttgccctcttcctcttcctaatatgctcactcaagtaaaattactagtgtcctaatgcccctatgcatattgtcaaaaataaaaatcagaagcaggttagatctgttaggtcttccagaagagcaaacctgggatgaagccagagcccaggaattctgaaggtggcctttggactcaggacaccctactcttgtctctcctctcagtttctctgctatgaatctcctgattcatgaacacgttatctgttcacccttctttctaggtcttagttcttagattttccttctgtaaaatgcatgtgatcttattttcccctccacaactttccagatgaactagactgtgaccaagaggtctataaaatcaaagcatcatggaacaggatcttgtatcagaccaaagtgtgccagtttttaaaaatgtgcatcaaaatggaagtctcagagacagagccctctggtggaaagttctagtaggttaggacagtcctgcctgcagacaccttgggctttactgagggactcaactgagaaaatgaggaatgttgcagctcatgattcttagaagaagaaagtgaagcttgtttaaaatatgatttaaaaaatctgtagaacactgtaaactacacaggctatgagggaatagcctggttgggccagcttggaaatcgggcacaggcaggaaggggcctgtctggtttgggccgtgtccacagagagcacttcttaggtcctgcctggagagaaggaatggctgggctatattttcttccagactcattatttttcttctgtttgacttttctctgaatttcccttgatttgtataaattttctcaataattagtgacagtgtctactgattgtaaaatgaagcttgaaggccaggcgcagtggctcatgcctgtaatcctagaattttgggaggccaaggtgggtggatcacaaggagttcgagaccagcctggccaaggttgtgaaaccgcgtctctactaaaaatacaaaaaaattagccggacatggtggcatgtgcctgtagtcccagctactcaggaagctgaggcaacagaatcacttgaacctgggaggtggaggttgcagtgagccgagatcacgccactgcactccagcctgggcgagagagtgagactccgtctcaaaaaaaaaaaaaaaaaaaaagtttgaagaacaaagacaataagaggaaatataatgagtggtcataaatgtgggctctgacagtagagtgcctgggtctgcatcctggtttcttagtcatgtgaccttaggcaagttactttaacctcgctgtacctcaggt

SEQ ID NO: 12300 - DNA, 14438 bp, Human
  misc_feature (1)...(14438): n = A,T,C or G
tgctgagtgaatcaaagggtgagataccatggcctgctgggcctgctgcctggcctgggagagcctccttgccacattcttggcattttcatggcatttcagattctagacctgttagtaagtacagcatctggatgcctgagaataagcccaagccattctggggagtactgcagcagcgggtcccttccagggacgtgtgccacttggacaggcgcaaagccctgtaacaggattacaacccatgttctgctggccttttattttgtgttaatggtgaaatgagattccctgcatttcaaatcctattacttttgtttgtggagctgaaacccattggtcttttattattaacctctgagcttggtttggcccctggattttctgtgttcttgatggtgaaagaagtaactggctcacgcaggggtttgactccattctcttttccagatggatcactcgtctcaacagcatcagaaattaaaaggttgcacagcccttgtggtgattataggttatgtgattctcaaaggtttaggagtttacgggttccctgtccatccattcactacatgctcacctatccatccatccatccatttatccatccatccatccacctatcacttcatccatccatccatttatccatccatccatttatccatccatccatccatttatccatccatccatccatttatccatccatccatccatccatccacccatccatccgtccatccatttatccatccatccatccatccatttatccatccatttatccatccatccatccatccatccatccatccatccatttatccatccatccatccatccacccatccatccatccgtccatccatttatccatccatccatccatccatccatccatccatccatttatccatccgtccatttatccatccatccatccacccacccatccatccatccatccacttatcnnnnnnnnnnnnnnnnnnnnatcacttcatccatccatccatttatccatccatccatttatccatccatccatccatttatccatccatccatccatttatccatccatccatccatccatccacccatccatccgtccatccatttatccatccatccatccatccatttatgcatccatttatccatccatccatccatccatccatccatccatccatttatccatccatccatccatccacccatccatccatccgtccatccattcatccatccatccatcctcccacaaactcaccaagcctacaatgcaatcaattctgctgtaacatgaaatatacatttctaaaaattactgtgcaacgcaaaatcttgctataaaaatcacacagcttatgggaaaatggggtcagtgtcacatcaaaaacagaaaaaggcaagaatgcagtaaaaatgaaagcatggttttaaatatgttaaatgctttagaaatgcacaaatactacaataaaaatggcatttgaccttgaaaatgacctgcagtttgcttgtggaagtgggtgtcggaagaggtgcagcctgtgagtgattgtgaggtggtgagggaaaaactgaagtcaatggaaagttgtaccaccaggtgtggacaggtgtggcttataatagtaaactgagggtgccgtggatgtctgaggcgcatgtgttttgtgtattcttatgtgggtgcagttttcttcattcacccagtgctcctcgtggatgaaattgcacctgaacaaatgcaaaatttatgttatgctcaaattgttccctaatacttgaatcatgttggaacaaattctcgttttcaaaacaagtactgtagcagaattgccctgtgccaggatataccatatcatacaatcctgaccccgacttctcaaccattcaaggtatttccaagcctgaccacctctatgagactgtgtgtggctcatgggtgcaaagccaaggatttatttttttatttgtcaaaaactcatcttgagccaagcactgatagtactatttatcaatgttgatccatttaatcctcttaacaactctataaaagctaggtatttgtaattaatacccattttataaaatgggaaactgaggcacagaattgttaagtaattgaaccaaaatcactctgctaggagtggcagacctaggacttgaacctggagagtctggctccaggattcaccctcctaagcactgcgttatactgtctctatttgccctgaggggacctcagccttgcccagagcaaagcacagggatttgcaggtcaaagctacggggtcaggcaggcctggaactgaatcctgactccaccactcactagtcgtggaggcacattcttcacttctcagagccttggtttactccccaggaaaacaggaataaagaacaataggataatcccagtgctgttgtgagtattaaatgagataaacgccttagaacagagtctggcatactcaaatgctcaagaaatactagtgcttataaaacaaaacaaaacaaaacaaatccctgtctcctagccacagatgcatccagctctgctttgtcctttgggcacgggaatgctgctaaatagtagaggtggggaagaaaagggggttctgaccacccacccaggctcctgagcctttggtgattaggaaacagccttggtagaaccgtgaccctgagcccgggttcagtggccctgccactgccttacactctgcttccctgggctgtggacacagtgacccagacactcagagacctggatgccgatgacccagacatctcgggacaacaaagaacagagggaagaagcaggtgggtgctgggagccagcctggagcgcttctgggtcaacagagaggatgccaaggccctggattctgtgtgctgaaggggcgggaaggagtgaaatgtatgcatgcttctgctcacacacacccacctattattcatcagaatgtgcagagcaccaactgtgggccagctagacaggcattgaactcagtgtctagtgggacagacagacacacatgtgacaagatagagagtggagggcactgtggtgggggagggacaggggactgtgagagctgctgatacagccagaggaacggtaggccctacccgttccattccacttctgcccacgcccaggacagacattgctaatcaacctcagctctcctgccaagcctggacttggctccagaatccttctcaacacagcactccagggaaccactatcaattactggtgttggcacatgagatacagcctttgtgccagttctcagctgaggtctggagaaggaatgagtcagagggtgaagggggagcaggggtagagaaggaagtgccaggtagagggtgcaatggatgcaaagacctggaggtgagaaaagtgaagggtaaaggttcagggtggtggagtccccacatggatggggactgggagaggctgggaaaagtcagaagaataagtgctgggtggcaaactgtggtgttcaaccaaaaaggagacctgtaggtgtccaggcaagagcgatgtatggccttgaccaggagatggaagtggggaggaatggatggattcaagagatcattaagaataaaatggcacagcatgattatggattgggaatggattatggattggagagggggaactgtctgcaagaaccccagatttctggtttgggcagctggggagatggtagccctgtgcacccaggcagtgtagcaggctctgctgggccatccccccaccccttattatgtcagtgcttgctgacttctaaccgccagagtctgcatgcctttgcccaggcttctctggcccctgaagagcttctctagcctcaagagcctatgttaccacaggaagagccagagttaacagggagcagccactgctcagtaactcgttaagagctggaatataaatacctcagctccctcacttcctgaggagataactcccaggtgcatgtttcacatgggttccgagagttccccatcaggattggctctggttgcccaccaggaaagctggcttcttaaagcatgctttgttgggtgcatcacctctctcccacatgctcctctgctattattttctagaatcacctcccaggtgaatcacttgcacttgaacccatgtctcaggtctggttctgggaaaacccaaactagaacacacgtcaatagggagtatctcaggattagggcaggtggggagtatggtatgtctggaaggttctgttctcacggccccatctcagagggcttgagctctagctcctgcccttttcctgggtgagatgggcctggcctggtggcatggctggttgactctgcatccttaacccacagagctccaatttctgatcaggcagaaacaggctcaaggaaagaaagcccttccccagccccaggggatcaaccacaactggcccagcatgaggcccatggtgtggaaagagagaggggctctgggtccttgatggcatccttgaactaccaaaccatcctggaagcctctacttccaaaaaacttaataaatgcaaccattaaagagaaaaagagtgtaaacattaagggcagatacccaatgcccggatttgaatcccagctcagccactgactggctgtgtgacgtggggcaacttatttaccctctctgagcttccatttcctcatctgtaaaatgggaatattaacagtcccattgtcaggttgttgtgacaattaaatgagtcaatataagtaaaagcccagcacagtgtctgcacatagtaagtgttctctgcaagagttagccacggccattattaccattaagccagggcttctctaccttaatgtgcatacaaaccagctgggggtctcattaaaatacagattctgattcagtgggtctggggtagaggctgagattctgcatatttaacaagctcccatgccagtgtttctgggctgtggatcacacttcgaatagcaagggctgaagccattgtccattggtattacataacccgggactcaaggcatcctcactgacagagcgacccaacccacaggcaccccttccccatccctgacaccttgctgggaacacaacatttcccaagttttctatacctgtcctttgcagctctccccacactgctagttgcttagtcagtgcccaagagtggaagctcatggaggacaaggtatctgaggtgcctgacccaactgcctggcacattctaagtgctcaatcacatctgctgaaatgaaaatcctgtgcctacctgcaggaatacatacgcctggtgatccagcgcagtcagacagacccagcggtgccaggggctgcagccttgcgggggtgctcaagtggggctggctccctgtaagcctcagctgggctggcagaagcccaaggggtggggagaagggagaacagtcccttcctgtttcagagcccggcatttgggccaaaccagtgcccaaaatgcctacagaacaagaagtctgaccacagctcaatgtccccacccattccttctgtgtccctacctcgcccaggtgttgggcaggtggcagcgcctcgcctggctgggatccaccaacactcagctcttttcaggaggccaagactgtcccctgctgctggacccgtcaccctccaacccacctgatacctcctcagttgggctcagaacacccacctcaagccttttagtaatcgtaatcctcacagccaacacttactcagtgcttactctgtgctaagcactttatagacacaactgtatttggggtggctcactatatccgttagaatgcaactgaccaaaacagcaaaatagccaacaaacagtggcttaatgaacaacaaacaataatagctaacaattacagagctggtcactgtgctaagttcttttacatgtattaacatattgaaccctcacaactctgtaagtgtctgcactgttatgtcccctttctatagatgaagaaactgggctcagagaggtgaagtaacttccccaaagccacacagctactaagaagctgaaatgaaccacataccagggcagtctcgtttttgagtcctggctttgaacctgtctgtaattagactctctggtcccttaaaacccattacagcaaacagtaacaagagccatgttccaaacacctatcacctgcaggcatcacctcgtttcttcctcataacacactctgataatgctccccttggtcatgtggcctttctgagccttcatctcctcttctataaaacggaaatgcaggtttgacttctctgctgctgctcactgaagcacgttgcccttcccacaatctagtcctccagacctgcccgtgaggctgacagatatttactggcctcaaacatgagagaggtccactgatgtgctcaagcccacccaggggcatgagtggcagagccaggattaggacctgagcttcctgactccctgagactcacacctgtcagcagggccccactgctccccagatgctgagaatatcttcctccaagttctgctgccttgccatgtttctcaggttaaagaaaacactggctcccttcctcctcctcctcctcctctcccttccgctgtcctcctcctgttctcgcccacgggaaagtctcgctaggaggtgggtggaacagcagcatctgctaaggcaaggccattcacgaggctgaagatgcccagtttaggaggggctgggggtggggaaggcttttagccagcagaagcccccagctgaggggcagggccagaatgaagggaagcaaaagtggaggccaagccccagccccacctctcagtggctgtgtgtctgtccttgcacaagtcacttagccagtactgttcaaacgaattttctatgatgatggaaatgttctattttctgcaccacccaatatggttgtcgctagccacaagttgctagcgagcacttgaaatatggctagtgcaatagaagaacagaaagtttcatcttatttaattagccacatgcttctagtggctacttttctggacagttgtggaatttaacttttctaagcctcagtcttcccatgtgcacaagaatcatgatatcccaccccacttccctgactttagacgatagctaggaccatgaagcgatgcagtgctgggaaataacccctggctgggagtcaagactcctgggttccagacctggtaacacacttcatgatgcagagtgagctctttaacctctctgagtgccctggtcatctgtatgataaggaagttgctttggatcaaagtttctttgatctagggatccatggatggttttaggggactctgataacccctacagttatgagaaaagcatgttcgcaggactgtgtgtgggagaatgagggtgtacatgcactgagggctgtgtgtattgggggaaactgggcccaatgctttcctgaaattcttaaaggggtctgtgaaaatgagaaacccctagtctaggtgagttgctctagggtaaaagctttttaacagtggagttctcaggccacactcccagagactaagtcagcagcctggatgtggggtcctgcaagctgcactggtaacgtgttcccgtgattctgacgcggagcccacagagggaaacgctggcaaggagccagccacactactgtctagtgagctgatgctcaagaaatgcctttataaagcagtagtatacatttttcaaaaccaacgggatttaggaaactaaaaaagtaaagaggaaataatgatgataataaaacccctttctacccctcctttatttcttaagcagcactaatatacagcacttagtgccaaacactgctttatgctgtgtataaatatcacccctgcattatatggattgtaaacgtctaatcctcataacacccctatgaagctgatgctgttaatcccattttacagatgaggaaactgtggcttagagaccttgcccaaggtcacacagcaggaagggggtggagccaggattcaaatccaagcagcggggctcgctctccctcggggctttgctgttacactgcctcccttctgaagatgggggatgaacctggagccctgagctggcgctttcacagcctggagctgccctagggctcccagaggggttgctcagtccctcccgtgccccaccacaaaagactgcaagaaccaggagggctggtggccccacacttacttgccctctgagccatagctgttcatgctgtcctcaatggactcgtggctggcctggcgcagtgtccggctgggcatctccactgccaggcccgtctccgtgctcctctggatggcccccttcagcctccggctgtccccttctgggcaaagcggccaagagagatgggaagagagacacaggtgggagggggacagagagaagagtcatctggttagcagtgtttcagcagctgggggctgtccagcttcagcctccaccctcagcccatcaacctcctcagactcctggcctcaccagtaaccactccaccaacaaacagtattgcatgagttctgttaaacgatagattcatttacatgtgctttttctcccccttgaattcatttctcccctgaaatcttctccaaatcatttctcttcctcctcttcagctactatttattgagcacctactatgtgtcctactgtgtcaagtgctttgcatggattttgaccagggtttcttgacctcagcagactggctgtgtggatggcatattgctttgcagtaggggctgccctgggcatcacagaatgtctaacagtatccctggcctttgcccactagatactaatagcaaccctcaccccaccccgctgcagtccagttgcagcaataaaaaatatctccagacattgccaaatagcccctaggcagcaaaaatcacccttgattgaggactactcgcactgaaaccagatggcatgggttcaaatcctggatatctatctcagtggctgggagacttaaggcaaattactcagcctctgtgtgcctctatttgcacaactgtcaagtgggagaataacaggctcttatgaggctaaatggcccccatcagccgcccactccttccattctgtggtcaaacatcatcttatccaagatctttcttgacctctcctggcccctccaaaacagcagccttctcccaccccctgcccctctctgccctgactcctgctttggttttcctcctaacacttaccacccaaatgcgttaaacaatattggtgttttggccagcttcctctgcgaagaccataaactccatgaggacagggaattttgttcactcttgaagcctcagcaccaagaacagggtctagaccattgtagagctcaactaataactgtggctgccttgagagcagccttaatcctcacaaccaaccgtaaggtggatgctgctgttcacccccatccagtacccaaaacaggaggcacggagaggtcaggacttgtccacgcccatagagctagtaaggtggggagccaggacacagccccgggagggtgtctgctccctgctccatggcctagtgattcaagggactgtaggcttgctagaggtggggtagatcattagtgggatctttttcatggtcccacaaagtccagacatgggctgattcccaagaggatccttcaatgcttgctgattgacccactggggaaaagcagccccaatcacacccagtcatcctcctcctgccagaggacaagagagctgggcctgcgtacaggagcagggcaagccaggacagctcccgccggccttctcctggcctccctcctcctcccagctccaggatggtctctccttcctccctgcctctaagaatcacacacacgtgtacacacacacatgcatgcgtagatacaaacactctgtttctcagaacgtgtagcctcgtatttctgtctcccacgtgtctttgttattcagacacacagacacccacactcagaaaaacacagcaacacacacacacagtaagatgcatgcaaagacagtgtgttaatgcaggtctgagtgtgctcccaggggtctccacatgcctgtcgctctgtgtgtttgaggctaagtgggtaggtgtatacacatcttccctgcgtgtttctgaacacgtgggagagcgtgtgtgcccctatatctgtgtttctactccattccatcatctgttctttccctagcttgcatctgcagcctcccccgaccctctatctccactgtttctgttatttctctgtgtacagcaggtacagtgacacagagaaagaaagaaccactcacatgcacattcagaaacagactcagacagagatgtccctgtacacacacacacacagcactgtacatatgtccctgtcagacgtgcaggaacaaacaccccccccacaccccacactagggatacagacccatgactgggcaccctgcaggcaggcagcacacacctgcctcggctccctccctctctgctgagcgctgttcaggtgcccccaccccggatccatctccacctacctgggtctgacacatttctcccggaagagggaggagcagagcatgacaaacaactcagtcccccagagctgtgccttgcatctgtgtggcatcctacagccctcaaagcagttcccaaccaggccctaggatctgcctcccagcagccctggctccccacacaggtgagcatgcctttgcagtcagaaggcccaggtatggagacccggggcaagctggacggcatcttcccacggagctgttgagaggcttaaatgacagacgtttcccatagtgcgggcacaaagtaggtgccaaacataaaaagccaaaccactgcagagggagaaagaccttccaatgcccccacacctgcccttgccaactgtcttgctgacacccttgtagactcatttttttcccttgacacaccaccttccccaagctagggaccacgactggacccaaccacagcaatgtccaccatccaacctctaccacctacccctcctgtgcatcctctcttgctaactgggccatggcccccaaagtgactgttccagtgctttcccaactacccccaccaagatccatccatcccacgtggctgagatgtgttccctttgttctgctcttcctcacttccaaatgtcactgtgattgttaatagcgagtgtcaactcgattggattgaaggatgcaaagtatcattcctgggtgtctctgtgagggtgttgccaaaggagattaacatttgagtcagtggactgggaaaggcagacccaccctcaatctgggtggcatcatctaatcggctgccagcatggccagaataaaagcaagcagaatgtggaaagactagactggcttagcctcccagcgtgcatcttcctcccatgctggatgcttcctgctctcaaacactgggctccaagttcttcagctttgggactcagactggcttccttgctcctcagcttgcagactgcctattgtgggaccttgccttgtaatcgtgtgaatcaacactccttaataaactctcctttatatatacatctatcctattagttctgtccttccagagaaccctgactaatagtcaccatcctgacctttcaccctgcctggccctcccctcctttctgaaaggaaggggccgtccttctcctggctgtggctgatccatctccatcactcaccatgacctcctcccccatttgtcctctctgggccttgcgtctgctgcctctccatcctcgggccctttctagttctcccacctctttcaccaactaacttcctcggagaacagcctctggccaccaagtcacccaccacaccctctctgatctctcagtgtggctccagcccatcgatccatcagggcggcttactaaaccattctctagtgactgctcaccaccaggtctcaacccagctcccgggccctgaagcatggccctttcattctctcaacagacatctattgaacacccttttgtgaggtggaagcccctgagatgttaaacacgcttctaagtgctgcacctgctgataaaacacactgacgggagccagggagaaatgaacagcctctgcttgtcgtccaccaggacccagaaatagaccctcacttgacccactgtagtgaacaatgtgatcctcctccaagaccccctttttaccacttctgtgagcccctccccactgtagcatgctatgtgctgtggcttcccacagccagtacctggcacctttttctggggtggggtgtgggggtgtctttctttgggctactgagcccatgttgcccccacacaggcagagctagaagtgtctggaaatgtatgacccttaacctgcccttgccctgccccttcatcaaagactaaatgaaatgggaggatgaaccctcacctcctctgccctgggtcagaacaactctgaggcttcacgcagcccccagagtaaccccacagcggggctggggccaccctttcgggacctgcctgagagcacaccattgcgtgtctcctgccctgtcttgttctgcttccctgggtctgttctgggggcacttccttcattactgcctccacacgaatctcatctcagggtctggtttggggacacctgacctaagacaggctggcaccctaagcaagtaaaagttcaaaaatcttcacacaggtgggctcccgcatcataactgtagttgtacccatttacacccaaccagcacattgggaaggaaatttatttctcttttgtatgcttctatgtcatttgaattttaattaattctataatgcaaatgaaagtaaatacaaacaaattcataaataaatcacagcttcagtcatgccaccatcttatttaaaaccttagccaggcgtggtggctcatgcccgtaatcccagcactttgaaagacccaggcaggtggatcacttgagcccaggagtttcagaccagcctgggcaacatagcgaaaccccacctctacaaagaaaaaatacaaaaattagccgggcatggtggtgggcacctgtagtctcagctactagagaggctgaggtaggaggatcgcttgagcttgggaggttgaggctggttgcactccagcctgggtaacagagtaaaatcctatctcaaaacaaaaacaaaaacaaaaacaaaaacctcagaatgtttcttcactgcctgctgaattaggttcagtttttgcacccaggcatccaagactctccattttctgactccctccccatcagctactgctctccctcgcagtctctatatcctagcccagccagacacctcagtgctccatcctgagaaatactgtacatcctcaataacttcctcatcctggttctcactcctctcctttcctccttatcaaatttctaaccatcctccagagtttagctttaaataacacctataacttatcaggcactctgtacttcagtttcttcatcatataatagggataaaagcaccagaatctcagggctatgtgagcactaaatgttaacaagcaagcaacgtaaaaatgtaataacatataaccctcaggatggcctaggtgggctgggacacacggtcagccctcaacaaagttgactattattaatatggttattaccattgtgctagatgccatgccaagcgttttacaaaggtatctcccacttaattctcacaataaaccatgagatagctactgcccccctttacagagaaagaaaatgaggatcgagaaggttaagtaactttcccaaggacatgcacgactactaatggtggagctggacttcaaacccaggctattctggctccaaagccatgttttaaatgcaccctaaagtaaactctccaagctccatcccagaactcaaatgccatgtcttccacaaagacgtccctcatcagactccttgagtcccggggcacttcaatcttcacttctcttggggtaactattccatggcaccttgaaacacagttctcatccacctagtcgatgtcagtgtttacagcgtgagctcattcgtcatttacttccattcagcaccagggatagcgcccacactgcccatccccactgaaagtgtgttaaattgaattggctttaggatgtgtccccaagaaaaatggaaattctctctggtaaagaaaacaagtagatgtcactctgctgtttatacttgaatatgaatgtgtttaatgtacgttctcccaaaagcaagtattcataaggaacaggataataaaacgatgataaattatgaaaacagattctattgtttttag

SEQ ID NO: 12301 - DNA, 42894 bp, Human
ctccaacaaaagaaaattcagactaactacagtttaaacaataaaatattaaattatttcatgtaatgagaagtctgaatggtggctccaacaacaacatgaagtcccaacgactcagaccttttttttgcttccactctgccatcctcaatttgttgactttttattctcagcctcatatacccaaaatggctgctgcagctccaaccatcacatttgcacacaaggaaagaaaagaatgagtagatggtcattctcttcctgaggaagggaatcttttctagaagaccctagcaggtttcccttatgtctcattggccggaattggatcagaggcacatccccaggtcagtaaatggagaaatcatgagcaccatctcttctggggtcatgtctatagggatcataaacctcttccatgaacacaagcctgctgctacctccaagcagccacacatgcttcagcatcccttgttaataagctacaggaaaagagaagagaaggagtaactgtcatttaaacctcagtgtcgagtattcctactgagacctggagatgctgagaacttgccaaggtgtgagaggagttgcaaggaggccattgtggttgggcatggtgcacgaaagggagagaggaagaagtgtacagggagctggctggcccaggggccacgccaggactggggactctgtgctgtgtgatgggcaggctttggacagttgtatccagaagatgatctatacatgacgctagttcaaggattgctctgagatgtgtggatggtagaaggtgggcagggaggctgggtatcagtcaggaggctgtggcagcggtccccatggggagcacagggctggactaggacagcccatagaagacatcccatctcctttcttgcccaaggaagagactcagtggcagcagtgcaataagggtacaggccaggaaacccaaccccccagggatagcaagcatccagagacacgtggggacagctccagcaccaaacggcttctgaccaatgagcagagacggcaaacagcaaatgcgttaccgtggctttcacgtgtcatgaaggtgatgctgtaacctgagcctcagagctcattttatttgtgaattcctatcatctctagatgggtggactgaaagccacctctttcgcttgcagctaggtagaggggagtgcaagagggcaaatgaaaaccagaagtagggttgggcgcaatgcctcacgcctgtaatcccagcactttgggaggctgatgtgggcggattacctgaggtcaggagtttgagaccagcctggccaacatggtgaaacctcgtctctactaaaaatacaaaaatcagctgggtgtggtggcacatgcctgtaatctcagctattcaggaggctgaggcaggagaattgcttgagcctgggagacagaggttgcagtgagcagagatcgcgccactgcactccagcctggccgacagagcgagactctgtctcaaaaaaaaaaaaaaaaaaaaaaaaaaagaaaagaaaagaaaaagaaaaagaaaaggaaaaagaaaaccagaagtaggagcagcctgaagaaatgacagggagttgatttcccactgggagccctctcaaagcccacacacccgcctgcctggggtaacagtatctcctcggacatcctgcaccctcccatgctcccccctccctacagtagtgaaagacctaggcaggatgaccccagctcctctgtgagaatttcacaccctagtgtgaagtcatagccttgtaactttccctttaagaactgtcagagctggggaggctggccaagctcaggctggaggtggggacagagggaagaaagaaaaaaaaaaaagagagagaggcaggaaaagttttttcagaggaaaatgcagggtttgtccttcaccctgacgtcagatcttgctttaataaaaccccccaagggctgcggaagaggcatatctggtgctcctgatgggccggccagtctgggcccagctcccccgagaggtggtcggatcctctgggctgctcggtcgatgcctgtgccactgacgtccaggcatgaggtggttcctgccctggacgctggcagcagtgacagcagcagccgccagcaccgtcctggccacggtgagtcctgcctggaggggctcagagggagacccagctcccttctctactgggtcctgctacatgggggctggtgggcaggatgaaaagggccaggaaggtttggggctggaaggtggccacttacagggcaaggacagagcccagggtgaggagtcagctgcccaggttggctgaagctggcagggtgaggaggacggtgcgacacttggggaaacaaactgcacaggtccagcctgccctctctccccacctgaaacagtgcagaaagaacggggccctcagcagaactgggagtcaggggcccgggctccagacccgtcttcgcctaacctggctgtgtggcctcgggtgggtcactcaccctccaggagcagcgtaaagcgacgaagttgttaggtgacttctagagtctctgagtttgaaaactccaagactccaagcattggagatgctgcgaagatgggagatggaaaaagccaaaaaaaattggaaagaaaaatgccagctttcaacaaaagctccttattgagcaaacagtgctcagggtgatgtctaaccccaactgctgtcacctccggtctgcacagccctctgcagtctgcagagtgtccatacttgggtcctgcctatgaagcctgctgttccagggtgggggtgatgtgggcaccccagagtctctctctcttccacctgcaccccagggtacaccaaggggaagggacaaaggtctgcacctccaaaagccaggggagtcacatatgtgaccgtgtagagccagcctgctagggccaggcatggtgaggaaaaggcagaggcaggcagtgcaaggagggcaggaggtgggtacctggcagcttctgagccccagattccacagcccagggcaggacctgctcctggcagaacagcctagagacggaggggtgatggcaaaagagtgtttatccccaaatgacactgatggcttccttgggggttaagaagcccccttcacagataaggaaaccgtgtgttggggttaaaccacttgccagaatcagactctaggtctgcttcagccagaactgaggccgagagccgacagcaaactgagacctgggaaataggaattcctctcaatgcctcggtgtgtgtaatgatggcggggagtgggtctgtttcatcttggttaaatcctcacgcctggcatggtgcctgactatagttggttcagaaccaccttaccagaaagttatcagctccatttcacaaatgaaagaaatggaaagtgagagcaagtaaaggacttgcccaggagctcctcattaataagtggccagggcccaaacttagatcttctgatgccaatttctaaccattcctacttaggggaagctgactgtgtcctacaggagtgcccagaaggagctaagtcgctgtttatttcggctctgggtatggctgcgcctttatttgggtatagctttgcaggttgctatgtctgggagggcagggagaggatggagaaaaggtgagcgtttgagagaagccaaagtctgagtgggcagaggaggcgagaggtttaagcatgagtccaagtaatctggagccccagtcagctcccagaacagccggtgctgaggaggagtgaaggacagagccgaggactcagccagaggagaccagcaaaggagcagagcgtgtggagggacccagggagcaggttggagggaaggctcccgggaccagcacaaggtacctctcttttaggcagcccctgcctggggaacccagaccacccaccccatgcttgtttcatgatttagatgcttctgggacagaggtgtgcacggcactggagttctcaggatgtcttgaaagccccgccccctgtgtgggctgtgagactgatagaaacgagctggactccatttggaaaccagccttgtttcatagccaaattccatacatggtcatcctcccgaattaatatgcaaagggagcacatgtccaaccagggtctcagtgagatcttaatggaaaaaattgttgtaaatgttcatattgaagaaaatgcatgtgagaattgccaagaaaactttgaggaagtagagttacaagggggacttctctgggagatatgaaagcactctgtaaagattctgcagtggaaggaggaagatggcagcccagaaggagatcagccaaggaggaaggcactggagtgatctcaggaacagccgagtgtatttgggaatttaatctgtgctaaaggtgtattgcaaatatgacttatgctttcatctctttattcttttcttctgcatttgttgagcatgtccgccatgtgctaagagaaagggactccatttaatgtgcattagcaagcactgagccaacacatgtataagaccaacctcagttcacccaacaaacatttattaggcacattctacaattcccataacaatattatttagcaagtgcaattatcctccttaacagatatgaaaactgagactcggagaggttaagtaatttgtcaaaggtcacacagctggtaatcagggaagctgacatttgaaccttggtccagctcttggtaatgtagcctcctgcctccctggtccaagggcagaaaccaggggcatgtagtccctgcccgacagagtttactggctagtggggcaggtgacaggggtaacgtcagccagagtagaggggctggaatcaggctctgccactggctgtgtcggccgcactaagtcccgttgcacctcagacctcactttcctcgtttgttaattgggactaactgtctcaccacaccaagctccctgctgctgaacgtgaaaatgtgcctgaggaaaacctctcagaagtgtgtaattcagcaaacgaaagctgagtgataaaatcctgggcaagcattaggcctgtggtggtctatgtataggtctacaggtaaaacccacatcctccctcctgtatcagtgcatgtgggatgtgcatagctgcactgtgtgtgtgtggggtggggtgtgtttgtaagagggtgtgtgggggtatgcgtatggtgtgtatgtggggtgtgtctggtgtgtgtgtgtggtgtgtgtgtgtatgtgtgtgcctgtgtggtgtgtgtgggggggtggtggtgtgtgggggtgtgtgtgtggggtgtgtgtgtggtgtgtgggggtgtgtgtggatttgtgtggtgtgtgtgtggtatgtgtgtgtggtgtgtgtgtggtatgtgtgtggggtgtgtgtgtgtgtggtggggggtgtggtgtgtgtggagcatgactgtggtgtgtgtgggggtgtgtgtggtgtgtatgtggtgtgtgtgggggggtggtggtatggaggggtgtgtggggtgtgtggggtgtgtgtgtgtgggtttgtgtagtgtgtatggggtgtgtggggtgtgtgcatgtgtgcgtgtgtggtgggggatgtagtgcctagtatggagtctgtgtggagggtgtgtgtggtatgcgtggggatgtgtgtagtgtgtgtgtggtgtgtttgtggggtatctgcctggagtgtgtccgggggatgtgtggtgtgtgtgtgtggtgtttattgtgtgtggtgtgtgtggtacgtgtgtgtgtggtgtgtggtgtgtgtgttgagtgtgtttgtggtgtgtttttgtgtgtgtatgtgtgtggtgtgtgtactgagtgtgtatatggtgtgtttgtgtgtgtggtgtgtgtgtggtgtctgtgtatgtgtgtggtgtgtgtgttgagtgtgtatgtggtttgtgtgtgtgttgtgtgtgtggtgtgtggtatgcgtgtgtatgcatggtgtgtatgtgtgtggtgtgtattatgtatgtactgtgcttgtgtgtgtgtggtgtgcgtggtgcttgtgcatggtgtgtgtatggtgtgagcatgtttgtggtgtgtgtgtgttgagtgtgtatgtggtgtgtttgtgtatgtggtgtgtgtgtggtgtgtgtatggtgtgtgtatgtgtgtggtgtgtgtcagttgagtgtatatgtggtgtgtttttgtagtgtgtgggtggtgtgtgtgtgttgagtgtgtatgtgttgtgtttgcgtgtgtggtgtgtgtgtgtgtgaaccttgtgtttgggtgtgagatacaaactcattctctgcttccagaagcaactgcagaataatgtgggtcaagtgtatggcaaaatatcccctttagaaaacagagaatgtgaacaatatgtcttttcacacctcctgtttagagttggaatctgagtgaagatttcaaaccccatccaggccccacacccccaactccccacccagagcctctttgggctccctgaagcccctgctgccagctcagggcccctccagccgacagcttatcttggaggctggcacgaggacggcactgaaaggcatttccccctcggcatggcatttggagaaggagtgggcacgggaacaggcctccgcccaaccagctccttgagagacaaaacgctaccttgtgggctgagcagcactcctggctccacagcaagccccaccaaccacccccaggttttagaaaaggctccggccctgtgccagcaaagcacccacatgccaggaggctgcccttggctttgtataaacagcaacccagggatcttcccaggaacctcagccatcctctgggcagcagggaggcaaactccaagggaggtgggctctgatatggaagcaagggtggcgaagcagccatggtccaggtgggttcctgggaggggctgagaagggtgccaaccacaaccaggaagcaaagcgagccagcaagggtcaccgtggaggtttcaaagcaaggcttcagcacagctgtcccctcattcaaggacactgtggtgggccctgcatccctgtgatgtggatggtggcaagggttcacactgagcatgtgcccactctactctgggcacagtgcccttttgcacacacctatgaggcagcggtgttgctgtaatctagaccagccagtcagtagccacgtgtggcaggaggccactcagcacttgaaatgaggctggtcccagctgagatgttccggaagcataagatacaccattgattccagagacatggtatgaatgtgagagcgcaatattcccattaataatttttatattaactccatattgagatgataatattttgaatatactgggttaaacacaatctattattccactaaacttcatctgtttcgtattactttttaataccgctactagaaaatgtaaaatttcatctatggctcttattgtattttactagatggtgtcggcctagaaagacacaagtgtgcctaaggctatgataacaggtagggagggagaaatgccaagggttctaatcccagtgtctccacttacaggctttgtgccctcaggtaagtagcccagcttttctgagccaggatcatctctgtataaaggaatatattaacattagtactattggcttgttaagggtgttgaatggggaatgaagcagagacaaagcccacaaggccccagaacacccaagggaaggattctattgttccaatagcagggcaggggaattccaacttgagtggatgcaccagctgcaggcaaggccctatccaatgagcaggggtttataaagacctcaggctcagcaccagttggctaggaggaggggcaggctgaggggcagactaatgggcaggctgtcctggctcagtgctgggcatgtgttctaaagatcccacagattccatagcctggccagcttacctggcacatttagagggtcagtgaacacttttgggttattgtgtaggagaaagaaatgatgatgatgatgatgatggtggtggtggtggtggtggtggtgcctgtaggtgagatgtgtatcttactaacctgagtcaggatgtccctcaatgccaactgtgagtttctgagcctatttcctttttccatggagcccaacagacccaactatatgcccagccacttccagtttctagaggtgtggtggtgagtggtctctctgtgtttaaactggaggatggttccagtgtggaacagaggtttatattagcagagaggggtatgtttaggactcagagggggaagctcggagaacatgggagatggtgaaaaacatgttctggaaccctgaaccagaattcctagaaagacctcaccctcacacgtctgcacattaaccagcaccctgatgattcttatgtatacttgatttcaaacaccagtgaccgagatagactctagtctcccccccagctctgacattccattaaccagtcagctcccctcctcctcctcctctctatgaaagaaggaagagagacagagtcaagggagaagagactgcctcgcaaatgtgaacgatgggcattccaggggatgcgataaaatctgagcccgcccaccccaccgtctccaatctggaggcaagttcaggcttggggctttgagtgtggatctgctaagtcttgattaggggtagggggtagggtgagagaaaatgaaagcccaggcccaaaggaaaggaagggaggggtccaccctgcagctctaggaatcctgctctgagtctgggagtggagaaaggcatgtgtgctatgagcctgcccatggctgggaggggatgaaggcgggtaattctaagagtaggggaatatcctgagagagcagggactcatacccctgccctcagagcggaacagcagactccttgcctagagagctagaagaccagggggaaatagctcctgctgtgtggctttaggcaagccacttgccttctctgtactcactttctcatcttgaaagtgaggagattggacttgatcccaaagctggcttccagctggagctgccatatattccaagagtccactcattcattcatcgggcagatccatcatttaacaagcagcaggggagctcacgctgctgcttctctagaaaggggttgtcggcacccaaaatgtatgtcccttgctctaggtgtctatttagatgtgctttgtccctcttacagtgtccaaaaatattctcctttcagcccacgtctcttttgtcaatcctcaaagtgtagctgtgtttctggcccacagcagcctcatacaactgaaaatcacatcagcacctggacgtccgaggggtcccaccatctcagtggtttcccaattaggccctctccctgctcttcctacacaagcctgttttcccagtctcttcctttggttcttctcccattcaccttcttttctacttcatgagccttgctgtcaaatactcctgagttccgcctctgtgcacgtggccaagctgttcctttgctctgaaatgccttccccatgcttctctgattcatgaaattgaagccatctgaactggtggcctcctccaaatggagctgcagacatcttccagtgggcacccatgggttcttgttcttgcccacgtggagggaaacacgtcgcccagctgggactctctgctggccttgccctgtgtttgagccaccctccctcctccccctaccctcctgcaaagccaagccctttgtcgcttcctgaccacctgtgccctcaggccccagggcctttgcacatgctgtgccctctaccaggcttgcccatacatcttccctgctctgttgctctgtcactgtctatgcctgcatattgcaggtgctcacagtgtacttcctgataggatgaattaaagcaagaaccagacctggcataggctggggagaatatgtgtataggagatgggggaggctgggagggaacaccactgattttttttgaagtagaagcttcatgctggggaggaaaaggagggaatttggcaagagggcctggactcaactgctaagaggactgagtggcaagcggcagcttacgggcttggttctggagcaaggacagaacgaggagtcaggagactggggtctctgcaggctctgcctgcatctctgagcctcaatgtctttatgtgaaaaaggaaacaagaagaatgcccctctgctcaggcttgtgctctaggcagggtagtgcggtggtgaagaggaggcgggcagcacacagcctgggtcaagagccagctccaccacatcccagccccaagcccttaaatttcctgggtctcagtttctcatctgtaaaatggatgtaaatgcccgtgtcacagagaccttaggactaagaaagaggacttagaaagaggttgggtgtggagcatgtgtcgagaaggggcttggaggagccataattagacagggaatatcaagctgctttgagattagacagtgttgtctcatggtccttttgggagctcatggataacagagctggcaggcgtgcgtggagtgagattgcagccacctgtcttcccagccatgctatttgtatttaaatctgtcgcctacatacacatgcacacacgcacacacaggcacgcatgccagttgacttccttgacagctgtttctggccttgtgctccagtgccaagtcctgatgcttgcaaactttggctcttagatgatcaaagagccagcccttgttgggcccttagtgtgagccaaggcccacggcgagccccttcccacaggtctcatctgatgttcacgagagccctatgtggcaggagctcctatcagcctcattttaaagaggagaaaactgaggcgccgagagttttacgcacttccatggcatgcaaggttcagaacaccaccgtgtgccccaagcaggctgcctagaccagctcctaggggtatccttgtgtgtcagtcccttaggccagttctgtttctccctatctgagccagggatccagtgcaggaggagggaagggagatggagtcacgctctgggcggtggagggaggacagatagactttatcccctgctttatttccctgatccacgaaccattgccagatgtggaaggcccacagtgatcccttcatcccagcctgctcttgttacagagaaagtgacttgtccaaggccaccagcttcagcatggggactggagcccagggcctctcccctccagggaaggagctcaggagactggaagacgatccccactaccccatcgggtagatgcccactctgcccttgtaggtggaacaagcctgagctcaatgacagcaaagagcttcattcttccacccgtgtctgtgttcgctgtggctccagggctggccccctccatggtctccccatagccaccgccaagcccaggcctgggacatgaaaggccctcggttacatatggttatttgaatgaactggacagtgggcaagaacaaggtgccttagaggtagctggaggaggataggacctggagtcaaaacagctgactgtgtcattttcttgttgtgtctcaacctttttgggtctcagtttcccatctgtcaaattggggccatcaatgctgacctcatgggattgttttgatgatcaggaaactgacttcaggaaagaccactgccttccccaggggagggagcacgcatcctctgtcccgggcccctgactgccatctccgtgtccttgaacattaagccctagcaacatggcccactggtcatcacgtgtcatgccacgttgcttctgcctgcacacccctgctcatgtcatccccagcttcagggccctctctgccctccctctcatcaatttccactcatcctttaggattcagtgcaaatgtctgctcctctagggagcattctctgctcctactcccaaccccatgccctttcccctcttcatctcatcctcgtagcccttacttagactatgctaagttaccttacagtgtggcccttaggtgtgaagccttaagaaacggatgctttgagtcccagggctgaggttcaaacctcaacgttgccatttgctagtggctttggaaaaattatctgacctttacctttttgtgactcagtttgctcatctaacaaatgaggaagctaataataacagcagcctgcctcttaggataatcacaaggattaaattacttacttaaaatgtagatgatcttgattcaaagaaaccatctgttaaaaaaaattatttgggagagtgcaatctgaatgtggactgggtattaactagagaaagttacaaaattgtaactaatttattggtgtgataattgcatgggggttacatttttcctaaaaattcctcataatttagagacacactggagaatttcaggtaaaatctcaggctgtctaggattcgctagatttttaagaataaaaaagcatacagccaggtgtggtagctcatgcttgtaatcccagcactttgggaggctgaagtgggtggatcacttgaggtcaagagtttgagaccagcttggccaacatggtgaaaccccatctctactaagaaatgcaaaaattagcagggcctggtgggaggcatctgtaatcccagctactcgggaggctgagggacaagaatcacttgaactctggaggcagatgttgcagtgagccgagatcacgccactgcactccagcctagacgatacactcagattcagtctcaaaaaagaaaagaaaagaaaagaaaagaaaaaaacccatacatgtgtggggaaaatggaaggaacaagaccaactaagtgttgataattatcaaagctgccgatgcgtatgtagggtttgttatattattctctcaacttgggtgaatatttaaatatgtctctagcaaagaacacagtttaaatttgtgtacagtattcagtgttttttgttgtggttttctcactactctctaaaactgtgagaacattcagcattctttcccctgctcagtaagcaggtcttgtgcagttaaatgaaaatgatgtattttacccttgatgttttgttaaaatgactgaaaatgggagaaaaccaaaaggagtagctcccgatgaaaagacccttaagttcttcacctccctggacaaacagggttatcatatagtgggcaggcccttataaaaatgtcatgagccatctatggctcttgggctgtagtttttgacctttataatgcggttgcctgttttacgttcctgtctccttggaggctggacgttctcagaggctttgtctctgacactggccactgcatgtgggacttagtagatgctttatatacagattgacaaatgagtgaatgcatgagtgaacacatggactagggctcgttatctggaaaaaaaacctggcttcttgccccttgtaccctcatcatgtaaagttgactttccccgcctgcatgtttataaaaccaattagtagaaaatctcgaaaaccttctacatcccataacatgcagcctggccaacaactttctggaaaccacccttgggagattctgggcagtgcggtgggggaaggaggaggatgtacctggctcatacacctttcacgggtttggagctaagagctttcaaaggtgatctacccaggaccactgtcccaggccccacttgaaggggagcccccaccagggcccgggatacaggtgcctaggggtgcaagtgccggaggtgttgggaaaagaggtgtttgttacctgtggctgactcagaggcacccgatgcgctttgaaacaagcgtggggaagacatgggcaccggccaggcctgtattctctcacggtccccagggcttctcttttcagcaaagcagtgaacagaagctgcttccagcaggacaaccctgtcctgaaagctcccgggcccagctagggccggctccggccattcctgcctcaaccctgccccctggtggagtatctaggtgcggcctccgaaacagggcaagccaaggcctccgaccgtccacactgctcacggagcacttgcccagggtgtgccaggcgcagtgccgggcacccaggaggcgggaaagggcaacccgtccctgagaatccccacaagggctcctcactcctcttctgggggcccttggcaacctgggctcaattccattgctatcttcccagggggtgaggaccctgccttgttcatctgaacagcaggcacatagtagacgcttggtacatgtgtgtgatgggcgggtggagggaagaacgaatgaatgagggagccgtgcagcaaggtgattacaagtaagggttctgcagggacactctgggtcaatagaccaccttccagctgcgagatcttgagcaagattcttgagctcttggagcctcattttcctcatctgtgaactagggatgacactaataactgctcattaaggctgctggaggatgttgacatcaccatcattttacaaatgatgaaacaagctcagagcaggtgagcacggctccagatcccaaagctgggagtggcaggaggttggggaattgtcaaatggggtcccctcattgcagatgacgtgccctttctgcaaattccatgccctgttcacaataaactgcacacactcttagaagagaaagggatctatctccttcatcaaacgggacgcttcagatatcctgggcagtccaccccaccgctgctagcctcccacgttctgctcctatgcctattgctaagcatttttgtaaaaatgaatactgatatgcaaacgtcaaattatagacttacctcttcccaagtccactttcaaagagctgaaatacaccataataatcagttaccactcacctttaaatattatctcaaaaatacatgtgaaacatttcctccagggctttattttttttccttcccaattttaatcagcttaagtttgtccaataagtatgattgaagggatcacttcatcactgttcacctacctactgataaccctgtttgtccagtggggttaaggacttaggggtcttatcatcgggagatactccttttggttgtctcccatttttcagtcattttaaaatatcaaggataaaatacatcattttcacttaactgcacaagacctgcttacagagcagttgtgtcaccctgatgaatcacagaatgcggtatgttctgcaggtctgcgtgaactgctgtgtgaaagcagcttagcagtgtcggtgggtaatgaacatgggtgtgggttgtacaaaagtcagatgttaaaaaaggaagatggtctaaaatctccacacttttctcttatccctgcccaatgttctaaggcagtggttcctatttctataaaaattcccaagggttgctggtcaaactgctacggattccaggcttcagcctagagaaacttaaggcgaatattcaaagagggatctaggaatctggtttttatcactctgtcacccaggctggagtgcagtggtgcaatctttgctcactacagcctctgactcccaggttcgagcaattctcctgcctcagcctcctgagcagctggaactataggcatgtgccactacatccagctaatgtttgtatttttagtagagacagggttttgccatgttggccaggctggtctcgacctccttgacctcgagtgatccacctgcctcagcctcccaaacagctgggattacaggtgtgaaccacatgcctggctgaggaatctgtattttaacaagtttcacaggccagtgattctgaaactttggggcattcagaaccacctggaaaaaatcccaatgcccaggctcctcccaggccccttaggttgggatctctgagtagagtgtccattaaagccccagggtagttgtactttgcagtaaagtttggaaatcatcatcatactacctgggtagctaggaggggttgctgaggagggaggggtatggcaggaggagtctcagtggggtaggtggggcccggtgggctcaaaggctgcagcaggcagaagtgagcaggaccaggctgtgcctgggcaagccctgggcatcttgccaggcagaagcaccgcagagtggccaccacctctgtcttccccataaacatagtgttatctgcagagtctatttccagaagtacatcatgaaagagacttttatgtgaacatctgcaatttggaaatcccaaggctgttttggtttgttgttgttcttgtttgtttgtttttgtctttgtcttttttttccccctcctctggccttccctagacaacactctccttgacttacgatcttttctcctttttgccttcttggcttctgtggttggacagaatgatgcaggctccatatgacagtgtgtttgcaaagatcattttctccatctgcagaacaggcccaggcaccccagctcaggtagctcatggtgggtaagaagatagccgtcagggctctctggggactctacaggataggatatggggcaggctcctgcctgtggctggggaaaacaggaatagcttccaatccccaaggaaaatgaaagcctggtagaaacctcagagggtcccaggggcccaagcaagcatcctggggtttgaggatgagccccagcccccagaaggaaagcactatttttgagatcctacagaagcctctggaaaatgtgcaggcctttttttgtattgtttagctgcaaaaagattcctctaaatgttcatattctactaattacctctctctcccaaacccaggcaagccaagcaaataggtatttgttttgcacaaatacccattgcttacacagaaatgggtttatcgtttttattttgacaaaggccatactctcattgtccactaaagataagggccaggtgtggcttaggggcccgagctcccgggcttcttcactgcacagcaccacaggtgcggcatgggagtcccaccagcagccaaaccagggtactagaggctgggatgatacagctggtttacctatggagccacagctctgacccagaggcgccacacatttccttcaggatgtgttgatgttctggaccaacagagacacccccagaaaggccccagaccaaccactcaaggtcaacacacatacatgccccagatattcccccagtgactccccatcatgacaggcctgggtgcactgaggaggtccccagacagcaggaaagggtggggctggtggtacctgggcccttggatgactccgcaagcggatgtgcaaggaatgaggagttgagagcccacataggatgcacagacagaaggtggtgtgggaaactctcatctcccttctctggctgagatgcttcccccactcctttttttggggggtggaaaaagagaaccattcagtgaaaagagctgtgaaccaaagcaaaggacaggtagagatgtcatgccatcctggatgttgaaggaggctgatggtgtgtgcgcatgtgtgtgtgtatgacagagacagagagagagaccctacactggccttccaagcagctgaagccccagtgagtagccttcgagggatgctcaggggatgagctgcctcagcctgcctggggccgagggaggctgccagtggatgggcacaaggtgccagggatcacactggaattaaggtcccagaactaactgggaggttctaagatgtgacctcgccacccctacactccaagccactgccagggggttcttggacaggctttttcattagaagctggtatcattcactgtatatgccaccggcccaggaggagtgaaagccgccatggcaccatgcacctccagttgatcagggccccagagcagctttggagtggagcaggaaggcgggggggaaactatggcttcactcagggagaggtggagactgtaagcacaggcttagagtcaagcacttcagactagagtccttctgccgttccctgctcatgcagggacagattgggtaaaggagttctaagatgactcacagcgttaagactcaccggctctccaggagaagttctggccatgaggcccctcccaaccctcactcttcagcaatgagcatcatttgttgtctctggaagctgagtgctcatgcactagaccacccgaatggcagcttaggctggacttcaggggagaagcagggcagtgggccgttatcagctcatttttggcagcaacaagaaccctgaagggacaggtacccccacatggggatccagctatgtcccaggatcccaaagcctctccttgagctcccagcccccatgaaatatttgttttgctcaagatctgatgggagcatgtccccaaaattcacatgtgcacggtgttccctgtgcagtgatcagaggcagaagagttagtggctcgaaaactctggacaaggcagaccttggttccatccctgactacctgacttgtgtggccttgcacaagacattaacctctctgtgcctctgtgttctcactgctcaggggaacattagcagacctgccttgtgatttgttaggggattatatgagatagtgcaaacagagttctccatatagaatgagccctcactcagatcttaggtatgttgattataagggcctgtgagtttgtgcatgcaggggaacagatgggcggcatgtggtttctgccttcaaaggatggcagattggttggggaaatgaacattcactcatgtattcaccctatcaacagatgcttattgacacctactatgtgtcaggctttgtgaggcttgatgtccctctacaactgccagcccaaataattgtctagctgcttcttgattacttccactgatggtgcactcactacctttcagctgttttttttttttttcatcagaaaattctccctcatgtacagtagtgggaaaaacattaactgaaacagttccagattcaaatccaagttctgtcatttactaggtgttgggcataagcaagccactttactgatctgttaaatgggaataataataccagtcactgtgcagaagacaaatgagatcagccagagtcactgagggctagggcaagacagtccccaagtggtcatcagagtgatggtttgcaatggatgtaccagcaggaggaattccagctgtgacctcatatgatgctcacttccagtcacttgcgagctaagcgatggtagcaatgccgttttacagaggagaagacaggctcagaaagtgaactcccagagtaacatgaacagtgacaaagcctggactggatacagtgtggtgtttctaaaacacaaatctaaccctgccgtcctcctgctaaaatccttcaataaaccattcttccagacctcagcccaaaccaaggcattcaaggtcttccttgatgtatgctgtgccttgaacccatcctcatccgtcctagccttcgcctcctcctgcctccaccctgcaccctactccaggctctgcaggccccaggccctggcacatgttgccagctcagtgcctgtgcacttgagggtccttgcgcattgggtaccctctcctgcttcctcactgatctattcccaccccctcttcaaaacccgttcccagtgcctcctgtcttgggaagccctcttcagccccagcacacacacagcccagccactcccctgtcatcccacaggcaggtctgcttggctctcacactgcatccccagcacctagtgctgcacctggcacaaaataaaagctgactacaggtgtgttgaataaataaatgaaagggagaatgaataaatgagtggatgccattgttatagcattgattgcactgaattgcaatcattatttatgtgtctgttggcctcactaggtggggagccagtcaggggctctgtcttaggcaccttcgtctcctcccagcctggcacaaatcctgtgcatagtagggattcaataatcctcggtccctagaatgactcagtcatcgtgcacatccccagctaaactgtcagtgctggagggcggaaaccgcccttgcgccagtcatctgctttccctcgtgctcacacagagaggtgaggattgatcgattatcacgagtcaggactcacttgtggcctgcagacccaaatcctaggtaagcgtctatgctggacataccctaggtatgtgtcagtgctggacaaggcagctggcactcagaggctcacacaccaaacccagcagtcctcatgccctggggtccagagggttttcccctgcacagatcttgtccagcaccttctcctgagtctgggagattttctaccactagatggtgccaattgcaaaggctggctcagccgactgcccacagcccttccctcctctgcccagggatgccataaatggttcccctgtccaagggaggacttctctgcagcttcccctcaccagctgtgtgccctggcacctccaggcacttagaaaggaagcttccttctgggcatctttaacttgggatggagacaggaggatggatagtgatcccaggagtgggatacccacccggttccaacccattccagctcagctcaaagtgtccagatccccaactctgttctgggcacagtggggtcagggaggacacacaaccaaatgggtgtaagaggagacaggcttctgtgtgccatgtgacatgtgccaggccctacctagtgctgccacatccacaatgccccttcacccttccaactgcccccaaagggaggtgagtgtgattgtgcccatatcacagatgggaatgctgaggctcagaaagatgaagatgctgttccaaggccacacggaaagaacgtacgtcggactgtctcaggttgcatgttcttttcttgacactcaaacttagggcccagaggagaggttccagtacatgatgccttaaatatcatagatatccaagcctttttagccgacaatcccccatccatccatttcaccagtcaacacatatgaagccctactgtgtgctctgtgctgtgtttcaggcgcacagagagatgcaaggcccgggccctgccctttccaagttcacattccagtgagcgaggtaagggcagggaagccttcctggaggagagggcatctttatttcctctgccaagagcacgtcctgagtgtggtggctctgagagatggtctgctagtgctcatgaggctctgaggcttctagaatcatggcctaacaaggaaatgtctctccccaaagtcaaaaagaggggtgtgtgtgtgtgtgtgtgtgtgtgtgtgtgtgtgttttactgattcggatatgtagggttttcttgcatcctgttgtgtttttgaggaaatatgaacaagggcaggctaactagtgcctcctcggtgaaccacccagaactgccaaccccaagagctctctgttccctaccagcaaggccttccaaggccacatcgcccacagagccttcctccctgcagggggctgcaggcaagattttttttggccattctggtgtctgtctgggccataacagagaagtcacccatatgtccccagtgaagactggcaatgtgcaggcactctgtgggggcctgccccatcctgccctcaccccatggagttcaccggcattaacctccaaacacacacaaatgtctaatttctgagcctgcctagtggcttaagggaaagccagacacacgcaggtcagcgagtcaggagagtccgcccagagaaaggggccccaggtgaaaaagataggaagggcctctcagccacagggaactgcatcgcagcggccttgaggtagggaaagggtggatttgaccaagttctgaaatcaagcctatgggagatgaaagcttcaagtcgggttttgtctgttgacttgcaagggctttatttattgcatcaatatttactacatttattgtgcgccaggttcagagcctagtcagactaattcagaaattcatctgaaccactttcctcatccctggtccttcaaggtgcaagagtggaccccactctcctgggcagagcagttactgccctggtgttcagagagcttccatgcctccttggaatgcccagcactttgcgtagtaaatccctcgagttgcagtaaatccctcgagttgtagtaaatcacctctaatacttgcctctcccataagctgtgggttccccaatcatagggacttttaacgcttatcttcaaatatctaaaacttaagagagactatgagctaactctgcaaatgtctgttgagtgaatgaaagaacccagaagaggcaaaagtagaagctgttgtaatgagagttaggagattaatttgcatcttggccttgctgtgaactgtgtcatcctgggagtgtccatctgtctcttcgggtcttgccttcctcccctgtaaaggaggaaagaatttgtctgagtagctcagcaccggagcctggtgttccgagtggaaagcagatctgtgatcccacaaagcaggctcctctgcttccagatggagggagcagcccagagcccagccagccccctgtcccagccccacagaagccctggattctcctctgcttacttcagaactcagccgtcaaggacgagaagtgctgggcaggatgatccatggcttgcccaggagagggaggactgactcaaagcctggctcccgtccccgctcctgtgtcctcaggcgattctcttcctcttgcaggcccaggtctctttcgagatagagcaaagggcacagatgggattcaggggggcaaccagatgggacagcaggtgactgggtgctggagatacaggcagcttgaagctcctgcactcagacacccaggcatctccatctgccgctcctcaggcctgggcagctcttagggccttggtttcccttcccagctggcctcttgtgtccatcatatttgccaaaataaagatgaagctgttgactgggggatgggaatggggatgctggggaggagtgcgggttggtagagtggagtgtgtatgtgttgggtggggggtctcattgccctgacagcaaaataaaagggctcctccatgtagggcttgtgctggcaaaggaagcgccaactcactccccaagggctggggcccatgtagctgccaggagctataaagttgaatacctgccgctgcaccacgccagccctttccggatgctcagaggggaaaaaaataataataggtcagcgggccgaaaccggtattaagtaggagtcctctgactcagagaggccttaagaactctcggtgagtgaaggaactggccctgcaggtcgtcacagaagagccatgggatccgagccccgcgcagccacatgactcacagccagcttccacctgctcagggcctcggctttctccctgtaaagtgaggccacctcccttacctcggggctgcagcgacaatcactcaagaaaggaaaggagcagggtctgaggtggaatttgggccccaccgctgaccagcggaaggattcgggcaattggtttaacttcgctgcatgttgggctcctctgttctatttgttttactgagaataaaggagatgtttggctatcaaaagcgtgatagaaaaaataattttatgaaaaccttttgaacagcatgaggacaggaatgcaatggcagggccctttgggcgttgaaacccctgtctcagcagcccccctttccctctgccctccccccgcaggccctctctccagcccctacgaccatggactttaccccagctccactggaggacacctcctcacgcccccaattctgcaagtggccatgtgagtgcccgccatccccaccccgctgcccgctgggggtcagcctcatcacagatggctgtgagtgctgtaagatgtgcgctcagcagcttggggacaactgcacggaggctgccatctgtgacccccaccggggcctctactgtgactacagcggggaccgcccgaggtacgcaataggagtgtgtgcacgtaagtgagtccctccataccttctgaccagcccctgagcacccccagctctggccccaaacccctctcccttggcacccccacagcctttcacctggccaggcttccgttcagcaggagatacaccccatgatcagaggccagaggctgggtccttcctgggaaggggaggcaaggatgcctgcactcttctcgcctccagaactttgcttcttgctttattctcagtcctggaggcacattcatggctgtccccagggaagagggagacgccatgaaatacctaagcctggttttgttctcttagtggtaggatcttttaacaaatgtccatggcctactaggacacaccagcatactgcagaactccagatattttggtaatattgtaaattaaaaaatatggttttaaaaatccagtagccttgaaagaatgaaaatcagcagcctgcagtcatcccttcccaccagctacctacatttctcagttactacagtcacttaaattttctagttatttcttctgaaatataatatagtatattatagaaatatactatatattctatatagtatagaaatataatataaagataatatatacactataaatattatctttctaatgaacttgaagaacagttttcacagggggaaatatactacatatacactatatatagtagttaaatatactatatatacactatatatagtagttaaatatactatacactatatatagtagttaaatatactatacactatatatagtagttatatatactatatatacactatatatagtagttatatatactatatatacactatatatagtgttatatatactatatatacactatatatagttatatatactatatataactatatatagtagttatatatagtatatataactatatatagtatatatacactatatatagtagttatacatactatatatacactatatatagtagttatacatactatatatacactatatatagtagttatacatactatatatacactatatatagtagttatacatactatatatacactatatatagtagttatacatacactatatagtagttatatatactacatatacactatatatagtagttatatatactatatatacactatatatagtagttatatatactatatatacactatatatagtagttatatatactatatatacactatatatagtagttatatatactagatatacactatatatagtttatatatactatatataaactatatatagtagttatatatactactatatatactactatatatactactatatatagtatatactatatatacactatatatagcatatatactatatatacactatatatagtagttatatatactatatatacactatacatacactatatatagtttatatatactatatatagtagttatatatactatatatactatatatagtagttatatatactatatatactatatatagtttatatatatactatatatactatatatagtagttatataaactatatatagtatatatagtagttatatataactactatataacagtagttatatataactactatatatatataattgctactataaaatgtatgtgttctgctatatattaattgccttgatatatcaatttttggataatatattaatattctaagatagctgatgatttagctcctcaataccacctgatatacccctaccttccaaatgacattgccataatttttgattatacaatcatcagtatttataatattatgactatgtaaatattgttcactgcagtatgagatcatgtacttgctttaatttacttccttatgatgctttttgtttttcctggactttctaatggcctttgctttttctttattcttggtgtattctgatatcctcctgtttggaggtggttgttgttgttgttgttgttgttagttgttgttttctttggtcttcaagtgctccatcacgggtattctatccttttttgttccaagacacctcctttatgaaactttctgaccccctgcttctgtccggacttgtattcccttgaattgtgtaagcattacccaaaatatatgactcatcagattaagagagctacctaggtattatgatgcagcagcctaacttctgaaaacttccacaaagtctcataaacccaaaaactcccttcttcccttagtgctgaatcaagccttccccttaactatgactccatatacaccccgtcacatagtcacacacaacgtagtctctcatcctcagctaaccattatattttttgaggtggattgtccatgagggttatgtacatcatttgcagtcagacaattttattttatctgaaccacatggttaatttatgacagtttcttctcttttatcattggttcatgcttcaactttcacacgaatccttgtgtctttggctttctgtgaataaccatcccacttctcccatctttctaatttttcttcttttactgaaactcattagcagccacataaatggtatgttcaaagagaacttgcagcatccgctgcacagaatcatctgatatgttgattataaatgttattcttgagccccaccccagacttgttgaatcagagtctctggaagtgggaatgaggatctagtcctttaacaagactcccaggtgattctcatgcatgctaaagttcaagaattgctgctaatatactcagtcatctgttccctccccataacccaggtagggaaacctggcctggacttcttacactagaaccacctccagttatatgagcttgtctcataatttattcttccagtaaaaactgttcttcaaggtcattaaaaagatacttcttttcactaccattgcattaatctctaaagctgtattgagatcttgtcatctgccaggcaccactcatttatagatgttctgtcatggatccaaagattgtgtgaacccagaaactgcctgtcctgcctgccttccccaccggtggcctggaaaacccccttccctgtcctcctcaccccctatctctgcatcttaggtcctgccttgacccagtacagccacttaacttcccaacaccatgggcttctgtgtacttcctttccttttatttgaaaaaaacaaaaactgtaggctaaaggagattgtaatagattttacgcctaccagtggttccctggtcatgaagttttacaagcattgagataaataaagctaaccaggagctatagaaattctcagaggcttcaaattttcatgtccattgccaaattccaaaagagaggtatcataagcttcataataaattttttagatgtatttaatactaaattttttcagtcagatagttccttacccacccattacactacacacacacacacacacacacacaaacacacagttatacatatacacatcacacacatatgtgcccacacatgcacaaacacaactcactagtgctctattgaacatgttcccggaagtgctaccatagtgtctgaattcatgagaccctaatgcaggaaagaagagagtgtggggtctgcaaaagaatacacctctgggccagagggtaaacagaacaaacggttcctctaagaaacaatctttccacaaatggtcagctaagcaaatggacagttcctaggacaggctaaatctgtccttaaagatttgcatgtaattagaccagaacaaggcaggtaataaaaatgagccattgcaaccctggcttatataactcaaacagagtatgatggggacaatggcaatctggtgtgtgcaagccctggctttcagagatgaccctactgggcccagccactctggccaagcagaaaaaagctaggtcttgttcagcatgcttagttttcaagagaatccaggtacatagatttgtgtatgatttgtaaacattggcaatacattcaaaaatatttttaaaaccactctgtgggccaaactaaatacatctgtgggcagagggtgacctctgagttacatcatttggctatttcagttgcacaaacactactctacgtttaaatgaagctgggtcaggcctgagggcagtgtggtttggtggaaggattatgatatttacaagctgacagacttgagttttagatcctggctctaccacttgctagctacgtgaccatgtgcacatcacttaaggagtgtcataaaaccaacctcacatgcttgttgcaaaataaataaggaaatgtcaaaaaataaaaataaaagtaattggctgctcttggcttgccttgcaaggaaagttacctcagtcttattcacggccacctttagaggagggagcaggtctagctcctggcctagatcccccatactgaagagtgagggagtagtaaattcatgcatgctctttggacctagacaacccagctggaatcccagcatcatcactcactattactatgactttaggcgaactacttagccttttaagtctcagtttcttcttcaaggaaaatgtgacaaagaaagtttatatctctgggtggttagaatgtcaagtgcctgctacatggcaggagctgaataaagagtacagctcaccccagttcccatccatccatccctccattgattcttcacacaataaacataagtgaggcagcaaaaacaaacagagctacaacaaggcatggcccactgtccctgctgacagcgtgagctgacagtccatgggaggtgtgaagggagggaaggccccgatggcagagcaagttgacttgaattcctgaaagtgcttcagtaagaggaaagctaactcgatcacacctgcacttgcagatctgagattagataggaggtagtgaaggaaacccaactgtcttcaccatctcgcctttgattagttagaaacttaatgagtcagctgaagggaccatctgcagccgtcatgcatcccactagcctgtggtgggcaggctggtcagagccagtagcagcatctcacttccccacccaaagccccaaggagagagactggcgcgccttctagttgcactggttttcaaccttagctgcaaacaggattcacctggggaacttttaaaatacggagatcaacaaaagaagaatactgacacccaggttcacccccatattctgaggcctggcatgagcatcacaatttttaaaagctccccaggttcccctggggttcccctgtgcagctggtagggaaagccactgtgctggggactccgggcatctagcactgacctctccctccaaagtctccacatgcagggacagagttccgggcttagcccactcccttctccacacacacacacacacacacacactcttcctggagagacagcgtgcaggcagaggcagggtgactcagaatgcaaagatgagtgattcacccagcgcttcctctgctttttttgccttcctctgtcccctccttcactggtgtctggtggcaggaaatgggctgtggagtcaggtctcctgggtttgagtcccagctgtatcattcaacagtttcgtgaccttgaacaaacgaatcatttaacctctctgagagctttcctgtccatcaaaggagaaaaataaaactcttcatgaagtcattgggagaactgaatgagataatgtatcagatgatacctggcactagatcagagggtcagttgatgttagcatctttcctttctgcacctcctgcacggataaccgcaccccaaaaaaaacaatagccgcagcaaggttcacacaaaccgggattctgcttcccgctgtggtcaccttggacgctatgtgtcttcaccttgctgagactttgttttgctatatataaagacaaagatgataatgtgatagtgtttctgtacagaataaaataagtaatgcaatgcacaatacagaggagacccagtatccaataacagagacagtacttcgaaaaccttcatgcctgctagacattaggattactgctattattaacagccaccttcgggcaaaccctgaaggacagaactgttggcccactgcagattccaaactgcttctccttgggtggccactcatgatgtccggggctctttacctgcatttccagaagctgtcctccagagagagcatggtatcaagggtgatatctggtccagaagtccccaactctccctgactccaaactggcttaactaactccacatggccacttggttgtcaaccagccatctcacgcataatggagaacacttgagtccacccaacccaaaccctgcttgtccaaagaggacagagcatcttcctccttctcgactcctctcctttcccccgcacagcccctctgtcagtaagtcctggcagctctccttccaaatctgtctggaagccgagctcttctctttctggcttcagaccgctctctcccacctgggtctcagggtggtcccccatgctacctttgccctctgactcagcaccgtgagtgttctcatgtcctcaactcagcaccatgagtgttcttgcaaagcatacttttcatcattcattcagcagttgcttactgagcacctactatgtgctaggctctaacagctttgcacttcctctgagcctacaaggaagccttctcggacctcctctccttcccttttccttcttgtctcccctcctcagacctctcccacagcccaggcttgctcccacctgtggtctttttacttaagtgggcccctccctacctggaaagctcctcccccaacccctgggcgggcttccttcctcacctccttcaggctttgctgagcgtcatcacccagtgaggccttccccatccacctgatttaaccctattcccagttgcgctgagaatactcaccagcagcactagaggctgcagcatttaccccaaaataattttgccacaaaatatctcacttttgttactctattcacatcattctagaataccaactttgaaaaacaaaagatatcattctatttacagcattgtgtttttttaggagtggtatttccatttacaaaatatagtaattctcgatcactgaaaatgtcaaatcctagaaaacccagcattcctatgcataattgttcttcaacagttggctgggattcacttgatgaatctgatttttctgaaatagattattctgatgattcagacaattctgatgttagttctgtttagaaagaactccaagaaacagtttttatattttatttttacatggaaaatcagtcagatttgctttaacctcaaaaagtgtgtttatgtaaaattaaatgagctctggcagctagctgaacatttttttctaaacagggaaagggttattaataaatttgcaactgtctccccccgcccaactccccctccctgctccacttttctcccagacacttgtaactgccaacattccatatgacctttccacagcataagctctttgagggcatgtcttttgtctgttttgtccactattgagtccccagcacatagaaggctccatgaatgtgtatggaatgaatggaacacgtgtttcgaagtgttctggctttttttttacaagtcggtcaccttcagaaccatgagccctaatggcaggtctttgtcagtaccaggctttgtgcctggtgctggggaccctgcagggagcaaaccagccaagtccctcgggaggctgcgtccttccactccctgggtgctggctgaagctataaaggaactcctgcactccctttgctgaagttccaccaaacactcagccctgccctgtgcactctcacacctccctgcctttgcctttgtgcctctgttcctcctccatgctgggagccatccccgggattggggcatggtccacatggagcccctataaaggcagctgggccagccaggggcaccaaggccactgggcctgaccggccacctgtgtttgcagaggtggtcggtgtgggctgcgtcctggatggggtgcgctacaacaacggccagtccttccagcctaactgcaagtacaactgcacgtgcatcgacggcgcggtgggctgcacaccactgtgcctccgagtgcgccccccgcgtctctggtgcccccacccgcggcgcgtgagcatacctggccactgctgtgagcagtgggtatgtgaggacgacgccaagaggccacgcaagaccgcaccccgtgacacaggagccttcggtgggtgtgggcccgagtgggctgggggtgggaccctacaaatgggttgtggaccctcctggaactctgaccaccatagaatgactcattccccagtccactacctactagctttgtgaccttgagaaagtcatacctcccctgagaccctatttccccatctgtaaaacagaaataatcccatctgtctagtctgtcctgtgggatcctcccagcataaaatgaggagtgctttgtaaagaacaaagccctaaaagtgcaatccattattatcctactaaagagttagggatgggtggtggaagaagggtaggtatgtgggtacctgaggagaggaggtatgagcaagaggagatgggtctagtagaagcttcatgatgatttggggcttcccccttgctatgaagatgggtgggcaggtgagatttcagccaggtaaaccagataagaggaagccctggaaaagaagagtggggacaggcccaattgtttcactgctgcttactggaatctagcccagtgccatacacttagcaggtatccaattaatgtttgtcatactgatgggtgggcagatggatggatgaagaatagatagatgggcgggtggatggatggatggatggattggtgaagagatggatggataaatagatgaatgtataaatagatgagtggatggatagatgacggatgaataggtggatgatggatggatggaaggatgatgaatgaatgggtggattaatagatggatggataaatggatgtatgaatagatgggtggattgatgagtggatagatgaattgatggataggtgtataaatagatagatgggtgagtagatgggtggatagatgaatagacagatgaatgtatgaatggatggatggatggatatatgtataaataactagatgagtggacaggtggatggatgaatggatggatggatgaattgataaatggacagatggatgaatagatagatggatttataaaaaattggatgattggatggatagatgatggacaaataggtgaatgatggatgggtcaattaatggatggatggaggatggatggatggatggatggatagatgtataaataagtagacgaggggacagatggatggatgaatggatggatggatggatgaatggatgaactgaatggatgggtggatgaataggtagatagatgtataaataaatggatgattggatggatagatgacggacaaataggtgaatgatggatggatcaattaatggatggatggatggaggatggatggatggatgaatgggtgggtaggtggatagatggatgggctaatgaggatctgaactagggcagtgggagtagaggcagtgaagaaggaacagacacaagaggcattgcttgagtaagactgaaggtcttaatgtcaatctaatgcatggggtgaagaagaaagagggacagaggctgactcccagggcttgtcattgcctaggatcaaatacaagagaaggagcacatttgggccaagggagatctactctgtttgaaacagactgagtttaaggcagagtgccctgcccacgggatcttaagagaagcttccagtttctctttatggggaggaaggagacgaaataggagagctctgaagtcatctgcttggagctgctggtggtgatggctgggatggcctgagggtaacatccacagtgagacagagggggcctgaggcagaggtctgggaatgctgacatgtgaagggtgagcagaataagaggaggcatggggaaacagagaggagggttgggatgtatgaagaaaaccaggagcatctgatgccatggcaggcagcagatgaggacatttctagaggaaagtgcttacgaggcaagcagtagagagcagtagaaaaatggcaatagagtgggagttctaagagtattggtagtttttttaaaaaaaattatatatgctaaagattgctcagggacggtgtggggcaggtttctcaagctcggcactgtcaacatcttggatgaaggaattctttgtggtggggttgtcatgtgcactggaggatgtttagtagcaatctaatgcatgactactaaatcccagcaatctaatccctggcctctacccactagatgccagaagcgcccgctccctcagagatgtgacaaccaaaatcatctccagacctttccaaatacaccctaggagacaaaattgctcggtggagaagcagtcctgtgaggataggaggaggcgtggaggaaagctttgtccccagcagccccagggcagcaaggcagctctcccaccaccacctccccaggagggccacacgagggtcacggggggagcagggaggcagaagctgtctgccattgtgtctggcccagtgaccctgttctgaccgagcacaagcggagcccctgcctagccgaggtgacccaaaaaccaaagcctctttatcctcctgggcaattccctccccaccacctcccaagatgcttgcagctccagctcctgtcagccctgcccctcctgtccttggatgcctcccatttcaggtctttccctctctcactcagtgattcctgcattcattcatcaatgttcccagcacacctataagcttagaggaactgacttacctttcctctttatccttctaatcctagttagatttctcttcttttctgtgtttatcttttcgcctctctttccctcccttcattctttttattacttttattaccttcctcctgtttctttctctctctcacacacacacacgctttttctctctcctcctctccttctttctctctcttttctctgagcttccatctgtctttccatcccttccctgtctgcctgttccctcctctcctcatgcacatgtgtgtttggatgggacaggcctcctctccactgcatcttgttccatctttctgtgggcagttctgtcttaacagcttttaacctgctttggtctcgagctcaccaccattttccgtttttcagatagttagagagcacttactatcttctagatgcgggagatacatgcatcaataggaacatccaagagtgggtagttgagttggctgacagtcaaatgaccacacagactcacattaactaagggctttagcttactaaaggccagggacagcctgggtgtttcataggcgtgaagtcatcttttctatcatggcactagaaagagatgctatagccaaccccatgtgcaggtggggatcctgaggcaaggaggtgtgagctagcttattggaagttacatagccagcaagtagcagtgctgccagttgaaccctggtgatttgactctgaagcctgtatgtcctttttttttttttttttttttttttttgagacagaatcctgctttttagaccaggctggagtgcacgggcacgatcttggctcactgcaacctctacctcccagatcaagcaattcttgtgactaaacctcctgagtagctgggattacagcacatgccaccatgcccggttaatttgtgtattttttagtagagatggggtttcaacatgttagctaggctagtctcaaactcctgacctcaagtgatccacctgctttggcctcccaaagaagcctgtgtgccctcttacccactatgccctcggcatcactgcgacaaaatgttaggtgctggcatgtagctacttgcctttgaacttcccccaaataaactttctctctgcagaggcaggagaatgtcttttaccactcttattcctggtcaggcgtggtggcttacgcctgtaatcccaacactttggaaggctgaggcgggtggatcacctgaggtcacgagtttgaaaccagcctgaccaacatggtgaaacctcatctctactaaaaatacaaaattagccgggcatggtggcccatgcctgtaatctcagctacttgggaggctgaggcaggagaataacttaaaacccaggaggcggaggttgcagtgagctgagattgtgccattgcactccagcctaggcaacaagagtgaaactctgtctcaaaaaaaaaaaaaaaagtcccattcccagcacctagcaagatgattgatgcatactcagtaaaaatctaggccttattattgtgttgccagccgcacaggcaggtgttattgttctaatagggagacaggcccagggtgggttatctaagatcacacagcttgtaggtggtagagcagaatttgaactgggatccacctgtctctaaagatgggtttcctcccatgcttccacactgcctctcttgatcagaaacatacaaggagctgagaacatgtcctccactccctgggtacctttgctggttagaagccaacttgctgtcctgtggggaggtacagccaatttctgtgttcctctgagttctggggaccgcagaccttagtgtggtgaaagtgagggttgggggctggtgggagctgtagattcatgcagattctgttccccacacacagatgctgtgggtgaggtggaggcatggcacaggaactgcatagcctacacaagcccctggagcccttgctccaccagctgcggcctgggggtctccactcggatctccaatgttaacgcccagtgctggcctgagcaagagagccgcctctgcaacttgcggccatgcgatgtggacatccatacactcattaaggtgggtccagagcaggtgtggatgtctagacttcacaagcagacaaatatgggtttgagcctggctcctgaacttcctcgtggggagcatttgtaaagtgggaatagttaagctcacctggtaggtctggtgtaacagctatttcggataatgcaggtcaccagattggtgcattgtgaatttcagtcaatggaagctttggtaggtatcatattattagaatcaggatcactccagagaaacctcagagaccctcaggagtggtcttctataatgattctgagggatccttaccaatttccatcctcccttcactcctgtgccagcccacccccacacagcagccacactgggtgatatagagagcactaaatgaggctcaggacccctagagtcaaatgtctgcttgcattaattgcatgtgactgtggccaatctctgctcatcactgagcccccattccctcatcattaacatattggagttgatctctgaaatccctttcagctttaagagtccaagataattaaaataaagcatcaaagaaaattgggccacattagtttgagccccagtctcagagttaaaagtggatctgatttatctaattcaagtcctcctcactcatgccttaggagtggtcagccttttgtcacaggaaaaacaaagcaaaacaaaaaattcaacagttattccatttttggaatgctgatggtttcttagggatgttgaggacagggttgcctcccatgtagaaaagacagcacagcttcctgtgatcctcttcagacatccaacatcactcctcatcccctagacaccttctccagtcatctatatattgatcaactggatccatttttcttcttccttctccttcttctcttctttcttcttcctctctgattatttttccctgtaatactagcttttgtattttctgcacttggtatacagtaagcattccatagacatctcttaactgaaaacgtacatggaaaaggtaccagctgcagaggaatgacagcaaaggtcgttagctgagtgagatggctctaccattactggaccacgtaatgcaagtccaagccaattttgatttccaaccaatttttttccagaattatgtgccctcagagggtttcccaaattgggcaagcttcatgccgccatacagcctagatctagcatactatttacacagtagaccctgagaaccctcaatccaatgggtttagtaagtgcctactctgtactaggcatggaattataccacagaaacacagaaagaacagtaaatctcaagtggcccatagcccagtggaaggtagcgttacctttaatgtcaaccatttgaatacgttgaatactaaaggtatgtgtgaaaggccacgagaggcaaaggcaggaggggcggttagggcaaagcgtgtcccctgagtgtggagtcccgatgccagttctgccactagctagccaggggaacttgcttggatgaaggagctacataggctccccatgttggtgaaaccatgatgaatgactggccataggcaagacaaaaatgcaggacaaaagagaaactgcaggctgtgagatacaacccaaacaaaacatttttctctgtggtcctccatttacccctgtgcggtatgctggatctcactgtgtttgctgttgtccctccttgcttgaggatgctgtgaagctgaaagtaaggtggaatgctcccacatagtgagaagggaaaaactgggggctcaggggaagaaggtggttgtccattctctgagcactcccactgaaagctcctttcctttccttcaggcagggaagaagtgtctggctgtgtaccagccagaggcatccatgaacttcacacttgcgggctgcatcagcacacgctcctatcaacccaagtactgtggagtttgcatggacaataggtgctgcatcccctacaagtctaagactatcgacgtgtccttccagtgtcctgatgggcttggcttctcccgccaggtcctatggattaatgcctgcttctgtaacctgagctgtaggaatcccaatgacatctttgctgacttggaatcctaccctgacttctcagaaattgccaactaggcaggcacaaatcttgggtcttggggactaacccaatgcctgtgaagcagtcagcccttatggccaataacttttcaccaatgagccttagttaccctgatctggacccttggcctccatttctgtctctaaccattcaaatgacgcctgatggtgctgctcaggcccatgctatgagttttctccttgatatcattcagcatctactctaaagaaaaatgcctgtctctagctgttctggactacacccaagcctgatccagcctttccaagtcactagaagtcctgctggatcttgcctaaatcccaagaaatggaatcaggtagacttttaatatcactaatttcttctttagatgccaaaccacaagactctttgggtccattcagatgaatagatggaatttggaacaatagaataatctattatttggagcctgccaagaggtactgtaatgggtaattctgacgtcagcgcaccaaaactatcctgattccaaatatgtatgcacctcaaggtcatcaaacatttgccaagtgagttgaatagttgcttaattttgatttttaatggaaagttgtatccattaacctgggcattgttgaggttaagtttctcttcacccctacactgtgaagggtacagattaggtttgtcccagtcagaaataaaatttgataaacattcctgttgatgggaaaagcccccagttaatactccagagacagggaaaggtcagcccatttcagaaggaccaattgactctcacactgaatcagctgctgactggcagggctttgggcagttggccaggctcttccttgaatcttctcccttgtcctgcttggggttcataggaattggtaaggcctctggactggcctgtctggcccctgagagtggtgccctggaacactcctctactcttacagagccttgagagacccagctgcagaccatgccagacctactgaaatgaccaagacaggttcaggtaggggtgtgggtcaaaccaagaagtgggtgcccttggtagcagcctggggtgacctctagagctggaggctgtgggactccaggggcccccgtgttcaggacacatctattgcagagactcatttcacagcctttcgttctgctgaccaaatggccagttttctggtaggaagatggaggtttaccggttgtttagaaacagaaatagacttaataaaggtttaaagctgaagaggttgaagctaaaaggaaaaggttgttgttaatgaatatcaggctattatttattgtattaggaaaatataatatttactgttagaattcttttatttagggccttttctgtgccagacattgctctcagtgctttgcatgtattagctcactgaatcttcacgacaatgttgagaagttcccattattatttctgttcttacaaatgtgaaacggaagctcatagaggtgagaaaactcaaccagagtcacccagttggtgactgggaaagttaggattcagatcgaaattggactgtctttataacccatattttccccctgtttttagagcttccaaatgtgtcagaataggaaaacattgcaataaatggcttgattttttaatgtcatttttccctcttatagtctttctagctccttttcaaaagacgagaatatctgattttctgataatttaggtgcttaagcatccaaaatacatgggacacacaaaaatccaggaatcccctgtagcttattccctctttcccatcggaaccagctctcatcacacatttaaaagatgattctgtttacccaatgctgcatattgaatgttgtgtagttattcacagggaattctgtgcagtgtgcagagagattcctaaacgggaaaaggactgggaatacatcctccttactgtgacctccccaaaacctagtccagtgcaaggtatacagtggtgctcattaaatacttgatgaatacaggaagctgtgcatgtgttcctacttttattcgaagctctcttcttccaaagctacatgaaaatagaattttaacagtcaaaattttatattaagtgccttagcaaaagagacatttaatatttcaaagaaatgcatatgtatgtatacatatatttgtgtatgcgtatgcaagaattcttgtataaagagaattcactccatgaatgatctcttctgtaagtcagtgtgaatcatgttagattttctgagagtgaaaacacctgccatctacaaattacaaggctggataacagctcactccatttgaaattcagtggaaacccaagagctaggttcttactgaatttgcatctcaatttgggaaactgaacttagctttcaaagatcataggaagtctggttggagaaactagggattattctggcaatgggtggaggaaggtggtcagaataacccagtcgccattggttttgagaaacggaactatcttatgcagagcccggagggcaagtctcagacccatgggttgaagccatggagaaggaaatttggatccaatgtaatgaagctctttctaagtcagaatttccctgcaatggtgtggcctgattcaataaaaattaagaataataaatataatggaaaaaaatctccactgattgagtgtttacttggtgccaagcactatgctaagttgttcattattttatttaattgttacagcaattttgagtatgcatctttcactattttataagtggaaaagagaagtgcccccaaaaagttagagctcaaacagcagcttattctaccagcccctgctcttgcggaggcctctggaaaagacctgaatgacacctattggagaatcacatctacaaggggcttcaaacagaccaaatagatcatcacctctgtggtcccttgttaactatatgttctgagacaaaggaaagctaccctaagggttagttaacctttgctgaggaaatttacattcatacttagagtgaattactcaggtgtgcttaggtgtgcaaaagggaaggagacctgaattcaccaagttaaatcttgctaaaccttatcataagcattttttgagcgcttagcatacaccaagccttgtggaaggtgctttcctgccatatctcatttaatcctcacagcaaacctatagaatatggcattatcatctgagtctcacagaagtttagtcgtgtactcaaggtcttaccagctagtgaacagcagaccaagactggaaacccaggatagtctgatacctgagccatctcttcttgtgctacgcctagttattctgtcccccaaatcaaaaggcatgacctttataagaggcgctttactgacaatagctgcaattttaactttgaaaatgattcagaattatcaaagatagtagattcgaatgacatgattgtctataatctcgctagccttgtactgtgtgtgcatagcaattacagggaagtaatctagctcctgactattatgttgaactatgtcgctgctttttacaaacttgtcttgatccaaagcagtcacaatgataaccctgcatatctgggaatcataagtcaactatgtatctctgtgtgtgtatatatatg

SEQ ID NO: 12302 - DNA, 20373 bp, Human
cgcggggagcctgcggggtgggactgcatcgggaaaggggaaggagtcagaggcgagaagggggagagtgtctgtttggctccagccgctgcacgctcttcctgctcaggggactcacggtgaccccggagccactccccagcccagcctccaggtaagaggtcactgagatgggtggcagcaggggccggggatccccctattacgacagcggtcatgggacgctgactcactgccggccagaccacctgacctccgcggcgggaggagagggccctgccagggggttcccgccgcgccttgtttacctccgggaggcctcggcctcgcgtgggggcagggcggccgctggggccgcaaggcgtgcggggaagggccagagccgggtgtccaccccagcttcccaaagactccctcttctgtgcttccttctcccctccccgcccccccccagtctcttcacatgcccctagcccccgcggaaacttcccgcgatcccaaacgggccaaatggcgagaaagcaaaggagctccttcttgggggtgagtggggcgccttgagcgcttcctcaaagctatgttcccagagccacaggccttccttgtgtccctcaccctgctcagaccgggccatagccgggggctggggcaggaaagccggccctcggcgggggccacgtggctctcaggcgcctgggctgctgagtcacgcttggccagcacctgtctgtaggccacagcctctgccagcacgcccctctgtgtcccctgcccctgtctgcaaggcagtggctccagcaggccctggggcattttccactctccaccgccggatgcagggagaggcctgaaccctctccacagggctgctctgggcagggtggaagccttgcccacttcggagccctccgggaaggatcattcacacctgtggaccagcccctgctgtgcgcacacccacacatcaccttcgcacctgactggccccatccagccactcttgcctccctctgggtttcctcccctgggaggtttctccagctcctgcaagccctgggctgaaatggcatgagttggacccagcaggttctgacctcctactcacaggaccttgcctgggaggctccagagggtgaccactcgtcctgcccctctccttgccccagttctggcggacaggttactctggtggcataaagcagtgtttcttccttcctagctgaggaggctgttggctgacccccttggctgcccacaaggccaacgggcctgagcccccacagggccatgggcattacctgctgaattgaggagcccataaggagtcacttggaccacagtgaacacttggcgaccactgacactcaggagaccttagctggtcctccagcacctctcaactccactcctactaaactgggaacttctctggtgctcaggccagagtcggggtccgtcaccgagtatgctatgcgctgcccatcaccgaggatgccatgcgctgtaagagggctgccaccgcggcaggctgaccatggcagggtcggaacagcaacctgagagccagcttgttctggccagcagtgcccactgggcgacctagcagcctcctgatatgggggctgtgtccccctctccctgcactgggtacccccaactgaggatattgctgagtcatggccaggcccaagcctgggaggggcgaggggctggacccccgccagtaccctgatcccaggtgcagaggctggagcccaggcctgtatgagtgccagggccggtttcctggggtccttggtgcaccggggcaatgaagagaggggtcagcaatgagggggccgggagacctggagcgaggggtagcggggaaggggagagtagtgaaggggcctctgcagggcggctctcgcgccgcgacgacggtggcgggggcggggagggcgcgagagactccgcccctctcgaggcggggcggggcctccgcgttcgctacaaaagccgcgcggcggctgcgaccgggacggcccgttttccgccagctcgccgctcgctatggcgtcgctcaccgtgaaggcctaccttctgggcaaggaggacgcggcgcgcgagattcgccgcttcagcttctgctgcagccccgagcctgaggcggaagccgaggctgcggcgggtccgggaccctgcgagcggctgctgagccgggtggccgccctgttccccgcgctgcggcctggcggcttccaggcgcactaccgcggtgagcgggccggggagcggcgggggcggtgacgcaggccggacacggcctcctgccgcggggtggctgccccctcccttctcggcgacgcctggcgggccgtgagggggtctgcgctggctgctccctggatggcggtggcctgcatgggtccccagttcggccatgggagccggcctggtgactggagtggtgaccaaggccgggacccgctgctcagcgtcggccccctggggcggtggagccctgccggccgggggctcgagcctgggggcgtcagacgccccgctccaccccccgcgctgttggggattttggcaaggacgcgccggggcgaacgctctggctctccgcgggcactgggtggtcaggcgggcactcgggttacactgacaccttgctgcgccaggtggtgggttcagataatgccctggaggagccgggcgagcgccggcgaggggagggagtgacgcgggtaaacaagcgcgggggtgcgggggactcgcgagcgccgcgacagcgcctgggagaagggcacggatcgccggcggaacgctccgagccaggtcgagtacagatgttttcccattggcaagtggacgagaacgttcttcagaagtgttggtgttggcccagaagccctgtttcctgctgcgctggtgtgaccagtggctgctgggggtggggttagggaggtggttgtggccaggagggcgggaggtggccaaggccggcccctgggagggtgcagtgctaggacctccctctggagcgctgccagcataccaggccctctcctattcttaaaaaaaaaaaaattgtgatgttattgagctgtaactgaaataagggttcacccatttagtgtacaagtcagtggttttcactattttcataggtttgtggaccatattcagtgtgagagcttttcatcaccttataaacgccatacataccatttatcaccctcttatccacatgcccccagcaacctcctttctgtatctattcatcttgcaatcctggacatttcatgtaaatagaatcagacaatgtagtcttgcaagtggtttctttcacttagtgtaatgtgttcagtgttgtggcacatatcagaactagttttttttggaggaataatattctgttgtgtggacaggccatgttttgtttacctgttcattagttgacagacatttgggttgtttgcatctttgggtgcctcacctgtgccctcggtggatggcgtggtttggtctgcacagctgtgctttaaagccatttcagctcatatgtatctgtcacaaatggagactacatacaaatacgtgtctttcagctttgttagggaaggaagcaggcagatgcccttgtcttctcctttactcccaagccactagaagtctaaggcctttgtggggctgggcccctcaggagcaggtcacaggcagggatctcccacagttgaagacggacatgggcctggtcggatggggaatgaggtggcacgtttctgaaaaggcagctggcccaaggctaaataagtgcagcagccaaagctgctgcccctgtgcacaggccctccgccccctgcatgtggctgtggtccagggcccaggtcggagcactcaccttccaggaggtgccagagcaagggggtagtcttgcctctcactcctgccctctgtggctcaagtaggtgtgtttgtttatagccctgtgagtgtccctttcatacttgcctcagcccattccagcagcttatgtccagctgagaacccctgggtgctcacgtgctgtcttttaaacaatctagatgaggacggggacttggttgccttttccagtgacgaggaattgacaatggccatgtcctacgtgaaggatgacatcttccgaatctacattaaaggtaaggggctgctctgggggctgcctgaagccagctcagcttgtactcagttccctgctgagtaaaaaacagggctcgatgttccaccaatgaaggggtcagcaatttgagggctgtttaagacagagacataggccaggtgtggctcacgcctgtaattccagcactttgggaggccgaggcgggcaggtcacctgaggtcaggagtttaagaacagcctggccaacatggtgaaaccttgtcgctactaaaaatacaaaaattagccgggtgtggtggtacatgcttctagtcccagctactcaggaggctgagacgagaatcacttaaacctggagagcggaggttgccatgagccgaaatcacatgactgtactccagcctaggcgacaaaaaaaaaaaaaaaaaaaaaaaaaaaggacattttaagtgctgtgcctgacctgagaaagaggagtccatgttcactctagggatggggtctggtgccgtggtgcttgggttagggatggggtctggtgccgtggcgcttgggtgaagggcaaggccaaagctgtgcagacagggctccttgctgctgctctgctgcctgggccaaacagacacagggactgggaacctcctagcaggttcttggtggctctgctgccctcacctaagtggctgaattttgtgtggattccatgctggagagcagggccgggggccttgctggcagtgacagccccacagtgacgacagagggggaggactttagggggtcccaccctagcggctctctttacccttcctgtagagaaaaaagagtgccggcgggaccaccgcccaccgtgtgctcaggaggcgccccgcaacatggtgcaccccaatgtgatctgcgatggctgcaatgggcctgtggtaggaacccgctacaagtgcagcgtctgcccagactacgacttgtgtagcgtctgcgagggaaagggcttgcaccgggggcacaccaagctcgcattccccagccccttcgggcacctgtctgaggtgagcaggccctctgtgcaggcctggggtgggctcagggtggcaggaaccttgacccgctcactgcctgccgctctgctaattcctcccccagggcttctcgcacagccgctggctccggaaggtgaaacacggacacttcgggtggccaggatgggaaatgggtccaccaggaaactggagcccacgtcctcctcgtgcaggggaggcccgccctggccccacggcagaatcaggtgaggcttgtgttggaacctgcttctgattggtgacagtagtcaggcagcctgtgtgcagggcccttgtgcaaagcgtgtgtgcaaggcaagaattcaggataccccccaccttcctggtgccctacaatcacacaagaaccctgcaaagtggggtgtattctctccatttcccaaatggggaaactgaggtgcctaagtgcctgaggccacaaatttacctgcacagcccttcctacctcaggaggctgccctctcaaggtaccctgaggtgcaggcagggaggcccttccagcccaggggtctttgatgcactttgttctcttttgtgatggttgtcaggaagatcagagccaaagttgctgaagtcctttgaaacatagttataagtgaaagacttaccgttagctttgtagtctagatttttggattctgattttattaatgttactgtgtcctgtgaatcacctcaccctttgggacaaagatggggatgtttgcttgactttgagtaaataacatatttactcaaggaggtgatcaatattcacagtgtactgagcctgagcctctgtggggttgctgagcaccagggtcacagatgagggggagatggcacgggagagtggagatgctctctgtgcagggccagggggtgcagagtgggaggaaggagagggggatgctgagtgggtcactggacaagatgtccgggttaaaggtcacccgggaacacagggaccttggcaagaaggtgacaggactgtgacaggtatccaaggcattaaagatatctttatcttatctttgtaaaaatcaaagcttctggtccatcggaggatccgagtgtgaatttcctgaagaacgttggggagagtgtggcagctgcccttagccctctgggtgagtgcacctccttgcccagtgcttccctaactcagcctgcactttatgtaactttcacctggaatactgcaaaggaatgggtaattgacatgcccttgacactggtgaggatttgttgcctcaaatcaacctttagtagtgctggaccacgggcaactcaaggttgaattccctgacaaaattctcgagctttctacatggagtgaagtcgaatcagctggcatttggttgggataatcccagtgagggagggtgaccagactgtggttgcaggtcttgcctgtcacctctgactgccctcctttggatgaacaatagtctgcaatttcccctaagccaggccttgggatttggacttttgaggacctgggtagtagttagttgacatgctatttatcttttccttcttttagtttacaacccccaaacctttctggtgcttctgagtgctgggcctgcctcagagcggggagaaggtggaggcaggtgctctgggtgacacccggttctggtgcctcaggttgcacagtgggtctgtggggtgggtgaaggtgccacctgaccccaggcatgagctcaggctctgagacccctccctgctgggctttagaaagtgcctgttgcgtctggctaagggtctcgggtgggtgctgcagggttaggcatgcggcagtgagaatcagtgaatgaagccaacttctagttcaagatgacggtggatctgtgatggcagatggatcgctgggacacctgcatctctcgctagacgagtgagcttgtttttgtgactgcagtggcaggctgtgtccacccagcctgtccaaaggttgtgttcagtgtctgaaagaatgctgctaggaggggcgtccgaaccatgcctgctgcctcctgtggctacagggcgtgactgccatctgctccaactttgctcattccgatttttttttttttttgagatggagtcttgctctgtcacggaggctggagtgcagtggtgccatctctgctcactgcaacctccccctcctgggttcaagtgattctcctgcttcagcctcctgggtaagtgggattacaggtacccgccaccacgcccagctaagttttgtatttttttagtagagacggggtttcgccacgttggccaggctggtcttgaacttctgacctcaggtgatccacccgtcttggcctcccaaagtgctgggattacaggtgtgaaccactgcgcctggccttgctcattccactttgaggcggcagtgacatcttggcattgcttctgaactaaacagcccaaacacgcatggcttctgtactagagtttagaggtgaagtcagagaataggaaagaagaatcgctagtctgtttttttttttttttctttgagacagactttcacccttgtcgcctaggctggagtgcagtggtgtgatctcggctcactgcaacctctgccttccaggttcaagcgattctcctgcctcagcctcccaagtagctgggattataggtgcccaccacaacgcctagctattttttgtatttttagtagagacggggtttcactgtgttggccaggctgatctcgacacctgcctcggcctcccaaagtgctgggattacaggtgtgagccaccgagcccggccaagaatcagtattcttaatgctttccaaggagggtaaacagtggagcaccgaggtcatgattgagagatcggctgtgcctaaatcctgccactcactctggacgtagtaaaggtctgagagattgccggtgaatttggagatatgaacaagagtccttcactcaaagaacaaaggagacatcccgggaagtcacaaaaccaagtctaggttcaggtagagacttttaaaacagtgcagatccccagaccttaccttttttgatcctggtgagtgagtgttggtggggcctgggatttgtctgggaggctgcccaggtgcttggggtcacactgtctcaagacccacctgtgctggtgcagcatctcggaactgaactggacgccccacttggcacagacaggaataatcttgcagatgctcagatgtctttttttttctgagacggagtctcgctctgttgcccaggctggagtgcagtggcacgatcttggctcctgggttcacgccattctcctgtctcagcctcccgagtagctgggaccacaggcgcccaccaccacgcccggctagttttttgtatttttagtagagacggggtttcaccttgttggccaggatggtctcgatatcctgacctcgtgatccacccgcctcagcctccccaagtgctgggattacaggcgtgagccactgcacccggccctcagatgtctttgagcactaaaagctaaaggcttaaagtggatagaattgctttctccgaactagggaggagcctgaagctctacaaacaaggaatatttcagtaaaatagactgagtggtttcagctgaggagagccagtggaggagcggcttagactgttgtggaagttagggctagtttctttctttatgaggaactataagctggatgactcacaggttaactgcctagaagggactgttcccagagcagggcccaaaggggaacgaacgagtcaacagctgcctcccggtggcagtgtgtgtagggtaagcggcagctttcatgtgaagtgccaaggccttttggttggggggctgagaacctgctgagggagccacaactgagacccaggctgctcctggctgggaggctacaggccccgaagccacagggcccctcctggtcgtgggatctttgataaaccgacacgcagaggctttgtgaggcagcagggcacggagcatcgtctagtcttttttttaagtgaaagcacatttcttaagaaagtaaaggaatacaagaatggctactccgtagacaaagtagcctgtccagtcttacgacaaggcctgaaaatctcacgctttcatcaccaagttggagagatcctaattctataatttctctgatctgcttacaggcgagtctcattacccatttacaaagcatatgggtattgattgtactattctttcaacttttcaacttttctgtttgtttcaaccttttttttttcttatctttttttttttttttttttttgagacagacttttgctcttgttgtccaggctggagtgcaatggtgtgatcttggctcactacaacctctgcctcccgggttcaagcgattctcctgcctcagcctttcccagtagctgggattacaggcatgcaccatcacgcctggctaattttgtatttttagtagagacgaggtttctctgtgttggtcaggctggtctcgaactcccgacctcaggtgatctgcccgccttggcctcccaaaatgctgggattacaggcgtgagccactgtacccggcagcttcaaccttttcataatcacaagttgggaagaataaaggagaaaaataatttaaatattacagatggaggtacttgtagttaagcctgcttttacctctgctccccccttaaactctattgaaataacaggaaagggcttacacaaaaaagaaaacaccatagacaaagaaagtaatagaggaaaagacaaagatgtgatcagattttggaagatggacatggagggagggtggcaacctgctgagggaagcttcagaaatctctgtgccagaacagggcatcctggtgagaaggaagaccatctgttcaggtaccaggaaaggcaagaggtgggagtgatcgggggacaggaacaaggggggagggttgaaaacctctagggagtgtcagctagagacttcagggcccacttggccagatgatggctcttgccaacaattgaaggagacctcatgtttaattccaggagcacctgacccagggaagcttcagcatgggatactagagacaggccagggtgaggcaccagcctgaaactgggcatcccgaatgagcaatgggcccagcagtcagttccctggccaggcaggaggtggggagtccctgctgagggaggttgaatgcccccagagaagtgtcctacagctcctgcctgccagacccccaggcaccctgcagagggaaagttagtgatggcgctggccccacagaaggcttcctgtcaaccttagtgcttcagtgggatcagacccctgggtcaccagccatctgaggaaagcccccacacatgggagaaaaggtcttaaagggaagagaatgttaatgtcctcagtgagatacaaaagagcattgtctgcatgaaaaaggaacaggatactagaaaaaggataacaaagggaacagaataagaaagttcttaaaattaaaaaatagaaaaaaaacttcaaaagaaggcttagattctactattgtctcaaggagatattccaaaagcaaaatagagataggaggagaggaaagataaaaaaactaatgtaggaacaagtctagaagcccaatataggatgagtaggaattccagaaagaatagaaaactgaaaggaggaaatgaacatagaatgcaagatagtttcttggcaccaggcatggtggctcatgcctgtaatcccaacactttgggagaccaaggcaggcagatgacttgagctcacgagtttgagaccagccttggcaacatagggagacaccatcccccacttcccgtgtctacaaacactatgaaaattagccaggcatggagttgtgtacttatggccccagctacgtgggaggctgaggttggggatggcttgagcctggaaggcagagggtgcaacgagcctggattgtaccactgcactccatcctgggagacagaaacagaccttgtctcaaacaaaacaaaacaaaacaaaacaaaaacaaacaaaaatgcaagatagtttcttggcaatgaggacattatcttctagattgaaagcggccctgacaatgactgagaaagaccccacagcaaagcttatcattgtcaagtgtcagaaccctgaggataaagaaagaggggcttctaaaactctaggttattgtaaatacttgggaatacaaagagcaaacaaacatgaacagctaggagacaatggaacaactgatgactccagaaatcagttaaaaaggcttttcggcctagaattcttttgtttttgaaaccgggtctcactgtcatctgggctggagagcagtggtacagttgtcttcatctcgtgggctcaagtgatccttctgcttcagcctccccagtagctgggactacaggcatgtgccactgtgcctagatatttttttttttctttttctttccccacccccgagtcagagtctcgctgtcgcccaggctggagtgcagcggcgtgatctcagctcactgcagtttccacctcctgggttcaagcaattttctgcctcagcctcccgagtagctgggattacaggcacccgccaccatgcctggctaatttttatatttttagtagagatggggtttcaccatcttggccaggctggtcttgaactcctgacctcatgatctacctgccttcgtctcccaaagtgctgggattacaggcatgagccactgtgcccagccccgtgcccagctattttaaaatttttttgtagagatggggtcttgccatgctgcccaggccgattttgaactcctgggctcaagagatttctcatgttgttctcccaaagtgttaggattacatgcatgagtcactgtgcctggtccagcctagaattctatacccagctaaaacgatcaagtatcagggcagaacaaagttactttctggtatacagtcttaattattttaaccttggtttgaaccacatgaagagagaaacccaaaatgaagcacagaggtattaggaaacgggggacctaacaggacagagggtgaacgtaaagggggtcacagcatcacagcgcagcctctgcccagagagctgccagtcctggctggaacaggaggctgcacagcaagcggcactctctatggaaaacaccagaaccagtggggtctctgatccacttcacccttgtagaaaactatggagatgctgtgggagaacatagggaaagttagcaaatgcaaagagaaggcaggctgggtgcagtggctcatgcctgtaatccaagcactttgggaggccaaggcaggcagatcacctgaggtcaggagttcaagaccagcctggccaacatggtgaaaccccgtctctactaaaaatataaaaattagctgggcatggtggcacgtgcctatagtcccagctactcgggaggctgaggcaggagaatcacttgaacctggtgggcagaggctgcagtgagccgagagattgcggcactgcgctccagcctgggcaacagagcgagactctgtctacaaaacaaaggaaaagagaagccattatcagtggtaggaaaacaaaaagcgatacaaagaaatagtctgctacttgacccagcaaagaacatttagatagaggtcctagctgaaacattgaatgttctttttttttttttgagatggagtcttgctctgtcaccaggctggagtgcagtggcgccaacttggctcactgcaacctccgcctcccaggttcaagcgattcttctgcctcagcctcccgagtaactgagactacaggcgattgccaccacgcccagctgattttttgtatttttagtagagacggggtttcaccatattagccagggtagtctcgatctcctgatctcgtgatccgcccgcctcggcctcccaaagtgctgggattacaggcgtgagccactgcgctcggcctactgaatgttcttttaacaaaaaattgcgtcttggaaagggtagtggaaggagaggcaggtactggtccagagtaggaagtgcgcagatgtgaactccagcagcaggcaagagcagcgtgagctgaaagggcacagggagagtttggggagtgggatgggggcagggagtgtgcaccacagcctttggcaactggtgactctaagctgtgggtgtggagacttttgacacatttaatttcaaaaatagtgcaggtgattctcccctctgtccctggtgagtcacgtgagcctggaggtgtgcaggttccctgtggggccagcgttgggccctacgcagcgcctgcacggcccatccacctcccagagcagagctccggcgttgaggtgtgcgtgtgtgtcgtcgcacaaagcctctgtgtgcaggtgtcaggaggcacatggccttccatcactgtggctggaagcgcctgccacatgtggtattggctctccctgtacttagggcctggccccacctgccgtgtggcccgtgtcctgcatggttaggaaaaaggtctctttcgactttctggctcagaagctgactttagatgctagctgaggttaatgttttactgaattggagaaagagaaaggtccagtatcatgggcccaccaagaatgtttccagaagccacagagatttgtagctgggatatggggagaagcctctgactcatgggtttgtatcgtctggtcccatactggctgtgtgattccggggtcgagctgggtagaacctagcacctgcatccacacgctgagtgccaccatccagacacttagctgcttgtggggactgaacgttgagatcttcgtgagtctgtagtctccacaggccaagctcctgcttgcaggtgcatccttgggggaacttcacggcttgctctttcctcctccgcctctaggcattgaagttgatatcgatgtggagcacggagggaaaagaagccgcctgacccccgtctctccagagagttccagcacagaggagaagagcagctcacagccaagcagctgctgctctgatcccagcaagccgggtgggaatgttgagggcgccacgcagtctctggcggagcagatgagaaagatcgccttggagtccgaggggcgccctgaggcaagcctgtgcccctcccgccacctgggaccacggccagcctagtgatctgtggcctgcacctccgcctcatcctcagcacctctgcagccccacttacaaacccgagggagctgctgctgctgcagtgatgtctgtgccattaaagtcacgctgggaacctgctagaactttgtagttacttggtctttgtgagtggccactgttccccctagacccctgcagccttaactgcacgtgtgcatgcgtgctccccgactgtctgccaggagccagggccatggtcaggcttggcctgttgcgcgtgtctcctgtgtgctcatggtgagttttgttccaggaacagatggagtcggataactgttcaggaggagatgatgactggacccatctgtcttcaaaagaagtggacccgtctacaggtgaactccagtccctacagatgccagaatccgaagggccaagctctctggacccctcccaggagggacccacagggctgaaggaagctgccttgtacccacatctcccgccaggcaagtgaaccaagaggttttgtacatattcctacctttccctttagagcatcctgccctcctctgatttcagcgacacaaacagaaggatgagatgttctccactgcagggctgtctgtaggtgtgggaggttaggagttggttttgtcctattatgtgtaccctgagcaatagcgagtaagctctgctaatgcagttctgaaaatgtttttctttaagcaaactccagagccaggaatattaattgtaggagtttctaaaacttaacatgcagaccaggaattaaggcaggtgtgacacagagagggggcagcactgggtgtgtccctactactcacactcaagtgccgcctcagggagtgctggtctgagggggggggggggtcatagccaagatccctgtaggagccaggcagaagccaccgttgaagtggatggtgtggcaggcagcagtgggggggtggggggtggggacagctgacagaaactcctcattgtcacatggcagccgtgtgtaaaccaaggtccgtgtgcacaacctgctgtgggccgccgctgtgtgtcttctctgccttagggcaggggatggcgagctatggcctatgggccaagagtagttcttatttttgtttatttatttatttatttatttttattgatcattcttgggtgtttctcgcagagggggatttggcagggtcataggacaatagtggagggaaggtcagcagataaacaagtgaacaaaggtctctggttttcctaggcagaggaccctgcggccttccgcagcgtttgtgtccctgggtacttgagattagggagtggtgatgactcttaaggagcatgctgccttcaagcatctgtttaacaaagcacatcttgcaccgcccttaatccattgaaccctgagtggacacagcacatgtttcagagagcacggggttgggggtaaggtcacagatcaacaggataagaatttttcttagtacagaacaaaatgaaaagtctcccatgtctacttctttccacacagacacggcaaccatccgatttctcaatcttttccccacctttccccgctttctattccacaaagccgccattgtcatcatggcccgttctcaatgagctgttgggtacacctcccagacggggtggtggccgggcagaggggctcctcacttcccagtaggggcggccgggcagaggcgcccctcacatcccggacggggtggctgccgggcggagggtctcctcacttctcagacggggcggccgggcagagacgctcctcacctcccggatggggtcgcggccaggcagaggtgctcctcacatcccagacagggcggcggggcagaggcgctccccacatctcagacgatgggtggccgggcagagacgctcctcactttccagactgggcagccaggcagaggggctcctcacattccagacgatgggcggccaggcagagacgctcctcacttcccagacggggtggcggccgggcagaggctgcaatctcggcactttgggaggctaaggcaggcagctgggaggtggaggttgtagcgagccgagatcacgccactgcactccagcctgggcaccattgagcactgagtgaaccagactccgtctgcaatcccggcacctcgggaggccgaggctggcggatcactcgtggttaggagctggagaccagcccggccaacacagcgaaaccccgtctccaccaaaaaaacacgaaaaccagtcagtcgtggcggcgcgcacctgcaatcgcaggcactcggcaggctgaggcaagagaatcaggcagggaggttgcagtgagccgagatggcagcagtacagtccagctttggctcggcatcagagggagaccgtggagaaagagggagagggaaagctatatcattcttatgtctttgcatcatcatagcttagcatctactcataagtgagaacatatgatatttggtatccattcctgaattactttacttaggataatggcctccagctccgtccaagttgctgcaaaaggtattatttcgttcctttttgtggctgagtagtattccatggtgtatatataccacattttctttatccactcattgcttgatgggcagttaggttggttccacatctttgcaattgtgagttgtgctgctccagatatcatctttaactcctttgccttctccacatacatttccaagtcctgttcattctacctccaaaatgtatcttgtatccattcatctctctccatcttcaatctatttcaatgccccatcatctcttgcatggaggagtgtaataattggctaactggcctgttcttacattttaaaatcaaaagatgtgacaggtgaaatgcctatttcagtgtccattgatggttctgcttacacaccacctggctgcctggtgtcgcagtggcagagttgagcagtgtgaaaaagactgcttggccctttacagggaaagcaggtccactgtggcctgtgaggacgagagctctgggcaggctcggacactggcagaccctggtcctggctggccaaggcagcagggtatgtgtttcgggtcactcacagggctcagcaccactcctcatggcttccttactgtttcggcagaggctgacccgcggctgattgagtccctctcccagatgctgtccatgggcttctctgatgaaggcggctggctcaccaggctcctgcagaccaagaactatgacatcggagcggctctggacaccatccagtattcaaagcatcccccgccgttgtgaccacttttgcccacctcttctgcgtgcccctcttctgtctcatagttgtgttaagcttgcgtagaattgcaggtctctgtacgggccagtttctctgccttcttccaggatcaggggttagggtgcaagaagccatttagggcagcaaaacaagtgacatgaagggagggtccctgtgtgtgtgtgtgctgatgtttcctgggtgccctggctccttgcagcagggctgggcctgcgagacccaaggctcactgcagcgcgctcctgacccctccctgcaggggctacgttagcagcccagcacatagcttgcctaatggctttcactttctcttttgttttaaatgactcataggtccctgacatttagttgattattttctgctacagacctggtacactctgattttagataaagtaagcctaggtgttgtcagcaggcaggctggggaggccagtgttgtgggcttcctgctgggactgagaaggctcacgaagggcatccgcaatgttggtttcactgagagctgcctcctggtctcttcaccactgtagttctctcatttccaaaccatcagctgcttttaaaataagatctctttgtagccatcctgttaaatttgtaaacaatctaattaaatggcatcagcactttaaccaatgacgtttgcatagagagaaatgattgacagtaagtttattgttaatggttcttacagagtatctttaaaagtgccttaggggaaccctgtccctcctaacaagtgtatctcgattaataacctgccagtcccagatcacacatcatcatcgaagtcttccccagttataaagaggtcacatagtcgtgtgggtcgaggattctgtgcctccaggaccaggggcccaccctctgcccagggagtccttgcgtcccatgaggtcttcccgcaaggcctctcagacccagatgtgacggggtgtgtggcccgaggaagctggacagcggcagtgggcctgctgaggccttctcttgaggcctgtgctctgggggtcccttgcttagcctgtgctggaccagctggcctggggtccctctgaagagaccttggctgctcactgtccacatgtgaactttttctaggtggcaggacaaatcgcgcccatttagaggatgtggctgtaacctgctggatgggactccatagctccttcccaggacccctcagctccccggcactgcagtctgcagagttctcctggaggcaggggctgctgccttgtttcaccttccatgtcaggccagcctgtccctgaaagagaagatggccatgccctccatttgtaagaacaatgccagggcccaggaggaccgcctgccctgcctgggccttggctgggcctctggttctgacactttctgctggaagctgtcaggctgggacaggctttgattttgagggttagcaagacaaagcaaataaatgccttccacctcaccgcaaaccttctgctaaattgcatgaccaggctttccaaaaacaagacattctcatgtcatcaggtgatccatctcctggggaccttagaatcaggttaccggtgcctacaaaagaattttgagcagaagggcctcgagacatcgggaaaggggtgcgctggctccattctgctacctcccaccggggggcagctctccagagcctgccgggttctgcagctgcagaggtggcagcaccgagctccctgtgggataggactggtgctggggtctggcttctctcaccccaggaaccaaagatgctctgaaagttgggtgtcggccgggcgcagtggctcacgcctgtaatcccagcactttgggaggccaaggcaggtagatcacctgaggccaggagttcgagatcaacctggccaacatggcgaaaccctatcactactaaaaatacaaaaattaacctggcgtggtggcacgcgcctgtaatctcagctactcgggaggctgaggcaggagaatcacttgaacctgggaggcagaggttgcagtgagccgaaatcacgccattccactccagcctaggcaacagagcgaactctgtctcaaaaaaaagaaagttgggttgtaggctgggagcagtggctcatgcctgaatcccagcactttgggaggctgaggcaggcagattgcttgagcccaggagtttgacaccagtttgggcaacatggtgaaaccccctcttctacaaaaaattagccaactgtggtggtgagtgcctgtgatcccagctgctcgggaggatcacttaagcccgggagatggaggctgctatgaggtgtgattgtaccattgcactccagcctaggtgacagagtgacaccccatctcaaaaacaaaaggctgggtgcagtggctcatgcctgtaatcccagtactttgggaggccgaggcgggtggatcacttgaggtcaggagttcaagaccagcctggccaacatggggaagccctgtctctactaaaaatacaaaaattagccaggcgtggtggcgggtgcctgtaatcccagctactcaggaggctgaggcaggagaatcgcttgaacctgggaggcggaggttgcagtgagccaagatcgtgccattacactccagccaggggaacaagagtgaaactcctactcaaaa

SEQ ID NO: 12303 - DNA, 65552 bp, Human
ggagtcgcatctctctctggacctcagtttcttcacgtgtatttgtgtattctctggggtggagctggcgaatagctggagacccctctagctctaccattttttgattctaattaaccaaaaaggatattcgaggtccccgctacaaattctgaacccttggcttcccctccaaactcccacacaaactccaccccatcctgcctgtgtgtctttgggaggatcatttccttctttggtcttggtgtccttgtttacaggttgagggatgataagagtcacctgatctgggcaagtcaggccataaataaggcttgtatgtaaaggtgcctagcatagttcttggcaaagcaaggatcagtcgatatgattgcattggtttgtgcatctgggaagaatgagcagactgcatactgtgtgttagggtgtagggaggaatcagacgtgaccctgccctctagtcatctgggtgcacagattctagattaaaggatgtgggggtggtaactaacaaggagatggagaggaggtgtgcagttcctgggggatctgatgaagaattaaagcagaagggtaggagatggagaatgggaaggcatacctgaaaccctaaagcaactcttgatgagtaggcattggcaggaggccccagaacattttctgaccctcaaacactgagaatgcatgtctgctggggaatagtagtgagggggctaagggtatgggggtgttcatgcctgagtcaggggctctggatggtagaaatgtctgggagttctgacggaatgggggtgaggaggcctaaagataacctgttcatagtctttcagggccttaaccattatggctggggaagtgggaagtgccgatggggtatgcagaggagggcagctgtgatagtacatttcatcctgaaagcactacatgtggataatgacggtagtgatgatgccctaattttagtgtcatggcaacattttccaaggggatggaattgggtaccctcattagtgtcatttttgtttgagagatttcaagagtctatctaggtgtcattttaaaatctattgaaaaaaaatcttgaatgcaggtcactgaccagttggttccatgtaactgcactgccttctgctaccactaaagcaatgttatgacaacctggacaagtcatgggaaacctatgtgagacttagttttttctttttctttttggagttgggggtctcactatgttgctcaggctgatctagagctcctgggctcagacaaccctcccgcctcagcatccccaagtgccgggattaccgatgtaagccactgcacccagctgagacttagttttttcatctggaaatgaaggcgacctttgtgatcccagtgggcccttgcacttgtgtataaggtgattcccagcactgctcatgaaagtagtgatggcagagtagcctctgctctccattttatttttggggtggggggggcagtggtggaggggaggatgaggatgatatttccattaaataagtttccttgttgcttttcttcaggcaccactgacctcgatggaaaaatgaagtccctggcccaggaaagagacccaactctgtggctgttttggattagtttgtacaatgccctgcagacctactctctcaggaggctccaagtgaccaaatgtgacaagaaagttttttgtccaaggcagtttggaagagaagttggtgaccgtcgggataccacagccgccccaggacggcctggttgagacattcactggagggtctgggtgcagcccgctgcctggccggtaggcggcgcgcacaggccgtggggcccgggtctgggcgtgcgcgcggctggtagcagcggggccgcgcacgccagggtccgggagccgggccggtgcccccggagccatttccgggaggggcgaggccggcggctgccgggcctccaatctcggcggcggcggcggcaacaggggagcctgggtctcgcggcctgcgagtccgtcgcgtgctgagggagacgcaggaggtggagccggccgggtgctcgagggaaggagactggaagctggttccggcgtgaggaggtggaggggccgccgcgggctccggggggcggtgagggtcgggacggaggcgccgcggggtgaggagaggacaggggccgggtgggccgagggcgggcagaggcggcggggcggctgcgcccggggcgggggcgggggccgggctgaagcgtgggcaccagccgctgaggtccaagcaagtggacggcgggcgggcgcggggccgcggtggggcgggtctggagcccacgcctgccgcggggtaggcatgggcggccaggatttgctggtcctccgacgggaggggtgacaacgagagcgaggccgtgctgattctgaagggagtgcggaggaggcaggaccctggtagcctcggcaccttcagcccgggttaggtggcctgggctgggctccccaccccgatcgcgcgcagacggggcgtttcccctagtttccacctgggtggaatgctttgtgggagtctgggtctggattagtttcatcagctgtgggagggaaacctagttgcagcaggattttgattcgctggtctggggtgctaggggtggactgtgatatctgggaatgaaatctgagccttcaaaggagggagagaaccataacttggctgctctggcgaatctaggcgggctggcgagacagtttaaagctctagaagtaaacaaacctggttcccttttacagagtctgaaaaaggggagcgcggagaggaggctggaagaggaagatgcctagcacagaccttctgatgttggtgagccttttgcagacatcctcctggttccaaggcatttgtctccgtttttttagtccaaaggatcccagtgtgtagatttcacctctgatgcttgcttttggtagctgagcgttttgccaccttttattttgttttgttttgttttgtttttttggagacggagtctcactctgttgcccagactggggtgcagtggcatgatctcggctcaccgccacctctgcctcctgggttcaagcgattctcctgcctcagcctcctgagtagctgggattacaggcgcacgccaccacgcccggctaatttttgtatttttagtagagacggggttctccatgttggccaggctggccttgaactcctgacctgtggtgatccacccgccttggcctcccgaagtgctgggattccaggcgtgagccaccgcgcctggccaaccaccttttattttggatgaatgatcaggatgaataaatagctgaattaaatacatcaatacagtatatgtagaacttaaattattgaagaatctttttcaaaattattattattttttttaaatgagacaaggtcttgctatgttcctcagaccggagtgcagtggctatttacaggcataatcatagctcactgtagcctggaactcccacttcaagtgatcctcttgcttcagcctctggagtagctaggactaggagcacaggtcacctctcctggctttctttttcataattcttgcagttttaatccctcccttcccgtactaccagagcagttttgaaacctctattattacgttttatcagggtctgccatatactagtttatctgagtgtttgtcttccagattagagttatggttcctcgacaggcagataatcatgtcttctttgtttagagatgaataaacacctagcatggtgctctgaatatagtatgtgcttaacaaatgcttgttggattgaaccagtatgaatttaagttcttttgttggacagagaggtatgcctgctttagagctgtttcctctcctcctgagatctttctgtgctgttttactgagcagggaagaatagcgttgctaaatgcatgtttaccaaaatgacattttatttttgggacttttatgattccttatggacttcttagtgtgagaattatggagagtttatagctttgaaatggtggtatagaaaaagtgtccgggtttagttttttttgtttcgttttgttttgttttgtttgtttgtttttgagatggagtttagctcttgtctcccaggctggagtgcaatggcacaatctcagctcattgcaacctttgcctcccgggttcaagcgattctcctgcctcagcctcccgggtagctgggattataggtgcacaccaccatgcctgggtaatttttgttttttaatagagatggggtttcgccgtgttagccaggctggtctcaaactcctaacctcaggtgatccacctgccttggtctcccaaagtgctgggattacttacaggcgtgagccgccgtgtccagccaagtttgtttgtttgtttgtttttgtcacttctctgagtgcaaaatcagtgctttaaaaacaattcatttctctctctttatctcactatcccagagggtgggttggcgtcactgggaaactggcaaaaactggtagtgagatttccttatactgggtgctgacatcgtagtggcataacctgtaaggtctgcaggggggctaaagaagagagaaactaagttttgatccattgtgatttgaggcagggatctaggataattttaggttgtatgtgagagacatagatgaatacttaggttatccgcagatcccaatgaaaagttcatctaaaatagtatcttgccccaaatttcatggatttttcagttttaattaatacccttatataacttaaaattcttattcaaagaccattatgttagaaatactggaaactataagtaagcaaaaggaaaggggatttgttaatctcccctatctcctacatccccttcattcgcctctaccccgtgcagtaatttatcacccagaaataaccgctgtgagcatcttggatggttaatgcagagtgacttgtagcaattgacagtttctgtttatcctcttacagaaggatatgtttatgtaaattataggttcttatatgtaagatatttccccatgcacagagatatggttattacttatagggcctatgcatttactttaacagaacaatgactgcttttactcggaatattaactttggaatcagttttcttttgaggtatttctctagctgttgccaccacctttcacctcctcacctgttaatttagaatgtttaggagtgttgctttgcttgttgctgtaaggaattaatccacatagatgcgagtggccctaggcagtcatcactttctgaagacaacatacatgttgcatgaagtgctttcactggaaaagttgtcattcattccttgactgtaatgtataatactatttggaactaactggtaaagaaccaataaccatggctgggttttcagtggcacactaacccatcattctatgaggtgtttctcaagctactttatatgatatgtaaaacatgttcttggccctccacctgggaagaaaggacctaagtgaataaaaaaataacctcagtgcagtgcagcatctcagaattagaaatagtcttagaagtcatgggatgcagctttttttttttttttttttttgagacaaggtctcactctgatgcccaggctggagtgcagtggcatgatctcagcttactgcatcctcaatctctgaggctcagatgatccttccacctcagcctcctgagtagctgggacgacaggcacatgccaccatgcccggctgatttttgtatttattttttgtagagatggtagtttgccatgttacccaggctggtatctaactcctgggctcaagggatccaaccgcctgccttggcctcccaaagtgctggattacaggcatgagccactgtacctggcctgtgatgcagcttatattatacatgaatctgttgaagagtatctctggtaaatggatatccagtctcccgtcttttctgctaatggaataagtgagcaaaagctaggaaacaatacaaggtggattcaggaatagtaatgttaactctgatagctaacatttattgagcatgtattacatgttaagtgtaggaatactgtacttatttaattttcacaaaaaccttttggtatccttcttttacagatgaaaaacgaggcttatagagagtaactacagcagttgagtggtggagccaagtttgacctcagttggtctgacttcagatccctccctcttgcctactttgtgtccttacccctggtaagggtagaggttgctgaccattgtgactgatgggagagggtctgtgtggagcagatgggataggatagctccaccctctagggggcactttggcaatgggggactgggggaggagggagtcttttttcttctagtgtagtctgaaaatacatgttttattattaaattattattaaatcttgtttattgggtcaggcgtggtggctcatgcctgtaattccagcactttgggaggctcaggcgggcagagtacttgaggccaggtgttctagaccagcctggtcaacatggcgaaactctgtctctactaaaaatacaaaaattagctgggcatggtggcgtacacttgtattcccggctatttaggaggctgaggcaagagagttgcttgaacccgggaggtggaggttgcagtgagctgaagctgcaccattacactccagcctgggcgacagagcgagactgtctcaaaaaaaaaaaaatttgtgttttattttcttttacgtcgcatttaatgaattatattgaaattttaaaacttgtatctgcaggcatagtgttataatctttaaatgccatgtcagagtagcaaaagggattacagaatatttgttataaaaagagggcattgggtcatagagttgaagactacttgtgtggacagtatgctgtgagagaaaacctggagatgacctggagtccacatataacaagccttgaatccagactgacaggctcgggctatcagccctcagtgtgttcctgccctcaattttgttatcatttgattaggatagtttgcttgcctttttccatttgctcgtatgtgatgtgtcatagactgcagtactttccacctgtgtctcatagagaataaaatgagtatgttcatctgctgagagttgtgatgatgtcagagggaattcaagtcagacagctttgtagcagcctttctcccccttggcaaccattctttttattcatactctcctccttggtgctagagggtggtatcactttgcaagttgccaaatatttgtagtttttaagaaaaaggtattttataaagccagtctaccccttaggtggcttttttcttttctcatcagaaaatgatgactaaattagctgatattcatagatgaatcaaggttagcgtgtgcaccctggtagtgctaggtggggtttgagtgataattgcttatctagggcagtggttcttgaccaggggcaattttgccctctgggtgacatttgacaatgcctagagacattttgggttgttacacctgaagggttctgctggcatctagtgggtagaggctagggatgcaaccaaacaccttacaacgcacagtttcctgcaaacaagaattatctggcctagaatgtcaatagtggtgaggttgagaaactggtatgaagtttcttaccatagatacctggatatctgtgtagtctatgctttcatatgggtgggggagtgattcccttcttggaggttaacgtgtctgttattgtctcacttggggttattttgcccatgggtcaagccttgctgctcaggaatatatattggagatggtgcagctgatcttttatagcaatgcagaattcttaagaaatgctgtcctttgcaacatttctgcaccactcttttcttgatttgcaaacagcaagcttccctcagttttgttttttgggttcaaaaattgaatctttccaggtccttgagcgtctttatctgtgacccttgactctttttcagggatgctttctttctgaatctcaagtgggatttaagcaataaactgaaagattgaccttaggagctctgttctattatttgagccttgtgtcttgtttgtaggatttgctagaagaaagggaaaattcattgggattgttgataggacattaaaaaatttgttgacatttgagtggccattgcaggatgaacactgtatttggcaatctcccagtgttatagatgaaacagagctgtaataatttccacagcctttggtttaaaggaaaagagggttataaacagatagaatccaaatcccagtatttgacttagcttttcagtctatgtgtcaggaatttttagtaatatttaccttcttaattaggttttacccaatctaatattatatacagtttgtgcacattggtggcagaattgagaatcagcctgggtttaagaatttccatagggaattgatgtgaatcagtctgtatgtgtaaatgtacagaacccaattactgagataaaaaccatgctgtgggggaaggggagataggggccctctgagaagatggaatggtgaaggctgcgagtagtttgtggatatatcagtcatatcttggcataatccaacagcgtactaagggatcaagggactattttcaaggctgagcaggtttaaggaaaacatctaggtgaaacatctaagggctagctagcaataggagagccattatcactcttttttttttttttttgtcatggcaatttcactgaagcttttattgcctctattggtaatatgacagggactgtaagaaacacaattgaacttacagagatatgcagatgatattcactaaagataatcttcatctcaagtattttttatatgtgggcacttctaattttatacatttttctatttaaaaagcattacattttaaaatttgtacctgttttgacatttggcaaaaaggaaactgtacctatggttcagtttaaaacaaagaatcagcatggggagtttaccggaatgaggactgaaacacttaggagttaaagcaattcaaggggcgtgtgtgtgtctctccctttctccgtcaatctctctcactctctctggctctctcacagacacagactcaaacacacacagccatatgtgtaatcattttttagtacaaaatattccctgtagccagacatttatcttcagaataatcacaccacattaaatcagtcttctcttttcagccctagtaaaagttttgtttaattctaagatgccatcatagtgatgaacaaccttaacttttatcctacataattatattcaaagctttatgtatttttgtttataattacacagtaattataaatgtttagtaccaacctgatgacaaacactattttgttgaaaaggttttgcatttaaaaagaaaaatatgtaaaatccaaggcactaggccacgaaccaatatcagacttttaaagaaaacactttatattgaaaaaaaaaaaaaaaaaaagctaatgggatctcatttcaaaacacagcatatgtgaattaatcaatctgaaaccaataaccataactcaaaatcttcaagacaggaaacaaaacagtacatatatatagatatatagatatatatatcttttaaaaatttttcataattgaagttcctctttatatttacaaaaaaatcaggaaatactgaaagcagcaagattcttctttttcctttttcttttaataaccaattccagtagcctgaatagaaattttcagatttttcttttggtaaaactgcattcttgaattaaagttatgattggaatattgatatgtctatagggaaagctttctagtctatttcaaaatcatgtaaataaaaagcagttttgatatgtcattgtttcttaaaataatttccatatttgcataaaatgtactgctattctaagtacattcctttgttaatatcaaccctagaccttagagagtgcctggatatatatcccaagcagaatctgttcctatcaaaagaccataatcatcgaacatttgaagcattacatttctagcctgccttacggaaatgtttaagaaagcaagaaacccttcttcacatgtcagtaagtgaacagggaaatgaccattttcagcataaaagcagctcatgggtaatgaaaaaaatacatacaagatagcattctgctttgatgagaaaactgagctaatctgagtgaaacaaaaacagtaaagagactagaagccagattggtattttgcatcatgtatgcttgtttgaaaatctttgctcctgaagtaaatatttggcaaccaagtgattagcgaccacaatttcaacaaaataataagtcattgaaaatggactatttgtctgaaagagcaatacctatattacaaagattgaacttcatggctcattacaaccattttcaaaatttaactgcaactatcttcttataaattaagagagtttaatttgtgttccatagtgcgatgacaaaaaaaaagtaaaaacaaaacaaaaaaaccctcatgcctaaatttagaatattgtattatgtagcaatccaaaacattcaaaacaaattaaatagtttaacttatgtgacaggcagataagcatttcaaaagcataatgaagtccaattatgtagtgcttaatgtagacaggagaagaatctaacattatgcagacattttctaaataaaagctccctgtaggacagctatatataaacatgggtaaggtaagcgcagactagttctgtggaaccttttgaaatcaagagtctaaaacacaatacatttttcaggtaggcaccaagttatcctaaaaaattttcatgttggttattctgacgttgttttttctcttttttttttttttttgagacaagtcttgctctgtcgcccaggctagagtgcagtggctcgatctcggctcactgcaacctccgcctcctgggttcaagtgattctcctgcctcagcctcccaagtagctgggattacactcttaagcctgtgagagggcaaggaagggagtagtttctggaactttgagagagttgagatgaaggagaaggtaacctgtaggaatgccagccagtgacccagtaggaaaggcatcaaggggaataaatacttcaaactcttttgctaccctctgatctcctgctgtagcctcccattggtctaatacaactggaaaccagaggttaaggagtctggttgatttaattcagagggtggaatccggaggcacatagccgagctggaaaatgctggatggaggatctggaggaggagatcatctggaggggagaacatccagcatgctggagttgagaggtctagtttgtcttaaaaggcacaaatgaggagataattcttgaacagaatcttgaaggtggatagcatatggattatagaaagggaatgttcccactgattttaacaggatagattcagaggcacacagttgccacagctttggcaagcccaaagctgctttgttccagtagtagccttagaatcttaattgcctggagggcctttaaaagtactgcagtccagctttcttgctgcctaggaatccctctacaatgccctgtcaggagtgagtgctacatactttctcagggggttctttccactgttggacagctttaatttttagaaaatttttcatgtgtccagatcactgaatgcatcagctagaattaggtttgagtgtatataacagaaaaacctaaagtaatagagattttttaaaagacataaatatatttctttaagagaaaactggcctggcgcggtggctcacgcctgtaatcccaacactttgggaggccgaaatgggcggatcacttgaagccagaagtcaagatcagcctgggcaatgtggtgaaaccccgtctttactaaaaatacaaaaattagccgggtgtggtggtgggtgcctgtaatcaatcccagctactcaggaggctgaggcatgagaatcgcttgaacgcgggaggtggaggttgcagtgagccaaggtcacactaccgcactccagcctggacgacagagtgagactctctcaaaaaaattacaacacagtacaatacaatacaacacaacacaacaatacaatacaatacagtactacagtacaatacaatacaatgcaatgccagtacaattccattccattccattcattcccattccattccatgccgataaggccattcctgagtctttgaggtgccaggctgcttctgtctgtcattccgctatcagtagtgcatcccctcctgggccagggtagctgcctggggttctacctgtcaggttcatgtttcattcatgaagaggaagaggaaacggaaaaagaagggcttgccctccattttaattaaaaattattttggaatttattatacgtgcagaagagtatagaaagcacatatctacattttaatgaacaataataaaacaacgataccagattaggatataaaccatttatctctaactctacgcttcaccctgttacaaatatttcctttcttcccctctagggataaccccatcctgacttttataattattcccttgcctttttaaaaatagttttaaccacctgtgtatgcatcctaagtttagtttgtttttttttaaacttgatgtaaatggatgcatatgtatttttatttttgtgattttcctgtgttgctcagtattcatgcgatccatgttattgcatgtagtttaagttcattcatttttattgctgtatatatagtattttattgtgtgactaaactgcagttatttatccatttgacttataattcacatttgggttgtttccaatttgaggctttttcaaacattgctgttatgagcgttcttatataacaagtgatcacaagtgcaagagtttttctgggatttgtgcctaggagtggaattgctgattgtaaaggcatacatgcctaacttcactagatattgctaaacttttctgaagaggccaatacaatttataccactatcaacaatatatgagagttatttccacccaacttggcaaacctgatatttataaagcttattttttgacaatctggtaagcagataaatgtaattgtaatttccgtatgcatttcctgataactgatgtggttaagtacccttttcaatgtttaccaaccacttggattttctgttttgtggctgcctcttcaagtcatatgccttatcagttatttctcctttttagttctattattaatagattttgctgtatatttgctgagattttgttactaggtgcattcagatttaaaattgttacatcttgtaagttgagcttttcatataatttgctttttgacataatatagctacatcagctttttgtcatgaaataggaaacttcaaatgtatgataaatgaatgagttgcctgttagtataggcagaaactgcagaacaatcctagcccattattcaggctttatgtatcagcgatttgttctgttatcccataaagtgaatgagtcatttttgagtttaaaaaaatcatagggctttttttttgaggtccaatttgcatacagtaaagggcacaaatcttaattatccaggtcagtaaatatttatgtatgaatatacttccagatcaagatattaaacatttccagcactccagccagcttcttaatgtccctcccagttgatacctaccaaaggttttgcttagttttgctgattttgaactttacataaagtggaaacatacagtatattctcttttgtgagtggcctttttgctcaacattgtgtttgtgagattcagtcatgttcttaggtagcattagtttttctttcttattgctgtgtagtgttacaatgtataactatattataactaatttgttctgtagttgtagaacatttatgtttctagttttttggctattgtgaatgacactgctgccttcttgaacatgtcttggtaaacataaaatgtagagttgctgtgtggtaacgtgtactgccaaacagatttccaaagtggttgtactaatttacgctaccagagttttaatatataacttcttgatttagctttgggcagcaaatgttaaatttctgtcatctgcataccacacatggagaagagcactgagaactctttcctgaagttgtataggcacttttattttattttttatttttatttttttcggagacagggtttcaccctgttgcccaggcaggagtgcggtggtgcgatcatggcttcctgcagccttgaactctgggtctctaaccatcctcattgagaagcctcggcttcctaaagtgctgcgattatgggtgtgagccactgtacccagcctgtacaagcaattctaaaatgtgaaatgcccttccttttctgtaatttccccagagagtaaagcctactgcattcttgtttatctagtctgtaaatgttaatacacaattgatgggaacaaagcaaccttagttctttttgagtatgaaaaggaccctgttaagggcagaatttaaaatatttgtagtagttaattctcaggttaaaatcataatcttctagaatgctttagattctaagtggctattgtagtaacactttatactcaatattgggggaccatgttttttggaggctttcactgaagcatttaattccattcttttgaattcgttttgacagatgggtctaaaaaggaatagatcaattctgtattgaattccagtcttaatggcaccgagtctttgagacaattgaggcaaattggaaattctgttttcacattcttctgaaaggggatgcctttcagaagtgtcctgaagggcgctggggagggcaaatatgaggatgccagggtaagtctgctccctgtctggctgtgttgggccagagtggaagaaagcctaagactctgttacccagccctttctgaaaatgttttcaaatgctttcccaacaatcacgaccacaagagtcaacagtctgtttggatgactgaaaacacacaggtttacgatctgtaaagatagtaggtaagtgatttaatcttgttgtataggtaggccagagggcactcgcagccttctgattgatttaatagattgttgaagattaagagttgacttaacatctctcttagaaaactgagaaatagctcattactaaggtgtgttttattaccaccgtctgtaagaaaatacaacataggcatgggaatcaaactacttaaagcctcttccagctcctttgtgactgggaaggttacttttccttgttgcttattgaagagaaaaggaaaatgtttatcattggataattcaggttcactgaatatttaatgagtgtttattatctgcagtcattttcttattaccttatctcatttaatattcacaacaaccctgtgagtggacgatggtatcttttttttttctcctgaacgttttgttgaattatcccaatggcttctatttttgcagatgagcagagtccagttgcatagaggtttagtgttgtgccacacatcacacagcttctaagtgagagctaaaattagagccgaaggttttgattaccagtccagactttctaggacaccacagctgcctttctgtagaacagattaacatgactctcagagtccgcaagagtagtggtgaggtgtcagttcaggggaatactcaaaggtcactgtccttttcagatatctgggtagttgctacagtatgtgcttaggaattgctggataaaaaaatattctttaaaatctcatcattttagtcgttaataatttattattataactcgtaaaaatatacctttaggcaagttattcttaggtagttatggttgctttcatttggagtccagagctttactctctatttctggagttgcaatttctgctgtccttggcccatttaaaaactttttcagaaggccttttaaattttatttttttattaaaagaaagcctgtgaatccaaagaatcttaggtggtttcttagctgaagggacatttggtgaacacaaatggaactgttaggtcatgatgcttttttaagtgtacaactctggtgttttgtatattcacagttgtgcagccatccccacgatcaattttaggacattttccaaagaaacccagtactcagcagtcacttccttatttccttctcaccggtcctcagcaactaccagtctactttgtgtagatttgcttagtcaggacacttcatataaatacaatcatacagtaaatatgtggtctttcctgattgacttcctgattaaccattcgtttaatggtttcaaggttcatccatgttgtagcatggatcagaactgcactcctttttattgcagttacagggcttttcctacagaattttaagtaatggatatatctaacaatgtctcttgttctcacctacaggagacacaggatcttgggcttactttacttatataggaccttttgtaatatcgaggctatttctatgctttattgtagaacagaagttattaactggggaatatggacctttatgactggcctttaggatgtcctgaattctttgtaattatataagattttatgttcacaagcattttctgggcgtcggaggagtctggaacagcaaagatctctagcttttgttaaaagataattttcgaaagtaatatcctgactcttatacagatataaaatgaacatatgttgaagattttattttactccaaaagaggaaaccaggcagatgttataactggttcaaaggagaggtccaaaaagctgctcatttatggatcaggaatatcaaatgaatgtgcaaatggaggcaaaacaactctctgtcataggggtaggaaagtcaggtgaaacttcacctgacggcagaatttgcatatttagggatctagattactttgcactgctatcagttatctacaactttcagagccgtaaacagcctcctcataatcagaatctggtaacccggaggggcgtcccagataatgcataatttttcattggaagccgtagggaaaaactctctcctctactctcacaccacaacaatcaacaccgaagacttccgtgaccaaacgtgtgggatttttttccccacactccaagaagcagacatcactgggtgtcgcctaattcaattctgacactgtctacctggagatagcatcagatctatgggttgagggctcagtcccaacccatacctgtctcccccaaccccaacctgtcacaagtctggtccttcaaaatgtctgactgactgtcttcaaggtgaggttcccatgacctcctcttggattggattaatttgctggaacagctcacagaactcagggaaacatttacttaggtttacaggtttattttaagggatactgcaaaggttacaaatgaagagatgcatggggcaaggtataggggaaggggtgtggagcttccatgcctccctgggtgcaccaccctccaggaacctccatgtgttcagctatccagaggctctctgaaccctgtccttttgggtttttatggaggcttagttacataggcatgattgacaaccatgtagaaatgtgactggacacaggaggcatgatctcatactaatagactgaccggaaacccagcaaggcctgtctgttcaggttgtcgctggcctttctgtgcagccttccttcctccagaatatggggcacaaccctcccaggaatgagggttttttggcccacagttggactagagtcttgctttgaggcaggtaaaagaggacaggagaaggttgagagagattctgtttcctgaggcccaaagtgccccagcattataatagaagactataacaagggctatgggggttatgaaccaggaaccatggatgcaaaccaatatatacgtataacatcacagaagcacactttcctgctcactttcaatagataccacaaagtttgaaactcttccaagtattaattttaaattaaatttactcagctgcttacttcagcttttaaaagtaggttcttggtaatttcgaagatgcactttccaaagggtgtttatatagttgaaggtcagtcagagacctagggataggtccctgcttattcttttgagcaggcttacgtgttggaaatctctagagaaatagctttagttaggttacacttctcagcaaatattcagtattcctcatctctaatagcagcatgactgttgtagggaaggaatttccacaaatggttatgaaaagtctaagtgtcttaactcccagacaaagatagagaattctgttagtaagataagtatgggactggagaagtcagctaacctctgcccttccccaatcgtgatatgctcagagaagttaagacttctttctgtgtgagaaatacgggatcttttccactagatcttgcttattatccaagaaattatcatttctagttttagagaatgatgaaactcatttgtgctttgaaatataacctgtatacatgtgcacagtaagtcatttagctatttattgtcagactctgggagttcatagcaaacttagcaacattccatgtgcaaatttgcatatttttccccccatatcttacctacttgccttaggctgggagtctattttcctacaaaactggtaattgctcttatctctgtgtccttcagtgtgttcctctgcttattgaattcagttttatgcatttagtcttctctcctagtataagctgctcctgatacttttaaatatgtatttcagaagagaggtgctcagaattgttacttaacagaatcagcatctccctttacttgatgccttgtcctgaccacaagtacattaataaagtgaccatttagcagtgtttcgggttcagcttttaggaacttagaagctgtggttttccatgagtgcacttctgatgacttgggaacatttcatatgtgtgttctttctgtggccaagatggttttgttatttcagggatggaaagatgctttgcctgaatactcccatgctaagtgtatagcagttggtgcttggggaatggtaccaagtgtacatatctggcaaggccaggctagaagggaaaatgtagactcttaagctttttgagacgaacttctcagatactggatctcttgactcacatagtggaattttgggggaagtatgtggtttgctttttgtctcctaagaaatgatgattcagtttcctcaaacgtttctcacagtcactactggttgcttggaatggctgtctggttttgttgctcagttcttacttctttaatgacccaagaggattttccctttggggttgtgatgtgtttttgatgataaactttaatgcttttggaggctataaagacaatagtattttcttacctgtttaccttgcactttgaagttctgtagactgtaatatgaaagaaaatcagattaaattagctttgctttctggcttttctttttttggtgggggggcagaagctgataagaataaatatactaactgagtctcttctgtattttaacttcactccctaggctgaggcttagtccttagagtaacatttgaactgggtagaacagatttttcttttcctcaacagcccattcctgctgtaaagctcagatttatggtccttctggaaaaagtattgagcgttgaatagttcaggaaaacaaataacaaattctgtcttctttgcaggattgtggggtagaagattttgatttttattagtatctggccaaagaataaatattaggcaggaacaatgaattgatatctagtagagtgacgtgactgggccctgacttttaacacttcccaggaaagcttcgtggatgtcttttccctgctgcgtgaataccgggtagccattaagtttggtgattgggtgtcagtaatatgttaagtcagctactgggtcatcttttaataaaagaaaaggatggggaagagaatggattcttaagcagtgttgcctgtcagaatcaccggagggaggtttacaaaatacacattctgtactctgaccctgtgggtggggtattctgacccaagaagatgattcgttccaggaatcatgcttcttggatgatattgatgtacccccactggctttatggaaagaatattgaagaagaagatagattctcttgggggctgtgcctctagtttgaaaccagggaaggcacattttggtattagtctgtggcctcagtttcttcatcactgcaatgagattggactataggtggtctctaaggttccttcagacagtagcattttatgattttgaagacaacttttctgaagtacttttcaaactaatttctttccgtctttcttttgtaagcaaataagtagtatgagtgtaagtctctagctcagagaagaatgaagtttgcagttcgaaaaggccatgcaatagcagttcacttccccaaaatgctcagcccttgtaggatgccgttaggtcatctggaagttctgtatgccttcactgggagcgtagtgaagatgagagcctttcctttggctcttggagtaaactagctgacaggactttgagaactgttggtctcctgatttgtgccactgatagtttggctctggaaaactaggcagtggaaaaaacaatgcattttaaaccagaagatttgagtcctggctccgctatttccgagctttgtgacctgtaggcctcaatgtcttcatctgtgaaggacaggttcagctctgatggcctatgatgtgatgaaccttgtgaacttgtaggcagagtgccacggtgtgcagagtccagttacagataaccagccattctcctctgcagattcaacccactgccactgtgtcttgttaagcttaaataggagagatgtgggagagaggaggcagaaacatcctaggatcttgcaaaacaaaactgtcaaaagtataggcaatatcataattactttatttgaataaacgttgagttcctgctgtgttgaagatgctgttttaggcagtgtaggagatagaagacttatatcctcctcctaatttgtattcttatcagcacctggtaccatagagagttcatatattaaaattatttggttgttctccctaaccagagttgaattctttccttctaggacaaattaactcataatgcaataggctaatgcagtttggccctgagtgactcttgagaaataccctgagttgaggcacactggaaacgtggcacattagaaatgccaagaagaggccgggtgcggtggctcatgcctgtaatcccagctctttgggaggccgaggcgggtggatcacgaggcaggagatcgagaccatcctggctaacacggtgaaaccctgtctctactaaaaatacaaaaaattagctgggagtggtggcgggtgcctgtagtcccagctacttgggaggctgaggcaggagaatggcttgaacccgggaggtggagtttgcagtgaaccaagattgcaccactgcactccagcctgggtgacagagcaagactccgtctcaaaaaaaaaaaaaaaaaagaaatgccaagaagacattgtacaggagaatgaagggaaactttctgtagggaagtagctttcccagaaacttgactctataatgaagctatagagatcagtaaaatcattagggcattactgttttgaacatttccttgagtgaataacagacttacactcagggccctaggtctctgttgtggcccagcaagctgcattcagacaaggaggcagtttgagaggtacgagttgttatggaagcctgagaaaactggtttgtgtgcacttcagttttgaccatacaaccttcactcacttagcactgtgcagtaatccactgagcaaaattgccacattttccttggcagggaatctgtgtgcctgtggcagttcagaaattatttgtagagtgggtcagcctgtcagcaggaatgtttttctttgatcttcagcctgtttttctttaatgtgagcagaacagtaaagagagaatacattggaatatcttgttggttcccctgtttggctttacctacagctctttggttttcttcttttaggtcatactttcccaattagtatgtaggtatttatgatgttttgaagcccagagcgatggttccaatatcttgtggaattcagctctgagtgtgaagtcctgactttgcctctttctatcagtttgactgagcaagtcacttaacctttcttgacttcagttttccccatctatagagtgatactgcacactggtttcttttcttttctttttccccttcctttccttttcctttttcttttccttccctctccctctcctccctttgcctttgcctttccctttccctttcctgagatagagtctcactctgccgcccaagttgtattggagtgcagtagcatgctcatagctcaatgcagcatcaaatgcctgggctcaagtgatcctcctaccttagcctgccaagtagctgggactacaggagtgtgccaccatgcctgctgcttttttgtttgtttgttttttaaatttttttgtagggatgggatcttgttatgttgctcaggctggtcttgaactcctggcctcaggggatcctcctgccttagcctcccaaagtgctgggattacaagtactttataatgtgtaaatggcctgtacattcttaatctaatagcctcatgaggttataaaatacaaataaaataacatgaaagccatttagagttttaaggtgtataataccatgtattctcattaattaaattttaataaatttaaaagataaaattatttttataaaataaatttatttttaaaattttaattacgttaaaaagttaatgctttttttttttgagacagagtcttgctctgtcacccaggctggagtacagtggtacgatcttggctcactgcaacccccgcctcccaggttcaagcgattctcatgcttcagcctcctgggtagctgggactacaggtgtacgccaccatgcctggctaatttttctatttttagtagagacagggtttccccatgttagccaggctggtctcaaactcctgacctcaggtgatctacccacctcggcctcccagagtgctgggattacaggtgtgagccaccatgcctggccaaattaaaaagttaatactttttaagtgcttcactctttcctgtgcatgttgtcttggcctctttttctaaattagttttattccctctgtaatcagagggtcaccaaatctttgagttttagagggaagagaaagtttttagtgaaacaagtgggtgaactctgatccctgtaaaatagtgccttcatacagtaggcactccaaaaataattgttgaatgactgaaactcttaaacagcagtaagcatacgtatagcagagacaacattacagagtagagctctttctaggttggcatggtagatagctctgagggactacctgaatggagatgccattgcttttgaataaaacaaatatacatggtgtcttagtccattttctgctgtgatagcagaataccacagattgggtaattataaacaatagaagtttatttggctcgtggttctagaggctgggaagtccaagagcatggcactgatatctggtgagggccttcttcttgctgaataataacatgtcagaagggcaagtgagcacgcgagctagaggggatgggccaagatgtcatcctttatcaggagcccactcccaagataatggcattaatatactcatgagggcagaaccctcctgatctaaatcacctcttaaagatcccacctctcaacactgttacaatggcaattaaatttcaacgtgagttttaggggggacattcaaatcataacaggtagttagccctgttgagtaatggagaaaggattgtattagttccaaggaaagatgcatcatccagtgtgggtctggaaatatttgccagatggcttttctcttttagtaatattcatttgtggaatgtttctttaggtataaattggtgctgaagtaatttgataaggaaaaaatatcactgcctaattggtatttggtcacgagcagtaccagttcgtaagatttttttggaggtagcaaggggtggatagtgctactattggaagtttgcttatggaatcttttgctctcttgaagtgatttggagattaaaagagtttagtatcattggggatagctgtggtctactgtcagttaggaagtaactcatgactagatatcctgggcttattacttcagctcatattcctgacctcacaaaaatgttaagagaataaatcgtaagtataaaaagcactgagattgtgtagagtggaaaataacattagtgttagctccctcactgtattacacaaccacattctaaatttaaggaagccagaagtaaaatcactctgaagcactgcttttgaaactgcagattatgatccatttagagggacacaaaatcagtttagtatatcaagcgttaaagaaggaagaaatagaaatgtgagtacattacaagtaataaggtgctaagtattattttggaaacttttggttttatatgtttctgtttctacatgtattagattgtgttgtaaaagacatttctttgggactgtattttacaacacagtctcatacacgtagactctaatacacatattgaaacagtttgaaactcagtggtctaacaagtagcataccccaaatttacaatatttgtagccttctgctgttgggtacattcatgaaaaggtcttgcatccttaaagtgaaggctgaaagagttttatgtcattggggcgagtgggctaccaagctcccataaattctaggagctgccttttgtctaacgattaggattattgagtactattttgatgccttttgggtatcatctgaaatgtaatcattgaattggaaatggaataaacaagagaaaggctagtttactcattatttgacaatagctctttaaagtagttaatattatgaatattcctactactaaggtttataagagtttgtttttttctttaatgttatactttaaaaagtattattcattcactgggcaaataatttttttttttctagaggaatacctttccaattttataacagtgaaggaaggaatgttttacttatagaaactgtactgaaactactgttctattaagcaagggttggagataagcacccctgtcccccttccctgcccaggcacacacatatacagatacagcttattttatgactgtattgttcttgtgtttcttcttctagataaagacataaagattgatgaaataatttacctggagttgcacagtaagctagtggcctttgtggatgaccattcatagttcatatatttccagagacacaatacattgataaaattgaaataaacagaagcctaagaattataagtatatattcagagatatatagacaaaaaagtactgttataagtaaaaagacatagtgggaatagtaattataatcacatgaacttctgtgccatctctatctagatcaggggtgtccagtcttttggctgtcctgggccacattggaagaagaataattgtcttgggccacacataaaatatactaatgatagctgatgagcttaaaaaaaaataaaaattgcaaaaaaaaaaagtctcatgatgttttaagaaagtttacaaatttgttttgggctacattcagagctgtcctggactgcatgttggacaaggttgatctagatgtttatctgtagtcatgacctaactatataattttagtatgttatacatggtaccatgtatccagggtagatcctgccaagaacataaattgtgaaaagaaaactcttgggatgctgctggattgtaatgtgttactcctctgcccatgaatactgaaaatcaagatttgaaagggtactgaatactgagtcaaaaggcatgcgttcctagacttcacttaatcacaagcatgtctgtatgagcgtagtcatgtcatttcactttggggtctctgcttgtaaaatgaaaatgttagacttgatcttccaggttcccttcagctcttacattctgtgcttcccaagggctagagtattgcatcaggacccagcctggggtttgtgctgttttcaaggtcctaaggaactgcatcatcctttagtccaaggagataggataccttatgccacagagcccaataattcagtgagctgtgagtgttgtgagttgcatctacattggggactgagcctaggttgtttgtagtaacactaggaggaccttagaatgatgccaggagatgtaatttctgtgatcaactagttgactactcaaaaagcttgtcaggacccatccaactacagtgtcattctgtctttggtgttaaagaatttagatttatctccttttaaaggacctcctttgaatttaagaattgccattatcttcataagaatcaaaacaaatacaaagaaaatatattcttgctgaatgtaatttttaaatgttagtgaggaatgtctttatatcttaattttaaggcttttaaaaattagtttgcatttgctggttctttgctgtcaccctaatactggttatgttacttttttgctcagtgctgtgaattgttcataatatctatagtcatcttttgacattggtaacttctgttttctgggtgaattaggaattagtatcaccagaagaaaagctaatctgaataattgttctttcatcatctcgttcatgcacagtatttaaccatctggtttgaccacaactttcacactagacgagtctttataatgatagaaatcatgacatacttttgatgatagactcctctggtctttcccaggttttggctggtattgccattgctttggattgaggttgttgatgcaacagtgggctctggggaatggccaccaagaactgttggggaattgcagataaactgtctccatgggtagccctccagggaacttagtagttgtctaatgttaattaccttataccacagtctaattactaagagtattgtctgagtccattcaggctgctataacaaaatgccataaacgtggtggcatataaacaaaagtccatttctctcagttctggaggccaggaagcccaagagcaaggcaacagcagatatggtgcctgatgaggcccacttcctggaaggtggccttcataaaagtggttcatagaaaatgtcttctcactgtatcttcacatggtagaaggggcaaatttgctctctgggggtctcttttataaagtcactaatcttattcacgaggcctctgccttcatgatctaatgaccccccaaaggctccctcttcctcctaccatcagcttgagggttagatttcaacatatgaatttttgggggatgtaaacattcagtccattgcaggtataaatgttttcaacaagcatttgttgagtatctgtcctttttctaagctttcatgttcctactagaacactggatgtggatatccaataggaatatatttaagtcagtatcattatctttttctcaaaacatcttctaccttttttaccttcccttcctcttctagtcttaccatagttaatactgatattaactgttaacatcatagttaaccagtctgtcgaacttgaacttgaaaattttgaatgatctatacccacacccgaaaaaattactcacatacttaaaaatccatgccttttgttttgttttattgctgttgtttgtaatttacttatttttacctgatactatgttctggaaatttttctacgtagttcatgtagatctgtcttcttcttaatgtttcatggtatgggtacataaaatgcacgtattatagtttatttaaccattcttctgtgggtggacatttacattattttttcccttttgttagagaatactgaaatgaatatccttgaacatgtttatttgtatacatgtgcaaagtatgcagatgccaaaaagtgagattgctaggtcaaaacgaacatgcgtttaaaatgttgatagataccaacaaattgctttacaaaagttcctatcagtttgtatatcagtttttctaagtcctttttaaacatggactggattagcccgttcttgcattgttgttaagaaatacctgagtctgggtaatttataaagaaaagagggttaattggctcatggttctgcatatttgtacaaacatggcttcaacatctgcttccggtgagacctcaggaagcttacaatcatggcggaaggcaaaacttgagcaggcacgtcacatggcaagagtgagagcaagaaagagagtggggggaggtcctaggcttataaacaaccggatctcacctgaactaactgagcaagaactcattcatgaaagatgcacccccgtgatccagtcatctcccaccagacctcatctccaatgtcgggaatcacatttcaacatgagatttggaggataggcatccaaaccatatcatggacctagcatacttctcccagcctcacgtctctgatttaagtgttcactcatttacttgggcactgttacttgggcactgtcagcccctgtccatgtttgtattcagtataaattgtgtgccgggcactctgccacatgttggggatttagtactggatgagacagaaatggtccctgccatcatgtagcttacactttgccacatagaacttttgccatatgcagactctttttatgcatttgcagctactatcctctctttctggtatgacttttttccttttaacttttctacctagagaattttctttcatccttttaaccagcttaaattttgccctctgtcattatctttatcccttcagagttagatagtccttcctcagtgctccatcttggcactcatatgctttttgtggctattcccctgagaagttttcgtgatttgtttgtatatgtatgtgcctgtgtgtgtgtgtgtgtgtggacacacatctacatcttgcatattagattgtaaactcagtatagacttggaactatgatatgtacctgaacacttccccagcttactgccttcaaccctggagatgcttaatcaatgttgattaagtgaatgaatagtaaactataaaatgaccttagtttgtacagggcattgtaggggattgtagatatgaatagaactggtctgtcttcaagaacttaaccatatagtcagggagataagaaacagatgagtagactgcaaggcaggttgtgataagctctgtataggacttatcaaaaatgagtactggaggagaatttaaagggagagaggaattctcgtgaatgagatactctggtaagtttacagaggacaggttttttcttgctcgtaccaggtgttgtgaggaatacacatgatggtaagatatggttgctgactgagagattatagtcaagtaaggccttagagcaggcattggtaaattgtggcctgcaagccaaatctggctcttgcctgcttttatatggtccttgtgctaagaatgatttttacattttaaaaattgttaaagaatattttatgaacatgaaaattatatgaaattcaagttttggtgtccgtaattacattgtgttggaacacagccatgttcctttgtttacacaataactgactatatttgtactccagcagcagagatgagtagttgtaaaggagaatgtttgctttgcaacacttaaaatataaaataatttagtatcaagctcattacagaaccagtttgctgactactggggtagagaataggaaagattcaaatagagaagagaaatgacattgatattgggggtattagtgtgagttaagagagtgggacagtgattctagcagtcatatagaaattttagggctgaagtgacgatctagcttaaccctcttactgtataaaataggcacaagattgaaaatagtctcaaagtccactagctgttaagtggcagtggagtgctgctggagtgactggtacagaagccttgagggctgtagatgataataagattattgctgaagaagggcaagatccggaatgaccttgcccttgaaaaatgagagttgaagtacaaactaagaacagacttcttttctctctctaaatgtaatgtttttatttttcacttgtatttctagaaggcctttgagccctacttagagattttggaagtatactccacaaaagccaagaattatgtaaatggacattgcaccaagtatgagccctggcagctaattgcatggagtgtcgtgtggaccctgctgatagtctggggatatgagtttgtcttccagccagagagtaagtatgctgtctcctctgtaaaggtatagtggtgtgtcactagcctcaaactaattgctgagagataggactaatttattgccttttggttgtttttttgtttgtttgtttgtttttgagacggagtctccatctgttgctaggctggagtgcactggcctgatcttggctcactgcaacctctgcctcccaggttcaagtgattctcctacctcggcctcccgagtagctgggactacaggcacacgccaccacgcccagctaatttttgtatttttagtggagatggggtttcaccatgttggtcaggatggtcttgatctcttgacctcgtgatccacccacctcggcctcccaaagtgctgggattacaagcgtgagccaccgtgcccggccctggtttggttcttatttttaaaatctgtttaaatgtaaagcagtactttgtcttctgattggtcaagttataacaggactcttgtataactaatactccttacattgattttttttggatttgtagttcacgtaaaaacgcctcagaattagtcattgtaaggatccacagaaatctcagtatggtttaaacctttggtaccagtttcttccctagaacataattatgtcacctggagttcccagagcaggaatttattgctttcattttgtgctatccttttcagtaaagattaggtgaaattggaacagcacttacatggtgaccatttgagtgcttgctatgtgccaggcactgccatcaggctgtggggatatctgcacaagtagtacaggatctctctcctcttggagttgaactggtatcaggggatcgtatactttgagcttcctagaagtgactcagtgccagatcaacatggggaagaagaggccacttctcagggtgcagaagatgagcagtctcagtgatctgcttctgaatcttccacctttgcttaggattaagcccctctcctgcccacccacctttttcccgcctagaaacctggttgtgtgttaccttcttatgagttattttcctctgcagtctgtgcttggtgagtgttgttagtacctaaacacaagtagtggatttggtgctggatgttctataacactcccctgcaccttttccccactcttagtagggtatgggagttaacttccttgggataagaaaacagtaacattgaagataatcattagctgtttctcatttgcttgaaatttccccaccactttgcttccctgataacacctgtttaaaagggctctttaatgtgttttttctgcttttcttctcttgttcaaggaaagtcaatttagaagccagattccatttttatctctttaccctgcaaatagcttcttagccatttatggcgcagtaaacattgcaaaacctgacaaccaagaagcaagttccaactgcttagagtttttaaattaaagtggaaatgagacctgactctcctgtgtaaatctgtagctcactccagctttaaaaaccttgtcctcagttgctgctcctagtccttgcaagattttctgataaactctaagaaattagactggccggcccttccgctgcatctgctcaatggtttggatatggatgtagcttgtgtccttctgctcttgcttattcctttcctaggaagtattcaattcagtgagtaaggggcccatttcagaggattctgaggggtagcaagaaatatactttctttttattttttaacttttcattaaaaaaaaatcagtctctgcttatccttctattataataaaatatatacaacataaaatttaccactttaaccatttttaagtgtacagttagtcctgtggcagtaagtacgttcacattattgtacaggcatcactattaccagaactttttcatcaccccactggaactccattttaataaacatcaaataataactgcccattactctctcccgcatcccctggaaaccaccatttattgtatcgccttgttttacaaatgtactacaattcaaaggtggtacatttatgaaataaggctaagcttagagatctgagatttatattttacttgctatgattaatattaattttaggtattctttttaaaacaaattttaaaattaattggcaaataaacattgtttatatttatcatgtacaacatatgttttgaaatatgtatacattgtgaaatgggtaaattgagctaattaacatgcattacctcccatatttttctttttttgtggttaggtatttacttctgttttcagttctgcagctcactatgccatacattttgcttagctaatagtagagacacagccatcttaggttctgatacttatctgcttttagtggtcaaaaaggaatatgctggcctctgagaggccaattttccatgagaaaattgttagtcgtagtatactgatgagatatgccatctaaatccttgtgggctgaactccaagccatttgaggttttttttttgttttttgttttttgtttttgagacggagtctcactctgtcacccaggctggagttcagtggcatgatcttggctcactgcaacctctgcctcccgggttcaagcaattctccctgcctcagcctcatgagtagctgggattataggtgcccactatcacgcctgcctaatttttgtatttttagtagagatggggtttcgccatgttggccaggctggttttgaactcctgacctcaggtgatccgcccacctcaacctcccaaagtgctgagattacaggcctgagccaccatgcccagctgagttattttgtttctaaagatacaaaacaaaagcagtacatattcactatggaaaagttggacaatatgggtatataataagaacaaaattaaaatcttactactgaaggataccactattgtatttctctgtttctatatctgaatccagtttgaaccatacaaaatgtaattttgtaaaaaaaaaatcgtcaaatgttgacaattttatacaatttagcacatacacacacagcacactttcatttggtaatttccaacttgaattttagacacagataagaatgtcttccctccagagatcagggataattttgatagaatattcattttttttagcacttgctcacttgccatgtgttgctgaacaatcaagttatttttagttacactgcactaaaggagtctgaagtctggactagtgatgaattttgctgatcttccaacactgaatccctcttgagggaagagagtatttctggaacaaaggatggagcctggggtagaggagaagtgggcagcggcatgaactgtgctggggttagcagcctcttccttaattctgcctctgtgattatcagctcacagtttattacttttactttaatgctgattttaactgtgggttgtccataattcatcaacagaaatcagctttatgtcatggaggaaatgataaactctcagtttcttgttgtgtcaccttgggtgacacccttaagctctcttagcccatttccttgcaataaaatggacatcataatagctgctttacctagtcatgggtaatatgaggactgaatggcatcttttgcatgagtggaatttgtaaactgttaagaaccatgcattgttcttacactggcattttctattttgttaaacttaaaattctttttttaaagtaacaaataaaaattgtatgtttatgatgtacaacatgaagttttcaaatgtgtaagttgtggaatggctcaatcaaactaacgtgattacctcacgtacttttttttttttttttttttttttttttgagatggagttttgctctgtcacccaggctggagtgcagtggcacgatctcggctcactgcaacctccgcctcctgggttcaagcgattcacttgcttcagcctcccgagtagctgggattacaggcgcgtgccatcacgcccagctaatttttgtatttttagtagagacagggtttcaccatgttggtcaggctggtcttgaactctgatctcctgatccgcctgccttggcctcccaaagtgctgggataacaggcgtgaaccaccacacctggcctcatgtaccttttttaatggtgagaacacttaaaatctactttcttagcaatcttgacgtatgcaacacatttttatttactatgtcaccatgatctcttgaacttattgcttccgtctaactggaattttctatccttttgaccatctcccagtcttccttcttccccttactctcaatcccactaaaaaattctaattacttttcattctgtaccttctggggacttttgagataatctttttaggtcagggccatgggatctttttatttttagtttcttcatctctgatgctgtattccgttctttttaccctgtaccattttttctcacaacttccacaaaattagtttattcttttatcctccacctagtcacattactatacttctggacagctggtccagtttgctgatttttagacttctttttacctcattaattacttcatcaaataaggaagcatttctgaatctgtacagctttaacagttagaaatagttgaataacaagaagctaaaatatccaatattagattatagtcatttgatgaactattataacattaaaaatatgtttagaaagaattgttaataatgtagaaagtgctatcagtgaggaggatacagttattttacattatacagaatctcaggtatgtattacagtgtgtagaacatagggctagaaggaaatactccaaaatttaaacaaaaagtaaccacaaacaagtggtttcagtctctttgtcttcttattcagtctgtgtcttagttacctggttttgtcccaggtgtttacagaatgtggactctagggagagttagaaagagagggatgcagctgaagcaaaaacagctagcagagatgcaaggcatgatgtgatagatacaaaaagggggtgcagacacatcccgtggttgttgagtgaagagggagctccttctggccaggaaagtgggaatttccagatctcctaggaatgcagtagaagttcatattcagttcacaccttggataaaagccaggcttagattcttatagactcaaacagaaaattcctgtggtgcatttgaagcagtatagaatcctgggaatcctggactgaaaatacaaagacttcagttaaatctttgctctatcactgattttatctgtggccttgagcaagttttgatgctttgatcttgcattgccttttatgtcactcgtagatggtatataatgccttctgtgccagcctcagaatgctgttgtcagagtcagtcgagatacattgattgtgaatgcatcagaaggtctattagtctatttagatgccatgtatttatgattattatgatcgacaggatttgtattccctatttgttctatgtactgcctgacagagtggactctggcatctgtgatttttcaaacttttttttctttttgttgagacagggtctcactgtgttgcccaggctggtctcaccctcctgtgctcaagcagtcctcccacctcggcctcccacagtgctgggattagaggtgtgagccactgtgcctggccagcatccacaattttgagggcatttgtaggtccagaaaatgttagaatctgtgttggatgagaggctggacatagatccaagaaaaacaaaactaaaaacaggctgcccattagtcttgggggaaggaagagaaatgttgaacatctagaaaccttaggaaggtcaagaattctggaacacgtatatcatttgacctagtagttctgcttctgggagtttatcctgtaggtgtacttgtagtttatcctgtaggtgtgcagtatggtgtgtgttacaaggttatttcagcatgatttgtaatagcaaatattagaagcaacctatatatccatcattaaggggcaggttaaataaattttggcacatccataaaatggaatactctgcagctataaaaatgaatgaggatgcactgatctttaagataatactcctaagtggaaaaacaaggtctactacagtgctagagtgtgctactttttgtgcaaaaaaagggagacaaataagaatatagctttactgttgcacgtgtatgcataaggaaactcaggggggtagcatgagggttggggggatacgtttgagagagggaagcttcactgctttactgtgtgtgttatgtgtttgtatttttaaaattttgaaccatgtaaatatagtacttattcacaaacttaaatttaaaagtttttttaaaattttttaaacgaaagaaactctttgcaattggaaggcaagtgaggtggaagacacattgaatggttgctatatgccaggtcatatccatggaaatttatttgaataagagaaccatttgtttcttttaggtttatggtcaaggtttaaaaagaaatgttttaagctcaccaggaagatgcccattattggtcgtaaggtaagtagaatctgtgtatgtcattttttcccctcttgataatcatacctctttctttctatttactaaacctaatattctcaaagtggaggggtgattttgtctcttacctccaggggacacttggcagcatttggagacatttttggtggtcacagcttggatggaggggtgctcttggcatgtaatggatcgtgtccagaaatgctgctaaacactaaacatcctacagtgtacagggcagcccccccccacccaccaaacacagaattatctggctggaaatgtcaaaatggccaaggttgagaaccctgacttaaccctttctccaatgtaactggccaaaggagagatgagaagcctgttaaggaagtaagaatttgagaaaacctgactgtattgttaggtgctttggaacaacatgcagctggctgactttaggtatttatctaggagttgggtgcttacatggtttaggtcaggggtcggcaaatgttttctataaagggctagatatgaaacattttgggctctgtaggccatatcatttctgttgcaactcctcacctctgcccttgcagagggacagcagcaagaggttcaggaatgagcctggctatattccagtgaaactttctttacgaattcaggtaggcctttgttggttcctggctgtagtttgctgatcccaagttgcacagcgctgtctcttgctgtttgcaattttctgtattgtagtatgtcccctttgttatgtcctcttggccctcatccatgttgaggataaggtagtcacctctgtgcgtctcccacaggttatcccagatgaagataaacagggcaggccacttggcaagctctaaggaaggcatatgagtccttggaatcttcatctcctccagtgccctcccctgacccccctttggtctttcccaactttacctgcctttaagttttcttctacttttggctttcagttccctttcctggctataccagggtttgtttgccaacccctgacctaaagttggccagttatctttaacctttggctgaaatccattcagatcgctgtgctaactctcccagagataggtatcttcaggttcatttcctgtaggagagtgggagcaataacaggtggtgaagggaaatgtgagcatataggcttctgtttgctctccaaattatattaatccctaaaagtaaatctagtccttacagagtataaggggtggggacagggaaggtattgtagaagatggactgtagcacaaaggagattaggatttccccttatctcctgaatttttttttcttcttttcgttcagttttcagactttgagacaaataaatgctagggttccagaacccactcttaaacttagaaagtaacagaattggaagatccttagcttgccaaggactatccaatcactctccatttttcagaaacagattctgaggcttagatacaaaaagttacatgtgtgtatgtgtgtgtgtgtgtgtgtgtgcgcgcgcgcgcgtgtgtgtatacctctgtcatttattcacttaacacatgcttattgagccacctgctcagtgtcaagtacttttctgggtgctggggatatggtggtgaacaagaccaaatccttcctctcatggaacttacattttaataggaaagacagaaaataaagaagtaaacaaatatgtggaattttattttgaaataaatgctttgaagaaattaaaattgggtaacgtaatacaggctttgaggcaagaattgggggtaaggaagtacttgtgctttctaatatacctctctgtcactttttgtctgttttatggcaatagcatactctatgtatggaagctcagctttcatagcctgttctgttgcatgagtcgccatttatgtgaattaattttttaatttacaacttaaaaaatgtcttcacatccatagcatgcccaggcattgcccaggagtgtagcctctgctccctgccagtgtgggcctcttagactattgcagacatgctcgaaaggagtggctttccctgtggtttcactgagggccatatctaagaagatcttcttgtattctaattatccttggctagagatgagaaaatcttagtgtggagtgagttctggcgttctttaacaaatatattgctgaaacaatagcactgtgacaaatcgtgacatgtagcttctctccccaaacctactacccaagagccttttgctataagcagcagcccctgcccttctgcctccttactctgctattttttttccctcagcactttttgttacctgtcttactattttctgtctctcctgctgaaaataaacttcatgaggacaggaggttttttttcctgtgtgctccattgcctaagtttgttttgttcactatgtgtccctggcctgcatatttgtgaatatgcagtgaatatgaatgtgaatatgtaagtgaataaaagaaaacagctcagaagctgtggctttgaggatggaaaagaagggaaccatagttgataaactacctagcagaaaggaccttagttccttttaatattttggggtcagacagtgcaagctgtcgacagcagcttaaggagatacattagagtcttcctggcagttcttagaatgccttgtgctagtgttgaatgggacctccaaattcctagtgtgctgcgtgtatgtctgttgaaggagctcatcacttgcacaaggaccagaatcacttttactgcagcatggccagttttctggccactgttcctagttatacctttgattcttttacacacacactgtagctgctgccaaggcaggatcaaagtccaaatactgccctcaaggatgtgctgactttagcaatgccaaccaagtgaagcagcagtgatgtcaatgtggcagagaaaagggttatggggaaattgggtgcaacttttttttttttttttttgagacagagtcttgctctgttgcccaggctgaatggagtacagtggtgtgatcttggctcactgcaacctccacctcctgggttcaagtgattctcatgcctcagcctcccaagtagctgggattacaaatgcctgctaccatgcctggctaatttttgtatttttagtagagatggggtttcaccatgttggccaggctggtctcgaactcctgacctgtaatgatctgcccacctcggcttcctgaagagctgtgataataggtgtaagccaccgcgaccggctgagtgcatcttgacctttagagagaagcttcgcttttcaaatttttaagaggctattgtacatgccagaaagtagctgatcagtcagaatatcaccatatatctttaggaaaaatgttagtttagttacttgtgcggtgcctagcattgagcagttgcttgactgtcataataattctgctgtctctactgtactcttgcatctggataactttgtctttcttacctttggagattcaagacaagttgaacaagaccaaggatgatattagcaagaacatgtcattcctgaaagtggacaaagagtatgtgaaagctttaccctcccagggtctgagctcatctgctgttttggagaaacttaaggagtacagctctatgggtatgatgcttggcatatacatgctctctacttccttaaagagacaggttttgtcattgtttaatgttcacataggttaagaataactcatcattggttaatacatgtttaggagggcctactctctgtttcacaggttgaatttcctatttttaaaattatgtttagattcatccttcatccataaagcaagcaaatctcagagacagtggaacttggcttttatttccttttgtaagcatgaataaaacaaatatatttgtgtttaagaagagagaatataagatatgtaatacaaatgaaatacagatccatgtaaaaatgtgaaatctgcataaaggcacaaaagaaaataagtcactataattccactatcaaagataaacagatggtgtctatctttatgcatgtagctataggtagagctgtctatatagtttacatctatctatatatgtatatctgtctgtttctgagaatgctaatagtgtttgtctgtgtgtatacacatgtatgcatgagcacatatgggatggataaatagaccaaatagcttggtgcttaagagcgtaaccctggaaccagcctggattcatatcttggtttgccacttaaagtatgcctttggcgagttacttctgtatgtcacagttcctgtatctctacaatggggatagtaatagtagtacagtacttacctgaaaagatgattatggggattaaatgagatcatacatgtataaatgttttatagtgcctggcatatagtaaggattcagtaaatgttaaacattattgctattattaactcaaacagatttatgtttgttactgattaagatcatattacaagtactttttaaaaagaagctttttagtttgatatatttacagaaaagtagcaaagatgatagagatttccctatacccagcttctcctgatgttaacatcctctataaccatggtacgtttatcaaaactaaaaaattaacattggtacagtgctattaactacactacaaattctatttctagttcatcagggtttttttttgttttgctatgttttgttttaaactaatgttcttttttctattctaggagccaatccaggagccatgttgcattttgacaaatacccttattttttattttttgagacagagtctcactgtgttgcccaggctggaatgcagtggtgtgatctcagctcactgcaacttccaccttccaggcttaagcaattctcgtgcctcagcctcccaagtagctgagattacaggcgtgcggcaccatacccagctaattttttgtgtttttagtagagataagatttcaccatgttgcccaggttggtctcgaactcctgaactcaggtgatctgcccaccttggcctcccaaagtgctaggattacaggtgtgagccactgtgctcggccttgacaaatacccttacaatttctaagtgacatgtgttgaggtcttgacattgaatagtacaaaatttgatatagtctaggatgtagatgaataaagcagtggttagcactctaaaacctggtgttaaagatttccatgattatgagacctggttgccgccatcatattgccttctctttaatgtttaagtcactgtccattgctgtattctctagcatcagtaaaagaacaggaaatgaaaccagttatcttatttttgaaaggctggtgaccactggtctgaagctgtgtatagtacagagcagtgtcctctaaggaaagagtgaaagtcaaacgggcagcaagccagagcttggcagattgctgtaagaatgagtttgtctgtatatttaccacttagttttctgttctcaagagctgaagatctttgctttggagagcccttggctccatgcagtttttagttggtgtgtttccgtaatagctttctcactacccactttcaatagggcacagctgcattgtagcacaaggacctgagacacccatatcaacaaatttgtgggtaaaatgaagaatgtctcggggagagaggaaagtggaaagtcagatcttatattctactcaggaactttacttttctttccacactgggataaaggaggtttatcccaatgttgactgtgttcctgatcttgaatatgctacagcgtgtgctgctggaagcaggtaactagttttatgtgggtttccaggcttggcttaagggagccggcgtctgagaccggggtgctcatggtttatacctcattgtggtttgtttgctggtttcatctctgatgatagtgtgctgaaatttcacacttttcattttgctttcttctgccaactctgctcataatagttctcaaaattcctaggactggataggaaaggagagaagaaggaagctattgcagaaaaaggccactccaaagccatatagagaacaaaaaataagtatagacaaaggcaaatgttcctgctgttagaaggcagttgaggatgaggacaacattattatcagattgcctttattgtagctaaatgctattaatatctttttcacattgctgataataatgatttttcatctttattttattgtgctaactctattgaacttttttcttgatttgctataagaatgctgttgggtttccactcaacatttttttcttttgtatccagaggagtttcttcctgtttcttctttatcagaacctgtcttcccagagattcttgcttactgaccagtgaccttacctttctctgcagacgccttctggcaagaggggagagcctctggaacagtgtacagtggggaggagaagctcactgagctccttgtgaaggtgagtgtccagttcttgagggaagcctgtgaggtctgtgccagtttacatgacctcctttttttcccttacttttgtaattagaaaaattacttaaggaaagcttattggtacaataaaaccataaaagtttctcttcacccaaacataggcgaatatgtataatattatcaaagacatcttcagtctgtaaaatagtaaaatgttatttatgttttcagtctttgcagatgtcctgtctagaaggcagattactagggaaggtagtcctgtcagatgagatttttgtggtgagacagattttgtttgataagaagagataagatagggaaactctttcataattttctcaaatcatgtgacccaagatgagcagtggtctcatgtatacttcaaataattctcattcttagcttcttccatttctaatcaaatttatttttattttattttattatttttacagacaaagtctcactctgtcacacaggctggagtggagtggtgtaatcatggctcacttcagccttgacctctttggctcaagtgatcctcccacctcagcctcctgagtagttgggactacaggcgtgcatcatgacacccagctaatttttgtatttttttgttggagatggggtctcactctgttgcccaggttggtcttcaactcccagcctcaagtgatcctcctgccttggcctctgaaagtgttgagattacagctgtgaaccactgcactcggccctcatatttatttttgaaactccacttcatcatataaaattggggttgtactgatgatctctaaggtctttgtgtttgattattataaatatgaaactgtcccttactaaataaatatggcaggttttgcataagttggtgtaatgctctgatcttctgtgcttaaaatctttcagtagcttcccattatctacaggatgaaactcaggttcttatgcagcagagaatacaagtttcttcatgagccagctcccacttattttttcttaactacttctctttatttcccacataaacactaatcctgccttttctctttactaaatgtgtcatgcttttacgttgttttccttcccttccatcattcctcttgttccaaatgatgattcctactcatctctcaaagttccactcagcagacacctctagatcactcaggatgttagttgttccctcttcagggtcccttagcactctgtacacacacctgatattgcagtcgataacaacagctgctttgtgccagacactctactaagtgcttcacatgcattatgttatttaattattgctagaacactagaagatagctaccataacaacttctgcgtatgaagaaacaaccttagattatgtgacctacacagctgaaagtaataggcaaagcttagacttcctcctgggtcggtttggtgttatagtctgcgcttttaaccatatttatacttctttcctcatcacattgtaaaattatttatttacatgtctgtctcctctgctatgttttgatcttttggttgaggaatatatcttatctttttttccagtttatattgttgtgcctaatacttagaaactgttgtttagtgcatgattctttgtcctgtatagtgtaatagttttgatttcacatctgcttgcatttttttgcaggcttatggagattttgcatggagtaaccccctgcatccagatatcttcccaggactacgcaagatagaggcagaaattgtgaggatagcttgttccctgttcaatgggggaccagattcgtgtggatgtgtaagtatatgcaaggggcatccaatagccttattttttaggttaaaatagaagagtttttaataaatattaattatattttaaaaaataaaaaatattaaaaatattttactacacaagaaatatttgatcattgtagaaaggtcattttactacacaaggaatatttgatcattgtagaaagatcctaattaactgcagttttaaatgttacttgtaattttgtaacctagacaatgtcaacattttggtatatattcttctagatatttttattttcacctttttattttgaaaaactttgaacctacattgagttgctaggatggcttaaagaacaccttagattcactaaatgtaaatatgttgccatatctgctctctacactctttccctccctacccgcttcttccctcatcccccacctgcatacctaccattcccctatttatctgtgtatacttttgttgttccatccagcagtgtttttagtgtacttctggttttacctgagccaaagtttaatttattattttgctgtaaactgaacctcatttagttgctattaggcataaagaaagggggaggacatcattatatttaaagaaacacatgaggattctttgttttacctgttctttcaagtagatggttgttagttttcgtaaactatgatagataaacttctgtttagatctgttgtctttagaaaaaacgaaatctcaggttatgtaggatagatagatttaactcaatatgctgcaatggtgtcctagaggtgctaatcctatcagatactcatcatatttgcagtcattataaagactgcagatttaattattgaagggcccattcgaagagcacctaatttagtttctttttttttttccaggaagcattgtttttgttttgtttttctaatatgttggcgccatgaaaatcatcatgttcaaatattagtagtaataaaggtgatatgcctggcattcattttcaaagcaaaatactgaaactgttaaaaacagaaccacccataatacagcagcagtttcccttagagtactgaggtgaacagggtgactttcagagggaagatgataatgtacttacagtatattctcctatgccattagactcttgaagaacttgtaagaggccagagtgaatagccacagaacagtttggccttatctggtaaatttgaagatacatatatcttatgacccagaaattctgctactaggacatactctagaaaaattagtacacatatatatcaggatatatggacattaatattcatagcaatgttattcatgatagctaaaaactggaagtaattcaaatgcctatccacaggacacagatgaataaattgtggaatgctgtgtgtgcctcaatccattgtagctcttattcagattgatgtacaaattgcctcatccatctttggccagtggaaacatcatattggctcctaggtccatttacatgacccaagtaatctttgaaagccttttttctctttctttccttttttttttttttttgacgaaatattccaggttcaggttcactttgtccatttcctgctccaggccttcaatcagccatttatccaaggagccctggttcatttaaaactaggtaaaataattacatagttccaaaatcacatttatggaacaagacagattaaaaaaaaaaagttaaccagaatgcagtccagagagacaaagaaatagaaggtatgaaagagaggctaagagatgcaaaggataggatgagaaggctaacacacatctaactggtgtttgagagcagccagagaaaatagattacctacaaaggcataactgttaggacaactgatactcaatagcaacgatggctggggcagttgggggtagatgaaagattggctgtaaattgaaaattgctggagcctggtgataagtagtgagaggtcacagcgtgctggcagtcctcacagccctcgctcgctctcggcgcctcctctgcctgggctcccactttggcggcacttgaggagctcttcagcccaccgctgcactgtaggagcccctttctgggctggccaaggtcggagccggctccctcagcttgcagggaggtgtggagggagaggcgtgagccggaaccagggctgcgcgcagcgcttgcgggccagctagagttcccggtgagcatgggcttggcgggccccgcactcggagcagccggccggccctgccggccccgggcaatgaggggcttagcacccagccagcagctgcggagggggttctaggtcccccagtagtgccggcctaccggcactgcgctcgatttctcgctgggccttagctgccttcccctggggcagggctcgggacctgcagcccgccatgcctgagcctcccaccccctccgtgggctcctgtgtggccccagcctccttgacgagcgccactccctgctccacggcgcccagtcccatcgaccacccaagggctgaggagtgcaggcgcacagcgcaggactggcaggcagctccagtcctgcaggcagctccacccgcagccccggtgcgggatccactgggtgaagccagctgggctcctgagtctggtggagccttggagaacctttatgtgtagctcagggattgtaaatacaccaatcggcactctgtatctagctcaaggtttgtaaacacaccaatcagcaccctgtgtctagctcagggtttctgagtgcaccaatcgacactctgtatctcgctgctctggtgggggcttggagaacctttgtgtggatactctgtatctaactaatctgatggggacgtggagaacctttgtgtctagctcagggattgtaaacgcaccaatcagcgccctgacaaaacagaccacttggctctaccaatcagcaggatgtgggtggggccagataagagaataaaagcaggctgccagagcaagcagtggcaacacgctcgggtccccttccacactgtggaagctttgttctttcgctctttgcaataaatcttgctactgctcactctttgggtccacgctgcttttatgagctgtgacactcaccacgaaggtctgcagcttcactcctgaagccagtgagaccacgagcccaccgggaggaacgaacaactccggacgcgctgccttaagagctgtaacactcactgtgaaggtctgcagcttcactcctgagccagcgagaccacgaacgcaccagaaggaagaaattccggacacatccgaacatcagaaggaacaaactccagacgtgctaccttaagagctgtaacactcaccgcgagggtccgcggcttcattcttgaagtcagtgagaccaagaacccaccaattccggacacagtagaagcccattgggcttttaaattttatttactctaatttcattctaaagaattctgttttgtagttctccttttattttattattattttttgagacagggtgtcactctgttgctcaggccagagtgtagtggtgccatctcagctcactgcagccttgacctctctgggctcaagcgaccctcccacctcagcccccttgagtagctgggactacaggcatgcaccaccatgcctcgctaatttttgtatttttagtagagatggggtttcaccatgttgcccaggctggtcttgaactcccaagctgaagtgatctgcctgccttggcttctcaaagtgctgggattacaggcgtaagccaccacgcttggccgtcttttttttttttttttttttttaatctgcttggttgttttttatagtccttttccttggcttaacttttgtttacttaaatatattacacataaatatgttgtattctgtgtctgataattccaatatccatgagccttacctgattctgctggcttcagtcatggttccttgtttccttatatttgtgattttattttatttatttatttttttatgagccactcatttttctgggaacctagggattctttgaggcctagattgaagttaagtctggaagttctcttcttccagagaagatttgtcatacctttttgagttgctggggattgccaccacactggaaccaaattaagtcaaatccttagcttgtcattttgtaccacagaggtagtgtgaattctgaccacaaactcacataaaggcttccttgttacacattcttgaaagattgctatttttctttacttgaacatcagggttgagaaaaacagtttttcttttctcttttgcagtagtgggatttatttcttgtacactgtagagtgtggtctttttccagccatctcctgttggactccttatcttgggcagtctctaatgtatcttctggtccatcctttgctcatctgtcagtgtaggagtttgaagtctgaagggtctggtgccacctcagggtgaaagctagttttgccactcacttatcttgcaggattcttgattttgctttgtttgggggtttagcaagtttctttatgttaggttagtgataggtttaaattttttttttttgatgttttatcaagttttttagttatttcagttaggaaggttgctcaaggtatataatattgctagaaatagaagttccataattgttttttccatgttacagaccttcgtctatttgaaagcccctttctccctgaatcttctctgccccacatttttctgggttactccgcttttcatatgatttcacagacttccaaccatcgcagtcattctctgtatgacttttggttgcctctggccagattgaacacagttctccacatttggagtggcattgatctttcaatctctgtcttttttaaatctgggttcaataaacttatttcagaccttttccttgaagtcagcatttttattcttggcaatgtttattttattccttgctgttcctaatgtctttgttagttctgtatggatgctactggctttgtttttttaggtctgtagctcattctttttgtttcatggtctaggttttgaactctttgttttcttaaattcatgttcttatgatattttcctatagtgagaaagttataaggggtttccttcatcccttagcttgtttccttctgtgttgggtttttattttgcatgctacatactaccttttcccctgccttttagtttgtttgcatagtttccttgccattttctctcatcttggggtggcattctccagacattgttcttatgcactgtgggtgcttcctgtctgagaccatttggctggggacaaagctcagccaaagctttgttctatctgtattagaataaccaggtctattctgagattctcttcaaagttacctatcagagttcactctcttatttggaagagataatataccctttgagctctgattatttaattcactgaagtcttcactctaaagagccaatcctgatgttctctcttcattttgctcatttctccctagcagccatgtttaccactcactcatgagaagaagaagaaaataaggaaaccccctcagcttgcctctgcagatttgggggtataaaggaaaattctcaggattttgctgactttgcggtacagtttcaagggctgattagaaactagtgttttgcttacttctgctctctgctgtttcactgtttcttttttttttttgattgccaatatttgaagtttattgcctagattatctctctttccttgtttggttgttgttattgtagattttgactcttttctctccctgcactcaccctttttttttttcttcccatcttactcctgaagtccaggcctaggggttttttgcattgctgcaattaaaccatatctctattattttgatcttcagcacgtgtgagggatcagaagaaggatagagtctgattcccaggctcttctaatatttagacttttataaaataactaatcagcactggtattgtctttttccctctcccactctgtctcccccactcctcccttagcttcttacttctctctctggatgagctgcttctagtgaagaaagagttcactgttcagaggtgggaagccagaagataaaaccaaatggctgggcagtctttaggttattcctagctaagagttaagagttgtaagctctctcattctttgttcttcagccttaaactatctttccttctattaactttatttgtctcagttacaatgatagaggtaacttcacatactaaaagaaattaggttaccatgtgaaacattcttcttggcttgtgctaatgttatcagatccaaacagcatctgaaagaaaattttccaagtagatgttgttctcttgttttctgaaatacatatcatatgttaaagtgagagtttttatacatgttgaaagaagttgaatgacataacaaatagttactgaggcctccattttcttacttcacagttaaaattcctgtttctctttgggtataggaggtagaaagaagtgggagagtaatagcattttaaaacacagaatcaaaaatacatattaaaagtagaacttaggcccaggcacagtgactcacgcctgtagtcccagcaccatgggaggctgaggcaagtggatcgctcgagcccaggaattcgagaccagcctgggcaactaggtgaaaccctgtctctacaaaaaatacaaaagttagccaggcatggtggggtgtgcctgtagtcccagctactttgggggatgaggtgggaggatctcttaggcctgggaggtggagattgcagtgagccgagatcacgccatggcactccagtctaggtgaaagattgagaccccatctcaaaaaaaaacaaaaaagaaaaaagtagaatttaggtattcctacttttacagtcaaaagtccactggtgtttgcataacaatgatgttttgactagttattggactaaaagtaggacacatgaagcaggtgactaggaatttggaaatattattgcttaggtcattactggaccttacgaagagattgttgcactggtgacttggactttgctggtccctccccgactcttcacagctggcttgacgactcttgtgacattctgaggttttatgctaaaccacaggacatgctgctgatttgcagagctgacctcagctgtaagcactttgtcttctgcagcgtagaaatgtagtgacctacaagtgtcccatgcccaagttgggtgcattattttgtggtgatggtcacatgtttcataaagacttcctgagtcaaaaaatgacttttctcagttcatcttccatataactcctggccacagggattttgtatccaatggtatttttgttctatgtgtggatattattttagcaaagttcagtggtcactttctctgattccatcttgtattaagctacactaaatatgaaaacgtagaaagttttacttcttatcaacagatgctaatgtatgacattgagtgaaacactttaattcctcaagggctcagttttctcacctgtaaattgaaaaaacctttcaaagattgtatgaatcttcagagatggtaagtctaagaagttgtccaactagtttagtattgtggctttttgtttgttttggaatgattcattctcatatattattttttaaaaaaatagccaggtggctatgacatgcctgtgttggtcaaggtttactgagagtcaagtcaggcattaagaaatgtgaaggccaggtgcagtggctcacacctgtaatcccagctctttgggaggctgaggtgggcagatcacttgaggccaggagcttgagaccagcctggccaacatggtgaaaccccgtctctgctaaaaatacaaaaattaggtgggcatggtggtgggcgcctgtaatccgagctactcgggtaactatggcaggagaatcgcttgaaccaggaggcaaaggctgcagtgagccgagatcatgccatggcactccagcctgggcaacagagtgagactctgtctcaaaaaaaaaaaaaaaatggattgagggtttgttaggtgtcagccactatgtcaggtgctaggaatttgtcatgaacagactggtccctactttcatgaatttatagtccagtgagggaaataagatgaataaaaagacccctacgtctttttgtttgaactctggtaaagaaatgtgtttatcagaggggctaggccaaactttaggaaaacatttcacttcacttaaaaaaaattaggatttttgttttatttcagataaggcaacaaacttccatcaagtagaaacttctgcttttctctgtctttcaaacttgtcaaaatcagcagtttactttgttaaatctgaatgtctctttttagtgtattgcacagtttactagaattgtaatcacaatttcacattctttaacaggtattgaaaatttaaattaaaattctgatatttttgaatggcataaaatgccctatcttatctgaaaattgaaaaattaatacagaaatgtaaatggattgtgaataggtgggatctggccaagtgtgcatttgtctaggcagtgctgagtttctgctcattatttagtagctttcattcttcacctgagccaaaattaggcttagccaataaagccaaattttccttctggaagacatggcagtgtctgccttgcagcatgcatccaagaccttatctgtttctgtatcaaacattgtcaagatcagggcatgaagagccggggcattcctgactcccccaacagatggcatctcttctttattataggtgacttctgggggaacagaaagcatactgatggcctgcaaagcatatcgggatctggcctttgagaaggggatcaaaactccagaaatgtatgtatgtgtggctgttttgtccccttttggatttgtctgtctggagtacagctttatgaaactaaagcagataatccattttcctgctgcttctcttcctctggtaattctggtcccctttccccctgtcctagcccctctgcccttatccttttacattcagtaaaattctaaatggatcagccagttatttttaaagatcattcccatcccgccccacccccagatcatgcatagtatatactacaagcaaaaataagatcctttttccaaaagtgagagtttgaggactacatctttgaatcctgtgatatttgcaaattatttggagcctaaagaaacctctctaggtactttagttctgcttaccttagaaagttacttaatattataggctgcctcagggtactctctgggaaaactttagtgtgagggctgttttctgggaggaagaataaaaatatctttttgagatttacccacattgccttccttggacataaatttgatgtttagttacattattttttcctagactgtccccttgtacagtatgtttatcctacatcttaatatttttactgcaagtattacttgacaatggggatttattgcatatggtctcatgctgtggttcatatgtagcataagagaataaaccaggctgccattctttcttcatatgtcgatctttggtgcttggtacttcctcagtagtagagatttttctccttagagggaacagattcgttgtatgaatggagtagttgaggaaagtctaaagcaaatacccgtgacctcattttctctttcaacactatttgaaatactatttccaaatgtgtaggagaaatggggattttagtttcttcaggtttgttgtctttcagagttggaaggggccactgagctgatgcttggccgctgtgtgaacatttctgcttgaacatgtgttgtgccgggaagccttcttctcattctcactgaggtgcctgtctttggtaggcaaccgttagccagctctgccttgtgttgctctcatccaaagtctctgtcccccagctttccgcctgccagcctagctttatgctttggatccctcactgtgggatcacttctgagtcctcttcctattgccagaatgatttcctaaataggagggaagtttctgcagaaaatcagttggcctctttttgggtgtgcttaaaaagaaaagtagagcagtctaaacacttaaatttttaatttggggaaaaataatcagaacttactcccggtaatttagattagctgctaatggtgttttctattattttggcctgagttacattattctcctcttccctgtcatttagtgtggctccccaaagtgcccatgctgcatttaacaaagcagccagttactttgggatgaagattgtgcgggtcccattgacgaagatgatggaggtggatgtgcgggtgagtccctctggagggcccactgtctgtgctgggccctgacagcagaagggccctcctgttgactagccgtttccagtcagatgggtctgactgcctttgattgtggcagccagaatatgaaaaactgcattgatagtggtgattgactgcagcttcagtcttttcataggttcatgaattctgaaagggaggtgatctagtcactaacttgggacttgagagacactggttttgcggtcagcgccatcactttttctttcttttctctatttgtaaaatgaacatggactcacttcccctaagactcttaccatggcccgggcatggtggctcacatctgtaatcccagcactttgggaagccgaggagggaggattacttgaacccttgagcccaggagtttgcgaccagtctgagcaacatagtgagaccccatctctacacaaaatttaaaaaagtagctggacatggtggcatgcacctgtagtcctagctactcgggaggctggggtgggaggatcacttgagccccaggaggttgatgctgcagtgagctgtgttcacaccactgtactccagcttgggtgacagagcaagaccctgtctcaaaaaaaaaaaaaagactctcactgtggtttagattggcttaaattaataccattgtcattatgatagtgattatttttatgcctcacatttgtgtagaggagttttctagtttcagtgttctgtcagaatcccatttgagctttatgacattccagagaggttgatgaagctgttatattattgtagttcacagataaggaacagactgaagtagcatactcagggtttcactgctggtacgttgtggggctggggctcacatttggctctttggcctcttagctcaatattattttcgcccccacagcgattctgttcttattttgtgctctcagactattctccaaatggacttacctggagtcacctgtgtcctgtcaccgtggtgggatgcagtcttctcccagttggagtggtgaaggagggggtactggtggaactggaactctaagctagcagcccaaattgctcttggcagcagaagagaagagtaattgtgacatagattctcattttcctttaaactttaaatccctaggcaatgagaagagctatctccaggaacactgccatgctcgtctgttctaccccacagtttcctcatggtgtaatagatcctgtccctgaagtggccaaggtatatgagagaaatgggctgctaaggcaggcaaatggatattttaaaacaaagcctaatggggcagtacttggcaaatagaagcgattttttttttgtttttgaccacagtagtgataagtagctctcatcagccctaggggaagccctgcagctcagttgcaagcctttaaaagttgctagtctctgctgtgggggaagatagtacaaggctgaggccttttaaactggaaattctgaaataggattgccttctagattgagatctggaaataatctgcatgtaggaatgtgcccaccaaaagggtgatattccacatgctgcccctcagcacctccctttccctcacgcctcatcctgcagtgactgaggcaggacctttcccttgtgcgagaggcagcctaaatcagagctctactcatttcctgcttgataccgcagagcgtttgaggtcatgcatatttaaatataaaattgataccatatttcagatgaattattttgaagggaaaatacatttgaaagataaattttgttgggaatgttaaaaatagccattttttaaaaacatgggaggcataatacaaaatagccttgtgtttatagcccatctttccacccatgtcttgcagtttttattatagggctataaaggaaattctcttatgttctttgttttttggaacaagctggctgtcaaatacaaaataccccttcatgtcgacgcttgtctgggaggcttcctcatcgtctttatggagaaagcaggatacccactggagcacccatttgatttccgggtgaaaggtgtaaccagcatttcagctgacacccataaggtgagctaaggaggagatcaagtgttaccagttgattattttgactattattgataaaataaattggtagcttccccgcaaagtataaaattaactatagaattctcatcagatgcttgttttaaactctctctttgccgtcaccagatcagctggttcaggtgatggggtatagtggtagaggtgacaagcagtagtgaaaatgaacctgttacctttatctcaaattggctaagagaatttctgtatccactgactgtgtgtaactagaacatgctagtgtagtggcccttgttaaaaaagctccctgaagccttgagctgatttgaggtggagggtagaggagtgtgagggttggtagtggagttcccatgctggtagataacattagagctgctgtgcaactgggctcctgagcgtacatgacgggaaaatgttgacggaagagtcctttggaaaatgggaagaacctgtgtgctcaggaacattcagcatttgagatggccacgcctgccacccttggtggactgagacaaagtctagatcagttgataacgctattgaatatacatccagatgtggaagaagtattagcagcctcaggaatgtgtaccttgttttgattgcattttcagagcttgttttaaactcaagtatattaaagacttgtttttcaaaatcggtgtgatctgcagccgattttcagtcagcatctgttttttccttaccatccagatagctcctgtgtccttttcccataaccatccatttctggatggttcaggtaatgaaattagttccacgttagttttaataagagttaattagggggtcagatgttctataaggaaaccagttacatagttaattttaaagctggattaagtagcttttagtttctgagcaccattatgttctcataagcataatattcttagtaatactaagcaaaaaaagatgggaagggggtcagatggtgattttaacttgaagtgacaaattccatcctttcctggcttccattgcaaacttacccttgctttcatcctgacatatggtctccagagaaatattttaaataaggtaaaccacatgctgggcaagagagggagtaaaccgattaactgggcgctgttcttccctgggtctcagattcctcattcctaacagagagaatttaaactccatcccttaagttcctactatcctttagcattttaagtttgaatccttaatgtgagtgggaaacataacagagaaactgagaaataaataggatttcctttgcatgatgagagttctgggacaaggtctgccagacagaactatactctcacttttcttgtctgctacttcttccacagtatggctatgccccaaaaggctcatcattggtgttgtatagtgacaagaagtacaggaactatcagttcttcgtcgatacagattggcagggtggcatctatgcttccccaaccatcgcaggctcacggcctggtggcattagcgcagcctgttgggctgccttgatgcacttcggtgagaacggctatgttgaagctaccaaacagatcatcaaaactgctcgcttcctcaagtcagagtatgtgtggaagactggggttctgccttgtctattgcttttttgtcctagtaggctcaaggcacctgcctggctaagtatccatagccctagcccacctgttgtctcctgcgatatagagggcttagggcagcagcttagggcttaggccagaccagctggcctgggagaagaagctccctttctctgccctgacttttggagggtctttgagacgggggcctcatttgtagtttatctcatctctatggatgtcttaataactggcagctcttaccctaaggctaatgtacaatttaatggttaggacagtgattcccaaacttgagcatgcattctaatcacctgaaggacttgttaaaacacaggtagctgggcccacccctagagtttctgattcagtggaactgggatgggctctaaaaatttccatttctggagatactgatgctactgctccaggaatcatacttgaagaatcattggaataagaaaataattggaaatgggccagaaggaatgaggaaaggagggcaatgaaatcttgggttaagccaaggccagaacaggctgcatgctttgtctaatgtatctgttaacatcttatctgcccatctctctatgtgtcacttggattggggaggctctttaagtatattgagggggaaggaaagctgcctgcaggcatttctcatttgagaaagatccttggccaggcacggtggctccggcctgtaatcccagcactttgggaggccaaggcaaaaggatcgcttcagctcaggaattaaagaccaaccggagcaacatagtgagacattatctctacaacaaatttaaaaattagccatgaggccgggcgcggtgactcatccctgtaatcccagcactttgggaggctgaggcgggtggatcacctgaggtccagagttcaagaccagcctgaccaacagggagaaccccgtttctactaaaaatacaaaattagccgggtgtggtggcgcatgcctgtaatcccagctactcaggaggctgaggcaggagaattgcttgaacccgggaggcagaggttgcggtgagttgagatggcaccattgcactcaagcctgggcaacaagaacgaaactccatctcaaaaataaaaaataaataaaaataaaaattagccacatgtggtggtgtgcacctttggtcccagctacacaggaggcttaaggcaagaggactgcttgaacagcccaggaatttgaggttacagtgagctatgatcacaccactgcactctagcctgggtgacagagcaagaccctgtctcaaataaataagcaaacaaataaataaaaattagatatatataaaaggtcctcctatagctctgatagggccatttattaagacctgctataccatttcttgctttagggattacatatgactttttagaactgtggagatgggcagattacttttccagaaatttttttagtacatctttcatgcctcagaagcatctaggggaatataattgggagttgggtagacaggttcgaagtcagtgattgagtcattagatctagatggggtttgggccttggaattccatttttattgttccatctatgattctgatctcagtaagaaccactgatccagtgtagccctcttcttttttgaagatgagaagactaaagcccaaagggttagattgcattcattataaggaagactttgaatgattaaagagatagtgaccaggggattgtatgtgactgaatttactttttcttccttcatttatttttttgttttaagactggaaaatatcaaaggcatctttgtttttgggaatccccaattgtcagtcattgctctgggatcccgtgattttgacatctaccgactatcaaacctgatgactgctaaggggtggaacttgaaccagttgcagttcccacccaggtaagcttgaagaagcctctttcccttattttgctccatgattttggaagaacttgggtggtacagtaacctgaagtatagagtttgactgctagaggctagcacgttagtagcaactgtagtatataaaggatttctctcttgccacctggaattattagatacaaagaacaagaccattagctttaaactctggcagaattaggtgacagcctcctagaccagtggttggtcatgaggtttttctctcagtctctagcctttctactctccaatccatcttgtacacagccatcaaattgctcttataaaatacttgttacctggctaatatttagttcaagaccttcctgggggtctctaatcattcaggcctgctactgccttctttattagacttttctaacctaatcttccatgatgcctttgagtaaatgcaccactccaactgagtacaggtctgttcatgtcctctgtgtacagcttagccttccacacgttggtgcattgccagtcccatctggactatctttttccctcttcacaattccagtaaaccccactaaattcctccagggcgaggtagaatttcttctgtgccctgaagtcctttaagaccccagccatgtggccctgtccccatgagagcacatgggggctgattatctaagataaaagtgtctcattgatggtgacgtggttgaaggaatggtggtggaatttgtgaggggatgggtgggacaaagcagccaacactgttcatcctcttagcatggttctcagtcatgccgagaagctctgaggccagcccatgcctgacaccccaagcatgagagagccgagattcccaggactaggaacaacttggatgactacacttgtcagaaatattgtgaaagggcaaccaggaaattcccgtatttggggctgcatcattttagaacattttttctttcttcaaggttcatctctctctgtctcttctttcctagtattcatttctgcatcacattactacacgcccggaaacgagtagctatacaattcctaaaggacattcgagaatctgtcactcaaatcatgaagaatcctaaagcgaagaccacaggaatggtagggacacttggagttttttttcttctcttggaaatttaggtgttggtggagagtttgaaggaatcatatgacccggagtctgttcctgcctctgcccctttgccacagacatcttttatttgttgactggagctgatgatctctgcatcacccaccccttagggttgctgaagtctcaaatgagatacactataaagtaccttgtaagttagagacttctgtataaaagcagctggtggtagtgtccatttgaaaagaaaattttgtcacaggaaagatagtaaacatgttttttctggaattttcttaggctagtccctttatgcagaaaggcagactggaaagtccctgtgaaaaattgactatgccagctgtttttctgatagaatgatgggatgccttaggtggaaatggggtagggcagtgcacatgcgaagctaggactcggggagaaggggctcattgctgcagttttattcttgcttttggacctggcctcactaataatgtctctttctttggatttgtagggtgccatctatggcatggcccagacaactgttgacaggaatatggttgcagaattgtcctcagtcttcttggacagcttgtacagcaccgacactgtcacccagggcagccagatgaatggttctccaaaaccccactgaacttggaccctttctagtctcaaggggattccagccttcagaaggttcttgggatatggaacaggccgtgcacaactttgacatctggtcttgctccatagagcacaactcaagatagaccatgagacagcttgagcctcaggattcttgttcttcctcttatcttccttttgtggtttttaatttgaagaccccagagaattccattacataatgattttgcccttgttataaatgttaccctaggaattgttttaaccatttccttttctaaactctctagctttcaactttacttaaacattgtgtggtagctctgacctgtcctgattctttagagaagctggggtacagtttatgagatagctagagcttctttgttatctcaggcaggaggcgtttacataacagatgtttcctcagctgggtgtgaggtatactctaagcaggaggctttttcagccttctctctcttttttttttttttttttttttttgagatggaattttgctcttttgcccagtctggagtgcagtggcatgatctcagctcactgcaacctccacccactgggttcaagcgattcttctgcctcagcctcccgagtagctgggattaccggcacccaccaccacgcctggctaatttttcaattttctttttcagtagagacgggttcaccgtgttggccaggctggtcttgaactcctgacctcaggtgatacccgcccccccgcctcagcctcccaaagtgctgggattacaggcgtgagccaccgtgcctggccctgtctctcttaagagtaggttcattgtctgtcttagagtcacttctattgcaactcattttctttttccagggcacagatcgaccaagctgccgttccctattctgcaggacaggactattctagcatacctgcttcgtccacccaggcagggtttggggtggtctcttctgtgcctgcagtccccatttgacacttggttgccaccatctttggagattattgtttggaatgatgcttccattggctttttcttgttaccatggactaggaagaaaacatggtttccaaataatctgggagcttttggccatggtgccgccttcctgaattggcagtggtcagagcacacctgaaccctatcctgggctggtgatgagcagaaatcagacctttttctatgcttttttgaatatcagagtaggatgaacacccagattcaaatatgtcaccaaagttggtggtggtccttccctgcacccttgcgttaagccattatgtaatgaaaatgtgtttgcttgaaggaacagctcaaagcaccttcacaagttgccttgacttaccctaggtgggtgtgaaagagcacccgtagcaaggaaaattttctctattagtgtgttcttctgcctcttcccccttgattcagctttcagaggtactatggcagttttgcctcaggtgctgaacatttctcagccctggctaaaagggagcagcacagggagagaaacaggataggaaagcagaatggcgagcagcctatggcccagggcctgtaatcccttcccaagactagctgctcagggtggtgcagggacaggaccagaccctgcgcctatttcctgccttctttcccctatagggaactctgtaggctgagccactgtcctgctcttatgacattatatcttgtgcctttctcctcagcagtgagcagtgagctactcctggcccaggccctaggggaaatggatcagtctttgaggtttctatttggggaggggagtacttaagatgagtcaaaagacactttcctctgttccattccccatctcagggactcctgaatattcagcctctccaggctggtgtcttctagtttcccccactgggaatgctggctgggagagccatgactaccagacttttcctcaggctccttggcatgttagtctgaattgttcttgagcactgtactactgacccaacaactgtgactagctggccacgccattcagggctggtgtggcatttatgtgtgtgtgtgtgtgtgtgtgtttttcctgtttgcccagcagtgcattgtgggttccaagagtgggtagtgtgtgtatgtgtgtgtgtcagagggagacctggcaggcacctctttgagagtagctgtggtcagagctgtttggtcagtgcattatgttgaatgaggtccaggaacccagagccacccagcagacaccactg

SEQ ID NO: 12304 - DNA, 34628 bp, Human
aaaatatgaaaaaatcaagacattttcaaaatacaactggaaaatttctacctagccgcacacccaacactgcttttactgtttttctatacattatgattaaatctgtagtcccatacgtgcactgatttttcaaatgcaaattccaccaaaatttatagggatggccatgaacactgaaaaagatcatcagagctataaatggatactactgccttaaaagctgattaaagggaaatgatggctcacctgtatctacattcatattaactgctattttggtgcttaagcaaatgaacacattacttttaggttttcagaaagaatgcagcatatatatatttctcacaattactcttaagagctgctgaaaaagtatttttttagacctaaccaagtaagacaaaatgccacaaagtcgagaaagttcattttacctcattgtttgttatttaaacaaataattttggaaaaaaaaagtcactgtgatatactcaataataaagagtaagacttctaaagtatcctcacgattcctggagcttactactattaacacagtaaattacatgccacgatatgttggagaaggtctgaagaaatgtctggcattacttggtaactgaagtacataacataaaataccaatttacacacacacacacacacacacacacacacacatatatatatatatatatacctagtcctgtgatgacaattcagaatatgatcttacatttgagtacccacaggatggggtgggagaaactacgcctaagaagctacaaaatctattttggtcaagaaacaatgctgttcttaacttaagagaccttaacaggccgggcgcagtgcctcgcgcctataatcctagcattctgggaggccgaggcgggtggatcacgaggtcacgagatcgagaccatcctggctaacacggtgaaaccccgtctctactacaaacgcaaaaaattagcccagacgtggtggcaggcgcctgttgtcccagctactcgggaggctgaggcaggagaatcgcttgaacccaggaggcggaggatgcagtgagccgagaccgcgccactgcactccagcctgggtaacagagcgagactctcaaaacaaacaaacaaacaaaaaaaaacccttaataaaaatggccatggacacatacatatactaggttattaaatctggctaacactgaactttaagaacaatcacgtttttggataaagaaaagggcagtcatacttttagagcctcatccacattattttaaacaaaaaacttaaaatatggtcgagaactaacaggcttccagcctgaattcaacacccaccctcgtgataaaactaaaaaatcggacagtctgtaagtaaaatacagggacactttactaccctgaaaatcatgctgggttcccgctacgccgggcagacgttttcaggagcatcaccgcgcggcgtctcggacgcacttctcctggcgccctccgggcggcagcgctctcgagacactgttgcttcgccgtcacgcccgtcgttgtcacgcccttccccgcggacaccgagaatgacccatagcggaaaattctaccgcactacctccctgaggcagcgaccggtaagaaacaaccttttcttcaggcttcccaccacccaaacacagtcgcagtcaactggccactatcacccaccaccctgcaggaacaattacccagcctcaccccaagaacgcgcggagaggaggtgccaaaagaaattctgttctcgcgaagtcttaaacttaatcctcgcgacgtctctgttcctgtcgttctttctcagccctaacccacaccagcgcgttgcctcggaaacatcgcgagattttgttccttcagtctccgcccctttacggcacgatggtcgcgcaagaatgtaatagagcttcgacggcccggccgccattttctttctttcttagctgttagctgagaggaagtctctgaacaggcggcagcggctcttatagtgcaaccatggcagactattcaacagtgcctcccccctcttctggctcagctggtggcggtggtggcggcggtggtggtggaggagttaacgacgctttcaaagatgcactgcagagagcccggcaggtaagtgtggaccgcgcggcggaatcccgaaagctcacggtaattggccgctgactgagtaggccgctacccttaagcgcatgaggaagaggaaagaggtgttcttccgggctgaaatgtgaagagacacgtttccccatgttggtaataacgattagagaccagaacccagttttgtgttcttggtgcctaatccacttagaaccccgacgcgtgctacgcaaagaaggcctgaagtctttctcccgcttctgcggcactcgcgtgtctccagtgagctagtttagataaagatcctcttccaggggataaagcgcagttagtttcacacaatttaatggaaggttctggtaatgagtttgggaaagaactagggtctgtcctggagccatagcaagggaagggatttatcattaaagtagcctttacagctcatttccgttctctctcgcaattaaaaccgctttcagtaccattcaccgtcacacctctacaaggaagggacttgaaagcagcctttttctgggcgggatttacgtgtcagtctgttccaccagtccgccccccttatttctcaaaatggcctcaggcccattataccagaggtttcaatttgaatctgcctctcagttcagagtcgtaaactgaccagacctctttgtattacgtagtgcgtgcatttgccctgaaggcaccactttcccagacgaaagctgttaaaatagtgcgtgtattccaggaaaataaaagataccttaatttgaactttacattcttagatagtcccctaatatatttaacatttcaaaatgtatggtgttggtatagatttgcatgtaagcaaaagaatcctattctctgtgacactatgcatattgtactaggtgctgggcattttttactagttttaagctaatgataattagaaaccagtgttgtgctgtgttttcgttgcattaggagttcacttagttaactttttaccgggacagttgaaggaacattgagtcaaaattagaattcataaaatccgttgtaacacatctaatgtgaacgcattataaacatgtacctgtacttttttataaccagaaatactaggagtagtcaacaaaaggtcatcattaatattagttctgcggttttttccacgtaatttaagaaattctgaacatgtttagcaacaagcatataactatgacaaacactcttagcgtgttttattagattgatttgtaaaacttaagggaactattttatttactggaaccaactattttattttaccagaaccagcacattggattaattggtatcgcacactgtaggtagatactggagttttgttttgttttgtttgagacggagtctccctctgtcgcccagactggagtgcagtggtgcgatctcgtcccactgcaacctctgcctcccggcttcaagcaattctcctgcctcagcctcccgagtagctgggattacaggcgcccgccaccatgcccggctaattttttgtgttttttttgtttgtttgtttgttttcagtagagacagggtttcaccatgctggccaggctggtctcgaactcctgacctcgtgatccgcccgtcttggcctcccaaagctgggattacaggcgtgagccgctgcgcccggccttgttttttttcgtttgtttgttttaatgcatgaattgtttcctactaagaagctatgatatagttccttgaccaaatgcagatgaacaggattatctgattaatactttaacgagagcagacaaaatatggatatttaattcatccacttgctttataagtgtttatagagtttgttaggaggggatgcccaatttcctaagtaaaggtgatatatgagcaagacattataaaatgaaagagagtttggccagtgaagaaaagaagcagcatgcgcagaggtgtggggacttgagggaatggcaaggacccagaagtgaagtcgctagaagatgggggtgggaggacgtgaaacgaggcaaggaaaggtacaagcggatccagatactggaagaccttgtgttgcaatgctttaattaaaaattggatttcaggccgggtacggtggctcacgcctgtagtcccagcactttgggaggctgaggcaggcagatcacttgaagtcggagtttaagaccagcctggccaacatggtgaaaccccatctttacaaaaaatacaaaaagtagccgggcttggtggcctgtgcctgtagtcctagctacttgggaggctgaggcccaagaaccgcttcaacctgggaagtggaggttgcagtgagtggagatcacgctgctgcactccagcctggtcatagagcgagaccctgtctcaaaaaaaaaaaaattggattttattattaggctaagccataatttctttatacttcttaaaatatagaaattgttggcaaattgtgaaatttattgttgtataatgctaatagatcagttgtcctgatgtctttgctgtaatgatttctttataaaaatgatcttaaatctgagctccctaactttagtttttgcctggaattacccattacatttgatgatatctctaaatgtcagttgtagctgttactctgatgatataagtggaatatacagaagcgtacttagacaaaagttaggttaatatctgaactacttcctccttgtgtatttaagagaatattgacttaagtttctagaatcctcaactaatcctaagtttattttctttgtctagaatactatgctgtttttgtttttggaaggaagagatataggcatagtttcctgctctcaaggagcttcaaaggctgtaccagtggggatgccattggtatttttagctggatagttgttattcagaaaagcaggacaagtaattatgattcctggtccgtacctggtaatgccagtaatgttaactctagctggttgttgacatctggtcatttagttgccaatcttctttttttttttctggcttttatgtgaaatttttagatttttataatatcctgagctaaattcaacacagggacaccagattgctgctttagttcagggtttccagcctgtgcacttaagaaatttatttttgtgtatatcaagctgtaactccagagattgggattgtttgattgggtctttagcagtggtactaatagcaacttctgtctctagaacattggaaaattaaaatgtgtttatctaccgtttttttcctcgaggttatatgaaggtagaaatgaatcagactagatgattagctaagcgagactattaaccctcatcccttcccctctagacaactatgaaattagtcattatgtattcgatccttcttgcagtctcttctctgacagttataaaagtgatttaggctgcataatgttgtttgaatgaaatgaaaatatagactagagctgtttttttttttatttccatcagtctcttcagtgaaaactaacatttgagcatgattctttttttaaatcattttgtgacagtttagcaaggcttgtgataagcaagttatggtatggtaatatttctagtgtccacgtttcttcacatgtctggtgtatgggaactactaactccatcaggaccttgcctatagtaggtactcaacatttactgaattaaatcaataaacatttttaatgaattacagtacaagtcagacctctgtatctgtgggctctgcatctgcaaattcagccaaccatggatcagaaatattagaaaaatggaagaacagtccagcaatacaagtaatatgaataaaaacaatacaacaactatgtacattgtatcaggtattataagtaatttagagatgctttaagtatactgaaggatttgcgtaggttatatgcagatactgtaccattttatataaggaacttgagcatctgtggattttggtatttgcatggttcctggaaccaatcccccagggatactgagggactatagttgatcataccacctgattttagagattttctgagtctcagaagttaattaagtaaactacaatagtctgttcttaacctcggaggatacattccaagaacctcagtgaatatctgaaaccacagatagtattgaatccaatatatacacggtaatattttttcctatacatatgtatctataaagtttaaattctaaatcagacacagtattaacgataataataaattagtgcaagactgggcatagtggttcacacctataatcttaacactttaactatgacgttgtctttgaaaagaaatcagctagccaaggtggctcatggctgtaatcctagtgttttgagaagctaagtcaggaagattgcttgagcccaggagtctgagaccaccctaggcaacatggtgaaaccctgtttctataaaaaataccaaaaaataggctgggcgcggtggctcacgcctgtaatctcagcactttgggaggctgaggcgggtggatcacgaggtcaggagattgagaccgtcctggctaacacggtgaaaccccgtctctactaaaaatacaaaaaattagccgggagtagtgggcgcctgtagtcccagctactcaggagactgaggcaggagaatggcgtgaacccgggaggtggagcttgcagtgaaccgagatcgcgccactgcatgccagcctgggcaacagagcgagactccatctcaaaaaaaaaaaaaaaaaaaccaaaaaattagccagacgtggtggtgcttgcctgtagtaccagctatccagaaggctgaggtgggaggattgcttgaacttgggaggtcaagtctagaatgttgacaatgttgggtcctttatgtagttgcataagtgagccatgatcgtgccactgcactacatccttgggcaacagcctgaccctgtctcaaaattttaatttaattaaaaaaataaaatagaacaattacaacaatacactgtattactggacaagaagggcaaatttaaaaaaaattaaaccaatatgctataataagttatatgaatgaggggaccctcccctaccccagaatatctgattgtactatatcataggtaactgaaaccgtgaagagcaaaaactgaagataaagagactactgtgtcttttaagtttcttttcaactcccaaattcttggatttctcacctcttggcttcctcaatagaggtgagaaatgttaaagtagtgaaaacaggaaaaataacttactcattcaagaagtagataatggtccagatggaaagcttgaattatttttgtaaaactaaaattaaataaagtagccaggcatggtggcttacgcctgtaatcccagcactttgggaggctgaggcgggtggatcacttgcggtcaggagttcaagaccagcctggccaacaaggtgaaaccctgtctatactaaaaatacaaaaattagctgagcatggtggcgggcgcctgtaatcccagctactcgagaggctgaggcaggagaatcgcttgaacttggggggcggacattgcagtgagcccagatcacgccactgcactctagtctgggtaacatcttgagactccatctcaaataataataataattaaataaagtaaaaagtttcccacacctcataaatgtctaataaaaattgaatatgttgagttcaagtactctgaaaaaggagttgaatatagttggaggttggtttttaggaattactatttttcttaaattaactatccttgtagtcacctaggaattgtgtattttctatagatcttagaaaattatcaaatctacagttcattttgttttttcagttttttttttttttttaagagatggagtcttgctgtattagcgttgaactcctggcctcagccagttctcccatctcagcttctgaagtagctggggctgcaggtgccactgagcctggcttctttattggtatttttattaaacacttttctctaatgtctttgtaacagttctcagtttttgaaatgctgttactgtttctttagtgtgaactgtcaactttcattttttcttttcttttcttttcttttctttttttcttttttgagacagagtctcgctctgtcacccagactggagtgcagtggtgcgatcttggctcactgcgacctctgcctcccgggttcaagtgattctcctgcctgagcctcccgagtagctggaattacaggtgcgcaccactgtgcctggctaattttttttttttttttttgtatttttagtagaggtggtgtttcaccatgtcagtcaggctggtcttgaactcctgaactcatgatcccccccgccctgcctcggcctcccaaagtgctgggattacaggcatgagccaccacgcctggcctcagctttcattttcatttggttagtttttgaactattcagtgggtaaagttgtataaataagtgtcttttctctgtatagaagtgtcttggagttcaaggagtgctgctttgcaaactcatagagtatttataaaagctaactgcagaaggtattcataggctaaaccgtttcctattcttggtagcaccattttctctggcctgaaatactttccttctactattagtgcctgtcgatacccagcagtgtatttactttcctgaggaacaattcaaatgctaagtgctttaagacctaagggtggaaaagcagtgttttcaggcattattaggaaaataagatttaaattagacacccagaaacaaaaacaggtttgtaattggtaaagtgaaagatggttaaagaaggttagattgaccaaagcgagaatttaccttttttttttttttttttttgagacagagtctcatgccgttgcccaggctggagtgcagtggcgtgatcttggctcaccgtaacctccacttcctgggttcaagcagttctcccacctgagcctcccgagtagctgggtgacatgcgccaccacgctcagctaatttctttgtatttttagtagagactgggtttctccatgttggtcaggctggtctcgaactcctgacctcagtgatctgcccgccttggcctcccaaaatgctgggattacaggcatgagccactgtgtccggctgagagtgtacctttttttttttttatcaagcaatctagtacttgatcctaataatctttgtggtaggtgtttgcatttttagatgaggaaaagggaaatctatgagtcctaggaaatacagttggtatatgggaactgatatgtaattagacttaagtgatccatgttgaatttatgacttaagcacttaactataatcttaacctctccagttgtctgatgaagttagtatatgggaactgatacatagacttaagtgatccatgttgaatttatgacttcagcacttaactataattttaccctctccagttgtctgatgataataaaaacttgaagcagttatccatatggggatctctttggggaatcccagtcaccaaaagttaggttttctttaatattttttcatggaagatttcaaatatactcaaaattgaaagaattatataataaattctcatgagcccatcacacatcaataatgaatgtacagcattgcagtgtggagcttggcctattgctgaccactcagcaatgtggcagaaccactccatgattccccatggaaatgggaactacttcggttgtccttttatagaaaaattcagtaagtatctgctgattgtgccctacttgtgacttgaagccaggtttttttttttgttttttattttttttgttttgttttgtttgtaacagtcttgctctgtcatccaagaggggcatgatattggtgcactgcaacctccacctcctgggttcaagtgattctcgtgcctcagcctcccgagtagctgggactatgggcgtgcaccaccacacctggctaatttttgtatttagtagagatggagtttcatcatgttgcccaggctgctctcgaactcctgagctcaagcaatctacccacctccacctcccaaagtgctaagattacaggcatgagccaccatgacagcaaagctgggtatttcttaaattggttcagtcaggtgcaataaattatttgccctactctaaaatttaaaaatcttctaagaattatggttttgcagctgaggtttttttaagactcgagctccctggactcctacatatatccttagaacaacattgtccaatagaagtacaatgtgagccacatgttttgtttaacccagcatatccaaaatattaccccctttgcatgtgcttaatataaaaatttaagatgatttatattccaggttttcaatattcagtgagtaattttacacttagagcaagtatcatttcagactagtcacattttgagtactcaataaccacatatggctagtggctaccttactagatagcatagcctttgagtcccacaaagtgttcacattctatgtgtttacacacatcttttgaagtgtcatgacagagccagataggatccagattttctttaaatctggtctctcttccggattcctagttgattacttctttgttgcttcttatagggatgtatcagaagtttaataatcttatgattattatgttaactgcctgaagtattaatggtagcaataaattgaactataattttaatttttcaagtaaattttcttatgtgatactaaatatttcacatatacatgtatcaggaagtaaatgggggtaatttagtaatgaatagtatataatagtttatgatggtatttttcttttttttttttagattgcagcaaaaattggaggtgatgcagggacatcactgaattcaaatgactatggttatgggggacaaaaaagacctttagaagatggaggtaagttatactctaagtattttaaattgtttttcagagtgtttagttgaagtgattctcggtatttttctgttattttattgagatattaacttttattataaggttgttaaaattgtaagctgtatattggcctaaaaggggggaaagaaaactagacaaggtaagtaaaatttgaaagaaattttttaaaaaattttttaaaaaaggaagttttgtcttaatagaaaacaatttattttccctcttttaggattgtgccagattgaaagtttgcacagacgtcttgttaataatattaaaaaacatataaattgcttagaagacacttcactggttttactcatacgtgaatggattttaatatgctgtattttcgtcatttttctatttccaattgcaccttaaaggttgaaattcctatagtttgctactctagtgtgttgcaggttataccattttttttttaatgttctttactttcagtacttttgtgtttcacgtttagctttaaacctgtggattaaaacagtggatttacagtgctatgtatttttaaaaatcgtaatcgttgaagcttctgaacttagaagtctgcatgtattttttgttttaggtttgatatatgagttttgatacattttctttttacccttttttttaaagggaggattctcactgaggctatagaatgtatttgtagcttttgaccaggagaacttggtttccttttatttaagtgtctttcatatttatagtgaggtttttaatgtagaaaaaaaatgagctaatgatgcttcagatgttgtatgtaatgtattctttttattttatgtgtagatggctcttggacaagtccgagcagtacaacacactgggagggaatgccctctccttttaaaggcaggaatttttatttattacctgtgttcagtatgtaaacgtgaaataaaccagtggattcttaaatggacacaaatatttcttggattatgtgtctgcgcatattttatttttgctgcacaacattctgatgtttaatcatttaagtttgaaggggggaggagaatgtagtactttgagctataggttgtctgttccaaggtatgcattgtattcatctgtgtaatggatttaggtgaaggtagtcatgtagttgctttgagattttatttttttgctaaagttttatgcagtgaaatgtttgtttataaataatagaacagtttaggttgagattgccttgtaatgttgtggggggtttttttgtttttttttttttgggcatagctttgtggtcactgtcagatacactttaatatgtcagatttttgtagtttgataggcttttctccccccagtcttcagttcctgaggtggaagcatcattagcctttagcatgtgatattttgctagtaatggacctaaagtacgttgtcttgtgtcattctaatgtgcttaacatacattaaggtcagtgatttcttaagaatcagataactattttaatgtctgtgcatcttttgaacgtgaagagaatgaagtatcgtttcttttttagattactgagttggggttgaattttggcagttttggttcaaatgataaaccataccttcagatatttcaataaatgtttatattgttatttattcttgtttgggaggggagaagctttgtacttaattggcaaaaaattaaaagacacttaattttgcagatcaaccagatgctaagaaagttgctcctcaaaatgactgtaagtattccttttaaactgggtcaaaagctaaagtaacaatttcaatgttaagattttgttcatattattgggtatctttgaagttagttggtttatgagtattttggatcagctagcctgaatttctttgtaaatatatacctttttctcctattttacaatctgtcccattaattgtggccgggtatatgtaaagattggttgctgaattattttacatatttaacaactccaattcttgatctatacttgtacaacttgaaaaaggaaattattttgttctgtgccattgctaatataatgtcttccctttcattggctctcttgcccctgtcaatgccaatataaatattgtgtaaaaaatttgactctcttcaaggtgttgtctgtgcattagggagagatttttgaatgtttgatgtgattgtgttgttaaatatataagtaaatttaaattttgaatttttgttttatttttatttaattttttgatagcttttggaacacagttaccaccgatgcatcagcagcaaaggtatagtcacaagattttcaaaaagtactctgcaagttttggttgagctgtatgtaaaaacacaaccacattggtgtatattgaatatgtgtctgtgtattttttggtgtacctagttcatatcactccccttgggaaggtaccataaagtgatgatttttcttttgagtgagaaaaatttgtgatttggagagataggtggaattaaccacattttagaagaacaggggtgaattagagtaactgttaagatgacattctctaaactccacttcaacttctttacagttaatgccttcagactgttccattcatcatcccttcttcacttgatgtgtcatcttaaatttcttaatttaactactcaagtaataagatcatattttttgacatgagtctgagcctagaaccttagtttaagccattgggagacattagacttccatttttattaatagattatcttttatttgtaaacaaagtatctttcattgaaggaaaatggtgctttctgttatttcttagcagatctgtaatgacagaagaatacaaagttccagatggaatggttggattcagtaagtaacttgatttttaaagttttgaaaacatgatcaaaacatactttagaatctttcaaccaaaaaaaaaatttttttttttctaactagtaattggcagaggaggtgaacagatctcacgcatacaacaggaatctggatgcaaaatacagatagctcctggtaatgttacattctcatggtattttcagtgtgactagaaaactagcttttttttttttttaagccttctagtaacaataatgctacttttaatcttttgacctgaagttatctgtttgttttaaattgtagacagtggtggccttccagaaaggtcctgtatgttaactggaacacctgaatctgtccagtaagtttgaaaaatcttaaaaatctacttaagtaacaacagcagaactctttgaattttgtctcttctctttgttactgctttattttacactgtggtttcgctgccaccttccctcaaagtcctccaactcctttgaagtttatgcctcatgcctttctcaggtggggttcatcatctgaatcattaaacacagaaaatggttaaaacaactccatatctactccagtctctacttgtaaagccacgtgtagcctggagaagaatgcacagtcaggtcgactggtgacacttaaaactcagacattaagctcaagtggactgttgtgttgcctgcatttccctagttccattcacttttccactcctctcccaggctctttaatactgtatttccccacctccaaatcttcagcatctaaccccacgctctcccacttaagcttatttactgagaaaatggaagcaaatgataagaagcttttctttttccctaccactaaacctaccagccttcatttttcctctgttcacatagtactcaggtaattgctttccttttgtgttcgagtgcctaaagccagccctttcttcctactgaaggttcagcttgcagttgtactttcttctgcattgttagttctccctcattactaggttttttcttttcttttttttgagacgaagtctcgctctgttgccaggctggagtgcaggggcacgatctcggctcactgcaacctccgcctcccgagtagctgggactaccggtgcatgccaccacacccagctaatttttgtatttttttagtagagacagggtttcaccatgttggccgggatggtctcaatctcttgacctcgtgatccacccacctcggcctcccaaagtcctgggattacaggcgtgagccacttcccccagcctgattttctttatggcactttccaaataatgtgttattcatttgacatgttatttttacttatttaatgaaatgaagccactctagcaggaaccctgtttctttgagtgctattaccccattacctagaatagcacctgcacatagttgatatttaaatatttgttgaatgaataattgtagcatatgagtaagcaaaatggtagtttaaaaatgtaaataaatcatttagttcttggaagaatcagtttaattctgagataactttagcattagagttctttcttggaaattttggactattcttaaaaataaaaattgtatatctagaaaatttttttgcataatctctcaatctttgacccttgatggcattttctttcagttaaaagtaaaagcattgttaaagttagcatcaaggcacctaatcctgaactgggataggaggagtacttggttatattgttttatatttctctatttgaataagcttgggtatgctacagcttactatttaaatattaatttgttaacaggtcagcaaaacggttactggaccagattgttgaaaaaggaagaccagctcctggcttccatcatggcgatggaccgggaaatgcagttcaagaaatcatgattccagctagcaaggcaggattagtcattggaaaagggggagaaactattaaacagcttcaggtattgttatttttgtgaaatggctacttttgatctgttttgatgcccatttttgtccacttccttttgttaatatatattatttctatgattgtaacaggaacgggctggagttaaaatggttatgattcaagacgggccgcagaacactggtgctgacaaacctcttaggattacaggagacccatataaagttcaagtaaacttaactttatactttataaagaaagagtgggttgaatggggttgggcaaaatatgcatgaataattaaaatgttttgagacatgctttctaaattagctaactttttctgctttagcaagccaaggaaatggtgttagagttaattcgtgatcaaggcggtttcagagaagttcggaatgagtatgggtcaagaataggaggaaatgaagggatagatgtaagtaaaaatacccattcagaaatggttgtatgctaattcataaatataatagtgttttctgttttgtgttaagtagctctaacattgttatccttttatttcacctttatactttagaatacagaattctatatatcttgttaccctatttactataaatatagaattatatgtacttttatgatttgaggcagattttcaggaaatggcgcttttttaaaatacttttttttactttaaaccctgagaagctagctttcttaatacttagtcttttttacataaggtccccattccaagatttgctgttggcattgtaataggaagaaatggagagatgatcaaaaaaatacaaaatgatgctggtgttcgcattcagtttaagccaggtgagtacatataataatcttgtaagtgttggcagcagtgagttttgacatacatttattgtttaattaattttgtttctttgttttgaagatgatgggacaacacccgaaaggatagcacaaataacaggacctccagaccgatgtcaacatgctgcagaaattattacagaccttcttcgaagtgttcaggtttgatagaaagttaacattttcattttttgtttttatggaaaagtattttccttcatgaaatctgaagttacctctatatcagagtctgcttgatgatgctttattaatggagaaagtttaaattgctttaaggtaaagatcttggagcaggaagaactactaccttaagtgctaccttatttactcttgtattttaaaaaatgttattacttattagggccagttcatctctacatttctgattcaggtatatgagagctgggaaaaataaacttaataattttatcatgaaacaaaagtatttctgtgctgactcttcgttcttgtctttccctctctataggctggtaatcctggtggacctggacctggtggtcgaggaagaggtagaggtcaaggcaactggaacatgggaccacctggtggactacaggaatttaattttattgtgccaactgggaaaactggattaataataggaaaaggcaatgtattttaaactcttaatgttttaacacattattcatttttctggacactttctgttgctgtcgtaaacaagtggcaatgctttttctctgaccgtattttagtagaaaagaattcttatgttaatatgtaacaagtaaaacataaatgagggatctcatgtatatttagagaaagagcaggattttaatcttactagcttctagagaaagcgaactaagagataattattagcataagaaatgtcttttgacccaaaaagtggtttgagtgtttttgtttgtgcattttggtttttcccgactcatattttaaaaatttgaatgtttataagtgtattagtttatatttacactgcttttaaaagcagttaattcaaatattttattataatcacattaagtttatgtttaaacatactaagtaaatgtaaatgtattttaagagaagcatgaaatgcttcctaaaatttgattttcagtgtagaatattaaatgaaaaatcttaatacaatattgtcaattaggatactgaccaaaccatatttttaatggcccatttaattgtgaccattttcttctaaatagctcctagtacacccttgaaacctttagagaaattactgtcttttgattttaggaggtgaaaccataaaaagcataagccagcagtctggtgcaagaatagaacttcagagaaatcctccaccaaatgcagatcctaatatgaagttatttacaattcgtggcactccacaacagatagactatgctcggcaactcatagaagaaaagattggtgtgagtatactttaaacttttaatttttagtgtagacccttagactgtagttaaattaagacgtttattcaaatacatcaaaggaaaatgtatcattactagtcagcatttatagatttcatgatatgtataatagatacaacgtgaagattttccagcaatgaaaataacctaattaaatgtgtagttacaggttttgagaacaaccttacatttgggtgtggctagataagaggagggtagtgttacctgtaggcatgatattagtgttggtgtaggattgtggaacatacttgaaggacatagttaacgggaattcattatttattaagattttactctactgaaccccagcgaggcaaacaagataaatcagatacatctgccactctacagtagaaattcataaatcctaggttttggactggctcacagatcatctgggggtattaaaatgtagactatttgggtgcttcccactcctacacataatatacagagacagacctgactcaaaatgtctgggatagggcccagcatctaattttacatagatgtttgggtgattctggtgcacagacaaatttggaaatttttcctccaggaaagttttctgttagaacaaaaaagtatgaaacgctttgactgcttttttgtaagtgaggcagacagtgtcttactggagtttttaacacaaagtgtgcagggggcatcttaaattattagaattgcctaggaaaaattatttttggtgtttgccatgctgtgaatggggtgcgtgcaaaacaaggttgacactgtttctgtcacacttgggaagaacacaaatagatgtacaaaagacgcttaaggaacgtcttactaaatgtacacaaacattgtgagttctgttgtatggatagtttaatggttcaaaaaatgaagaggatgtttgtagagtaatgatagaggttgatgccatggcaaaaaaatgaatagcactcatcttggttttttattttacagtattagcctaacatgcatgcgtcaggatttctgttggattcatggaaaaacaagatagattgttttggagaagcaatttggtgtggtgattaagagcatggactctgtagtcgggttgcctcagttcagaattctgtgaatcatttactggttctgtgaccttggagaagttactcaggcttttctgtgccttggtttcctcctgtaaaatgaagataatggtatctacttcatagagttgtagggattaaatgaatgttcatgtgtgtgtcacttaaaagaatgcctgccacataaccctaaaaaatgttgctactttttcagtattatttttactacttggaaagaataggtcatggatagtaagtgagagatgacagcaattggagatttaaagagacaagttaataaaaagaactttaaaggtcatgaagtttagtttccctattttgcagtgagaaatttacaacaaaatgtagtgttagcattttgtccaacatgtcgcctggttgtgttaactactcagaaggagcattttaggacagttaagtgtaatgtctttgttggcttaaccaaacagaaatcagttaagcgttattaatgatgtggcatgcatgcatgataaggatataaaatatcctgatttattgaaggaattaaaaagggaatttttgtgctattaaacatcatgatacatgaaaggccaaaaaggatataaattattgatctgaatgggattttagtgacagaaataggttgtgaggtggattttagtttcatagtgaaacaactagctattaacgttatcagtgaaatgttcagaagacgatgatacaggacccaagcggtttgggaatatattgtcaagacggttgtctcatgttaggcaagtagatatagagagaagagctgaagataaggacctgatttctgtgagtaagatggaaaaagatagtaaaagtaagaatgataaaaggaaagggaactactgctgtccgcaaacaagctaaaggaaatttaattgctaatttaaatttaatttaatttaaattgcatttaattgctactgctattgattttagtgaattttacatgtctcattattatggcagatgaaatagtttttgcaaaatgaatgaggaaaggaaggaaaacctaaaatttgttatttgtgactataagagggtagaaatggatgattatttggccgtagagttgtttaaccattactgtgtttttctgatttttctatgtcatccttttttttgtagggcccagtaaatcctttagggccacctgtaccccatgggccccatggtgtcccaggcccccatggacctcctgggcctccagggcctggaactccaatgggaccatacaaccctgcaccttataatcctggaccaccaggcccggctcctcagtaagtattgggtttagttctgggctttccccaaagattctagttttgggactgttttttatgctgatttttcttttcagtggtcctccagccccatatgctccccagggatggggaaatgcatatccacactggcagcagcaggctcctcctgatccaggtagaagatgcttattatttgtgtgttatctgtattattttccactcctgttacattattaaattttctagtgttgattctacatttgtatgcatcaccttcactcactttactctttcaacagtgttaggcactgcctctaccccagtgtataggactgacatgaatatgagctctgcttttatggaatttctttctacttgcctttggcttatgagttgatacagtagaatgataaaagctaaaagctgcaggaaagagcacagtgtcataggttttggataccagtgctgtcaaatgtgtagtatgttcattgtgacattatctgtggaaaaatagtttttacttatttagaaaagtatgtgataggggctgggcactgaggctcacgtctgtaatcccacctattcagaagtctgaggctgaggcttgagaccagcctgggcaatatggcaagacccatctctaaaaaaatttgttttaaattagccgggcagggtggtatgtgcctgtacttgaggctgaggtgggaggattgcttgagcctagaagttctagattgtattgagctgtgggcacaccattgcactcccctgggcaacagaatgggatcccatctcttaaaaaattatgtatatatgtaacagtctatataaatatatatatataacagtccaacagagtgttaagtattggggcattaaacttccaaattgtcaaataagatatctgttctagtactcctcatatgacaacttcatgtgagtaaaaatcaggcctgtatttaataactgcatgctaaagcccaaatacgtttaattattttctatattcagatttatttttatcctattatattctggcatctttccataccctgtagtttgctttccatcttggtcaaagagtcattctttgaaaccaattaacatttatttatgatccttttttctcacctgctacctaccttttaggcctctttcactcgtgtagtttcaaggaaaatatactcaattatggaatactttctacacataatacatttatcccaaaaaaacttgaagtaatttatgtaaatgaaattgcttgattaacttcataggaagtgtgctgtttggaatatgatgacacagcatgacagttaccaagcatgacttgagttgtgctaggatataggtgtgcaaagttggggttgtgttctatagcaaaagaatgcactcccagcgtaagcaacactgatggaaggggctcacagggtacaggatataatactcttaacaactaatttttggagaatgaaagggcttttctttccctcttgttggctgattgggatggtataattaatgggattgaagagtttgagtaggttaaaaggcagattcatattgggtaacttggatctgccaggattgtatttttgagcactactgggtggttagcatgattgaggaaaaatgatgggaataagaagtggaagtggtctttgtatcacaagttgaatttctcacttggagtagtagtgaagtcactactgtaagagctggtcagtgaatgtggttgcagcatggcctttgggcaagaagtaacccatttaactaaaaccagctggttggccccactcagatttatcaaagggttactgggtccctgggggtggatattgcttatattagacttagaatagcatactgttttaatattatatgaactaaaatgtttctttaaaaaaagagtggtctgttaatggatttatgtagtggtcaagaatttagacttcagagtcaaataaacctatatcagtcctagtcctacagtttactaattgtgagatgtcaagcaagtttttgaactcctctaagcctctgttttcttatctataaattaataaatgaatgaatcgggttgagtgaatatttagtaaattcttagtacatactagttatttgtaactgtgagactggttttttggtatggttttcacatttgggagtagaaataccacttcctaaagtctgttttatctcaaattctctatccaggcatagtgtaaagtgaaatacctagatttcttgattaatatacagataatggccagacgccatggctaaaacctgtgacgctagcacttcggaaggctgaggcgggcggatcacttgaggtcaggagttggagaccagcctggcaaacatggcgaaaccctgtctctactaaaaatacaaaaattagctggatgtggtggcaggtgtctgtaatcccagctacttaggaggctgagacaggagaactccttgagaattgctccactgccctccagcctgggcaacagagtgagacacttcatctcaaaaaaaaaaaaaaaatacagataatgacactattgagatatgtaaacatccaacataaaaaagcagtacattgggcaattgagaaaagtttggcaggtgtcctaataacaccttacaattatattaccttgcaattttctttttctagaaattcttgctcatttttctcaaacttgactaacctttattaagcagctgagaattgctactgttcagaatgaaggtataatagaaaatttaaaagttttaattgtatggtattcctagtataaaagacaatcaagttttttctggtttctagaagattgaaaggtctcaaactgttcgcacttcagttgatgtgggagatgagtgagggtcagtcaagtgtagaggagacaacatagctaaaagccgagacacgggcatagtgatttctgaaaagtacaagcactgtgttgtggctggagcttgggtgttgaagagatacaaccaaagggagagatgaggctgaaatggaaaggataagccaggggcttcaggctgttaaagatgttgaatgataggctgtacttaagctttgaacatcctgaagattgcagagaatgaagaatttcaagtaggatgacatcaagtttataacattcaatgtgaaataggatgaaatgtggctaatcttttttaagatttttatattttctcttcattgaaaataaggacaaagttcattgttctaaaataattttctttcttatacaggttagtccctagaaatgtttttctttagtcatcttctagatagagctgtttgtgcttgaggcgaaaccaatttagaaaaaaacaagggcacaggatggtttgagacagagcattggatttggagccaaaagacctttattcatatcccagttatgccactcagtagtttttaacctaggaaagtcacttagtctctgagacttggttttctttaataaaagctgatggtgacaacaaaaataatagaaaatttaagttttcatatactttttttaatgttctagttaattttgggggctgtatatttgccagagagctgggcgggggggtggtgtgtgtgtgtgtgagagagaattacagacttcacatgcaaaccttgaactttcatttattttagctaaggcaggaacggatccaaattcagcagcttgggctgcttattacgctcactattatcaacagcaagcacagccaccaccagcagcccctgcaggtgcaccaactacaactcaaactaatggacaaggtaactacagaacttattgtatgtgaaagccaaaagttgtgcttggaattatatatgaagtacatcactgtataatacctaaaatttctgacattatttaattataatttaagcagacttttccttttttaaattgttactttgaaatagtttcaaactttcataaaagttgtaagaagaatacccggagcacccagatagcccagctgttaatgttttattcccttgtttactctgttaccatctatatcatacatgtgtatctgtatttattttaaatatccattataattagttctgaaggaagctaattatatccagcataattagttctgaaagaaatcactgaagactaaactgtagacatgatgtcctgttgggtacttcttcaaaaatacataaccatcatacagccctccaaatcagtaagtcaacattgatatattaagttctttatatcattatggatttctgatttttgcagtaggttatatttttaaagtatttttataattttgataatcagattatcctggatttggccagtcagggagtatattcagggtggtgcctatatccttttgaaatacctgtcattcttttaagcacttccatactgtctggcacagtaagattgttattttgtgctttctgggctccagccctcgagtcagctatttcttcaaggagctcttattccttttagtagagtatggtagttagaaacgagacttgagtatgcttgttgctactgaggtgtaattgcttctagcttctttcaacaggcagaactaggaaatatatttacatacatgcatacctacatacacacaccaaaaaacacataaacatcgatatatgtatatatttttaaaaactatgttcatatcaccacatccgtttcagcattttggggttttcaagccttttccttttttgtacttgtttacaaacgtgagaaacctggtgtcctcagtgtatttccttatttgacatgcatttacttatatgttcaacataaccagtcttcaaacaggttggttttcttttctgtccaccacctctgtacccccagtaccttctatctttggcactgttagggatgccaccaccacatagtacttccctcctaccctcactgtcacattgcaggcccctgccagctcctgcacccaaggaaacggccaaaattgccttttaaaaactttaattctgttttttgttttgttttgcttgaacaaggagatcagcagaatccagccccagctggacaggttgattataccaaggcttgggaagagtactacaagaaaatgggtatgttttatacatttcttgaaaatacatacttaattaaattgaaacaaattattctcttcaggaagagaataattgaataaaatcactggacttgtaaacatatcaagacagttgtaaattatagtttttaaatttgtggttatatggcaaggaaatttttttttctaattgcatttgtcaaccagttattaattgaaactagaaatgtccttactggtacatacaatattaacattactatacttttgacaatgacagttatatatattatcagtctaaatgacataaggttaaattttaatgtgtcaggcgaaaattgtgtgtgataccattatttttgctgcaagataagcaggtaagaagtaatctgcagtgacggaaagtaaccaagtgatggaaccagaatctggcttccaagagggtctgagtcccaagcttgtctcccaaatttgtctctttaggaaccatttggaacctgatactatacttctggacaaatcactatatttcagctgcttttgctcttagtcatttaaaattattacataccacagctagatgtcacaaatgaaagctaaattggtaagcttggttatccttcactagcagaaaaagaacctataggtggtagagttttgtcataagagaacggtctacttgggattttcaatgttttctttgccaaagaatgtttctcattctccacagaaagaaaaatttccagaaaggtgatgattttaatcttctagatgtaaaattacatatacctgatgataaagttgttttgcacaactggtttctttttaaagaaaaattgtttttcctcttagaatggcttcctaggagagtcatgttccgtctctttctgaggctttaacagattatgtttttgtgacctagcttaggcagatctacagtagctacaattcggcaaaaagaaacttttaacttaaaaacagcatactctgattaaggttggttacataatttattttctgaactgggatcctttttagaatgaatagggatgctattaataatcatgccctgacagcattgtggtcaggacctgtaatcaacttaactttaattaaatagcatcaccattttaaaagacttgagcatgagccacgtgcggtggcacacacttgtagtcccagctgcttgggaggctaaggtggaaggattccttgaacacaggagattgaggccagccttggcatcatagtgagacctggtcacgtgtttgggttaaaaatcactaacttcaacttctattttctcaatgggtaatgtcccctagatagggtccctagttattattaagtaggtaaaaataaaggcttgttaatggatttaggtaattatggaggaatgagtttggcttctgtgctttattttaccatattgattatttgtaatatggccattaatacatttactgtttagtcttttttgttttactttttatgttttactcaaaatgagtgggtgggtggaattctaatttttattgttaagggaagacattttaccttgtctttaattttttatttttttttaccatttccctgccagttagagatactatactatactgtcttgaatcctctgtaggaaaacatggcatagaaataattaaataataattagatgttaaataataatgctgtatgactaaagaacctccttaccccaccttttctgttgttgttctgtagtaccacaataatcacttgttaattttatttatttatttatttgagagggagtctcactctcgcccaggctggagtgcggtggcgcaatctcagctcactgcaacctccgcctcccaggttcaagcgattctccggcctcatactcccaagtagctgggattacaggcgcctgctaccacatccggctgattttttgtatatttagtagatacgggctttcatcatgttggccaagctggtctcaaactcctgacctcaggtgatccacctgcctcagccttccaaagtgttgggattatgggtgtgagccactgcacccagcctcacctgttaattttatgagcaaaacagattagttgggcaagtccttcacatgcatatctcgttgttgttgttttttttaagacggagtcttggtcttactccccaagcaatggtgcgatttcgtctcagtgcaacctctgcttcctgggttcaagctattctcctgcctcaacttcccaagtagctgggattacaggcgcccaaccacacccagctaatttttgtatttttagtagagacagagtttcaccatgttggccaggctggtctcgaactcctgacctcaggtgatccacccgcctcagcctcgcaaagtgttgggattacaggtgtgagccactgcgcctggccacatgtgtatatcttaaaggaaataatgctaggtaatttagtcaggtgcttgatgagcatttgtcatcatcatacggagtcaatttgtctttttctataaaagttctttttgtaaatgattagttgcttaactgctttaatttcttctaggtaccttacctgtcatcaggatctttttaccacaaataagaaaccttaaagcataaaacttggttcagtcttcacatttcttaaatggaaggagaaagggaataatagggagatatctttatctcaaagccaactgttgttgacttttccagtggcaggggtatgatgctaggacttcagatttcctgattccccatcctagtgccccttttgccaaactaggcaggctttcacagcttttggagcctaatttaagtttttcttgttaagaacagaaaactccattcatagattttaatttgtcattatttgcttatttactgaaaaaaaaaaaaaactattgaaaacaggtgtgggttaagtttcccaaaattaggtttatatttcaaaacaattctaagttcccaaggataacaccaaactaagaggataaatttttattttatttttttttattttatttttttgagatggagcctttccctgtcgcccaggctgaagtgcagtggcatgatctcggctcacttgcagcatccacctcccaggttgaagcaattcttctgcctcagcctcccaagtagagaaaatcttgataagatttcagaggcttataaggaacagcagtaaagatgggtgtttttaaagctagaatacagggatttttttaagacccttaagagaacaaacagggtttcaaaatagaaaggagtaattcttgtttggagaagtgaagacatttgggaaaagtttgacttgaggaaggccattatgataaggactgatgtggtagactctgaaccctgaagaatctggtaccttaagcctaaaggagggtagagtgaggacttgtgggaaaggtacagttatatgggaagacaactgagtgtgaaaatctattcatgcaaggctggctcttaggctctaatagaatcttgcaagctaactctagagcaagtcttttatctttgggatgaaagaaatttaaggctaaactttatacattataattataaaactataataaatattagataatgttctactgaagtataaactcaactatctggcatcaaacagtaactaagccatgatcacaccactgccactgtgttctggcctaggtgacagagcaagaccctgtctcaaaacaaaatccagtaactaaagagaggaataaggggagcgcaaggtaaggcagtacatgtctgaaggggcagggaaagagttctttctctacttccaactgggcaaaataaatcacatttgccctttagattggaagagtgaaataagcttttcttgaacatcttttaagattggagtgtcaaatattaccaacttatttaccaagaatttggtttttcttaaagtctaaagtgtttactattagctttccacagggatataggagtttgcagaggttgtagttttttaagggaacatcaatgaattttcttgatgcatatgcctgtttctaccattttacattgttaatttgcctctaaaatgagtaactcttacaatggggtttaaaacctgaagactattgattgctaccttgatcaggtttggtttcaagtgtgcaccctgtaagagacaatgtgtggttttattgctattgtcacaccagttttttagatattgaaacctgtttcagatttgcttgaattgtgtcttgtaagaggaaaatgttaaacttacttcctctttgagaacagttatttatagaagacaggaaaatatgagaatttttaatagtatatgagagttctctgttacccaagaaaagagggtttttttcaggcatttttaaagaatcataaatcttaaattctttcactcagttgctttgagtctgtgacctgttttacaatggtgatagactgctttctgaaactatgaaattggtcttgttggcagcatcctacaaacataaaaagagcttcctgtgtgtccatgctccagtatttttgtctatggtagttatttcacaaagccaagcgagttacaaacgaaataaaatagtgcttaagtaaagaaactgaataggagaacatatactctctcttctcaattttttatttagaaaattatataccttcagaaattggggaaataaggcatcagacactcagcttcatcattttttaaaagtttgctgtatgcgctttatatgtatgttttttgtgtatgaaccatttcaaagtaagttgcagacaagacagtttgctctaaataaactcaatgtctgggcacagtggttgacgcctgtaatcccaggactttgggaggccaaggcaggtggatcacttgagtccaggagttcaggaccagcctggacaacatggcaaaaccccatctctacaaaaaaagagaaaaatgtcagctaggcatggtgggcctgtagtcccagctactctagaggctgaggtgggaggatcacctgagccctgggaggttgaggctgcagtgagccatgattgcaccgctgcactccagcctgggtggcagagtgagaccctgtctgaaaataaataccctcaatattatcacaaacatacagactatatttaaatttccatagttgtcaggaatatgtcttttgtcgtctgtgtgttttgtttaattcagagtacattcaagattcatgcgttgcatttcattgctatatttctttaatctcttaattcagcaaagtcaccttatttggaaaaagacctgattgtgaaagctgagttttatgtgttttcattgatcttgttctttattccttgtcaggttacttttaataacattgtgttgtaattggaataaattattaatacttttaacatcttattatgtgtgtgtgtacatacactttataggttactaatcaggaaaaagtcttggctaggtcttaatacagtctttaaatcattgcctttaagtgggcttaaagtttttcaaaaatgttctttttgtaattctggaatcgaattaagattatgcctaaatctttaccttccttagctaaagcagtgtggatttggggttgattctgtttttttactaataatgacgctctagaactaaaagttaacgattaattataaggcaaaaagaaaagagcgttctttttttttttctaattgcagagtagtttcctgacactactaaatgaatattttaaataaaacaggagtaattctgaccctctgtgcttttgtcttataacctgtacttacagtggatgtaattttatattaaagtttaggggtttttttttttggtcaacaagggcaaacacaagattattcaaaggcttgggagaaatattacaagaagcaaggtattgtttttattagaaatgagatgttgggcttataattgtggttacagcaacaaagttcttttttttcaaaggtcaggcagttcctgctccgactggggctcctccaggtggtcagccagattatagtgcagcctgggctgagtattatagacaacaagcagcctattatgcccagacaagtccccagggaatgccacagcatcctccagcacctcaggtataatgtaattgctaatttgttgatttctactccagtctgttttctgcatgtttactgtttgtctgtttgggagtgtttgccttttaaatttttatctggcaaagtataataactatttaaatgaagtactacggtgtattgtttgggtttttttgttttttataatgctttccagcatctgagtggtgaatatttctgcaatgcctttgattttaaaaataaattttcttcccccagggatttgcaaatcatgcaagaagccaccaccatttatattaaccactttttctttcttaaaggattcactcctgaattagctccatttcaaggattttctttaactttttgtgtatttcttatgtatctcttctgcacagggccaataataagaagtggacaatacagtatttgcttcattgtgtgggggaaaaaaacctttgttaaatatatggatgcagacgacttgatgaagatcttaattttgtttttggtttaaaatagtgtttccttttttttttttttttttgaaaatgtacaaaatatctatcactactgataggaggttaatatttctgtgtagaaatgaaaattggtttgtttttagtatttagtgtagatgtacacattccagcaaatgtatttgcaattatgtggttgatgctttgtgatataaatgtactttttcaatgtatactttcacttttaaaatgcctgttttgtgctttacaataaatgatatgaaacctcctgtgtcggtaagttggatatgtgggtatttaaaggattcataatttcttagcaatgataaattaagatacatatacacaaatatataagctttccccatgaaatattgagtttttaaacactggcatgtttttccccccttgcagtatagtggtagattggaggatcttttccatttattgtattggctctttcagcacaagtaatcctgatatcttcattttttttccttctgtttgattaaaaactgcatgtgtgtacaatgatcttttggcatacttccattgcattaacagtgaaatttccttttatacatgaccactgtttcagacctgtactgctgctataacagttaacctttctgttcttaatttgataatacttgatttccaagactgtttcggcataactaattttaaacagttttcagatagtgaatatgagtagtctaataagaacagtttttttccatgtgaagcaactctttcaatgtatataatgttagtgtgtttctttctaaatttaggatagaaaagtgaatagtgtgcaaaaagtatagctacattgcatctgccattgaaacataaatggggtatggaaacgttcaagctttttttttttctttatgcagtatagataagctttgttttgtaaatgcacaagtccaatcattgaatcaacttaatttttttatgtacttgaagtcattttattactctttaacactcatgctgaagttctgatattttgttgaaatccattgttttactctttgcatatttgttggctctttgcatattaatatattagactacatgcaaatacagtctgtcttgccattgtctgttgaagtgcaggtttgatccagccagtatagaactagctctgtaggggtgaggaggactgtgctgtgtatcatccttgattgtgttccttcaaggagcattgcactgtaagtacatcagaatgacaaattgatgaactgcaacagtatctttttgtcaatgttccacataatgcaaatgccatacgttgtgtgaatattatgttggaatacagtgctgatatcttggaaaaccataactgcctcttaatttaacatagaataatacatagttctgtattttttttaaagtgagcttaatgggtaagtattttttatatgctttagctatagctaaagaaaactgatacttaacaaagttgaatagtattattcactggtgctcctaaaatattgtttttcagtgtaaaatatgcatatcttctatatttaatatgaaagtcttgaaatgtatcagacagaaggggatttcagtttgcaaataatgagcaatgtagcaattttaacacatttcataaatatatattttgtcattggtggagagcaccatttgttgttttgaatatactttaaaggaagaggtacaaggacataaatgttgagattacctacaggatggaaatagcagtacagttcattgtagatattttgaaatgtttttgattgttttatataacctagagtgacttcccttacccttatttagatctgcatatatagttctagtatgaagtttaatagttaaggagttagctatttgttatctttaagagtagggtattgacgtgaacaattgcagtattttgcatgatactgttttatagatgaccttttaggaaagtggtgcatttattaattgaactgaagaagtagttcagttgaattcagtatcataattcacaaattggaggctgttgattttgattcatttaaggtttaaaatctttattaattgcaaacagtgcaattatttatacttcacagtgccttcccagaccttccaccttaggttctgctgcaaaaagcaccaggtaagcacaacctaaggacatatataaataaatatttcaatacattaatgttgtccctgtgaggtttttgtggttgtgtattcaaaggcaatctgctactgcttccccaaaatgtattttgttat

SEQ ID NO: 12305 - DNA, 28030 bp, Human
tccatgcagccgaataaggagctcagtgtggacacaggcaagaactgaccctagccacgatgctcctgctattgtccactgtgctaccattccacccctgctgacccactcatgccctcctatgcttcagcccagggggtggatggagctcctcaggccacacctacccgtgagcagtggcccttcccagccaggaaaggcaggggaagggaggtggtgtcaggggagctggagtaggggtggcctaccgactcaggcagcacacctcaatccctgtctgcgtggccagggagtaaaacaaacagcacttatttttattcttaaacattacccttgtgtattttttctcttccctgtaggttgaaacaagagagagagctggtgttaagtgagctgagccagggcctggccgtggagctgatggaacgcgtgatgatggagtttgtgagggaaacctgctcccaggagttgaagtaagtgaaacgctggtgtcttgctgtgccaggagagtgagctttggctctgccctaggctgtgtcttgcaccactgaggatgggctattggaaatggatcttgcctgtctaagctactttgattttgtgaccaaatgtatttgatgcagtcctctgtgctcccttggctaatagaattttattataaaaaattctcttttatatgagggctgccaccacatgatcatagtcagccatccttattagccactggcatttatcatatatttgagacacttccaattgattgcacaagtcagatgttgctgatgagaagattttgtggttgtctgcatggtaatttacaaattctacgccaggcacctgtagtcccagcaactcaagagactgaggtgcaaagatcacttaagctcagaagttccaggtagtgtgctatgactgcacctgtggtggccactgtactccagcctgggcaacatagtgagaccctgtctctaaaataattaaaaattctgactattttattaagataaaggtttatttcttaactgttacgagggcccctatggacctataatttggcaccctgttccacttaattctttttaccctgtctttctaggtgtctgtagtttaagtattaaagcttcttttacaatgaagatagaattacattttaatactgaggatgcagactcttgcactttttttttttaaagacggagtcttgctctgtcgcccacactggagtgcagtggcgtgatctgggttcactgcaacctctgcctcctgggttcaagcgattctcctagctcagcctcccaagtagctggaattacaggcatgcaccgccatgcccagctaattttttttttttttttttttttgaaatggagttttactctgttacccaagctggagtgcagtggtgccatctcggctcactgcaagctccgcctcccgggttcacgccattctcagcctcctgagtagctgggactacaggagcctgccaatatgcctggctaatttttcatatttttagtagagacggggtttcaccgtgttagccaggatagtctcgatctcctgacctcgtgatccgcctgccctggcctcccaaagtgctgggattacaggcatgagccaccgtgcctggccgccagctaattttttgtatttttagtagagacggggttctaccatgatggccaagctggtttcgaactcctgacctgaagtgatttgcctgctttggcctcgcaaagagctaggattacaggtgtaagccactgtgcctggccgactcttgcacttttcttttttttttttttttgagacggagtctcgctctgtcgtccaggctggagtgcagtggcgcgatctctgctcactgcaagctctgcctcccggcttcacgtcattctcctgcttcagcctcccgagtagctgggactacaggcgcccgccaccacaccaggctaatttttttgtatttttagtagagacagggtttcaccatgttagccaggatggtctggatctcttgacctcatgatccacccgcttcggccttccaaagtgctgggattacaggcgtgagccaccgcgcctgactgactcttgcacttttcaagcaagccctcagtgtctgtgggccccaagtgcagtgtcttccatgctgattgccctgtttctaggaatgcagtagagacagaccagagggtccgtgtggcccgttgctgtgaggatgtctgtgcccacttagtggacttgtttctcgtggaggaaatcttccagactgcaaaggagaccctccaggagcttcagtgcttctgcaagtatctacagcggtgagtcctgtgttcctacaggcaaaatccacacacacggggaagagtcttttaacaaattcaaaatatatgagctattagtttctgtattcagtggtaaaaggatgagggaaaatgttatagcaatgaatacctaaaatagactaattggattatactgcatttcagaaatacttgattacacacacacacacacacacatacaatataaggggaaaagtcaggagttagattgggacgtggtggctactctgtatgtcaactgatatttatagggtgcctgccatttgcccactgcactaggtgctgggagacagctatgaacaagccagattatggctgcatgcaccaataagggtgaattctcaaaatataagtagtggagaaaaagcaattaatagggaatatacaaatagtgtatattcaaactaaataggttgtttcagatttatatatagtggtataaccctaaagaaaagaaggaaaataatgatcataatctcagcatagtggttacttttgggaatgggaggtggtgcctctcatggccacaacttctcaactgggtgtaagtgcacaggtgcttgatgatttattaatcttataactgggcatatatgtgttacgtatgttgtatgattcatttcataataaaatttaaaatcagtaatagtgtccttggtagttggaacagtataaaagggagtatggggagaagtgagtcttccttctacaacagacccctgtccattgtgcgagcagcagctgcttgcgaaaccatccagagactttctgtcctttcttgtggctcttggcacagatgggctcatgatccctgctttgctctgagccttcctttgctccatctgatatgaggtggaggcttggctgtagcagcatgctgagctgtccccgttgccagtggtcttgaggtcagtgcgataatgtaccataaatgaccttcctggtcttctgttgatggactttcatgtggctctttttttttttttttttgagatggagtctcactctgtcgcccaggctggagtgcagtggcgcaatcacagctcactgcaacctccacctcccaggttcaagtgattcttctgcctcagcctcctgagtagctgggactacaggcgtgcgccaccatgctcggctaattttgttttttttatttttagtagagatggggtttcaccatattggccaggctgctctcgaactcctgacctcgtgatccgcccgcctcggcctcccaaagtgctgggattacaggcgtgagccaccgagcctggacgtagctctttttagctctggtaaagactgttgcagtgactgttgttgtacagacagacatctcacccgtttgcacacaggcacgtgtgtggagataaattcctatcagtggtggctgtgggtcaagggatatatgtatctttttttttttttttttttttttttgagacagagccttgctgtgtcacccaggctggagtgcagtggtgtgatctcggctcactgcaacctccacctcctgggttcaagggattctcctgcctcagcctcccaagtagctgggaccacagtcgcccaccaccatgcccggctaattttttgtattttagtagagattgggtttcactgtgttgcgcaggctggtcttgaactcttgagctcaggcagtccgcccgccttggcctcccaaagtgctgggattacaggcgtgagccactgcacccagctgggtatatgtatcttaaatctgtatccatattgccaagtcagcctccaaagctcattcagtattaactgttaacgttcggtagtttcattgctcaccacactcatttgatgtccttccttccccatgcctgagttctgactgcaatgtgtttctcagtttgaagaccctgaagacactctgtgatgatacattttcatgtccccaggtggagggaagctgtcacagcccgcaagaaactgaggcgccaaatgcgggctttccctgctgcgccctgctgcgtggacgtgagcgaccggctgagggcgctggcgcccagcgcagagtgccccattgctgaagagaacctggccaggggcctcctggacctgggccatgcagggagattgggcatctcctgcaccaggtcagcatcagctgtcgcctgcctcgtcagggctcccctgcccccacttggttttaccaggagcggaattaatgtgtgtgtttggagggtgaagataggtgaagcctggaggcgaagataggtgaagcctggaggcgaggacaggcacagggttgcattttgaaggttgtctcccacagttgtggacatgtgacttgttccactggcaaagcagagctctgagttcaccttgaaagactcagcgtcctggtgcctgagtctgactctgcatcacgtgttcttttcctgctcgtcccagtttaagtacctgccacttccatccttgttggaggagccggaggtccacgctggcctgtgtcttccgatcccatccccgccccatccctctgttcctcccgccgtctccttcacacactgccccctttctgtggcagcatcttccagactccacctccaccctccattatttccctcttgaggccccttggtgtggccctggtcctccctgccactcctcctggttaccccgagcagaaccggctcctcagggccatgccaggacccccctcagcctgcattcctggccatgctgggcttggcctttatttagaacccatgtaggtgccacctcttgcctggcctcagggctccctggcctcccagtgggtggggactggggaggcagcctggagggcctagcaggcacaccgctggggcctcatgtcatgtcttgtcctcctcctggtcatcactggatgttccctctgaaaactgtcttgtgggtttcatttagccccatcaggttctgcgccggcagtggggtggcagtcccagcctgttggaggcatgctgtgaggccagggctgggcctggctcctctgacccatggctgccttcacatagtgacctggccttctcctggagtcatggcttcttgtgtcccccctccgtagctgcccttgtcagcctcagtctccttgtctgagccctccaccctgccccctcagcccagacctctgccctctgcccttctgcgcaccccctggtgatagccctgtcacccctgtctgtcactgacagcccccatcatgcatctccaactgaggcctcttccctgagttccagacttggtttccagttggcagttcaacctctaaacctgatttttccccaccctgccccttcctgctcataggatgccgtcctgtcctcctgcgcttagggcacaaacctgggcttgcatctctctcagacccagcaccgagggcatggcagttctctccacctcactggaatgttgctgcagcacctgtctgccagcttccaccctgggccccaatcgtgtcctcagcaccacaacagagggatcctccaacagctcagccaggtggcgttgcctctcggcggcgtccctagcgctccccgagtctctgcattgtggacccaacccctccctcgctgccctcactgctctccccaaacacaccaggtccagctatggcctggcatagccatgccctctgctgtttccagaagttgtcacgctggctccccctgtttccttcaggtctttgctcacatatcacctgaccaccctgagtgagactgcaacacgcaccctgcctggctccagccccacctggcagcatttgcccacagtgccgacacctcacacatgccaggccagccacttagagatgctgttctctccccattagagcctatgttctcaaagggcaggattttgtctgtttattgctgaatctcccatagccagcacacagtggatacttaacatgatatttgtggaatgaaggaatcctctaacccgtttcattggcagaaaatgtgtttttcagtctcctgagtattccccaggggacactagccagtacttctcactaagctcctgcggggacactgtcattctgctttcctttgcaggttaaggcggctcagaaacaagacagctcaccagatgaaggttcagcacttctaccagcagctgctgaggtctgtcatgctgcacccttctgcgcaccccctggtgatccccgttccccaatctgtcacactggcagcccccttcatgcatctccaactgaggtctcttcgatgagctccagacttggtttctagtttgcagttcaatctctgaacctgattttcctccaacctgccccttcctgctcataggatgtgtgtgctgctcctgcaagggtctcacacactggctaatccacggtggtctgttcctcccagtgatgtggcatgggcgtctctggacctgccatccctcgtggctgagcacctccctgggaggcaggagcatgtgttttggaagctggtgctggtgttgccggatgtagaggagcagtccccagagagttgtggcaggtcaggaagggttttcccctgtggggtttccaagaggtggagtgggcagggcagggttgtgggccagggccgggtattcctcttatgtgtgatgggaactcggaagtgtaggtttatgttttaatgcttggatttacagtctgttttgctcatgattttaagttgaaactttagatttgattatttcaatttttattccataaacttggtgtattagtccgttctcacactgctttaaagaaatatctgagactgggtactttataaagaggtttaattggctcggctgtacaggaagcatggctggggaggcctcaggaaacccacaatcatggtggaaggctaaggggagggaggcatgtcttacatggccaaagcaggaggaagagagagagaagggggagatgccacatgcttaaccagatctcgtgagagctcactatcatgagaacagcaaagtgggaggtgccacacacttctaaacaaccagatctcgtgacagctcactgtaatgagaacagcaagggggaggtgctgcacacttaaccaggtctcgcgaggctcactttcatgagaacagcaagggggagtttccacacacttaaccagatctcctgagagctcactatcatgagaacagcgagggtgagttgccacacacttaaccagatcttgttgagagctcactatcatgagaacagtgagggggagttgtcacacaaccacatctcgtgagagctcactatcatgacaacagcgaaggggagttgtcacacacttaaccagatctcgtgagagctcactatcatgagaacagtgagggggagttgtcacacacttaaccagatctcgtgagagctcactatcatgagaacagccagggggattccacccccatgatacaatcacttcccaccaggcccctcctccaacattggggattacagttcaacatgagatttgggtagggacacaaatccaaaccatattacttggcaacagtcttagaccaaaagcatttaagagttgattgttatttcaagctgtgttaaggtacattgatagacctgcttcattttagactcttcagtaagatagtttatagtctgtttactatagttccatttttttccccttaaagaaacttttggcattttaaaaaagaaaaaattgacatgatcttattttctgtaaccacatagcatacagaagtcatatttttaaagcaactacagtctctttgtgtttttttgagacagggtcttgctttgttgtcacccaggctagagggcagtggtgtgataacagctcaccgcagccttgacctcctgggctcaactgatcttctcacctcagcctcctgagtagctggaactacaggcgtgtgccaccatgcctggttaatgttttttttttaaagatggggtttcactatgttgcccaagctggtcttgaactcctgggctcaagcaatctgcatgcttcagtctaccaaagttttgggattacaggcgtgagccaccacacccggcttacagtttatttttaaaatagctttattgaaatgttattcacataccataaacttcacccatttaaagtgtacatttcagtgatttttagatatattcacagggttttgcaaccatcactgttaataattccagaacaccttttcacttagaaagcctgtattcttttttttttttttagatggagtctcactctgtcgcccaggctggcgtgtggtacactttgttcactgcaacctccacctctcaggttcaagcaattttcctgcctcagcctcccaagtagctgggattacaggcgcacaccaccacgcccagcttagttttgtatatattttgtagagacagggttttgtgatgttgcccaggctggtctcaaactgggctcaagcgatccacctgccttggcctcccaaggtgctgggattacaggcgtgagccactacgcccagctggtgagtcatttcttaaaatagctgtcttctcatttgctaagttcgtatgtcacttaagaattcttaaggtctcaggtatgagaaatttgatctgtaaaaaacatgtatttcaaactctagggatgttttctattgctgaaaatcttaatgcttcagaattttaagtcacattagaatgagccagttccattctaatggaatggagtgccccctcctcctgcccaattaagaacaagtagaagccgggagcagtggctcatgcctgtaatcccagcaactggggaggctgtggagggaggattgcttgagcccaggagtttgaggccagcatgagcaacatagtgagaccctttgagtgacactctacaaaaaaaatggaaagattagctgggcatggtggcccgtgcctgtagtctcagctactgaggcaggtttgcttgctgcggtgagccaagtttgtgccattgcactctagcttgggcgacagagcgagaccctggctcaaaaaaaaaaaaaaaaaaaaaagaacgagtacagatcgttgctccattttaaaacaacagcctgttttgtgcagatcagcttcatagtaagatgtggtatttgtggacctaggtctgtgtgatatttttctttcttcttttcctgaaagtctttataattcaaatatagaattagattcttcaagtgttttttttgttttttgttttttttaaatctgtagaattctagcaaattggttaaaagtcaagttcatgggagatgaaggctcagtggatgacacatccagcgatgctggtgggattcagacgctttcgcttttcaactcacttagcagcaaaggggatcagatgatttctgttaacgtgtgtataaaggtgaactataattactttgtgtttacttctgtgttttcattactttcacttactcccagatatcactggaaccatgcaaatactgcttattccctaatgtggttttgaaagactgggaggctcagaagcaagtattatgtctgtccgtacatgtcgtttaaaaaatttttttaagccagtcaaattgagtagtgggcaccaagcccagcctgcttctttactttttctgttttaatactatatattggatttcctaaatgtaatatgtacacaaaacttttaaaaaatgaggaaatgtaaaagaagtataaagatgatgataagagccatccatgctcttgccattctgaggtaacagtaacttcttggtgcaaattcttcccttttcctgggattacaaagtcacatttcatctactggaaattagtttactgctgctgttaccttcattttcatttaagaaagtaacacttccgtgtacttaaaaagaagtcaaataatgccacccacgtgatttaaaatgagacatagtagctcctccttcctctcttaactcctttcttcagggctgcatttttctcctgtttccagatcacacacttacacagccatttctcagtttatccatttaaatgttctctgctgacttcccattaatataaatgtattagttaccttattcctaaataactaattactcctaacatagcagcttaaaataatgtctgttatcatggtatctgtgggtcaggaatccaggtgtagcttagcttgggtcttctggctcaaggtttctcatgggtggaaatcaaaatgttggctaggattgtggcctcatctgaaagcttgactgaagggtatctacttcccagctcactctagtgagcttgtgtcaggattcacttccttgcaggctgtggccaaagacttcctcagttcctgccacatgggcctctccccagctgacagcatggcagctggctttcatcagagtgagcaagaggtgagcctagatggaagtctgagtgtgtttataacctaaacttagaagtgacatcctgttgcttttgttggcttctgtctgtcagaagtgagtggctaggcccagctcacggggcaggagatcacacgtgggcatgaacactaggtggaatcaggggggtcctcttggccactgcataccatactaggtacagcgtggcctcttgtgccatggtccttgctcggccttccacgtcttcccgggatagctacactagcactttgtattacttcagtgagtggggtcatattttgatggctctgtgactgctattcacctcagaaccagtagtgttctataaccacaattatttttttcctgcaagaaatagagttgccttattgtctcacttaatgtagttctctttatctctttaattttactggggggccgtatatatctcggtagagttttccaaatgttctgtcacttcacttgatccatccatgttccctctgtcctggaactctcatctgtgggctggtctccatccaggcaacatgtgccttagtgccatcattgtgagcatatgtgtccctgctcctccacttggaagctctgtgaccttgggcaagttccctagcgtctctgccacctgtgtatgggtactgttacttattatccctattttactcagagacggtaaaataaactgcccaagcctctgcaggtgctgtctggtggagatgctcatctggctcttgaggataaaatgagtgcaaacacagactgcacaggacagtgcctggcacaggccaggtgcttgctcagtgttgccattagcagcagctgcagtattttttcttggttcagccccttgttggatgttatatgtcatgcgaggggaattttctgagtcttttccattatgaaaatgattttattaacaaaataccttaagctgggggaaagaaaaagaaaatgcatttatttcattctgacatttgcttcatagtttagctacgtttgtaaaattataggtagaaaattattttcctggccgcgcatagtggcttatgcctgtaatcccagcactttgggaggccgaagtgagcggattgttttgagtgcaggagttcgagaccagcctgggcaacgcggtgaaaccctgtctctataaaaaatacaaaaattagctgggcatggtggtgtgtgcctgtagttctagtagcttgggaagctgaggtgggaagattgcttgaacctgggagttcgaggctgcagtgagccgtgatcgcaccactgcactccggtgttgacagaggaagaccccgtctcaaaagaaagaaaattatttgccttccagttttgctccactgtcacctagcatccattgttgctgtaccattcctgttcctttctgtgtggcctggttttctctgtggaagccttttctctctgttcatggcgtcctaaaaattcactttgttacactggcactggactagcttcactcactgtgcagggcttagcaggtcctttcaggctagagactcctatttcacttctgggacattttcatgtctttatgacactctgtcttttttctgttctctcttgaacttctattagatagatgttaggcctcatcaattgatcctctgagtttcttatcctattttctatcctattttcaatctcatctcttcctactgtgttctgaaagagttccttgactttattttccaattgtcctactgaattttttattccatatatattacttatttcctctttctttttatcatgactttttcatagcatcttattttttggatgcatcatcttatctttccaaggaaattagggtttttggggtctaagttttctttggttcacgtattatctggttcctcttttttttttttttcctctctgttactccagtttatctcttttatgttggaggccctcctcagatgccttacccaaggctatctgtctatatctgagtgaggccctaaaaggctagccaagaagttctgtgtttggggtggggtggatggtagctaaatggcaagccaggctttttggagggactcccaaatgtctggatctggatggctgttccctagactgttcagtttttctggaaaggacttgtgccatctgctttctggggagctgctggtattctcagggtagggttgggagtggtttggcgctgagtcccttccactgtgcctgaccatggccctgcatctggatcctctcaggactcctgttcaggggcccagggggactggttttgcatagaggttgcctgcagtggtgggtgccgccaatagggtcaggctctgaacttcacctttggctcctggtgtctgcagcgcctgggtatacagggcttttgcaggctcagtcaacctgactccttacacacccacatctgcagcctttaggtatggcatcctctgcttccctaacccagggattggtcacacctatttgctgctttctagaaatgtatcagaatccctcatctgctgctggcttgccttccctctttctattattatgggcttatatttttgtttatttttgtagagatggggtcttgctatgttgcccaggctggtcttgaattcctggctcctggcctcaaacagttctcctgccttggcctccccaagtgctgggattacagtcatgagccactgtgcctagctttaacttttttatacctgtttaaggttaattaaagttatagtaatatggtcaaacacaattctagctggaggctaaattacctgttgacctggctgtttcttgcactaattctgttgcatttattctcatttttgtttctataaatttaaaatatgaacatgggtgggcgcggtggctcacacctgtaatcccagcactttgggaggccgaggcaggctgatcacttgaggtcaggagttcgagaccagcctggccaacatggtgaaaccctgtctccattaaaaatacaaaaattagctgggtgtggtggtgggcacctgtaatcccagctactagggagggtgaggcaggagaattgcttgaatccaggaggcagaaattgcagggagctgagatcgtgccactgcaatccagcctgggcgacagagtgagactccatctcaaaaaataaataaataaaaataaaataaaatatgaacatgccttatatctgaagggcagatatagaaattatttttctagggtgattgtcctctgaatatatgaagaaacaatgttatttgacgttttctttaaaaaggaagtctgaagctaggcatggtggctcctcgaacctgtaatctcagctactcaggaggctgaaccaggaggactgctcgagcccagcaattcaagaccagcctgggcaacataataagacccccttctcaaaaaaaaaaaaaggttgaggggagtctttgctaacaattggatttagggaaagaggggccaggaattaaaataactacaggaagtaagataactacagggtatgcccagctgtgcccttggaggcctgtctggagtacagtcagtatttagtgcacggagagctttggctgcacttgctctggggcagatcagtcactgctgatgcgtcccatggtgcatctctcctgatgatcttgatgctgttgcaggtggcccatggcgccctcagtgatggtgccattgatgctgtggagacacagaaggacctcctgggagccagtgggctcatgctgctgcttccccccaaaatgaagagtgaggacatggcagaggaggacgtgtactggctgtcggccttgctgcagctcaagcagctcctgcaggctaagcccttccagcctgcgcttcctctggtggttcttgtgcctagcccaggaggggacgccgttgagaaggaagtagaagatggtttgtgaaggaagtctcgtttatgaagcagcattgtttaataaatgggtggaggccctgggtctgaggatggtccagtagtgttggggtcaggaatcactgagacagcaacccctgtggtgactgtccactgcaggactgggtggggtcagcacagtgagatatgttagcaggtgtgctgacagcagaatgcaagtgaccttcatctatgtctgtcttaaaggtctgatgctacaggacttggtttcagctaagctgatttcagattacactgttaccgagatccctgataccattaatgatctacaaggttcaactaaggtaaggtttcatcatttttaatggtctgtcaagatattttgttttttccccttttgctgtatcttgaattgagtgtatattagcgtttgcattgtctttttcttaagagacagggttttattgtcacccagtatagtggcatgatgatagctccctgcaacctcaaactacagggctcatgcaatcttcccacttcagtctcccaagtatatgggactactgtggtgtgccactgcgcctggcagcagttgtatgttttatacagataactttctaaaaacataagcagaaatcaaaataaaagataaaatttgcccacagtcctgctatctgcaaattaaattgttcatgtaaaattttttagtgtttttgtttctatgaatttaaaatatgaacatgtcttatatctgaaggtcagatacagaagttatttttctagggtaattgtcctctgaatatatgaagaaataatgttatttgatgtttcctttaaaaaggaagtctgaagctgggcgtggtggctcctcgcacctgtagtctctgctactcggaggctgaagcaggaggactgcttgagctcaggagtttgagaccagcctggccaacatagcaagacccccttctcaaaaacaaaaaaaatagggcagggggagtctttgctaacaatttagagaaagaggtgccaggaattaaaataactataggaagtaagataaccatagggtgtgaaggcaccttggcacatagtgaagctgttagtccttccaaaaaggagaagactccatttctgtgcatggtgaaggggatgttcagggctggtttcctgagggcctgggcctttccatggggcaaccatgcaggtcacactcctcctcaggccaggtgggatctgggggctctctttagtgcccctactggacatgtctccagagccctagaaggctaaactcaactgcataggacacttctgttccccttcctaccacagttgagagcccagtactctggtattacctgctgtgggcaaccttgggggatcaagccctttcagaaagctgtttttgaaaaacagtgtgaattgttcaaccaagtctcttctttcttctcaggttttgcaagcagtgcagtggctggtttcccactgcccccattcccttgacctctgctgccagactctcattcagtacgtcgaagacgggattggccatgagtttagtggccgctttttccatgacagaagagagaggcgtctgggcggtcttgcttctcaggagcctggcgccatcattgagctgtttaacagtgtgctgcagttcctggcttctgtggtgtcctctgaacagctgtgtgacctgtcctggcctgtcactgagtttgctgaggcagggggcagccggctgcttcctcacctgcactggaatgccccagagcacctggcctggctgaagcaggctgtgctcgggttccagcttccgcagatggaccttccacccctggggggtacgtgcttgacctggggaggtctggtgggtggctgcagccaagtctcaggcttccttctcactgtagtaaccgtctggcaggtgttgggcaccagtgtgagggctgcacgtccacctccgtgtgtctccatgctgtgctcgcctgcaccttcctttggtcctttgggttcatgagccagaacaagctgggttttgtggagtgggggctgttagcctttcctgaccagcaaggcagtccatgggagttcactcagcttcaggagaaaagtgacaagtggtactgggaggaacaccaaccctgatcctgtcctgcctgcccacagggtccctgttttcagaacagacaaggggcaaagagcatggggaccatgtagccctgtccccaagccgcagccatggcactcagtgctgatttaacattctttctttgtcaaagaggccttcttctatggctctggctgtgcccctgttcctggctgaggtctttgggctgttttgacacagatccgacaggccatctggctggctcaagcccagtatggcatggggctgctccttcctatgcactcagaagggaatgagctgcttatctggcagaagttgtggcattagcacagacactcccctttgggcctcaggcgcccttctaaattgtggtgtgtggtctgtagtaggtctaactcatgctcattattgaaggaacccaaagggaagcaaaccactcagcacaagccctcggtgctctggttaggttggggttccccaaaataagctaagactgcttataccagactcatctgggtgcttgttaaaatacagatttcctaggcacaaccacaggcctgtacagtcagaacttctgggtagaacttggctagcaacactgttaagggggactgtctgcatccctcacctagaccctgggagcaagctgctcttccccctcaacaactgtggttctgctgtgtttagaaagcagacttctcaacttcacagttgccttctcctgagaaaatgttttcatgtacattttcacctgtattttggccaaacctgtaactaatgaggcactttctccccagccccctggctccccgtgtgctccatggttgtccagtacgcctcccagatccccagctcacgccagacacagcctgtcctccagtcccaggtggagaacctgctccacagaacctactgtaggtggaagagcaagagtccctccccagtccatggggcaggcccctcggtcatggagatcccatgggatgatcttatcgccttgtgtatcaaccacaagctgagagactggacgcccccccggcttcctgttacatcaggtaattagagcttgatgcaatgggatcagctcctcacgagactttcctggtccagtttctgcaaaggaagatgtttagttgatgttgctgcttttcttttgggtctctatccttcctttccttaggacttccctcttcaagtgagtgacttaaaaacattgagacaggctaggaagtttctggtagagcctgaactcacctccctgaaacaggccccctaggatggctcttagagaggattttgtggcttttgagtagtcattactggccctgccagtctcgatgtaagcttgtctggactttgagtgatgcatggaccctgggagcctatttaacccaagtgtggaagtcacataattgtgtgactttaatcaaaggtcttgcacttaaatcagtgaatttaagcacatgccacctgtcgctgtttaaatattatttgtacctgtttttgtttttttgtgtgtgttttttttttttttgagacagggttggccaggctggcctctttatctgtttttgtattgttttctcagaggcgctgagtgaagatggtcagatatgtgtgtatttttttaaaaacgatttgaaaaaatatgatgttcctttgtcgtgggaacaagccaggttgcagacgcagaaggagctacagctgagagagggacggtgaggttcatgttcagtatgtttctgttgcttgctaaactgtatttttcttgcaaagtaaatagaaattaacatcctacatgccaaatccagtccactgtgggcagactgtgacaaatcctcaaggaacagatcattcccatgcagtagaaactattctagaacaaagttaaagcatctcacttcatttatcaggcatacctgaccctgaaatcatacctaaccaggagagtacagctgacatttcatctcacttccaaatttggttccaaagcacagtacctaaaaaagttcacaagtatgctttctcccaggataaacaataacagtgaaaatctattaatgtaatttgttgccataatagaaaaataagtggtaattttagcaggcgttgaaatacgtttcttaaaatttatacctgttcctgataaaatttctttattttgggtactttctttagcttgggttaaaaaaaaaaaaagtcctaacttgataaggctacctaacataaaactaccaaaatagaaaaaaaacatgcttcttggtagaatgttaggaacagtggaatcagaaccagcctgttgtcccgactattattcactattgtcctggaaatcctgaccagtacagggatgtgggatagacaggcacaaatactgaaaggaaggagaaactgtcatttccagacagtacagttgtcagtccaagaaaagtcaagtccatagaaccattctcagttcaataaggtgatcagatagatagatccacaacatgttaaaaaaaaaaaaattctcattcacaacaataaacctgaacagaaagggcacaggatggtggaactttgctgttccttcttgttccccatagagatccttgaagtaccttctccaactccatgatactctaaaaactgttcatcttcataataggagtggagcctaatccttggtctcctcacctcctggtttcccggaatgtctttctcattaacatatgagttctcagggcctgtatgtgcaaaggaaacctgaaccattgaggttcagactaggttgttgacaggatacaatgctgtgaagatgtcagtactggtaagttctaaaattcatcaggataaacaaatatgcatcaattgctgagaaagttttaaataagactaacatggtttgcttggcctgataccaagacatacagtaaagctccagtacttaaaaccatgtggggatgccagagtagataaatggatcagaataaagagtcagaatatgtgacaaaagtgttaggccaaattattgaaattagtggggaaaagacaaacattggcatgtgtttagaaaaaaatgtcagatgccttctctctcaccatttgtaaacattacttccaaatgtatccaagagctatctataaaaaaccttgccaatactagggaagaacagaatctggaaccctagggtgggaagcaagacatgaagcagagaaactccaaaaacctagctgcctcttgagagcagaagcttccaagaggaacaggcagtctcaatgcctctgtgcataagggtccctacagtgcaggggctgccttccctctttgctccactccctgacttgatggaagcttggaagcaggcatggggccagcatgagctgttccaggagggcacatgtgtctgaggcacatgttcttacatgttaatgcacatgtgcaaatgtatctacatgctttacatgatgctgtagaaatattttctcttgaccataaacatttcaaatcatgtacttacagtttggcaataaagccttttcatccttctgcaaacaattttcccataccattgcttcacatgcaccgtaactggaagaggagcacagagtgtgctcaagaggggaggattcccagcacagaggatctgatgcgaggagcttctgctgaggagctcttggcgcagtgtttgtcgagcagtctgctgctggagaaagaagagaacaagaggtgaagcccacttccttctaattcatgtgtgtttagtctgctttatgctgtgaggggagactggttattgcttgattaatataagacagccaggatggagaagggcaggtggattattagcaacagttttagtgatgtaactatttaaaagctctttgaagacagaagcagtgccctagatagtatgtttctaactgtttatattgaagtgaatttcatttattatttattattgaaagtcagtgttaagtttttctgggaaattcatgtggttaagtctgctcagaagatggtgagtgctgaacactatggctggccacaggcaccctgcccttgggagcctgaggcattggtggatcatcccatgctgtgaatggacaggagctggggctgcccctcctctacattgcccacttccctccctcccatgcatacctttcctttgctttcatttgatggccatgtttaccattttactgagtagaatcaggaataagggaccttccacaggttgtcctctgccttccctgccctcccagccacatccagcatcctccctatatccccttcctgacgcctcttgttgctggaaacgaaccatgcagctcgtagtcagtcagcccttccctgggctgggatctcatctcccacctacccaaggacattcattcaatgagtatctctctcgtgctaccacccctccccatattaggtggtgcccatcagcagcacacagacatgaaacatgcctccctgtcttggtcccacttccctctttagccaccacttcatgtttctgccctcttaatggtaaaactcctcaaaaacgcttgtgatactcacttcttcagccttctttcccatggggatgaaggcccagggttgaacatgaccgtgaatcccagtccttggtagcatcccatacttgatcctcccctccttgctcctaggatgtccgtggtccccctcctgccctgctggttcctcctcatcccccagctgccccctggattcattctctcaacctctcctctgcatcgtctgtacctactcctcagaaatttcatccagtttcatggatttttaagtaacatcactattctgacagctccaaatttgtatctcaaacctctgaactccacacttgaacatgctactgcttccttgaaatcttcattagacacctattggatgtctggtagccactgcaaagttaacatatcccaaatccagttcccggctttcttccaaccaaccccttcctttggtggtcatctctgttgatggcggctccatccttccagctgcctagatcaggtgccttggaatcatcccctcacatcagcccattcacatatcctattggctctattgaaaatacattcagaattggaccacttgttatgacttccatggccaccacgtggctcaagccactatcatcttccttctggattattacagtaggctgcagtttagtcttggtagacctggtgggtgcctttcaagtgagttaagatggaggtcgtgtcacttgcttgcttacagcctctcagtggtttccctctttcacctgcaatcaaaggcaaactttgcaggggtggccagggccctgagtgatctgccccccatttcctctctgacctccgctccttccttgagcatggtaggcagttcacagttgggcctctgagtttgctgttccttttgcctaggactgtccagcccctccattctccccagcatccccatggctgatcttgtactcacttcagatctctactcaaatgtctgcttctgttaggccctgcttgcccatctccgaccttcttgtttccatggctctgctttgtctttctcatcttcaaaccatgtttctcttgttatgtgttccttgtctgtctctcctcactaaagtataaattgcttagggcagggcctctgttttgtttcagtgcaatattccttgtacctagaatgatgcctagcatctggaggaggcttaatgaatatgttttggaagggtgaatgaatgtgtccgattactaaaatcagtctctataatttaagtggtttgggatgagatttttttttcctttttattagatagagtctcgctctgttgcccaggctagagtgcagtggcacaatctcgactcactgcaacctccacctcccaggttcaagcagttctcctgccccagcctcccaagtagctgggactacaggtacccatcaccatgcctggctgatttttgtatttttagtagagacgcagtttcaccatgttggccaggctggtcttgaactcctgacctcaggtgatccacctgccttggcctcccaaagtgctgggattacaggcatgagccactgcacctggccaagattgtttttcttgaaaagaccggtatatggaagtagacagctctagagtatgttaggtggcagtgggatattattttgagttaattttaagctataagcagcaatccactcatttggaaaatgtcagaagaattaattatagatgcataaaaccaaagtaaattaaataagataagccaaacaagacaattacaagtaatgttaagtaacacatcgaagcagttgtttttggattaataccacctttttcattaaatataaattggaattggatttataaattaaagggaagtggtttctctaatttttttttttttttttttgagatggagttttgctcttgttgccctggctggagtgcaatggcgtgatctggctcactgcaacctccgcctcccgggttcaggcagttctcctgcctcagcctcccaagtagctgggattacaggcacgtgtcaccatgcctggctaatttttgtatttttagtagagacggggtttcaccatgttgatcaggctgatcttgaactcctgacctcaggtgatctgcccgcctcggcctcccaaagtgttgggattacaggcatgagccaccgagcccagcctagtttttttttttaaattaagctttatcataggaagttgttaaatttttaataagtacatttctgcttctcagttgatgtcataacttagttatattcttagtaaaaagcaaaggcttaaggctgggtgtggtgactcatgcctataatcccagcactttgggaggctgaggtgtgcacatcacttgagttcaggagttgtagactagcctgacaatacagcaaaatcccgtttctacaaaaaaatacaaaaattagctgggtggcatgcgcctctagtcccaggtatttgggaggctgaggtgagatcatttgagcttgggaggtcaaggttgcagtgagccaagattgtaacactgcactccggcctggccaacagagcgagaccttgtcaaaaaaaaataataataaaattggccaagcacagtggctcactcctgtaatcccagcactttgggaggccgaggtgggtggatcacctgaggtcaggagttcaagaccagcttgggcaatatggtgaaaccccatctctactaaaagtacaaaaaattagctgggcacagtggcacttgcctataatcccagctactcaggaggctgacgcaggagaatcacttgaacctgggaggcagaggttgcactgacccgagattatgccactgcactccagcctgggcaacagagtgagactctgtctcaaaaaaaaaaaaaaaaaaaattatataaaattttaaaaaagcaaaggcttaaaaagtttttaagtatatatagaagattaatgaacaatagttaacttcctaatgctcaaatatttttgaatttattacatattgtttcaggtttgaagatcagcttcagcaatggttgtctgaagactcaggagcatttacggatttaacttcccttcccctctatcttcctcagactctagtgtctctttctcacactattgaacctgtgatgaaaacatctgtaactactagcccacaggtgagaagaacgtatacatttggcatttacataagaattaaagattgagagaatggctggggaaaaaagtaatatcacgatttatcctatgatgttttgatgaccgacaaattattagctcaaattagaccttttcttaaactttatccatatcattgttaaagagacccaactgattttgagtttctgcctacgaaataaatgaagaatagaattgaaatattcttaagaactgaataagacctgtaactgtgtgctgatgtgtaattaagggcattaaggtgatgacagcagcttctgttggagcacatattgtctgagctttggcattacccagacctctcttctgggattaatttttcctgaggaaaactaatgaatgaggaaggtaagctcccagaagtcaagagcctcacccaagagtgttcaagtagtgagtggtcaggttgcttttcaaagccagatccaactggctccaaagcctaaggtctttttaccttaccattcttccttcagtggttaaagatgcaaaaacagagtttcaatcacagatatgtgccactgaacaggtaaaaactgtgctcctggactggctttaggaagtccttcaatagaggagaaaagcaaattaaaatgatgtactgtttccattcatcagtttggcaaatactttaaaaatattcataccctttgaattaccaattctaacctaaagaattctgacctaccagatattccccaaaaattaatgtataaaaatgtttactgtagcattattgtatgaaagtcgaaacagaataaatatccgaagatgggagtctgattaaacaattataacacattcatgtgatagaataattcacagcccttgacgatgatattttctaaaaatgactggctgggcgtggtggctcatgcctgtaatcccagcactttgggaggctgatgagggaggatcgcttaagtccaggagcttgagtccagcctgggcaacataaagagatctcatctctacagtacataattagccaggcatggtgctacatgcctgttgtcccagctactcaggaggctgagctggtaggatcacttgagcccaggagtttgaggctgcagtaagctccgatcataccactgcgttccagcctgggtgaaaaatgactgacactggaaattgttcatgatagaatacaaaggcaaacagtctatatacagataccagctgaatgtacgagctaaatgaggctggaaggatatacaaaggataatttttttccctctgtaaaaataaatgactactcagatgaggtttctaacatgatccagatctagtaccttcccagagataggtcgtggtttattgacatcccaaaactgttcagtttcttttttattcaaatagagtgacatgatgagggagcaactgcagctgtcagaggcgacaggaacgtgtctaggcgaacgactaaagcacctggaaaggctgatccggagttcaagggaagaggaagttgcctctgagctccatctctctgcgctgctagacatggtggacatttgagcagcctgacctgtggggagggggtctctcccgaagagtttctgtttttactcaaaataatgttattctcagatgcttgatgcactgttggaaatgtgattaatttaatcatgcagataaaccatttaaatgtcagtctcccagtttttcataatgaaaagttgtttcccctgtgtgacctcttcaatattctcctatattcatgacctcctcagattgtcacccaccagcatatgctctgaggcagtttagagcttacatttccatgtataaaaggcgattcattctctcagcaaacttgcagtccttgatgtgccagacatcagtgatgcagagataaagtaagacacagggcctctgcctgctaagcccacccagcttacatccaggagagtcaggtacttatgtacataattctcagagaatgtgcatgaggcgtgggcctgaattggtagcaaggaaaaaacagaggatggaacagggtctggttgggtagaggagaaacagaattcccggagaggagtgcaggggtgtagctggagacagtgtacttgagaggacatgatgaaagcgtggaggtaccagcttggttgtgtggccaggtgaggggaacaggccagcagggtgaggtcagagattcttgtcaccttcttctgagagctgtgagaacccgttgttgaagattaggcagagaagtgatctggtcacattttcttttaagaatggcatgtagggcaggaatcttgagaggtgggtgctgcagccatccaggtgaaattcaaagggaataagcctgagtttgttagcaattggtgtgaagagaggggataaaatttgagccatatacagaaagaggtattaatagacttggtgatgttgcgtatgaccaccaatcttaaactggcactcagcatctcctgactgtaatcctacatccccagactctatttcatgtcttctcattctcttcaaacctccaacattcttagatcatgtcctccttatttcactgagaaaacaacagcactaagaagagaacctcttcctccaccaaatcaatccctgcttctccaaacacacactactcaactcagggatctttagtgattagcttcatgtaaagacttaaataatgctatttcttaatcttgacttgacattgttgacttcctacaatggaagaggagttagcttctcttacactgtctttcccacaacatattatcacccccaccctcgacacccacatttcctctcctattagtctccctaagcagtttgatattggctgaaacctgcattcacagtttagtataactgtatgtttaccatttcctgttgagccctttattggtttatgattacatttcctttaggtacaacttttgatttttcctggagttaattacattgtttttctcatttgcttggttttctatgctcttgtcactactttacccaaaagtcgctgccctaaatgtaaagctcttcccaacaaagtcatgtgcatcaggtaatatgctccactttctcttcgagatgttcctgagaaccccctgtcttcttgccataacttggacatttcctggattctgaatcatattttcctcttgcttggttttctcttcttgatggagcctgtcctttagtagcctcctgagcttgaatatctaaaatgtctttatttctactgtaatattatcaaatatatatctggtctttgtctctgccttctgatatacaactcctaaaatccttgagatctctaaagtgatgtctttttgtatgctagtaagatgactgatggcggacagctcctatgtagcttcaggatagggactggacatctgaaagaccagggcatgattagaggggttgaaactttcagcccaccccccaaactcccagaggttgggggagagggactgaaagtgacgttgatcgccagtggccaatgatttaatcaatcatgcctatgtaatgagggctcctaaaaaccc

SEQ ID NO: 12306 - DNA, 12645 bp, Human
aagtgttgaaaaagaaaaaaaccctgctatttaagaatactgtatccagcaaaactattcttcaaatgtgaaggagagataaggtgtttccccagacaaacaaaagctgagataatttaatcaccgctactaccagacctttcttataagaaatgctaaaggaagttcttcagtctgaaaaaaacaacactaatgtgcaaaaagaaaacatgtgaaggtataaaacctactggtaaaagtaaatacatggacaaacccagatttctctagtactgtaattgtgactgcaatccactcataactttagtatgaagtctaaaaaacaaatctatcaaatctaatgatagctatgcaatcttgtaagacacagacaatataaaaatatgtaaactgagatgacaaaaagtcaaaatgtgggtaggatgaatttaaagtgtagaggttttttagttttctctttgttggcttctgttctttgtgatctaagatacgttgtcatctctttaaaataacttgttatatctataagatttttttggtaagcttcatggtaaccacaacacaaaaacctataatagattcactaaaaataaaaagcaatgaattaaaacatactaccagtgaaaataaattaaccacaaaggaaggcagtgagaaagaaagaaaggaatagaggaagttacaagcaaccagaaaacgggcaacaaagtgagggtggtaagcccttatttatcagtgttaatgctgaatgtaaatggactcaattttccaattaaaagacacagagtggctgaatggagaaggaaggaaggaaggaaggaaggaaggaaggaaggaaggaaggaaggaaggaaggaaggaaggaaggaaaaagaaagaaagagagagaggccacaactcctaattgcacttcctccaacctttctcccaaccacaaatctcatctccttaaatagcaccaacaccatccagctgctcaaacaaattttagaagtcatcctcaattcctctgcatttcttgcacagtgagcatgttctgctcatctcctcctgcttgcccttcaagtcagcctgctcctccccctagcctgtgctcccaccaccagctctcatttgaataactataaaatcctccagcgtgctctatctgcttcaactctgtcccctgaaagtgttcagttttggtttagcttcaaacattagaaatttaatattccaaaggattctaaaaacggattaaatgtgccaacaagaaggaattttaatatgcatgccataccagaaataaattgcttttcaataagatataatctccaataaagtgctttttcttatgtctggctagaagccatagactccgtcactttcttctcttttcagaatcatatctcttttctgttttatatattttattgatacataataaatgtacccactttggtaggccgaggtgggcggatcacctgaggtcaggagtttgagactagcctggccaacatagtgaaacctcatctcaactaaaaatgcaaacattagctgggtgtggtggcaggcacctatagtcccagctactagggaggctgaggcaggagactcacttgaacctgggcagcagaggttgcagtgagccgagatcatgccactgcactcctgcctgggcaacagagtgagattcggtctcaaaaaaaaaaaaagaaagaaagaaaactaccaattttcaggtatctgtgataatttaatacatgcatataatgtgggaagatcaattcagcataattgagctactgatcacattaaatatgtgtattttctttatgctagaaacattcaagttattctcttctagctattttgaaatgtacaattgattattgttaagtatagtgactctactgatttatcgaacactaggttttatttcttcttccgtttatttgtacccattaatcaacctctcttcactcctcctttctccctacttttcctatcctctggtaaccagcaatctactttctatcttcatgagataatactttcttagccgctacatatgagtgagaacatgtaatatttgtatttctgtacttggcttatttcacttaatgttgattccagattcatccatgttgctgcaaatgacaggactttattctttttatggctaaatagtatcctattttctttatctattcatccgttgatggacaattaagttgatcctataactcttcaatatattgatttcctttttttggatatatatccagaagtggaatgaatgtaccacatggtagtccttgtttctttctcatcatttgattgatgatgtttctcatcatttcttttttagctagtttgttgtttatgtataggaatgctactgatttttgtatgtcgattttgtatactgtgacttcacttatcagtcctgagttttttggtggagtcttcagtttttttctgtatataagatcaagttatctgaaaacaggaacaatttgactttctcttttccaatttggagatcctttatttctttctcttgtctaattgctctggctagaacttccagtactattttaaataagagcggtaaaagtgagtgtatttgtctcgttctaattatcagagtaaaagcttccaacttttccccattcagcatgctgtcagtggtgggtctgtcatctatggcctttattgtgttgagatacactccttctatacctaatttgttttgagtttctatcatgaagaaatgttgagtcttatcaaatgctgtttctacatctattgagatgattctatggtttttattcttcattttgttgatgaaatagatcacatttattgactcgcatattttgaatcatccttgcatttgggggatacatccctcttgatcatggtatataccttgatgtgctgttggatttggtttgctggcatatgttttgcggatttttgcatctacctttatcaggaattttggcctgtacttttctttttgttggtgtgtctttgtctggttttggtattagggtaatattagcctcatagaatgagtataaaatcattccctctctttagctttttggaatatttttaggaaaattggtgtttgttcttctttaaatgttagaatacagcattgaagccatctggttctggcttttcttttttggagagacgttttattactgcttcaaccttgttacttgttattggtctgtttaggttttctatttctttctggttctgtcttgatgggttgcatgtgtcagcaatctattcatttcctctaggttttataattcgttggtatggagttttccataatagtctctaatgatcctttctgtggtatcagttgtaatatattcttttttctgattttattaatttggatcttttctcattttttcttggatagtctagctaaagttttgttcatttttgtttaacttttaagaaaacaacttttcatttggttaatctcttgtattgattttttagcctctattttgtttatttctgctctgatatattctatttctttccttctactaattttgggtttggtttgttcttgctttttttagttttttgaggagcattattaggttgtttttggaaatctttctattttttgataaaggtgttttttttttctataaatttcccttccagtattgtttttgctgtgtctcacaggttttggtatgttgcatttttatttaatttggttcaagaaatgttttagtttccttcttaatttcttcattgactcatggtcattcaggaccatgttgtttaatttccaggtatttgtacagtttctaaagtttctcttgttattctagttttatttcattgtggtcagaaaagagacttgatatgatttcagtttttaaaaatttgttgaaacttggttttttggcctaacatatggtgtattctagagaatgttccatgtgctgatgagaagaatgtgtattctgcaggtgttggatggcatgttctataaatgtctgttaggtccatttggtctatagtgcagtctaaatcgagtgcttcttttttgattttctgtctagatgacctgtccaatgctgtgagtagtgtatgaaagtctccagctatgattgtattgaagtctatctccccctacatatatatatatatacacacatatatatgtgctttactgttatgtgagtatatatttacaattgctttatcctcttgctgagttgatctctttattattacataatgaccttctctgtctttttaaaaatatagttttagacttaaaatccattttatttgatataagtgtagctacttctgctcatttttggtttccgccttgtggaatgcctattttcatgccttcattttctttcttttctttttctttttttcagacagggtcatgctctgttgcccaggctaaagtgcagtggcacaatcatagctcactgcagccttgagctcctgggttcaagcaatcttcccacctcagcctcccttttagctgggactgtaggaatgttccaccatgcctggctttatcccttatactttcagacaaagaaaatatgtgtgtcataggtgaagtgagtttcttatagctagcatatagttggatctgtgtcttttattcattcagccaatctatattttttaacttgggaatttaatccatttacattcaaagttattattgataggtgaggacttacatttgttaattgttttctggttattttatatacctttgttcttttctttcttgcttcttatttattttcggagtttgatggttttctctagtgattatgtttgattatgttatctttcttatttgtgtatctgttcaaagatacataattttatacttttgagctttatacttttatatgttgtcattactgtagttattgtccttgtgcttccacatacagtgctcccttaagcatttcttgtaaggctggtgaagtggtgatgaattatctgtttttgcttattcatgaaagattttacttctgtttcatttctgcatgatagctttgttgggtatatgatatgatttggctgtgtccccacccaaaatctcatcttaaattgtaatctgaattataatccccacatgttgggggagggctctcatgggaggttattagatcatgggggcagttcccccacactgttctcatggtagtgaatgagtgctcataagatctgatggttttataaggggcttttcccctcttagttctgcactactctctcttgctgccatatgaagaggaacgtgtttactttcccttccgtcatgattgtaagtttcctaaggcttccccagtcatgcaaaactgtgagttaattaaacctctttcctttataaattacccagcctcaggcagttctttatggcagcatgagaatggacaaatagagtttatttctttcaatacattgaatatatcatcccattctctcctggcctgtatgcttttgttgagaaatctgctgttcatctaatgaggattccctgatatgtgactggatactttctcttactattttaaaacttctttgtctttgccttttgaaagtttgagtataatgtgcctcaaagaggacatttttggttgaatatatttggggatttttgagatttctgggtctggatatccatatctctcccaagaattggggagttttcagctattactagattaaatagatttcgtatgcctttttcacctttatttcttctgaaattctggtaatatgatcatttattctcttaatgatgtcccataagtcctgtagcctctttttttcttttttattctttttttctttaactggtttatttcaaaagcccttttttttaaggtggctctgcaaagagcctttggtttataaggcagtgttattgttattattattattttattattattatactttaagttttagggtacatgtgcacattgtgcaggttagttacatatgtatacatgtgccatgctggtgtgctgcacccattaactcgtcatttagcattaggtatatctcctaatgctatccctcccctctcccgccaccccacaacagtccccagagtgtgatgttccccttcctgtgtccatgtgttctcattgttcaattcccacctatgagtgagaacatgtggtgtttggttttttgtccttgcgatagtttacagagaatgatgatttccaatttcatccatgtccctacaaaggacatgagctcttcattttttatggctgcatagtattccatggtgtatatgtgccacattttcttaatccagtctatcattgttggacatttgggttggttccaagtctttgctattgtgaatagtgccgcaataaacatacgtgtgcatgtgtctttatagcagcatgatttatagtcctttgggtatatacccagtaatgggatggctgggtcaaatggtgtttctagttctagatccctgaagaatcgccacactgacttccacgatggttgaactagtttacagtcccatcaacagtgtaaaagtgttcctatttctccacatccgctccagcacctgttgtttcctgactttttaatgattgccattctaactggtgtgagatggtatctcattgtggttttgatttgcatttctctgatggccagtgatggtgagcattttttcatgtgttttttggctgcataaatgtcttcttttgagaagtgtctgttcatgtccttcacccactttttgatggggttgtttgttttttttcttgtaaatttgtttgagttcattgtagattctggatattagccctttgtcagatgagtaggttgcgaaaattttctcccattttgtaggttgcctgttcactctgatggtagtttcttttgctgtgcagaagctctttagtttaagtagatcccatttgtcaattttggcttctgatgccattgcttttggtgttttagacatgaagtccttgcccatgcccatgtcctgaatggtaatgcgtaggttttcttctagggtttttatggttttaggtctaacatttaagtctttaatccatcttgaattaatttttgtataaggtataaggaagggatccagtttcagctttctacatatggctagccagttttcccagcaccatttattaaatagggaatcgtttccccatttcttgtttttgtcaggtttgtcaaagatcagataattgcagatatgtggcattatttctgagggctgtcttctgttccattgatctatatctctgttttggtaccagtatcatgctgttttggttactgtaggcttgcagtatagtttgaagtcaagtagcgtgatgcctccagctttgttcttttggcttaggattgacttggcgatgtgggctcttttttggttccatatgaactttaaagtagttttttccaattctgtgaagaaagtcattggtaacttgatggggatggcattgaatctataaattaccttgggcagtatggccattttcatgatattgattcttcctacccatgagcatggaatgttcttccatttgtttgtatcctcttttatttccttgagcagtggtttgtagttctccttgaagaggtccttcacatcccttgtaagttggattcctaggtattttattctctttgaagcaattgtgaatgggagtttactcatgagttggctctctgtttgtctgttattggtgtataggaatgcttgtgatttttgtacattgattttgtatcctgagactttgctgaagttgcttatcagcttaaggagattttgggctgagacaatggggttttctagatatacaatcatgtcatctgcaaacagggacaatttgacttcctcttttcctaattgaataccctttatttccttctcctgcctaattgccctggccagaacttccaacactacgttgaataggagtggtgagagagggcatccctgtcttgtgccagttttcaaagggaatgcttccagtttttgcccattcagtatgatattggctgtgggtttgtcatagatagctcttattattttgagatatgtcccatcaatacctaatttattgagagtttttagcatgaagcgttgttgaattttgtcaaaggccttttctgcatctattgagataatcatgtggtttttgtctttggttctgtttatatgctggattacatttattgatttgcgtatattgaaccagccttgcatcccagggatgaagcccacttgatcatggtggataagctttttgatgtactgctgggttcagtttgccagtattttattgaggatttttgcatcaatgttcatcgaggatattggtctaaaattctcttttttggttgtgtctctgcccggctttggtaccaggatgatgctggcctcataaaatgagttagggaggattccctctttttctattgtttggaatagtttcagaaggaatggtaccagttcctcctcgtgcctctggtagaattcagctgtgaatgcatctggtcctggactcttttaagttggtaagctattgattattgccacaatttcagagcctgttattggtctattcagagattcaacttcttcctggtttagtcttgggagagtgtatgtgtcgaggaatttatccatttcttgtagattttctagtttatttgcgtagaggtgtttgtagtattctctgatggtagtttgtgtttctgtgggattggtggtgatatcccctttatcattttttattgtgtctactttattcttctctcttttcttctttattagtcttgctagcggtctatcaattttattgatcctttcaaaaaaccagctcctggattcattaattttttgaagggttttttgtgtctctatttccttcagttctactctgattttagttatttcttgccctctgctagcttttgaatgtgtttgctcttgcttttctagttcttttaattgtgatgttagggtgtcaatttcggatctttcctgctttctcttgtgggcatttagtgctataaatttccctctacacactgctttgaatgtgtcccagagattctggtatgttgtgtctttgttctcgttggtttcaaagaacatctttatttctgccttcatttcgttatgtacccagtagtcattcaggagcaggttgttcagtttccatgtagttgagcggttttgagtgagtttcttaatcctgagttctagtttgattgcactgtggtccgagagacagtttgttataatttctgttcttttacatttgctgaggagagctttacttccaactatgtggtcaattttggaataggtgtggtgtggtgctgaaaaaaatgtatattctgttgatttggggtggagagtcctgtagatgtctattagatccgcttgatgcagagctgagttcaattcctgggtatccttgttaactttctgtctcgttgatctgtctaatgttgacagtggggtgttaaaatctcccattattattgtgtgggagtctaagtctctttgtaggtcactcaggacttgctttatgaatctgggtgctcctgtattgggtgcatatatatttaggatagttagctcttcttgttgaattgatccctttaccattatgtaatggccttctttgtctcctttgatctttgttggtttaaagtctgtttaatcagagactaggattgcaaccccaaggcagtgttattattaatactttacttttcctttaccttgaggtgactctcagtcttcttgggcagcatcttggcctggatgttgggcaagacagtcacctgtgtgataatgactttacccagcaacttgttgacatcttcattattgcaactggccagctgcaggtggtgcaggatgatacatgtcttcttgttgtcacaggtcccattgcctgccaactccagaatctgagtaatcaggcactccaacaccactactaagcacagtggcatatcagcccttactttctcatagtaattgcccttgaagagcaggaggtgcacacaacctgtcaagaactgcagactaacccaggagggctgggtcttggcctcagtgcaagccttgctgctctgcttgccacatccagacatagtggaggggagtaattgtcagcatgagtatagcctaaacataaacttacctaaacaaatgatcaaagttaaaatatggcaaaatgtaaaacaaactcaaattgaaggatattctacaaaatgacctgcctacaaccttaaaattcatgaaaatgaggaaagactgaggaaatgaggaaagactgaaagtctctttcagttccacactgaaagagactagagagacgaggcaactgggttcaaaggatcctggattggatcctttagctatgaaagacattattgaaatattgggggaaatctgagtgggattttggagtgtagtgtattcagttatttatactcttcattatactattctttaagttgacattgtttacaattttaaagaaaaagaaaaacttatgtcttaagagagtatgtttgaggttggcacataataggtaagaaatgtttcctatttaatgacatagcagaatcaaaaaaggttgatttggagtgctctaaatcattcaagcttcctaaaaacattgactgtggcaaaatctgacctgagctgctttatctttttgagaatggggacagattgtgacaaagagatttacctttgcagccaagaccaatgagaatagaattgacctgaaattctagtataggaatttttctatatagaaaaccaagagaagctcaattttctagtaaaaacaagaagatgaaaatatgatcatgttataaaacttaacaaacaatgtgttataattgctttgcaaatttaggaaagacttggttctctactgtgtaagctgttcaataaatttgtataatatggtcattaaaactgtggcttataaaacccaacataactttaaaaaatgtttatgaaaatattgtataactctaatcattaataaaaggaaataaggacagctctcataaccagcttccacaaagctgactcactagattaaagggtcccctccattccccttgtaactcacactagttgatgctcttggaggactgacatgctggtcattcatgagtggaaacagagcctttaaaaaaacgcagttgaacttgatggcagattcatgagatggttcttaaggcttccactcagcagcagcacatgttccttactctcacattttattagccaaagcaagttacaggaaagtcacatgtcagtataaggggtgatagtatgatccttccatagacaagggcagggcagggcagggagtgggacatagaatggcaccccagtttccaggggaatctctggaaaatcctgaagacccctgatacaaacctttctttcttaatctgatctgtccagagactctagggctgacattcatgccctggaagaggacaaagctgcatttttcccagggcctaagaggatgggctcagtaaggaagggcagcaacgatgttagaaaatagtgtgattaaatagtgtaattaaaattaaatagtgtaataaaatagcgtaattaaaatagtgtaatataaattgagaacaagttgcctctttccagcttaaaaatttatatgctttccactacatcattttcctgccatccttcagttgggtttaaagtaaaaactatatatatatatatatatatatatatatatatatatatatatatacacacacacacacacacacatatatacatatatatatacacacatatatatatacatatatatatatagtgtatatatacacacaaggtttccattaaaatgcaattcttattcagaagaggagactttctaggccaatagcagtcaagggtttaatttaatttactgctttgcaaagtttcagaaatataccaccattggaacagaagataattttagtagtacatcaatgactattttttattttaatagtcttaatacacattaaaataaacaacatatcaaacctataatttcacagatattgattggaattaaattaaagcaattatttacatttaaaaagtgagtcaatttaaataaaaatattaggtcaacaatgcaagtggtggtttatgaatacagtgaaaattaagaagatggctgaaaaacaacaaaagttcgggagacgccagttttgtttctcagattaactagttatttgcctactgaaagagaagttatgtgggaaaaaacatgtctgagtggtagtaggggtgaagttgggagactttgggatcatggagatgttgaatctgggggttcctgagggccggaaaatcatagcacagagatcatggtaataggggaatagaagccaagaagggccatagaaatgtgacaaacaggaaaagattgttgtttcttcatagagttatgcagggctgacctggctcatgtgagatgcgtttttcttcatggtggcaaatggcaggattatgaaggaagaaaaaggtcttca

SEQ ID NO: 12307 - DNA, 6221 bp, Human
cgccagcctcctctctcccttcggtctcctcctcctcccgcccttcccggcctcctccctctcctctgcctcatccttccccggcccggcctcctctctcggtgtcgacccagtgcccctccttcccgggcccgccactgctgtccctggccggggcccctctccctcgctccgctcccgccgcaggacccgggagtccgcgcctcacctcgcgccccgcgccgaccgccgcacaagtgggtccgctggcttccgcgggtcagtgggccccgcgctccctgaggcgctgcgggggcgggccccgcgcccggccctcgccatggcaacgctacacttccggcccgcggtacccatagccggaagccgcggtgccccgtgggagccgggggcggagcctgggaggaggaaatgtcgggggcggggcctggggagggacggtcgggggtgggggccaacgcggacagctgcgggcggccgggcgagtcctccgcggctgggacctccttggggcgtgggtgggacgggaatggctcaaagtgctccaaggctcccgggacggtggtcattgatttatgctggacaaaaccgagtcatcgcgggcaacgggacgggcgccagcggaatgagtggcagctttgggggtggtttcgggcccaggacagtgcggtcggagaagagcggtcagaacttggggagcctccagcgccccaccaaggaagcgccagtggagaggggggtgccttaaaacttacgggagaccgggcgcggtgtctcacgcctgtaatcccagcactttgggaggccgaggcgggcagatcacgaggtcaggaaatcgagaccatcctagctaacctgatgaaaccccgtctccactaaaaatacaaaaaaattagccgggcgtggtggtgggcgcctgtagtcccagctactcgggaggctgaggcagaagaatggcatgaacccgggaagcggagcttgcagtgagccgagatcacgccactgcactccagcctgggcgacagagtgagactccgtctcaaaaaaaaaaaaaaaattatgggaaaggcccggcccggtggctcacgtctgtgatcccagcactttgggaggaggccgaggccagtgggtcacttgagcccgggagaccaacctgagcaacataggcaggcccggtccctaccaaaaattaagaaattagctgggctctgtggcgcacgcctgtagtcccgggacgctgagtcgggaggatcgccctagcgggggaggtggaggctgcacggggcccagatcgcaccactgcactccagcctgggcaacagagtgagaccttgtctcaaaacaacaacaacaacaaacacttgtaggaaagaacgacgccttgctgaccgaatggggtgaagtggccacaagtattagcctcatgaggcacaggattgtgcagccataacctagggaacacagcagagaggtggtggcaggagtcctgagggaaaccacgtggcgtctgaggggagagtcagagatagaaggaaaaggggcaccacccgaccgggggtgtggggggcaggagcagtgtggtaccccacatacaaggccccttgcggcccaggcctcctcctcctggacacttgctgcctgtccctcccctccacacctcagggtgtgctggaccccaccgtatgctgcagattttcagccctttgaggttatcgtggtggaggctgcacaagaaaagctgaattctcagagtgaagggcaaaagcatatccctgggcccccgtgtgtctgggggcccttggcctggtgccagcaccaaccaccgctgctaattcccagagctgctatcctcttgggcaaacttgccccttgtgagggaggagaacctgggctttggggcaggatacacaataccagccttgcttgggtggaggagcagagatggctagggaggaggaggtgagcggtccacctgggctcctgaagcaactcccaggaaatcagttgagtcaatgtgtccccctcttgttcctagggtgcgggcttcatggccttctcctccaggaagctccacctgatcatgtcctgggtggatatccagcccccatagttcagggcctactagcagctgctagatcttgaactccaggagcgccccacgccttgggagcttggcatgggctaaatactcccccatttgttaaatggggtcctgaaacctgaccagggaagacgggataaagtagccatgggtcatcgcagcccctttgaagccgggcctggccacccaaaggcaactcaggggtggagactgaggcctcaggagaagcccccactagaatgctctctgcccctcccttccagattaaccaaaacctgctaattgtggaagccctcggcatgctcccctcccccacagcctcttcctcccttccctcccctcccccttccatccgaatgataaaggccccagcccgcctgccccagcccggcctcaggtcccggccctgccttctacactgccccaccgccctgcaccctccacccggccaggcccctgcccacgctgtctaccgtcccgcatggggccctgcagcggctcccgcctggggcccccagaggcagagtcgccctcccagccccctaagaggaggaagaagaggtacctgcgacatgacaagcccccctacacctacttggccatgatcgccttggtgattcaggccgctccctcccgcagactgaagctggcccaggtgagcgggccccggcccccactctctctttccccagactcgttccccacccacttccaggttcaagccctgacccccaccccttcctagcccacccaggtatgccagtgggaccagtcctgagagctgagggcctcaaggcacgacccttctccgggagccccttgccctctctgccgcgcttccgcgcagaaatgtccttcttcggggacagcaggggccggcaccgcgcgcccctgagcccggtagtgggggaggggtagggcgctaccccctccccgtctgggctcacggcgccggccggccgcctggcggtttcagatcatccgtcaggtccaggccgtgttccccttcttcagggaagactacgagggctggaaagactccattcgccacaacctttcctccaaccgatgcttccgcaaggtggggcaggccagggtcggagcccgggggcggagcgcgcgcggaagtcctgagcatccaaggttgggcagccccacccatgtctgacccccacacccaggtgcccaaggaccctgcaaagccccaggccaagggcaacttctgggcggtcgacgtgagcctgatcccagctgaggcgctccggctgcagaacaccgccctgtgccggcgctggcagaacggaggtgcgcgtggagccttcgccaaggacctgggcccctacgtgctgcacggccggccataccggccgcccagtcccccgccaccacccagtgagggcttcagcatcaagtccctgctaggagggtccggggagggggcaccctggccggggctagctccacagagcagcccagttcctgcaggcacagggaacagtggggaggaggcggtgcccaccccaccccttccctcttctgagaggcctctgtggcccctctgcccccttcctggccccacgagagtggagggggagactgtgcaggggggagccatcgggccctcaaccctctccccagagcctagggcctggcctctccacttactgcagggcaccgcagttcctgggggacggtccagcgggggacacagggcctccctctgggggcagctgcccacctcctacttgcctatctacactcccaatgtggtaatgcccttggcaccaccacccacctcctgtccccagtgtccgtcaaccagccctgcctactggggggtggcccctgaaacccgagggcccccagggctgctctgcgatctagacgccctcttccaaggggtgccacccaacaaaagcatctacgacgtttgggtcagccaccctcgggacctggcggcccctggcccaggctggctgctctcctggtgcagcctgtgaggctcttaagacaggggccgctcctccctcccgctcccacccccaccttgttgacagggagccaaggcgaggcggctgtctgcgaccacagcagcctcgaaacaccaggcagcagccttgctgggagtccacggtgtttattgggccaccccacgcatggccgtggcccagctgggcacaaccctcaccctggtctgtcatgcctgtttttcctacactcagcggcaaagctgcaggagcagggctgagcctggaatagcccttcctagtcccctcttctcagcccactacccatccatcagtcaccagccgtcacctcccctcccgtgctccaggctgggggagggagagcccagtggtggatccagcctgaagtcctgccctctctcatctgtctggaaaggaggtagcacctttttcgggaaacgggttagggagtaaagactgcaccctacatggtcctggtggtgggggggataacagtaaaggaatttgcaacgttttaatgccatgcctgatttttgggtcaggagtggtgacttgggtaaccacttggcgggggggcctgggattccctgctgtgtgccgtgataacagcaaatggtgataaggagaaagccaagacctgtggcctgatgcagggctgggggcggggggtgatcacttcagcaggcacaacacacttcactggctgcggaggtggaggggtgactctgggagctcaggggcaatggatccaaagaggctagggagcttgtgccctgggagacggggtacagggactttactaccgcctctgccagcagagacctggcctgagaccccatgggcagggccgcgacccaggactagaggggcaggccctctgcgggcgcgagagccgagcccgagccgttgtcgggactggggcatggaggactgccaggggacggcgtaggggtgcagggggtcccggtgagcggagtgtcggtgctgagggaagaaggcgtcccggaggagcgcgggaccctgcggcgccgggctggccccagctccacttgacccactcggtcggcgaacttgagggagcagactgtctccccgagatcctccggccgcgtggagatctgcgggcaagaggcgcgggtgggcgggcccgggtgggcggcgaccggcacgcacacacctgccccgccccggcgcccacctgcagcagcagcaccgcggtggtgcctgggcccagcgccggctgcagcagtcgcgtgagctgcgagtcgcggaagggcacgtgcggccggtgggcccgcagtgcggccatcacgcctcctagcgccagcagcgagcggtttatggtctgggcctcccgcaggcgccgggcgccgtctgggtctccccgcggcgggccggccgcccctgccttccgtgcgcgttcggatcccgccaggtccaccaggtgcagcgtgcctagaggggcgagcgagcccgacatgggggaaggccgggcctcgggtgctctggagactccgcagggctcaggcaccggccgtggtacctgcggtgcctggagcgcgcggtggagacgccgcgcgcagcgtcagcgtgaccagggcatgcgagcgggagctgcgctggttcatggcggtggcggcggtggcccggttgctcctccccagtttcagcatctggaaggcggggcgaagggctggtcaggtgcagggtccccgcccccaagtggaagcacggggcggggtctcggagagcggtgcagccctacctggtgcaatgtctccaggttgggcacgtcccagtgggtgaggccagccacctggatcccgccctggccttctgggccctgcctcacggccaggcgctcgggaggccctggagcaaggaggtccctggtgagaaaggggaaggtcttggttccagaattctctggaaatccggaagggccctgggccaggggtggggagaaggcctccctggtggagtagcccacctgacagcctcattgtagatctccaccatgctgagtgtcacccggtgctgccggccggcccccatctcccggaacagcgactgcagcgccctaggaactatgccggggtcctcaggagggccctgaggatggggtggggtgcaca

SEQ ID NO: 12308 - DNA, 8888 bp, Human
aacgaagaaacttggacgatctcagccttgtgcttgacaacctatcccccacctcccttaagtggttggggagggggatgagcgtgggggaaattccatgtgtggagtccaaagggatacagccacctcccggcccaaatgcaaattcatattcatgagagcgggataaataaagacaaatctccgctgtaatagcacttggattcgcatccgtctttgctggcctttaggtttaggggactgaagacagatgtttgcatcccttttctcctcttgtctggtgaccataaagaaaaaccatttagagcgttgcaatttgtttcccgccgcagtaaaaccttgtatacatttattttcatttcacccccgtgcacaaaaaagtgcacactggtcaccaagggcccttctttatcaaatacgcattgtacaacatacaactgcaataaaactatcagccctccccataaaactatcaccaggatcctcggtaggtccggctccctgcactcccgactttagcgcttcctcacgccccgaggatttgcaaccacctgaaacgagcctgaaactcaccctgcaaagaagcacaaggctgggggaccgctgtccccgtttaatccattactgcgtccgcggcagtttagtgcgcaataaaacacggtggcaggggagagcgggagcccatccactccccggcactagcatcgaattaaaccacttagtttggcaaacactgaacgcctaaatgcccctataaagactttatgagtttgttactttaattactgacttgttacagagcacataaagggggtaatgaatgcaataaaactaattatctacacatttaattcatataaaatatccagggtttgtttacaccacacggcgattcagctaagctttccccctcttgtccaccgagaggaaggatttaatgaaatagtttcccttattctgctagggcctaacaaaccaaatgaaaattaccctccgcttaaatcatggggccactgaagtccacaaatcactgctcgctcctttgtctgtgcctcgctgccagcacccaaaagcctgaggaatcggacaagaaaggtgcccgacctggagcccttgcctgggcatttacatggcaagaatttccctcactacagtccgcaaacctaaaaggcaaacagacacaatccccgggtctgtggaggattgtgggcacctgaaaaaaaaaaagaggcgagaaagagggagagcgcccgaaagagatgaaagaggagatacatttgggtacacttcatgctcgcttgccagttatggtgtaattaaaacgaacaacctcacagaaactcaaaccaaccaaggcttgcgctaatgcaaacagacagaactgagagcaaagaacacaacggtcgagaatccagatgtttcacattcgaaagctttcctcagatttttttattattatttttaagtggctgtataccctgagtctcttgaaagcacatttagctgcaagaagaaatgcaatttataagatgctttctctctgtctctcttttttttaaccccctctaccaggtgtatttttaaagaaatccgcttatcgttcacataaacccccttggcccacttactctatgttacagggcgcctgagtcttgccaatgtcccagtcctttataacatttcatgcacttcggggggtaggcttgttgttaaattgagcgtgtaacactcttacaaaacaggttttctatgacatcaaggtttcttctccctaaccgagggggaaaaaaagaagaggacgaagaagggggaaaacacacacactatctcaatttatgcctaaggtatatgatcagttaaaaaggcttaaaagctcggggaaattggatcagggagaatcgtcacccaactttcattatttccaagtagtgtgattgaattaaagggcagggagctggttagaagggaggatcaggggctcggtgcgtaatggtgtggtattaaattctaattagagatgcaggaatcaatgatagggaggttggacagctcagttccccagtgccagcccaatagacggatgagttattgtcatgtaaaaagcgccagcaataagaccaaccgctttgctattgtccaagtggaaagagccaagtttattatgaggactatatgctctagagacctcagacaaggcatctcataggaggctttttcataaaactaggctctgctggtagtaaggaggccagtttggaggcaggcgttgagctgtgcacatctccccactccagccaccttctccatatccatcttttatttcatttttccacttggctgagccatccagaaccttttcaatgtataaaatggaatattcttacctcaattcctctgcctacgagtcctgtatggctgggatggacacctcgagcctggcttcagcctatgctgacttcagttcctgcagccaggccagtggcttccagtataacccgataaggaccacttttggggccacgtccggctgcccttccctcacgccgggatcctgcagcctgggcaccctcagggaccaccagagcagtccgtacgccgcaggtaaggaccttcagctttctcagcggaggaagccgcctttccgcccgtatataggaagccttgattgcatttgaaaatggaaatgtgtttagtatttaccaaacgaaatttgcttacacaaatgaaagaatttatcacgttagaagcgattgcagggaggggtaattcacttacagggttacactatcctagtcacacccgaaccgccaacaaaattatcttaagctgccaaaatgataggcataatttatttactttgcgatgagacgtaaagcttagaaaataattaaataacaaagagtaaagctcattactggcagtgtctctttttttaagaaccgacagcggctcacacctctttggctggtcatttttatgattatttctttaatttattattatttttttgcagctctttcccccaacttttgagccgggtcaactttctgagaattgaaaagttcccaaagtgggactgtttggtaacttctttcctggctccctgatattccgactgatgtttttggatttttttcctctctggttttttcctgctgaaagcactatctcaagtccgtcacatcgcgctgtttcaatccacccaaaggcgcttgtgccagaaaggactccgccaagcccgaagtttgagcccaggtttccgcagataacaaatttcctcggtttcttcccgcagcttctctcggcaactctctcgcgcgggtgtaggtagcggctgccgtatgacctgaccttggagtcctcacattctagctccacggccggcgagctgccggctgatttgctcactttctgtctcctctgtcatactctagttccttacaaactcttcacggaccacggcggcctcaacgagaagcgcaagcagcggcgcatccgcaccactttcaccagtgcccagctcaaagagctggaaagggtcttcgcggagactcactaccccgacatctacactcgggaggagctggccctgaagatcgacctcacagaggcgcgagtccaggtacgcgcgcctggaaaccgaccccgctccgccgcactggtccggggaggtgtggggtgaggggcggctggtgaaattcgaagtcctggagcctcgagtgagaaggacctagggccccatggccgatcagaaatactggatttggtgtggctgtgcgttcgagagaggcttagagcgcacgctcttggcattttatttacagttgcgaagtgtttcccacccgagcagagacatggggggccttgggacgtggatgagcgatgcaatttcggggacaggaagtgcctgtggtggaaggtgtgcagactttgctcccgtattataagtttttccttctcccctcccgccccccaaaaaaatgcctcctaactcaagtgcttttaacctggccccatggcatataggttcattttcccggaaactgtgacttgcatcagatttgcaaagggtctgtgacttcatgaaggtcaagaaccatgacttactccaacctgttaaacacaggtgcgctcacgagttggccacagcgcctctctgggtgagcccccgaccgagaagcggtgcgcaccatcgcacgctcttccaggctcaaaggccggggatgggcagcggagcaaacccagagaggatcccttttccttctaccaattagagtttaactttagaacttaggcttaggggtgaatggcgagctcggggcttgctcaagaagccgactgaacagaggcccaccaaaataaggccttcccttttcgggtctttctgggacctgcggctttttaaactctgccgcaagccttcatgtccctggcgtgctcactccccctaagaaagtttctccgaaaatgcacagcaataagaagcggtagacttggtggatgtgcgcgcgggggtgatcacagcgcatggggaggagggtgttaaaacaagccgaagtagaacttgggccaccctaaccggtgcttttctttcccattttcttctttctccccctgcttcaccgtctctccttccgtcttgggccaggtgtggttccagaaccgccgcgccaagtttcgcaagcaggagcgcgcagcggcagccgcagcggccgcggccaagaacggctcctcgggcaaaaagtctgactcttccagggacgacgagagcaaagaggccaagagcactgacccggacagcactgggggcccaggtcccaatcccaaccccacccccagctgcggggcgaatggaggcggcggcggcgggcccagcccggctggagctccgggggcggcggggcccgggggcccgggaggcgaacccggcaagggcggcgcagcagcagcggcggcggccgcggcagcggcggcggcggcagcggcagcggcggcagctggaggcctggctgcggctgggggccctggacaaggctgggctcccggccccggccccatcacctccatcccggattcgcttgggggtcccttcgccagcgtcctatcttcgctccaaagacccaacggtgccaaagccgccttagtgaagagcagtatgttctgatctggaatcctgcggcggcggcggcggcggcgacagcgggcgagccagggcccgggcgggcgagtgggcgagcgggtaggcccaaggctattgtcgtcgctgctgccatggctttttcattgagggcctaaagtaatcgcgctaagaataaagggaaaacggcgtcgccctcatttcaaccccactcctacccccttcctcaacccccaaacaaaacaaacaaacttccctggcttcgcacctgcctggggcctcgcagcggggccagggctccgcctgctgatcgggggttgtgagcagcgcggcctggacgcggggcactctcagggggctgtgtctgcgtgtcagtttgtgtctgtctcggggaatgtgtgtctgtggcccaagcaggtgacaggaagagatggggggcctcaaccaacttagtgacttgtttagaaaaaaaagacaaaaaagtaaaaataaaaacaaaaaagttggaaggcagaaaccattaaaaaacaaaaagccaacaacccagaaaggtttaaaaaacataaggaaaaaaaagacaaattaaaggaggggctaggggagaagctgcagctggagctgaaggctcgatcttgtgaacccctaaatccgctccctcctaacagcacggattctcttggggctcttcttcagggaagagtagggacgccgttccagccccccttcctatcgtgtccttgggttcgggtcactgcggcgacgacttgctcagactgtcccggcggccggagtgactttctcgcacccccttgcctgtcccacctcgctgaacaccatcccgccattagcgcatcggaaccccacacagttgcaactcccaaccccgaatctttgcagccgttcggccctgaaagatgccctatccatgagatgccttttcatctgcaaactctgcaaaatgtgtctcatgtttcgcaactctttttttccccctcgctcccgcctaccccgtcggcattttcttcttccaccagcttttactgaactttttggcactgctttggattggggtcaattgcagtccacgtaactggctgcagagaaatctaccgagcaaggaaaaggcacacacacacgtttgcaggggtgtctcggtttgcatttctgttggaatgatccgaactggactcacatcctgtatggtggatggactgtatattgagggttccattcttcgcgcagtttagacatctctgttttgattctttgttgttgtttttattttaaaaggcacaaactctagatattagttgaatgttgaggctttaactttttcggtgtctttctacaactgtgttctgtgactcaattgtatcgtgttaatatcagtgcagactgtctcctctacgtgaccgtataatgtttttctcttcttgtagtctctatggcgtgtctttatggtgtaataaggttctcacgggttcaatcttttgtgtttagagaggccacggttcagacaatggtatatatttttgttatcaggtgcatgtctgtctgatttctttttttttcctgttggactatgtttgtgaacataattgtcataagttatgtttcagatttttgaatttatttatatgtgttataatgaatgcttctatttaaaagggaaatatttctacatgtgcatatagttttccaagagtgtaccattaacttgattgttgataataaaaacaaaaagcaagtctagcaattgaactcttctttttcttgattctttttttttttttttttttttggttggtcattgtttttttttttttaagtttttttttaaaaggataagggaagataaaggaaattgtgctaaaaaatagcaagaacctcactgggctctggaaatccaggtgggttgggacatctaaacccatgcagccaaattcagccaaatataaaatttagtgcttgagagagcagggaggcttcttgtccatgcttttctgtcccccagaagcacaccagggcattgataaaagtgttcacatctggatgtggatatgtggactaagtggcagccaaggcaggatttgaattcaggtctttgaggtggacttaaaacgacagtgtggattctgtgtgcaggtgccttcaagaccagtgatatccggcaaggtccaggctgtccagctcccccaaaccctgcagagtgctgacaccccaggacacccgacaagctccatgtgggcaggtgatcaggtgctatatggaacagggtgtgccttccatgcattttctcatctatccttcaaaacaagaccatgaagcaggtacaattcctatcctctgttttattttaaataggtgagggaatggaggcaacagaaacttaacctgctgaagcacccctggtttatgagtgatggggccagccattgaaatgagaaaatctcattcaagaacctgcgacatttaacaataccaatggttctcaaagtgtggctcctgcaccagcagcatcagtatcacctggggatttgctagacacaaattcttgggacccaccttggacctactgaatcagaaactctgggggtggggtccagcaatgtgctttaagttctagaggttataggaaccactaaactaccctgtaagaaatgcaaaccagaaaattccagaactgggactaccttgggaacaggtgaggggaagaattctggcagccttagtgatctcttttggagggaaggggtcctcactacggccccaaaatggaatcgtgcctcctccttggaccctttgactgcgccactttctccaagcagaatccctgtgtaaacttctggtacttacctttatacccctctggctgggcataatcaacacataattcagttctcctcatttgaagggaggccacagtttgccttctctgatttaaggattagcagctgatctggtttaaatttatcagggcttcttgccaaaagcatccaaatgtggcttgcatttgatcaggcagtttgattcagaaatctcaaatatttgcatcatatcaaactttgaatcatctttctagaaggattttagggccaggcgtggtggctcatgcctgtaatcccaatcctttgggatgccaaggcaggaggatcgcttgaaggcaggagctggaaacctgcctaagcaaaaaaaaaaaaaaaaaaaagaaagaaaagaaaagaaaaaaaggaaagaaaaattagccaggtgtggtggcacatgcctatagtcctggctacttgagaggctaaggtgggatgattgcttgagcccaacagctgaggttgcaatgagctatgaacatgccaccgcattccagcctaggtgacagagagagacactgtctgaaaaaaaaaaaagagtaaaataaaaggctttaaaatattcttttaaaaaaatctgtctctaaatgcccctcagtaaagtctccaagacaacattgtttataaagagtgccactaattgtgctagtttaatatgccagcaattcccggaactcttgggttgtagtctttggttgtaaatataacttagaagatctgagacaggcagaccacaaaaacaataatttattggcaaaaagagcaatcaaggtcctgggcctggacacaggaaagttcaccttcctatagtcatggaagcccacgaggtaagtccctgtaagcttttgggcaggctagtggacaggcattctggaaaaggcaagacc

SEQ ID NO: 12309 - DNA, 19979 bp, Human
ttatcatctcccttgcatgggggcaggccttgctctggctgccctagtcaggtaccacggctggttctggggtgtaactgcctggctttgagtccacagcatagactttcctgtctccttgggagcactgattcttccatggcagcccaatgccatggggcctcggtctcaggccagtaaccagctcctgagcttctcgggagacagagctggctgtctcacacctcacctcacctcacgacgaggtggggtgagcggggcatccgaccatcatccacccatccatcctgatttattcagtgcttctgtggtcagcacaacatcccgaaaatgtgcccgttccgtcggccgctgtggctcacacctggaaccccagcacttagggaggccgaggtgggcggatcacttgaggtcaggagttcgaaaccagctggccaacaaggtcaaatcccatctcttctaaaaattcaaaaaaattagccgggcatggtggtgggcgcctgtagtcccagctacttgggaggctgaggcaggagaattacttgaacccgggaggtggaggttgcagtgagccgagatcacgccattgcactcgagcctgggcaacagagcaagactctgtctccatcagtcagtcaatcaatcaataaatgaatgtgcctgtcctactccctggaacctgcagctaaagggactttgaaaatgggacgagatcttcagatgggaaagcatcccagatcgggtggacccaatgtcaacaaaagagtccttagaaccaggacagtttctccagctggaggcaggggagcacagcagctagactcagtccttgaacacctgtgcaggcccgcccagccctagccttgggagcgacgctgtcagggggaactgatggggggcagcccacccgtttccatttcaggatccctctggctggctggggaaggggttaaggggagacaacagggggtgggcgattccgcaggaaggtcctggaactctcccggccagagatggtggctggactaaggtgcagggggtggtcggggagctgggggggggtgctcagattcctggattttgagggttcaaaaagcagctggacggggcgcagtggctcacgcctgtaatcccagcgctttgggaggccgaagtgggctgatcacctgaagtaaggagttcgagtccagcctggccaacatggtgaaatcccgtctctactaaaactacaaaaattagccgtccgtggaaccagctacttgggaggctgaggcataacaacttgaacccgggaggcggaggctacagtgagccaagatcgcgcctctgcactccagcctgggtgacagagaccccgtctcaaaaaaaaaaaagctactggagggaacttgggggcgtggaaggggtggtcacgggggaagtcccccagatttggacgctcgtaaaaagctcggaagctgggagaccaggagggcggggaagtcgaggtccagtcactgggccagagtccccaagacttgggctggagaaaggtcggaggaaaggaccccactagtccgaaagcatgtccccgcgcacgcgcaccaggcggccggcagagacagggcacagtaaaaggagccgcgcggactccgggcacagctgctgggcactggcagctcgcaaggcacagcgcgcaggcgcgcacgccacttaaggccccgccccctcccagcgcgctgattggcggggccgtagaggggcgggggcatggcgccgcggctgcgcagcgcggggccccgcgcgggcgggtgggcggagcgggccccccgagcgggggctggcgagcgcggggagggggccgaaagggcggcaaagccggcgcgcgcccggctgggggcggagggcgggggcccgcgggccggaacagccgcggcaagtggcggcggcggcagcggcagcggaggcagctgaggcggcggcggcgagtgggggtccgggcggcggcggcgggcccggcggcgggccgaggagccgggcgcaatggagcggaagaggtgggagtgcccggcgctcccgcagggctgggagagggaagaagtgcccagaaggtcggggctgtcggccggccacagggatgtcttttactataggtgaatgagcgcgccggccgcgcagggcctcaacgggctcctcccagcggcctctgcggcggcctcggcgcccctgccccgggccgcggcctgggccccgcgcgtgcgtcgtgcgtgcgtgcgtgcgtcttgcgtgcgtgtgcgcccggcgcgcggaggcccagtgcgcgtgcgccgcttgttgggccgcatggctttcggccggccgttcagggactggctgccggacggcgactgcggcctttgttcgtgcgcgctgggccaggggcgcctggcggcggccagatgctaccggggggcaggggtggagggtgggctgtccctttggttcccgtgagacgcagggggtgccttcttggggcgctcctggggtggcgcggagcccgagggggtggccagccgggatttcggggagcagggctcatgggcggatcggggagggcgtgcgtgaaaatacgggttcttgggctcgccccagtcctgggaataagcgcctcagggtgactggtctcccacgcagcgttgctttttttaaaggtattccccttgactccttccgaggcctctggtcctcttgggtcgtggccccctcagggtggagacctgaggctttcgactttccgagcccacctaacggtagtctttgcgtggatgttactggtggtggaaggctttcagagacccccccgtccccaaattggaacaaggcgctgctctgaaaggtcgcagggaaccccctccgtggaacaaagacttagtcgcctgctgcagccaagtcccagacagtcggccacctgctgtttgtcctcttttttttttttttcctggctcgggaaagatgcttttgattctgggccagctttgattgcgccctccccttggttcagtgtcccgtggcgccttcaggtcccccaggaggggaaagcggaggacgcctgccatgtgccgagcacctgggtaaaggggggtgtgcggctggtccccctttttcccacagctcggggtcgtgggcaggagaccgcccaggtgagggcgggtggtttccacgagccaaggaggggcagaacgaccgctccgtccactgtgcacttcggtcctctgtggttcttgactgtcccggtttggggagataaagtgagaaaagtgagcggggaaaggatggctgtgatcagaagcaatgtgtggggcctcgtcctgcaggaggagctcagggactggttcctggaaagttggaggacagcaagagaggggaaacttggtccccaaatgtgtacccttatgagctggaaccctgtacacgtcctgagatctgcagtgacacatgctgaaatctgggagggcagatgacggggcctgaatgagactggggtcagggagggcttctctgaggacgtgacattgagtgacagggagaggcgtccaggcagcaggaaccccctaagaggtggctgcagcttgggagctagaaccaaggccagcttgagcggagtatcctgaggctgtcatcaccccacctctctcattcccactctgggccctggccctgagcatgagggtctagcagtggagaaaagcagggagaagctcctctacaggctagagatttcaggtttctctgcagagggtgaagccaggcagcccagagccgccctctgcaggtctggggcctcaacccagcccttcatctgaggctgcaggctcccagactgcgttttctgttgggggtgcctggggagagttcaggccatgttgcccacttttttctatacgtgtggttttatcaaggctgttcttttttcattgaataaaatctcagggacatcattttgtgtcaatagatgggcataacctttatttaaaattgagatataattcacattccacaaaagctaccttttttgttttttttctttgagacagggtctcacccaggctggagtgcagtggtacaatcacggcttacgcattcttgacctcccaggctcaggcgaccctctcagctcagcctcccaagtagtgggaattacaggcacgtgccaccatacctggcttatttttatagagatggggttttgctgtgttgcctagactagactggtctcgaattcctggactcaagcagttaacccgcctcagcctcccaaagtgctgggattacaggcatgagccactgcctggccaaagccactttttagaaatgtacaattcagtggggtttttttttggagatggagtttcactcttggcccaggccacagtgcagtgacgcaatcccagcccactgcaacctccacctcccgggttcaagcgattcttctgcctcagcctcccgagtagctgggattacaggcgtctgccaccatgcccggctaatttttgtatttttagtagagaaggggtttcgccatgttggccagactggtctcgaactcctgaccccagcacctcagcctcccaaagtgctgggattacaggcctgagccaccacacccggcccccagtggtttttagtacattgacaaagttgtgcaaccatcaccgctatctaattccagaacattctcatcaccctgaaaagcagctctgtcctcattagcagtcactccccacttgttactcccccagcccctggtaaccactaaccccctctatcttgcatttgcattcattcattcatttattcattgtgagacagggtcttgttctgtcacccaggctggagtgcagtggtgcagtcacagctcactgcattccttgacctcctgggctcaagcgatcctgcctcctaagcctccagcatagctgggactacaggcatgtgccaccatgcccagctaattttttatgttcattattatttatttattttgagaagtagtcccgctttgtcacccagggtggaatgcagtggtgcaatctcggctgactgcagcctccacctcctgagttcaagcgattctcctgcctcagactcctgagtagctgggattacaggcccccaccacaacccccagctaatttttatatttttaatagagacggggtttcaccatgttggccaggctggtcttgaactcctgacctcaggtgatctgccctccttggcctcccaaagtgctgggattacagatgaaagccactgcgcctgccttcttttttttttttttttttttttttgagaccgagtttcgttcttgttgcccaggctagagtgcaatgttgcagtgcaatgctgcaatctgggctcactgcgacctccacctcctgagttcaagcaattctcctgcctcggcctcccagctagctgggattacaggcatgtgccaccacgcccggctacttttgtatttttagtcgagatggggtttcaccatgttggtcaggctggtctcgaactcctgatctcaggtgattggccctcctttgcttcccaaagtgctgggattacaggtgtgagccactgcatttattctttttgagaaggtgttatcgagatacagttttatgtaccatacaatacagtcatttaaagtgcacgagtcaatggtttttcagcatattcacatatttacggatataggcagctatcctcagattcaattttagaatttccatcaccctagaaagaaccccaggcccatttaccactgccttgtgcgcccacccccagtcttaacaaccaggctgtggtctgtgtgtgtctcttgttcgccttacaccttttttttttttttttttttttggagacacagtcttgctctgtcgcccaggctggagtgcagtgtcatgatctcggctcactgcaacctctgcctcctgggttcaacccaattctgcgtcagcctcccgagtagctgggactataggcacgtgccactgtgcccggccaattttttgtattttagtagaaacgggtttcaccatgttgcccaggctggtctcgaactcctgagctcaggcaatccacccacctcagcctcccaaagtgctgtgattacaggcgtgagccaccgcgcccggccttgtttcccttcatcttaaaaggcagaacggcctctctttggggtgaccggaggcaaagagctgttgggagtgttttgtggggtctcttcttccttccttgtggctacatgaagcctgagtctcagcctctggtttcttggtttctttccactgccctgggcaaaccagcttcgactgaacgtcagccagtccagagagtaattaaaagagttaagtctcaaaagtaaatctccgggaagagccctcagtggtttcagacccccaggcacttgtcctcgtgccctccctgaggcgtcctgtcctactggacatgctggagcctgcccgtgtccttgtggaccatggaatttgcccggggttggggggcaggggtggagagaaataaaacttcctgtgatctatgtatcggcccagtacatagatcctggatagaggcgattgagctaagcatgggaccaagcatttctgtgcagtgcctgcagaattgagtttccttctggctatgggagattcttctgagctgtctcagttgtctgacatctggcatctgccatgggccaggacgtctggggcaggggcagaagaggacaggaggagactgccctagaggattctgggaaaacgggaaaacagcaaaacagagctacccaccaatctcaggctgatgcattattaataaaagtgactgttgactgagtttgtagacataatatgtttgaggtacctggcctagtaagcaccatacaagtgctattatttctaaatgattttatcaagataaaagacaccagccaggcatagtggctgccgcctataatccctttgggaggtcgaggcaggaggatctcttgagatcgtaagttggagaccaacctgggcaacatagcgagtccccatctatgcaaaaaatttaaaaattagctgggcatggtggtgcacacgtgtagtcctagctcctcaggaggccaaggcaggacaatcccttgagtccaggaggtcaaggctgcagtgtgctgtgatcacaccactgcactccagcctgggcgacacaaggagaccctggatctaaaagtaaaaatgaaaaaaaaaagaaatgaagcagcagggcgtgatgactcacctttaatcccaaagctttgggagggaagatgggaggactgcttgagctcaggagttccagaccagcctgggtaacatggtgagaccctatctctattaaaaaaatataaaaattggctgggcgcggtggctcacgcctgtaatcccagcactttgggaggccaaggcagccagatcatgaggtcaggaggtcgcgaccatcctggctaacactgtgaaaccccacctctactaaaaatataaaaaattagccgggcgtggtggtgggcagctgtagtcccagctactcgggaggctgagtcaggagaatggtgtgaacccggaagtcggaggttgcagtgagccaagatcgcaccactgcactctagcctgggtgacagagcgagactccgtcttaaaaaaaaaaaaaattaggccgggcacggtgactcacacctgtaatcccagcactttgggaggctgaggcggacagatcacctgaggtcaggagttcgtgaccagcctggccaacacagtgaaacctggtctctactaaaaatacaaaaatcagccaggtgtggtggcgggcacctgtactcccagctactcaggaggctcaggcaggagaatcacttgaacctgggaggtggaggttgcagagagccaagatcgagccacttcactccagcctgggcgacagagtgagactccatctcaaaaaaaaaaaaaaaaattaggcgtggtggcttgtgcctgtcgtcctagctacttgggagactaaggtggaaggatcaccctagcccaggagttcaaggttgcagtgagctgtgattgagccattgcattccagcctgggcaagagtgagaccctatctccaaaaggaaagagagaaacgaagtcctgtccctatcagcagccactccacatcctgcaccccagcctctggcactacgcgtccccttcctgtctctgaattatcctgttctagacatttcttagaaatgggatcacacactgtgtggccttttgtgtctggcgtctctcactgaatgtggcgtcctcaaggtgcatccacgctgtggcctgtgtcagagcctcgctccttttcatggctgagtatgtcccatcgtgtggatgggcgtttgtccgttcatccattgaaggcgtctgggctgcttccaccttctggctcctggggacatccgtgtagaagtgatggtgtggatgcgtgctcatttttcgggcagatacctaagagtggcgtggccgggtcatctggaaactcagtgaagagctgtcaggcttttccaacatggctgttccatcttacatcccaaccatgatgacggtgtgttgggttgggtgcttgtcatcctgtagtgtgacctcatgtgacacacagggcaacccattggtgggtgtccttatgtcctggagaggatgagttgccggcgcttgtccatggcaggctgagagcagagccccgtgtctgagagcaggtctgtgtttacctggctgccttgttgcgagctctccagtcgggttatgcccaagcagctgttagggcctggccccagatcttagaacgagaccccttcccagtctggccctgctgctgtaaccccaaggtggaagaagattgcttttagggctgtccctcacatacctgttctccgtggggtcttttctcaagaatgtgacctaaattccatgtctggaatgttctggacatgtgagccatcctcccagagccggggcccaaagccctgtaggtagtagcgtttgtacccgaactcagcgtctgctgtgcctgacgctgccagggcctacggtggggaggattcagaggggaccggggttgggggtctggagcaaggatccgatgtggaggctggggctagggccagggtgtgaggatcggggccagtgctctgggtctggctggcgcccagatctaggggccagttgtggggtgctggggtctgggatgaaggtctggggtcacgccagggttggggtctggggctggggccagggcctgcctgggtttggggtcagggccgtgttggggtctggggctggggtcgcgacctgaagctggggctgggactgggtttgggtctgcggccgaggcctgggtttggggtctggggtccgcccggggcgccgaccgtcccgcctccccgcagcccgagcgggaagaagttccgcagcaagccgcagctggcgcgctacctgggcggctccatggacctgagcaccttcgacttccgcacgggcaagatgctgatgagcaagatgaacaagagccgccagcgcgtgcgctacgactcctccaaccaggtcaaggtgagtggtggcgtcacgcaggtgacgtcggcgcggggcgttctaggcggggacgcggccatgacgtgagctgcaggcgacacagcccggcgtcctgagcgcaggaggtcacagcgggcggagggcacagagcggaaggcgcaggccacagggtgcagagcgcaaggcgcatggcgaggacgcggcccgcggcgggcgttccagagccggccggaccgaccctgcgggagcggcctccccggaccgtgggggtcctggcgggcgcgggggacacgaggggcgccggcaaagcagggggtcacccgggccccgcaccccctgaggctccgcgccgccggggcgcccccaggccggactgcatatccttcctcccgcagggcaagcccgacctgaacacggcgctgcccgtgcgccagacggcgtccatcttcaagcagccggtgaccaagattaccaaccaccccagcaacaaggtcaagagcgacccgcagaaggcggtggaccagccgcgccaggtgagctcaacgcacagcgaccccagccttcccggccgggttgttcactttggtgggtggacgtttggaatgaggtcgtacgtggagcggacgtagtgagcgcaggagttccaggctagcctgggcaacatgacgaggcaaaaaacaagtaaaaaattagctggacgtggtggcgcccgcctgtggtcccagcttctggggaggctgaggtgggaggattgcttgagcccaggaggctgaggctgcagtgagctatgatcacaccactgcactccagcctgggggcagagcaagacccagtcctgcggtcccctcttggaatgtgcagggtattggtgccaggatacgccccaccctcaacccccagataccaaaatctggggatgttcaggcccctcagaaaatggtctagtatggcctcacgcggtgactcacgcctgtaatcccagcactttgggaggccgaggcaggtggatcacctgagaggtcaggagtttgagaccaggctgacccaacatggtgaaaccccgtctctactaaaaatacaaaaattagctgggcgtggtggtgtgcgcctgtaatcccagctacccgggaggctgaggcaggagaatcacttgaacccgggaggtggaggttgcagtgagccgagatgacaccactgcactcctgcctgggcgacagagcgagacccggtctcaaaaataaaataaaaatatttttaaaaaatggaaatggtctaatgtttgcacgttacctgcaggtattttctagcttgctcatgaggtgtggatgcttgtgacgttccttgtgtgtgttttattcatttttttaagtttttcactttcgagacagggtttctgtatgttgcccaggctggtctcaggctcctggcctcaagtgatcctcccaccttggcctccaaaactgtggggattacaggtgtgagccaactcacctggccagttgttgtatttatttattttttttccccccaaatattttcagtctgccgctggttgggtgtgtggttatggaacccacagatacagggggttgactgcccatatgtgactgtgtaacctacttcttaaaaacctgagaaccgtgtgtattttctttttgttttttcttttttttttttttttttttgtgacagagtctcgctctgtcacccaggctggagtgcagtggcaggatcttaactcactacaacctctgcctcctggtttcaactgggttcaagtgatccttccacctcagcctcacaagtagctgggatttcaggtacccgtcacaatgcacggctaatttttttttttttttttcttttttgagatggagttttgctcttgttgtccaggctgtagtgcaatggtgcggtctcagctcactgcaacctccacttcctgggttcaagtgattctcctgcctcagcctcccaagtagctgggattacaggcgcccgtcaccacaccggacttttttttgtatttttagtagataaggggtttcaccatgttgaccaggctggtctcaaactcctgacctcaggtgatccacccacttcggcctcctaaagtgctgggattacaggcgtgagccaccccatgtgtattttttattcttatttacaaacgtccactggatccctggctgtggaaagcctgggcagggtctggagacccaaggcagtgggaggggagatgccccattgggacccacatggggcaaggaggccaggtgggcctccctggagcccagcaaggacctggagtggggagagggcagggccactcttgaggttcacatatgtgtctggggcagctcttctgggagaagaagctgagcggcctgaacgccttcgacattgctgaggagctggtcaagaccatggacctccccaagggcctgcagggtgagcgggcaccctgaggggaggcggaaggggatgtgccgggtggggtggaggtgctgcaggtgccctcatctcctggcagggtggatggctgttcctgctttgggtgcttagggcaaatctgccagcgactggggcaggaggaggggacccagtggggttggggatgggtaagggcgcttgggctgggcccttcattcttgaccttggagaccctgcgggtggggctttgtggcttccaggtgtggcgcaggcctggggctgttttcacctgcaggacgtgcagttttgccatggagatcctaaataaacaaacaaggacagctgactttgcttctgtactctcccagcacgtccacaccacagaacaaagaatgcagctcttgcatggttttggtggttgttttttgagacagggtcggctgggtacagtggctcacacctataatcccagcacttggcggggctggggcaggagtttcacttgatctcagaagtttaagaccagcttggacaacatagtgagaccccatctctacagaaaatacagagcaaggccaggtgcagtggctcacgcctgtaatcccaacactctgggaggccaaggcgggcggatcatgaggtcaggagatcgagatcatcctggctaacatggtgaaaccctgtctctactaaaaatacaaaaaattagccgggtgtagtggcggccgcctgtagtctcagctacttgggaggctgaggcaggagaatagcgtgaacctggcaggcggagcttacagtgagccgagatcgcaccactgcactctcctgggcaacagagggagactccgtctcaaaaaaaaaaaaaaaagatacagagcaagaccccatctcaaaaacaaaaggcagcctctccgtggcccatgctgaagtacagtggcgccgttactactcacagcagcctctacctcccgggctcaagtggttctctcagcacagcctcctgagtagctgggaccacaggtatgcagcgtgacacctggctaatttttgaattattttgtagagacaggagtctcactgtgttgtccaggctggtctcaaactcctaagctcaatcagtcctcccacctcgccctcccaagatgctgggattacaggcgggagtcgccacgcctggcctaacttgcttttttttctgttatgaatgtagtaacacaagcgggagagggaatttagaaatggaacccaagttggggttccttccaagaaggtggcagctcccattcttggggcatttccgtggcctgtctgggccacagctgccccgtggtgacctctccacttgcggctgtttgtccactgcctggcaggggtgggacctggctgcacggatgagacgctgctgtcggccatcgccagcgccctgcacactagcaccatgcccatcacgggacagctctcggccgccgtggagaagaaccccggcgtatggctcaacaccacgcagcccctgtgcaaagccttcatggtgaccgacgaggacatcaggtagccccttggcctggtcccctgctgctccaccctgtctcttgtggccgtggggaccctgagtgtccccgtgtgcctgcgtgcttcccgtctccccacgatgctgctggggttttgaaacagaaacagccagggcaaggggacccatcgtcggagcagtatgaaccgtttcacccgcgtcctgggttcagggcgagccaggcaccccttggaggaatgttcttgaaaagagtgtggtcctttgagtccgtgaggactggctatgctgggtgctgggctccatgttgggccctggagacggagggacagggcaggccaggagtctctgccttcagggagatggctctgggtgcctgctgaggggcagttctgatgtgcagagcctcggaacgaacagcagggaacacggccgctcagaaacaggcaacagtcaggtgaggctgagcagcccaggggtgagcggccctcctgcggggcctcagggccgaacccacttccagtgtgcagagtggacgcaaggccgcctggtgacggaggcgcctgcaggaaactctggaagtgctggagcgaagacgggacctttcacgttcagtgcagcacacggcttaggtcagaggaaggaaaggaaacttgacggttccagaaagaaggagccaagacccggaacggccagggaggcgctgggcatgcgggtttcctgtggcagcagccggggttaaaggcccctgggcacaagaagagaccctgtgcccccacacagggtgaacagatggacctgagacgccacccccacaagcacacaaactgtgggcgccaagggttccatccggagcggctggcggcatcctcctccggccgtggtacctctgggccccctcttttgggtttgaggtccatttacactctctgcgcgctcagagaacttcccgaaatgaagatggtgaaataggaagaattgtcaacaaaagaaaagaacaagactgtgaaaaatagcagacagatcattaaaagccctgcagaacttgcagaaataaggccgggcacagtggctgacgcctgtaatcccagcactttgggaggccgaggcgggaggatcacctgaggtcaggagttgaagaccagcctggccaacatggtgaaaccccgtctccactaaaaataaaataattagctgggtgttttggcacatgcctgtagtcccaggtactcgggaggctgaggcaggagaatcactggagcctgggaggcggagttgagatcctgccactgcaattcaacctgggtgacagagttaaaaaaataaaataagaacttatagaaatagaaaagggcattgaaatgaggaactcggtggtgggttccgcaggaggtagggtcctgtctggaaagatgacgagcaggtggtggctgcagtcgagtaggtgagccagggtgttccgggtggtggggacagagtgagagggagcagctcaggtctgcaggagccgctggagagagaccccggaggcagggggcggctgagcctcggccacaactggggagaaacaaagtcagctttgcctgggactgaaagcagaacagagacgggctctttgggcagccggagagggaggtgggcagaagcacgtgctgcggccccggaggcggcaggcagaggagcggccaccctggagtgcctggcatcagcttgtaggccccgaggaggaggccccccatccctggtggtgggttgagacgagggtgtggattctttttctcaggccgcccgagccatggtaaaggagtacacgctggtgcatagtgggcagcggaaaggtgacccccggcctgcgagggtgggggctgctgcgggctgatggtagctgattttggtgaggcttgcttttttttttttttttttttttttttttggcagaatctggctctgttgcccatgctggagtgcaatggcgccatcccagcccactgcaacctccgcctcccgggttcaagtgattctcctgcctcagcctcccaagtagctgggactacaggcggccgccaccacgcccagctaatttttatatttttagtagagatggggtttcgtcatgttggtcaggctggtctcgaacgcctgacctcaagtgatctgcccacctcggcctcccaaagtgctgggattacaggcatgagcctctacctggcctggtgagggttttcctgccccactcagtgcctgtcaagggacaggagcaagggtttacacagctgagccccggggaggctcagggccaagtctggggactgaagggtcaggcccctcccttggtcccagtagaggtggcaggggggccatctgggagggtggcggacgctggcgatggccagcggcagccggtcattctctgcgtggattgtgaagggaggggtggcacgggccagggctggtcctgggggggtgcctgtggatccctcgggcctcccctcccagctgaggtccccacgttcatcctgtgtccatgtcctgctggccgctcaccttggtgtaacgcaaggtccatgtgtccccaggaagcaggaagagctggtgcagcaggtgcggaagcggctggaggaggcgctgatggccgacatgctggcgcacgtggaggagctggcccgtgacggggaggcgccgctggacaaggcctgcgctgaggacgacgacgaggaagacgaggaggaggaggaggaggagcccgacccggacccggagatggagcacgtctagggcaggtgctgcggggccacgggggctccctggagtcgggtcctggcagtggggactgcctggtgaacacagatgtgcttgggatgacgggtgcctcccaagagcttcccatctccctagaagagcccaagcgtccccgtcccgtggagtcgctaaagccagccctccctgtcctttccagaggccctgccgagagcccgtgctgcctgctggagccgcctgcagacgcggtcctcggccccacgtgaaccaggctcggcggcgaagcccagccttggagacacccaggaggaaggccgtgctcctggctccctcctcggcccgtccccacttcccggggcctcggggcacacagctggggctgcccccacccgaaagaccctccacgctcgtcctctacagagtccggcttcgggaagtgccgggtgctcctgggccctgcctggctccctacgacctttgggctcgaggccagctcctccccatgcccgctgtcccagctccttgagactggagagcagccagcaggtgcccggcagctcggcgccacggcttgctgacagctgggagggtttctcggtctggaggcgtagttttgaaactcacatcacccactgtgcagcgtgaggacgggactctggtctgctgtggggggcatgcaggacggcgccactctctgccctgccatgcggctggtggtgccacagagcctcaccgtgcctgagtggcatgcccaggaggccgctctccttcagtaaatgtaacacagtcgaggcacgtcatcgggcagccttccctgtgtgccaacgccagccttcgcttctgaaaaccaaactccagccgctgccagtcgggacttggtcgcccggcgctgccagaatgctccactgccagccggcccccctgcctcggtttcccttctgtttagtggcgacacaggcacccagctttggggtggtgctgacgctcccaggggtgccaggagccactgggacagggtgaggctcccagacgctcctcgaggtgcccagctctccagggagcttctggcccaaggccgtctgagggatctgctccttaaccccccagtgccttggcgagggcaggttccaagccacagacgcctgccccgagtggactctgcggccagtccctggtgccctcctggccctgctgcccagtgagggctcctacgggtgggttcattggcctgggcccagcgagcccccacctgcattgaccttaggcccatagagagggcctgtcccggtgctgccccagccaggatctggtcgctgccccagggggactgatgggcagagtcgcccctgtggctggactgtgaccatccctgatggggcctgaccgcgggagctgaggaagcgccgctccaccgtctgccctccaaggacccgcatggaggcagtgggctggcagcttcctgctgctccctgtcagagtcaaagcacaaatcctcaggacgggctcaagggccagggcagccgagggaagctccaggtggggaccacgtcttcctgaggttggtgcccactggctgggaccctttgcagtggggtggcctcccctctgtctgcctggtggagggagccgtgggcgtggggacgtgactgaataaagccaccatgggtggatgtgcttggagcctggagttcggtgcgtccgctagactttggtgcccacgtttgagcttctgtctttggttgggtgatgaaaggctgaaagcggtgtggggacagggccagcaggtcccccaacctcgcggacattcacaacccaagagtcaggcttaggggtattcagagaagaccaggccggcctgggcatctgtgggcaagggccgtgccccctgaggtgccgctggctcagcctagggatcgtgggtcttggccctgctgccccggtgaggaagatgggctggggctcagacccagcaccgctccttccaaaggaagggaagcaggaggggctgcctggcagggagggccccccaggtcctcaggtcctgcacagccgctgcagggaggggagctgtgccccgggaccctggacttcagctcactagccatggccactggaagctgctttctggacctgaaggctgggaggccaccctcccctcatctgcccggcactcagagacactctgtttccctcttcccatctcccactgtgtccctgtctcccttggtctctctctgtctctgtctatccctgtctctatctctccctcttgtctctctcttgcgccgtctccctctctgtccctctttgtttcttgctctctctcctgtctctctccctcggtctctgtctctgtctcttgctgtctctccctctctgtcgcagcccagcttcctgtcactgacagaccccgatcagtccctctgatcccggggttctggccatgtcctggccttggtctgagatgtgatgatccctacccctgccacagggccctccccactggaagcccatccaggccctgggctgtcgctgttgacgaagcttgagggtcctttcctctctccctgaaaccttggggacccccacaggccaaggcaatactggcctttgctagaggtcgtgcccggtgagaagtgagttgtaggcgtgggcacctgaggggccagcccagtgctcaggccctcgtcaaattccctgccctggaaaagtctcagaccctcaggctgaaccccctgggcgcaccgaggctccacactccagccccagaacccagacctggcatggggcggggaagcctgagctcccaatgctgggatctttcgtgggggcctcatgaccagcctgccctgtgcggtgcctggccccatcctcaaaggccacttggctgcccccagccccgcccatgtctcagccccaagaccttctgggactttttttttttttagacaagagtttcgctcttctttcgctcttgttgcacaggctggagtgcagtggcgtgatctgggctcactgcaacctccaccttctgggttcaagcctcagcctcccgagtagccaccacgcccagctaatttttgtatttttaatagagacagggtttcaccatgttggccagtctggtctggaactcctaacctcaggtgatccgcccgccccagcttcccaaattgccgggattacaggtgtgaaccaccatggcagcccttctggcacttgccagcagcagcaagagcctcacgtgtcccccgcctcccctcagaccaagctccccaccgctgccgccacagagggtaccagggaggagaggctcaggacccccgtggcgaggatgcacctcccagccctcggcccagccacacggaccacagggctcccgagtctcagcaacaccagctaaggggcatcatgcctctcctgccacacccagggcccgtgccttgctgtccctgcagcccccagacccaggcagacagggacagcccttctgaccaccgcacacactcgccaccgcaaagatccccggggatgcccctcgcctgtgtgtgtccctcatggctgtcacagcaaatctccaggagcccggaggtgcccatggaaaacacccccagcttccggaacgttctttcggacagggccataccggagcaagactcagctttctggtagcgggtgg

SEQ ID NO: 12310 - DNA, 74550 bp, Human
tttgatctacagccttattagcacagcatgaaaaggtagaattttccaaaagtatacctgttcccatctgttgtctcaactacctgtctcaattaccgtttctactgagatttttgctcatgtttaccctttactttcaattatgtgtgaaaatcagagtactctcttatgtcatacaaactttaatatcatttttttcctttattccttcagtggaaccttaagtattggcattcctcaagattcagttcttgatcctctttccttttattattaaccacgcaagcccttccttggagagcttacttacttccagggcctccttcaactgtcactttcacaaatgactttttttttttgagacggagtctcgctcggttgccaggctggagtgcagtagcgggatctcgactcactgcaatctccgcctcccgtgttcaagcgattctcttgcctcagcctcccgagtagctgggattacaggcgcacgccagcacgcccagctaatttttgtattttaatagagatggggtttgaccatgttggccagaatggtctctatctctagacctcgtgatccgccggcctcggcctcccaaagtgctgggattacagaagtaagccaccgcgcccggccacaaatgacttctttttttttttttgagacagagtctcgctctgtctgccaggctggagtgcagtggcgtgatccagttcactgcaagctccgcctcccgggttcacgccattctcctgcctcagcctccggagcagctgggactacgggcgcccgccaccacgcccagccaattttctgcatttttagtagagacggagtttcatcgtgttagccaggctggtcttgaactcctgacctcaggtgatctgcccgcctctgcctcccaaagtgttgggattacaggcgtgagccaccgcgcccggcccacagatgacttctaaatgaatgtctccagtactgatctcctcagaactcatttcttgatgattttttacattcacatttctaaatttcttgtaggaaaccacaaattagtgtctttcaactaaaggacattaaaagaagactaaggtcaggtttagagacagacaagtttgtgtgtatgagttaatgtttgcatatactgcaaagataaaccaaattaattttagatttttgttgctttatattaatcaactttttctatacgttaaacttggtcctcagtttttagggcatatgagtatagaaacccaagatagcttatcatcaggctgataacatgtgctttacatttttcaatcttccaaatatttcataatatattatcttgaatatcaatagcacacttctataagtgttcgacaacttatagaaaatatgcatttctaaaattcaagttggcagaccgaaaagaataccacacagtttcctaaaggcttgtgacagtaagttaggctggactttcaacataatggaatatttaccaaataaaaggccactgatttttgtattagacaaagacatctggaaatttctagatggatttagggattctggtcattctaaggagaatctagaggtaagccccatctgactcatgggcatattccaagttatcatttcctttcctacatccttacaaggttccaggagaatctgtcaatggctctgaagccaggctcaggagggaactggtattcagcgaatgggacactttgcttcattccttcattataagctcccctgcaagctttgtgcagaggggcgggaaaaggggctatcacccccttaaatgaatagccgagttggtatgtaatataagatctattttgcttgttattcattaattgggaagcaaacataggtaaaatcacataatggtggaggttaccccgtttgaaacaaactaaccacagtcactatgacacccccagctggtggctagcccgaccaaccttcccagctccgcgcgcccagtgggggccggaaaagcgcgggagggggcgtggccccgagaaggcggagacaagatggccgcccatagcgcttggaggacctaagaggcggtggccggggccacgccccgggcaggagggccgctctgtgcgcgcccgctctatgatgcttgcgcgcgtcccccgcgcgccgcgctgcgggcggggcgggtctccgggattccaagggctcggttacggaagaagcgcagcgccggctggggagggggctggatgcgcgcgcacccggggggaggccgctgctgcccggagcaggaggagggggagagtgcggcgggcggcagcggcgctggcggcgactccgccatagagcaggggggccagggcagcgcgctcgccccgtccccggtgagcggcgtgcgcagggaaggcgctcggggcggcggccgtggccgggggcggtggaagcaggcgggccggggcggcggcgtctgtggccgtggccggggccggggccgtggccggggacggggacggggccggggccggggccgcggccgtcccccgagtggcggcagcggccttggcggcgacggcggcggctgcggcggcggcggcagcggtggcggcggcgccccccggcgggagccggtccctttcccgtcggggagcgcggggccggggcccaggggaccccgggccacggagagcgggaagaggatggattgcccggccctcccccccggatggaagaaggaggaagtgatccgaaaatctgggctaagtgctggcaagagcgatgtctactacttcaggtacctccctgggggcggggagggggtggcggggtcaggccggggtcaggggtcaagagcgggcctgggcagaggatgagcgctggggcccggggggcatgtggcagggacaggctggtttggtggtggaaggtggcggaacccttgggtgagagttgaccccagtgcggtgggaggcagtgtcaaaaggtgagggcccgcaggagggcatcttatgtggaaggcgtcggggaagatggtttgcgaagaaagggttagcctggcagggatggttagtccactgaagggttaaaaggaggtgtaattcatcgaaactataaaacccagtcactgttggctcctgtcccagcctgtcccagattcatcatcacaagtgttaagcatgcacatgtggaagaatgagctatctacagtaacaaggtttcatttacttcatccaagaaagttttgtataaagcagctatttggaatgcctgaagtttttttggaacttcttggtattgcagaatatactcttttgaaactgacacactgtactaagtttttagactcctagaccaaaatttgctccccagggaacatttgtcaatgtctggagacattttcggttctcacacctggggagggtgtgatactggcatctagtgggtagaggccagagatgctgctacatattcgataatacaaaggaaagctgccacaacaaagaatgatctggcccaaattgtcacctgtgctgaggttgagacatcctgttttaaatgattcaaggtttttcaccttagtgtaatcttgcaatcccgtggtcatgctgctgatgtcttcagtttgtgtgacccagtaagctcaagaaagtgcctatggcaattgacatccgtggacttaatacacatttactaaattttgtaataagccatgctattgatagaagataatataaacttgtattcagtagtttggaggtacgtgtttgtggactgactgaagcatttttcagggaatgtatatgggtattggagacaattgtcatttagctattgtaataatgttataaaggatttcctgtcctcttcaagtagctctgggaaaatgtgtctgtacacataccatgcttatgaactaaaaatacttttaactagattgaaaaggttaaagaaatgtacatacacatatatacatacatatgcacacacaagaatgtgatcactgctggtgcagcatgtaaatacgaacacattcctgatggttgctatatatggatgagtagttgtagtaagttcacttcacctcaactaaaaaataaaagtgatgtttcatagaacttagtcttccacttgatctggaccctcatcttgaaacctcatatgataaaatggagaacttcttttaaacataagaaggtagtaatcacctgtggtcccagttacggggctggggcgagagaatctcttgagtccaggagttcgaggctgcaatgacctatgattgtgcctgggcaatagagtgaaaccccatctctttaaagaaaaaaaagaaaaagtgtgatagtcttggtttgtatttcctcatcattaaatatttgatttaatggtaagaaagttattgtgagcactttcacaggtcctccctcaggctgtggggccaggatttggtagctggtgctgagagaaaacctttgttggcatccttgccctgggactgtgccagtggcagctgtcattcaatgggacaatttcttctgattaaaaaaaaaggttattgtggttaaaaaaagattagttttctcaagttcattagtttcatttagtgccgttcacaattgttcgttttctagtattctttcattaacagagcattctgttttctttctaagcaggctgtctgcataaccttctgtgaactatgtgctgatgtcttgtaggcaattatatttgacaagattattctgtatctgtgattgaactccttgaggaatagatgactaggctattctcagtagaacatcttaaactttgaattttactctgtggcagttctcctgggatatggtttgtttggttttgggatgatgtttttgttcagactgactttgggtattgcagagctttttgtttgttggttttccttgtagttggaaaagttatttcaagaagtcagattgttgtagtgctcatttggatttgtggccacttaacattttcttggatgttgtgtaaattttctgatgttaaatttattttattttttttgagatggagtctagctctgtcgcccaggctggagtgcagtggtgcgatctcggctcagtgcatcctccgcctctcgggttcaagtgattcttcagcctcccaagtagctgggactacaggtgcctgccaccatgcccggctaatttttgtatttttagtagagatggggtttcaccatattggccaggctggtgtcgaactcctgaccttgtgatccacctgcctcggccagtgctgggattacaggtgtgagccaccaggcctggccattaaatttttaaatacaaacttaataattttttttttttttgagacggagtcttgctctgttgcccaggctggagtgcagtggtgtgatcttggctcactacaagccctgcctcctgggttcacgccattctcctgcctcagcctcccgagtagctgggactacaggtgcccaccaccacgcccagctaattttttgtatcttttagtagagacagggttttaccgtgttagccaggatggtctcgatctcctgacctcgtgatccacccgccttggcctcccaaagtgctgggattacaggtgtgagccatcgcgcccggccccgatatgatcaatttaaaacaaactttctaaacaaattcatcttaaggcaagtcgtaagccactatagtggtaattgctctctaaaatgaaagtctttttctgggacattgcagcatgatttgccttttacttgtttatgtaaaatgggaaggacacattgaacagatttgtgccaaacctgtttcattcagggccaaaaggagcattgtctgctgtttattaactgtctacagaggttccgttactttgcaggattgttaacaaccagtcttgtttttcttctgaaacgttacattctgagtcagtaaggtgtatgtagcgtaatatgataattgtgatacagtagttaatttgacttgtgactgtagctttctgtgatgaatgatggcagtcacttattgtaaaggaagacaaattatttttcagcttacagtgtcactgctttacatattagtgtccccatatttaaaaattccattagttcaccaaacacccactatctgctaaaagtgggttaagagttaattctcctgttggtaatgtgaacacctgcacccaattgttcacacagattctaataatactaacccttgaattagcctgcccctggggagattaatttaaacaaatctgtgcctgttaatgtagggtgtggcaggcacttattaattggactgaaattaagctcatcgagaaagcctcaaattttggtagtatgttttttgggtgctgttttgaaactgccaagttctaataggaaggcgtgcccctagttgccagttaacgcaatataattatgccttctgtcaggattactgatagtgttgtggtggttcatatattatcatctagtgtgtttgtttaaaagggtgtggtttgattggatccattggtatattttctgaaaaagtttgttgccatcatttgaacaataactttctaacttgtctacttgactcctgtcatttctagttgcttgcataacacttgctgattgatatttttgagatattttcttcctcacatagtcttttagtagccccctcttgccttttttaaaaaaatcaagtctaggtcggtcgctgtggctcacgcctgtaatcccagcactttgggaggctgaggcgggtggatcacgaggtcaggagatcgagaccattctggctaacatgatgaaaccctgtttctactaaaaatacaaaaaaattagccaggcatggtggcagatgcctgtagtcccagctactcgggaggctgaggcaggagaatggcgtgaacccaggaggcggagcttgcagtgagctgagatcacgccactgcactccagcctgggcgacagagcgagacacagtctcaaatatacatatgtgtgtgtgtgtgtgccatttgttgctaaagactagtatgatgcttcaagagcatgaattctgaatcactgaggttcaaccatgctcctcccctcaccttggtttgcctttaaaaacaaacaaacaaaaaataaatggaccctccatgtagtatctagaaaactgactgagtggacccaggtaagcaatgtgactattgtcatagttcttacatatttgtgttaaagtcttcttggattccaataaaaagccttttctgatattgtcttctttctcataattcctatgtagttaaacttggtgtcccttgtataactctcatattcatttacttagaacttgtggctttctcacatagctgtctttcccctcgacacaatgccaaacactcagatgctaaataagggtttaccaattgatattccacctaacgttttgtaaaacaagccttaaaatgactttgtagtttttgctttatttctgttcttgtggtggtgtgttgggataaaattggttgaggtattttattaataaggctatgcattttgtagtttctaattttcatcatcagtgtgaaggtactgtggaaagcctttttctggaattttgaatattagagatacagtgaaaatggtaaataggttgctcatagtgcacagacacaagtgagaaatcggcatttgaatttcatcgactgtgtaacatcgggtatagtagtgtagggtcttctgtgccttaattctatgtgtatttgtgttacagctctcagaattttggcacctattagtagtattttgctaaatgctttacatgagctatcatactggatttttttttttttttttgagacggagtcttactttgtcacctaggctggagtgcagtggtgcaatctcagctcactgcaacctccgcctcctgggttcaagtgattgtcctacctcagactcctgagtagctgggattacaggtgcacaccaccacgcctggctaattttggtatttttagttagagacggagtttcaccatgttggtcaggctggtcttgaactcctgaccttgagatccacctgcctcagcctcccaaaatgctaggattacaggcgtgagccaccgcgcccagcctatcatactggattcttataaccctatgaaacaggtacaattatctccattttacagattgggagttagcaaagggaagtagtgtgcttggggttgtacagctagtaagtgcaaagatacaacctgaagctggtggtttaacctcagaactcctaaccaccatgctctgttgcatggcatagagatccctacttgtattctcaaatattgcaacaccccatgtctaatctactttattgggcttagtgtgccattgagataatgtgattatttactattacacttgtatcctgaagatgtcaaagggtaaattttaaatcctatttggtagtgaagctattgtaccaaaggataaccctccagctttaaataatcctggaggggaaaaaaatgtaataaatccacataattaaagcagtattgttctgagtaataaaagtgatcaatttgttcagaaatattctctctttgataaatgttcaacctaggattaaccctgttatttctcagatattgaggtttgagatacagttgaaatataccgtacagatcaattttttaaaaatctctagttagagaaaggaaagaaatccaatatttattaagagcttaattgcataatagaaagtttggcttgctttaagtcttttctcttgatgttgtgtgattgaagcctgcacccagaaatgaaagacataggtgtggtggagattgtgctctgatatatcttccttagctgtactatcacatctttttgtgagataccaaaggaatttttgttagggtgcagcattgctgtctgtcctacatctgatttttagaatctgacatgcaaagtctcacctgccgcaacacccacaatacttgtattagaggaaatacatagctcaaaggaactgatgcatatacattctaaaaataatctccaacagaaattggtagattttttcacattgcttttaaaaatttagttaatgagatatcatcatttttttcataatttagttttaatggaatgttaaaggaagtgatgctttttttgattttggtttttagattctatagtggggctcatagaaattcataacttttttactcatgtttaaaatcttctcaagacatgcatgatgaattagaaataaaccataaactcttcctggatttagtgtttggctgggaatcttaatgcctcttacagctcttatgtattgatctttcattgttctttgccatttccagtgagaaacgattaggaaaattttgtaatatggtgttttacttaattttatcagaacttctaaaaactaaaacttcccaaggaaggagaataaaaatatggaatataatgaagtttgaataatatctgcagatttcatgatttcatcctgtctttgttctcagtataatacaaattcaaactcattttgggaacttgatgtacataaactctatgtgaatataaataataaaatttaaaattagattttaaaattgaacacttcgcatttctcaggagtaatcgagtgttttacagatgtgaggaagaagaacatcgtcccctttaattttttattttgttttgttttgttttgagacggagtttcgctcttgttgcccaggctggagtgcagtggcgtgatctccactcactgcaccctctgcctcctggattcaagtgattatcctgcctcagcttcccaagtagccgggattacaggcatgtgtcaaccatgcccagctaattttgtatttttagtagacgagatttcaccatgttggccaggctggtctcgaactcctgaactcaggtgatccacctgctttggcctcccataatgctaagattacaggcatgtgaatgctgagattacaggcatgagccaccgcgcctggcccatcatccccttttgaagatttttttttttgaatgctgtgtcttggtattcttttctttgttatttttatactggaagaatgcatggataagcaaggatgcgtgtccttaaaattctttttaacaggcattcatctcttttaaaaagcctttcctagagtcccctagcagaaatgggaaactcctatggcatttgagtattactctgttaactcttatcacatttgctttaagaaatagttggcaagtctttgttacccatgagattctgaacctcctcagtgtcaggagctgtgtctgattcatttttgaatcttcagtatccagcatagtccctggtataatatggaacgtttttcataaatcttcgctaagtgaagcaaacagtaaatacatttctctattaatccaaaaagttatggttaatctggctgtatacataggcctgactccccttataggggctgcagttaccagcatcctgccttgcactaaatcaggtatacaaatattgaatagctgaagtaaatgtaatttttttcctcaaacttgtgtgtgtgtagtgttgatgtatatatattacctaggcttttaggtctaaaatgatttataggacttttggtttcatttttaatattaaaattcttttatattttgcttgaaaaaaatctatcttcaagggctggatgcggtggctcacgcctgtaatcccagcactttgggaggccgaggtgggtggatcacctgaggtcaggagttcaagaccagcctgaccaacatggtgaaactccatctctactaagaaatacaagaaaaaattagccgggcatggtggcaggtgcctgtaatcccaggtattcaggaggctgaggcaggagaatcgcttgaacctgggaggtggaggttgcagtgagccgagattgcaccattgcactccatcctgggcaacaagagcgaaactctgtctcagaaacaaacaaacaaaaaaaaaaaggccgggcttggtggctcacacctttaatcccagcactttgggaggccgaggcaggcggatcacgaggtcaggaggtcgagaccagcctgaccaacatggtgaaaccccttctttactaaaaatacaaaaattagatgggcgtggtgatgtgtgtctgtaatcccagctactcgggaggctgaggcaggagaattgcttgaaccagggagttggagactgcagattgcagctagctgagatcgcgccactgcactccagcctggcagcagagggagatccatctcaaaaaaaaaaaaaaaaaaatctatcctcagaaattgcttttgtatcatcttgggaggctatgtttctatctagttttaactaatttattttttgttttgctgtaaatgtgaagcgtttgttcgagtggtctgtattaaaaaagaagagaaaaatgaagtaaaagtgaacatacaaaaaacatgttgcaacttcttagtaccagattcctgagtcacataaacttaccctgtcaagttaccatgacagtttccaaatgctttctctacacttgtggacttacttgaggaccagtaagtttgcacacagaccacactttggttgtcctggtttagaataaacaatggagacttttgagtcagaagatcggggcttgtatcttgctttactgtgttaatcttggatggataagtttttgtaagcttttgtttcctcaactataaatctagtgtaagaattctaccttgtggaggccgggcgcggtggctcacccctgtaatcccagcagtttggtaggctgaggcgggtggatcacgaggtcaggagatcgagaccatcctggctaatgctgtgaaaccccatctctactaagaaatacaaaaaattagctgggcctgttggcgggcgcctgtcgtcccagctactagggaggctgaggcaggagaatggcgtgaacccgggacgtggagcttgcagtgagccaagatcgcaccactgcactccagcctcggcgacagagcgagactccgtctaaaaaaaaaaaaaaaagaattctacctcgtggaaattttttgagattaaatgtgcttgccatgtgtaggtggttagtgcatcagtaaaatgttagctcctttctcttcgtttaattagccaacagaaatagaagcgcatgcttggtaattatgtgaaggtttactgtattttgttgtattctgaaatgtgattagggcagaccttaggttataaaggttcctcagagttttaaaaaaatattatgcataggtcaggtatgctggcacatacctgtaatcccagcactttgggaggctgaagcaggaggatcacttgaagacaggagtttgagaccagcctggctaacatagtgagactcctgtccctacaaaaaatttttaaaaattagctgggcatgttggcctgagcctgtactcccagctactctggaggctgaggtgggaggattccttcagtcgaggagttcaaggctgtagtgagccacaattgctccacgccactgcaacctgggcaacagagtgagaccctgtctctaaaaaaaaaaacaaaacaaagaaagaaagaaacaaacaaaatatatatatatgtatagtatgtatgggttataaaagtaacccctgctcagtgggaaagttgggaaaatatagaagagtatagtgaagtaatgacagtcattattatagtcccaaagagaactactgttttatcaggcaatgtttgttgttaaaaaaaaaaaaaaaaaagaaagaaagaaaagagaaccactgctaattttgacatagtagcttccagtctggtttttgggcatatttgtctaagtaaatattaatatgtgtgtgtatgtatatatgtaagatatatgtgtaaggatatatatgtgtatacacacacacatatacctacatacacacacttgtaattatggaaaagttcagacataggcaaaaatagatggaaaagtataatgaatccctatatagtcatccagtttcaacagttaccagctcctggccagtcttgctttatctgtattcaccccgttccccctagttatattttgaaataattcccaaacatacttaatttctgacagtgtcgtagcagtgtctagtccccaattcaaccaaaataaccagtatttttcttttttcctttctcagaaagcaaatgccttaaggatgagactaggtagaattctacataaattcattttttcgcattttagtggcataccctggtttttaattttttaaacaaatgatacagagcagtggtccccaactttttcggcaccagggaccggtttcatggaagacggtttttccatggatcccgaatggttttgagatgaaactgatccacctctgatcatcaggcattagttagattctcataaggagcatgcaacctagatccctcgcatgtacagttcacagtagggttcatgctcctatgagaatctaaagctgccactgatctgacacgaggcagagctcaggctgtaatgctcgtctcctgctgtacctcccggttcttaacgggccacggtcagtggccagggctagggcttagggatccgtgaaatagagataatactattagctatagtaatttactctaataaattttttccttatactttaaaaataatcccccccccccccgcccccataatccttccccacccatccccactgccaaggaatttttttttttttgagacagggtcttgctctgttgcccaggctggagtgcagtgatgtggtcatggctcactgcagcttcaacctcccaggctcaagcaatcctctcacctcagcctcctgagtagctgggactacaggcacgtgccaccatgctcggctaatttttgtgtttttttgtagagactgagtttcgccttttttgcccaggcttgtcttgaactcatggcttaagtgatctgtccgcctcggcttcccaaagtactggaattacaggtgtgagccactttgcccaaccagcaaattctttaatgctcaaattgacttgcccagagtcttgatattttttttttaaagctttcctattttggggggaaatcttcagctagcatacttaatgtttaaacaaaatagagaaattttcattcatacatacaaaagtagtgggaactacccagcttaaacaatttgtcaacacatagtcaatcttatttcatccccatcccaatttactactcctgacccaaccttcattatttgaaggaaatctgacgtcaagtaagttcattcataaataagtattcaatatgctatttgagaagatgtaacttgtgaaaatttctaccagtgcagaactcagtgtttcaaagctagaatgaggccaacaggcagttcatgattatttgcctaacataggcaataattactatatgggttcagaggaaagaaaattcctattactgggttctgtgaaggctttgtggaagaggtagtatataaggtggattggtatttctgggctcttggagactaggggtagcatcatgcattatggaccaagtagaagacatggtgcttgcaaagaactgtagaagccatttagactattcagaatagagtgattaaaccaatatggctggagcaaaggtcactaggtaagagtggaaagtagggttgaaaggttaagaggaggccataggaccaacatagtgaaaccccgtctctactaaaaatagaaaaaaattagctgggtttggtggcaggcgcctgtaatcccagctacttgggaggctgaggcaggagaatcgcttgaaggcaggagacggaggttgcagtgagctgagattgtgccattgcactccagcctgggctacagtgcgagactctgtctcaaaaaaaaaaaaggaggccataggaaaaaggatctaaaatgcaagcctaagatgtttggcttttttgcttatggggtaaaagtccactgaaagctgttaagccagagctgttgtcaaagtggtgttttaggaagggctatgtggatagtgtagaatgcaaagagacgagcaaagttagcttatcatagtgatttagacctgaggtgatgcagacttgatttgggcagtggcaatggaaaggaaggctgtgtttaaaggtgatcacttaggaagtgatcagacatgggagatatgaataaaataagagcagataaaatctatcagggacaagctgtagaggagtgctgaggatggtgcattgtaggaaaggcctacatttaaagattaaggggaaaggagttaaggaggtacagggagctgacttaggtagatttttctcgtgcgtgcttgcgtgtgtgcgtgtgtgtgtgtgtgtgtgtgtgtgtgtgtgtatagcaataatatacattcttttaatttggcgggtttctgattgttttgtatctaagtacaaaacaataattctaatttcatgtttttagtctcagatgaagtttgatttctgaagaaaattgttatttaaagttagggaaatgtttcgttgaatacttactgttgtaagtgagaagtaagtgttaacatttaaagagattttaaaaaatagaaagttggccgggcgcggtggctcacgtctgtaatcccagcactttgggaggccgaggcgggcggatcacgaggtcaggagatcgagaccatcccggctaaaacggtgaaaccccgtctctactaaaaatacaaaaaattagccgggcgtagtggcgggcgcctgtagtcccagctacttgggaggctgaggcaggagaatggcgtgaacccgggaggcggagcttgcagtgagccgagatcccgccactgcactccagcctgggcgacagagcgagactctgtctcaaaaaaaaaaaaaaaaaaaaaaatagaaagttgatgtttcttttagtctcaaacatttccagtgctatagcttacagaatttttagtgtggagatttttattattccccataaagtatttcctgatactgatgggaagtgatgtgcctctgaacatgctgtttagctatctagctagccatctgccatctgtgacaccccttgtcactcacaggccatttcatcttactccagtctggtgactgctacccccatcatgttagaaattgatttgaaaatagacttgtgtttatttagagccctggcctcataatggtttgactgaacattatgattatccatgttatcaaagaaacaagaaaaggtatcttctgctatattagagcggtgatttcagagtacagtttcacatgcaggcagcaggtcttctggagatgtaattttatgtcatagactggcagggcatattatagttgtctagctcaggtaatggtaattacaggtaagttcacagtgcgacaaaatatgagtaccactaaattaaagtgagcgtaatctgagtatttctggtttcaattactttttttttgttattttatttttatttttaagtgatgaaatgttcctatgtgaactggaaaaatacaattcatgttttgattttcatttaattagtatgtttcttcagggcttttttcagagtttatttaaatagtgggtagaagaagttaaaggtgtgatcacagttggttcaggaatggcatatctagggggcagttggtagggaatttttttttgtggttgaaagtgaaatagtatttcattactgggattagaagtaatcataatgggcagagagaactgaaaatgactaatatccttcactcagtcttctagagtttttgaacttccctaagttacaaattgatgcttttaaaataaaagcttagtcactttaagtcttggtgtttctgagaccaggacctacagcagccattattgagggtagacaggtgattaaacttaatcactttgggtaagactagaacttaggtgacagtctttttgttcatctagcatttatttcctcagtttgcctctcccagggtcagtttgctactgtacagatggtctgtatctcatctcatgggcagaattcctacttaatcattcccttgggccttgccctcctccatgtttgctttcacctcctgaagagtaaagtctctggcctaaaatcccctggggcagccaggttgactttccttaaagcaccacagacagactgtagcagttacggagaagaaaatggcttgtactactgttttctgaaggcagcagtatatatgatagatacttgtagctatccaatacagatgtttcatagaattccatctgtaaaacaggaaatggttattcattatgaataagaatttactggttactagtgaatattccagctttcttttggatatgctaatagttaaaacttctaccttttttccttcattgccaacttagtttattagtaaaggatgtctagcctttttgtttataataaataccttcctttttttttttttttttttttttggagatggagtctcactctgttgcccaggctggagtgcagtggcacaatctcagctcactgcaacctccgcctcccaggttcaagcaattctactgcctcagcctccccaagtagcagggattacgggcgcacgccgccacgctgggctaatttttttgtattttattagagatggggtttcaccgtgttgcccaggctggtctcaaactcctgagctcgggcaatccgccctccttggcctcccaaagtgctgggattacaggtgtgagccaccgtgcctggccccccatttcatttttaaaattaataaacaatagaaataatatgaagccgtgttaaactgctgatgaactgctaatctagatgataaacataagtgatcacatttcgtgagtatagccttttaattgagttcaaattatcttgatttgggggagagatctaaaatgaactggtctctaatgagttttgttctgtagaggaacattgtggtgaggctctattatgttttcagctgcagtggataactgacatttcaactttaagataaggaactacttattgcaggtttaatttgtgaagtttgtcaattgattccctcataaatagcttcctatttgtctctaagccataagctaagaacagtatgcttatctttttggtaagagttactgcctgagtatttcatcttctggaaaatgaatttgttgaaataaggtgtctactctagagctgttttttattgcacaaaagagatctatgtgagagacagctgattgagaattgtcattttattttattttattgagacagagttttgctcgttgcccaggctggagtgtagtggcgccatctcggcttgccgcaacgtctgtctcctgggttcaagcgattctcctgcctcagcctcccgagtagctggggttagaggcatgcgccacaacgcctggctaattttgtatttttagtagagatgggttttctccatgttggtcaggctggtcgcaaactcccgaactcaggtgatctgcctgccttggcctcccaaagtgctgggattacaggcatgagccaccgtgcctggccacagaattgtcatttttattttgtggattttgtgttttcatttttttgtggtatgttaactagtttatcagaatgtcgtttaccaataacttgagtatctgatatctgataataaggaccatatggctattgcagctttttgttgttgttgttgttttttgttgttgttttttgagacagactctcgatctgtcgcccaggctggagtgcagtggtgcgatctcagctcactgcaagctccgcctcctgggttcatgttattctcctgcctcagcctcctgagtagctgggactacaggcgcccgccaccacgcccggctaatttttttgtatttttagtagagacggggtttcaccgtgttagccaggatggtctcgatcttctgacctcgtgatctgcccgcctcggcctcccaaagtgctgggattacaggcatgagccaccgcgcctggctattgcagcattttataagtgacataatggcagagtaatgttactaatttttcatattaatttaggtcattagtaatactttatttcttatgtggtaaaacacattaatcatgaaaatattttctagcttagttttaaaaattctttgccatataacttttaaataaacaataatatttatcccattgtgtctgcaaatgaaaactacatcctttagtattgaactgataacgttttttgctctcagaaagttaccttgttcagtgctagcctataatggtgtttgaagtttaagagtggcattgttgtttgactcagcaaggaaatatataggaaatattgtaatgaaaatagaatttcgagtggtagtagattatttctgacttgaattgaagaatcccagaagacttcctagttgaggtggaggatattttagctgggcttggaggatttaatagctttttgataggcaggatgttgctgtgctcctccttccatctggaaagacatgactggaagattcaaaggtatatggcatattttggtgatttagagtttggaatgtaggctaccaaagctggtgggaaaagagtctgggaaaaattatataacagatataaagctttcgatgacttattaaggaggtgaagcttttttgtcaacattgaggagcttgaacatttagaacttggtactggatgtgtggctgagacatgggggcgctgaaagattgtgatgtggccttctagcttggagaataaagcactaagtggacagcagcgccactgacacaggtgcggaatatagaagatcaggttttggggtggaactctggtgggcagagatggttcaagtttcggacaatattgcgagtgacttgctattttattttgtgataccgagtattctggaagtctaggttagagttggagttgagctttgcttgtgtagaatcctgtactctttcctctggttttttcttgtattgttcttgttgttactggttgttattttcatctgcctgctgaactctataccttgaattgtgtttcacgaatacttaagtcatgtggttgtggaaaaagaatgttgatagcatcttcagttatcttgaagtgtggtgggacagaataccaaagagtttgtgacaagtccggggtgtattgctgtgtatttgacccagatagaagttttcttgttccaagagaatatttattgcttggtttttcagcctttttccttttatcttcctatgagttatttttcttttattgtggtcacttggtgcaaggttaagttctaaatgtgacacattggcttctttgagaagtattctacaattctcacaattttcttgtgacatatcacactgactttgttctagcacatttatttagttcagaaaatttattaggtaacactttggggcattattcctataaaaactttcttacagattaatgccacacaggaaaaaaattttttaggaaagactagtcctccgtataattctggcacttttgtaactttccagctttggcagtattacttacaagaagtaaattattcttcatatgcttccctaagggaggagtttggctaacaaaactcaggtcagcattgtacaagcatgttcacaaatatttgctctagttttctcatttcagtagtattagagagcatttaaatattgtcaagatgtaagaatttttttattgtgagtgttatgagcccaaattggtagctcagatatcacatagattccacatatttgtgtgtgtgtgtgtgtgtgtgtgtgtatgtgtgtgttttaaacaagggttgctgacttgagaagaatttgttctcaagttttttctgattattgctggcgtagttgtatatgtagtacttgcagggaaaaaaaaagcatttcaaaatcaatttggaaaggaagtttgtgagattgaagacatttttagtatgcctgttacactgtgcatgaagtttggatttaggttctcgcagtagttgctgagtgaccagtgggataggctgtggcaacatgttatgtattccagtggactacctaggggagcattatattaggtgacacttgattttttcttacagggaagttacggagttccctgtaaaactttaactttttttttttttttttttttgagatagagttttgctcttgttgcccaggctggagtacagtgacgcgatcttggctcactgcaacctccacctcctgagttcaagcgattctcctgcctcagcttcctgaatagctgggattacaggcgcccaccaccatgcccggctaattttttgtattttttatttttttattttttttagcagagacggggtttcaccatgttggccggactggtcttgatctcctaacctcaggtgatccacctgcctctgcctcccagagtgctgggattataggcgtgagccatcgcgcctagcaaaactttaacatttctttaaaaatatgtaaaattagaatggggtatcaattgagggtaggggaagacatgaagaaaaggcttatgtggagaatattgttgccttttgttcaattaaccttactttcttctagtccaagtggtaagaagttcagaagcaagcctcagttggcaaggtacctgggaaatactgttgatctcagcagttttgacttcagaactggaaagatgatgcctagtaaattacagaagaacaaacagagactgcgaaacgatcctctcaatcaaaataaggttggttaatttacttatcgcatgtatatgctacttcgaaagctcttcaaaaagtatctcacatcataattaagtgactggaattttggttgtccaaatgtcccgtgcatgtccccataccctgcccaccctgtcccagcaagagagagcataagtaaattgtgcacagtagaaaacagcatttcagtatctctctaggtcagtgaacatcatactttctgacccactggggctgtttacaaaaggtttctttggtgttaattgtctccttttttctttttcccctcaaaatagttcctgttgaccaaaaagtggcaaaattttaatgtgtcaggtatcttcaccccatagtttataattacgtattgattttcaggttcagattttgagaaagggcagtgtttttttgacctttgatgatgttgaggataatgactttttgaataatatcctaattctatgtttggatatttttccgttagcgcttagttttatcgagctgtttggttgatagtttattgtatagcaatttaagcaaatctcatttgaattatgatacagtttgaacattccaaatctgaaaaatatctgaaatctgaaactcttctggtcccaggcatttcagatgagagatacttaagcctgtactaatttaattatgttaaaggacccaatatctttacaaagaaagctgctttttccctggggacaactaaacatatgtgactattttttcttagtttttcttcctctaaacttcaaggatctgtgtgtatgggtattgccaccaccattgtcttcacactgacagtgaacatagtggagggagaagtaggggctctctttcttaagatgtgactgatgtaaccccataagtcccttgggagtgtgtgttcattttaggaacccagtggcagtgtagtggaataagaagggctttggacccaggaaggcatggcttggtgaactggctctgctacttattagctgatgcagtcatgagaaactttcttaggctccaagggccttcagtttctcattggtaaaattaaagtaagaaaattttcccttagcattgttgtaaggagtaaatgggaatttatatagaacatctagcaaagtaaatttgacctatgttaattcctttgctttccacactgctcgttccctaagccacccccttcctgagcaccaagccaccttggtgaacagtgttgcctggtggcctgcattggaaactttctgacccgagctctcttgcctcttgtcatgttacattttctgaggggcatggggtctctgcttcatacctggcttcactcaatttgtgcagtttacagtaatataattcctgataattgatacagaggtcaaaatgcattgtttcttcatatcatacctcgcattggttttcatagggacattggcaggtcctttgtttagagaggcagaatgaaagagaaggctaaattgcctctgtattgcttaactatggggtggatttgagttggtcattatgaagatgttaagaaaggtaagaatagcagtagagggagcccaagttagcaaaagttaggaccttgtgtgtgtgtaaatcactgtgatttcagcttcaggaaacctttattctggggttactttgcttcttaaatgcacagaggaaaattcaggtgtatttttctaaaattgccatcttaaaacacagtgctgggtacctataaaaggggcttcagtatttatgaaatgaagagtacttttagattactgtactgttaccagaaccacagtttagttatgttaagtgtaatgtgcagatttattttctgacacttatgtttcatcaaaaaccaaacactaattcatctcttcagtttgtgtgcacttttctgctctagctgcgctggaacactcatcgtcctgcaccatggcatgcgctttcaagactctgcttgctcatacgctgtttgctctgcttggaatgtgcttacccccttccccttcatctggtgaactcctactcatccaagacccagcttcattgtctccatctctgggaagcctgccctgcatactccaggcagaaccaatcctttcctccataatgcttccctggtgctttgccattgtatttgtgacttgtttgtctgcttcagctagactgtgagctccatgagggcagggaccatgtctttttttgcttttgcacacggtaggtacttaatattgctttatgtttatttgatttaccatccacctcattctagaagtgtatagtggtaataaatgtttattaaataaataaattataccgtacattattttggaaatacctttcattttcattgttttctgaagctttctgccttaatttttggaggcatggtctttttttgcatctgattttatttaaatggtcagaaagtggagttttgcattttaaaaaataagttctcttggaaagtaacaccagcaacatattagatagttctataaagcagaaaatatatttgtggctagttaagtaataactatattatgtcttttttatgatggtacagtgtaaagaaagctaagagctttaaagtaattaatagaaatctgaggtaatgttttgctttgtggttgtgaatctggcttcagtacattattgtgtttgttttgttttgttttgagacagagtcttgctctgtcgcccaggctggagtgcagtggggtgatgttggcctcccaagttcaagcgattgtctcttcctcagcctcctgagtagctgggattacaggcacccaccaccacgcctagctaatttttgtatttttagtagagttggggtttcgtcatgttggccaggctggtctcgaactcctgacctcaggtgatccacccacctcagcctcccaaagtgctgggattacaggggtgagacaccacgcccaacatgttttgtttttaaactcttatcttgaaagaattagagctttaattgacaaaataaactttgaaacaggctacattataatttacattaagtaattacaagctatgattttaacatgttttccatatcagaggtgaattactggtgatgaataatatctttaggtgtgattggaaagatgtcttttttttttttttttgagatggagtctcgctctgtcgcccaggctggagtgcagtggtgccatctcagcttactgcaagctttgcctcccaggttcacgccattctcctgcctcagcctcccgagtagctgggactacaggcacccgccaccacgcccggctaatttctttgtatttttagtagagacggagtttcaccgtgttagccaggatggtctcgatctcctgacctcgtgatctgccctcctcggcctcccaaagtgctgggattacaggtgtgagccaccgtgcccggccagaaagatatctttttaagaactctgcacagtggtttttaattattttaggatgggtgggtagggtgaagtgggcatcatttttaatctctactactatttttgcagtacctatttcagatatctcaaactcaatcttaaccttaccctgaaaatcgattccattcttgattacattataccttattgattttcttgactgccataattatttccaaccaccacctccatctcttcaactgacgttgaaatatcaagaaggttactgaagatattccattaggttaatggaaaaagactagagaaagatttggaagtcatcagcacagtttatatttgaagtcatgagcaggtttctcagaccttaaagggaaaaagttacagagcagcatatccaggggaacattctgtgatgacgggactcttttcagccacaggtggctgttgagtgcttgacatgtggctagtctgactgaataactcaatttttttttttttttttgagacggggtctcgctctgtcgcccaggctggagtgcagtggcgtgatcttggctcactgcaagctctgcctcccgggttcatgccattctcctgcctcagcctcccaagtagctgggactacaggcccccgccaccacgcccagctaattttttgtatttcttagtagagatggggtttcacagcattagccaggatggtctcgatctcctgacctcgtgatccgcccgcctcggcctcccaaagtgctgggattacagacgtgagccaccgcgctcggcctcaatttttagttttactttaaaattaaatagccagatgtacctagtcactatcctattgaacagcacggagctttgcctctcaatatgcaaataagctttgcctctcaatatgcaaataaaaaccaaacctttgcttcaaaagctaaatattgtttagggatttatgtttgatttttcaaagaggtggtgttgcagggtttcacagatgtgactgtcaacatttttagcagggaactgggaggagaggcaagatgatactaaaattgaattggagacactctaggattggataaagaagagtacagtgattctaagtgcaagatatgttttaggggacttcatgcagcttggtttgtcactagaagtttattttagtgttttagatgtataaacatactgaatttgtgtttctagtcttaacatcaaatgttttataaattaaatctacaaaactaataaaattcaagttccctaacattaatttaatgtgacatatgacatattctacaaattgcttacaatatgaatatggtatggaacaaattattttttagttttgcttgacaatactactggtatcttggaaaggctcaattctttcgtcacatttctctattcacccaaattggatacatttgaaaataaagaacatcatattttcttgaatggaatcagttgtgtgttaagtctgccattatttatttctcatgaatgatcttggtttaaggtggtagtatgtttttgtgagtataaatacacacttggattggtatatggctgtatactaggttctcagtcacatgatctagaaagtacttgttttaattatcaacaataataaaaaattttgtggagagcttacctatcttggtggcaatttctgtgtagtttgagaaacttagtagtgatgataagaatcagatttgggtatatagagtggggcacagtatggagactggatttgggaagggatgaaactagaagtagggagaatagttgggctcttgtagtctagaaaaataaagatggcctgaatgaattctgtgcaggaagtatggaaaggtgagactcgagaaattagatgtaagtacctgatggttacacaaagagaatggatgctgcaataaccctggctttggtcacttggggcagaggagtcagggaataggggaataagggcaagttttgggggtggagtgaggaagatcgagttaaaatagttttgtttcttggacttccaaaatgatcttggggacccccaggaattctcaggtcacactttgagaactcctttcatagtgtttttgtcattgataatgcccaaaataaggacaaatgaagtgtatcttgtcactctgtaggtccatgaattaaatgaataaatgaatcttgtggagagtaagaggaccttccagaaaataaataggagaatcaagagaatgtggtgttacaacaacctggaaaacaagatttttgttagagatcagggaggataaagactttgtctagccattggatttctaaattatgaagcaactggtgactttaccagtttcaatggatagaaaggataagtcctatttagaattccagaaagtttctgggaaatgagagactagaaacacaatgtgcctgttctttcaaatgttttaaaattttattattatttggttaagtaatttgggcccataatgaaaaggatattcagtgaaaaatgtctccctctctcctgtctcttagtcccaatcctctttagaggaaacttgttaatgaggctttttgtatgtttgtctagagcttatatgcatttacaaacatgtacacatacatgcattttttacccctttcctcacaaatggttggcctactcttaagaagcttgaatgagaagaagagagaagacaatattcagaagagaatgcatgatcaaagaacattatggttatttttcctttaaagatttaaagaggtcagcttggaaggaaccagtaggcagggaggtttctaatctgggcgaccatgcctcagaaagacctccaggaacctttgaattgtgtgcaatttttgtgtgtgtacattttattgttgagacggtctcactttctcacccagggggaagtgcagtggtgcaatcacagttcacgcagccttgacctgggctcaggtgatcctcccatctcagcctcctgagtagctgggactacaggtgcaggccaccactcctggctaacgttttgtattttttgtagtgacagggttttgccatgttacctaggctggtctcaaactcctgggttcaagcgatccacctgccttggcttccaaagtgctaggattacaggcgtgagccacagcatccagccttgtgtacatttctccaagagcttattttcctcaaattctcaatggaatctataactgaaaaataaccacttttttaaaagcaggagaaggagcttggcagaagatgtgagggagtaggtgaagagccaggtcacttgctgcagctcagattaggcatttgtttgactatggatttttcagttaatgaagtaatgccttactgggttgacttatttctgcctgaggtacttcatggtcagttcaccaccatcagagccctgtggtaggaccattctgatgaccagctcctggtagggcatagtgtggtaagaactgcctcttggcttctaccttcgtaggattcctccatccaaactgaaaacaaagacttcatttattccaccaacattcctgacctatggagaaagtaaaattgttgccaaagatactgataccctttttgtcagttattaaagtcttgctcaactgagtgttgtctggtctctgtagataaagttggggacagggaaggggaacgaataggtcgtaggtgataagtctagcatttctaggccctaaagtccctccaagggataagtgtgggccactgttgagtacaggtttctattaatttgatactgaaatcaaaagtagaagtgaggagcaagtagctgttgtagtatgatgatgatgattttgatgatgataatgatgatctagacgcgtgcccgtggagatagaagtggacagattctaaatctcttgaaaataggattgactggttttgctgatgagtcgtgtgtagagcataacacaaaaagagtactaaagggtgagttcttggtttttagattaagtgggtagatagaggtgccatttactgaggtcactttagggaaataatttatgtgagtaaataaaatcaattttaaatattcaacatttgaggtgctatacaaaaccagaaggagaagctttccttgtagaggcagtagccagtgtaaattccctaaggaaggatgcactcatcatgtgaagacaaaaaggccaggttggctggagcttagggagtggaggagtagtactaggtgaggtttaagtaggcaagcctggtaatagggctgtgccagccagcataaggaatagtatagaatgctgtctgagggttttacatagggggaaatacgactgctttgactgtgtgtggaaaatgtagagacacagaagtggaagtcggaggccagttaggaagctgttgtatttgtccaggtggggatgatgatgacttggacagtgctggtttaatgaatgaataaaggaagaaagggaaagatgtagcaaaagacagtagaacgagttcatgttctcttgttcaaagagcttctaattttctcgtatacagaaatatttttaataagtgaatacataaaggatatttagctgatattctttagctaatgaagataatcaggttattagctattaataatagtactgttccatctttttggctaatttgagtcatgtagctattgattggatagcgattgctaggaagcagagtgacagaagaatgttagccatgttagcaaataggcttgctgatgagaatgatttgttcagtatgatactagctgtattatattataaactagtgcttcaaatgtgtctaagcgtgatagaactttctgagagggtctggacttggctatagtgataatcatgaagggagattcggagacagagttgtccatgatatggctttaacaagatttgtttggtatgcccaggtgttaacagaacttttataggtcctgaagagttaacctaacttgcagactccaggtcagcaatagaattaagccctacagaaaaccatttgtgtcactatttccatagttctcccaaggatgtgtacatagctaatgccaactgagaagtaaaggagatgattaacgccatagaataactgtctgagtttgagtaggactgttctaggatatctggctgaaactctggcatctttggtgatgtccgttacattaactaaagctccagtaagttatttttcaagcagaactcttcaaaacgtgttttcattgatgaattgtaatcattcttctgtgaacaggtgtagtcctttttaatgagctcaaagtgtactccatccatcctattaatattttaatatgccattaatctcctttaaaaaatcttgttacccatatagaatattagactaagtggattttctgcatagacatcatgggtaccagataattttttctttactttttgtaaaaacctatgaagttgcacaaattagtgaatatactagaaaccactgaattatatattttaaaatgatgagttttgtggtatgtgaattatattaattaaaaacttacgaagaattgtaaggcactttccattgttggcatttgattttgtggaaagacattcactatggactaccgtatatattctggagcaaatctccaattactttttgagaatagccttgatttgacctaaaggtatcactcaggcacacctttgtttgaaccaggggatagctttatttctgggaaaacttaacaggttaaatttctaaattttaatagcatgttcaataacctgtttaggttaaataaataactgctatttatttagaatttgtaccaacatgactataaactctaaacttgttttactaagcgctggtttttttctttttttttatgactatatatggatggtccagttagtgcctgccacatagtaggcactcagttttgttcaatgatcaactgaatgaaagctgcatttgtagcagcagcagcagcataacatgcattatctcgtttgatttttataagaattttatccaatagctattattattctcatttacagatgaggaaactgaccttagagatatagtctctgcttctcaaattggagtatcttttggggagtgtgcggtgtatgcaaaaaccacagaattaaaatgacgcttgaataatacttggaattgtcagttttatttgaacattttgggtaggtagagcaacatttttaccttaaacatgactaatgtttaaggtaacgtgcaaaatttgtgtgaattttaaagataaaatgagtctactaggcttggaccctagaatatgtacaatttgaactgtcatatcactttatttcaaagccatactgaaaaaaagtggtatttacaatatagtatagcgtaagtccctggtgctcaaactatgctgtgtggaggctttacatgatattcatagacatggatggttttaaaggaatccatttcgatatctttaaattccatatacactctttccttcagctgatctgagaatgtaacctgtgatagaagtacacattattttttctgtaattctcctttatagtcaacctcccattttacagaacagcatacttctcacttgtatgcaatattaccatggtacaaaatgtttgatatcataaagggacactatgagatactggattgagaacacgaatgactcaggcacagtcagttctttccacaagtacaattacttgctttcaacaaaatttagaggactttatgtagatgttgactgattgttaaatttttttgatggttcactgttacattctatcatataactcaaaaggagttcagagaatttgaatggcgtggaataaaattcattctatctactcattaatgtgaacaacatttctcagtgctacatctatgaaaaaggaagactaggaatagaattgatgctataccttgtcccattctagcaattagtaatacacacttgagaacataaaattatttaaaaaatttttttcattaagctacatatatatatatatacacacacacacaacttctatatatgtaatttaggtactaaaaattgtaatactttattttggtcacatatatactaataattataataaaccagaagaaatttgttgttttatcactaagagctttatggtcacagaaagtgaaataatttcatgatcagtgaaagattatcaggtttaaaataagaaataagtttggaaatggaattattcaaagagtaaagggaatgaaaatttataaccattgaagagtttgttcgtatataaataggtaatgtaggtaatggtgggtgcatttagattctgttagatttaacagtttattattaaagtattagcatttaaattctggtaagtgcatcctttgcaactgattacattaaaatatgaaatattcttgctgactttaaaatgcaggtggggtatatatattttcaaatttctcataaggggtagaaatacaaaaatatttgacagccactggcttatgatacatgttcttcatctgcctctttagttattctcttgtatccttaatcatgtgagatcattggaaggttacacaataattaggccctttcagactcacctttactgagttgtcctttaagtcttatgttcttggttttcatggaaagtcactgaaaaaagaaagagcatttgaaatctgcttaatatttgttttgaagtttagtgtctttatcgattttcttctagatttaatacctggacattttttgttttcctcattacttggtatgcgtcctcctttctgaccatggtatctgtgtaattgaatgtttctctctttgcccaggccccttgaaaattcagatccacatttgatgcttagctctagtatcactattgatcttttccaaaggatatctgtttttttccttgttcttgattttctgtttttaaaaattaatttttgtgtattttgtcctttgggagtgtacaaaagatatatctcagatacttactggaaagagaggaagtaaaatttttaaaaataagaaagatttatttttatgttcctccctgcaactaggggataaaatagatcctcaagaaaaatactttcagcctaatatacacattattataaaatgtattaaattttgatttgagggctagtctgtacatagttttgtcaaaggttggaaacttagttctgatattagaatgtgtttgccagtttaattttgtaacaaagaatttctgcttcactttttcttatattgaagatataagaagattgcatatacataaacagctttaatcttgtcccataaaaaagtgtctggcttttaactccgacggtgatggtagattggtcctttagattctaaactaaactgtagaaaaactcagacacacaactgggcataaattaatagtgactcaaggcagtcctcagggtagaggtaatagaattgactgtttctttgacagttcctgggaaaactagttagtccagctttacagattgctcagcttcatgtgatactgttttagaataataaattaaagacattctgtcgtcagagcttctaggccagttaaaaggagaaaaaatactaaaaaccaaaataagattgagtgaagaataatgcagcacattttgaataatgtctcattctgtgccagtagggaatgaactgtctcattagacaatggaagttagttgtatatcttaaatattttagccaggcttttcttttaattttttttattgcacagaaacataagtgaatggaagaacgtccatcttaccagtgtagcatcaatagtttgacgtgttccatgcttccttccagtcttcatggattcaggattcatagtttgaaacagtttagagtagttgcctccagtcatccttggtaacaatgagaatctcacaggtttgaatatgtttactcatgcagacggttgcaaatacttctgtgtgtctactgaagtagacacatgatgccacctttgttctaataccagcagagtatatcattctttattaagaacaaaggctgggtgcagtggctcatgtctgtaatcccagcactttgggaggccgaggcaggcagatcacaaggtcaagagatcgagaccatgctggccaacatggtgaaaccctgtctctactaaaaataaaaaaattagctgggtgtggtggtgcgtgcctgtagtcccagctactcaggaggctgaggcaggagaattgcttgaacccacgaggcagaggttgcagtgagccaagatcgcgccactgcactccagcctggtgatagagcaagactccgtctcaagaacaaaaacattaaaagccaaacaaggcatcgtttagtgatacatactgattatacctaattagtgacaagaagttccctgtaagcatttatgtgtgaagctgcttaaggattgaatattgtctactgttgttaacaggttgggtgacttcacttagggcctccaaatggtcgagatgtcataaatcagaggtgttcaaactttctttgcatcacagaatgaccaggagagcatttaaaatgcgtactcctgagcctcacacttcgtagagttagcaacctaagtggttactttgcagcttgtcagccaaatttgcacattttatatattttttgaaaatccataaagataaagctaaatacctgagaaataatactgttagtcatttgagatgagcatatcttttaaaggtaagcagagacattgggggaaaaaaatgagataaaggaatgacaggattgcccaatacaaacaggagggctgtgttgtgtggagaggtgtagaggtgaggacacatttaatattggatctaaagaatactgtaattgtaataattgtcagattattgtgaggcttacatttctaggcatgctaatgttctttaagtagaggtcacaaactcagtgcctgcagggcccagacaggtaatgcaaatgtgacttgttgaggaatgttgcaacaggagaccctgaggccactactggacagccatttctaatcagtcacagcctattgttgccaaaccaagtccagtatttctagatctttcagtttttaagagaagctagaattctggattttatatgaagactctagatttttaggtgctgacttaattcattaaaggcactaaaaaatgaacactcatctctgggttaggcttgatccacctgccatcaaattgcaatctttgttttagagctgtgtttctccaggtgtggtcccaggattagcagcatcaatatcacctgagaccttaatagaaatgcaaattcctaggccctatctcagacctgctgaatgcccagtgccaggggtgagactcagtcacctgtgttttaacaagccctctgggtgattctgatgcatgctcaggcttgagaacccctgttctggagcatggaagttgagattacaatttatatgtgggggtagtagtaaagataaaagttcatcaaatatcctgtaaatatcaaaaatatatcagacgtattttgttttcaggtatatgttacttcatcctttttgccagaatctgagaaaacacgataattgtgttttctcccttttctttcttgtttgttaagagtattgcaaatgaacttaatagcaattctgtgccacattttgacctcactggaacacatcgtagattttattgattgattgattaaaactaggtaaataagttatatggctttacgaagcttcagtgttaagtctcctttaaaagtattaaatataatattcagtaagtcctcacttaatgttgttgataggttcttggaaactgacttttagccatatgatgtataatgaaacatatttactctaggctaattgatgtaaacaaaaattaagttcctgtggcatatttctggtcacaaaacatcccaaacttctaaataaagaccaaaacacttctaatgataaacactgaaattaacgtgagctctccacacatttaagaaagattaatataaacaagattattattcacccactgattccagttcagggtcgtgggtggccagagcctctcccagcaactcagggtgccaggcgggaccccaccctggacagcaccccatcccatcacaggtcgcactcacgctcactcaggctgggaccatgtggatgctccactgaacctaaagtgcacttatcactgggatgtgggaggaaacaggagtacacagagaaaacccaaacagacctggggagaacatgccaaattcacacagatgggcttaggctgggaatggatttttttttctcatcgttataacaaaatgacattgaacaaaacgacattattcaaagacctactgtatattaaaaataaggaacacttccttatcacatttttctaaattgagttctgtttgctggaattagaactaccatttgtacatatttgtttttatataaaagaggttaatttatgtggttttatgtaagtctggcctcctaattgctgatcaggttgtttatattttaatgccaagtatgccaatattttcctccattctcagaatgtagaaatgattgctatcctgattggtatccttaaagttcttggccaggtgtggaggctcacacctgtaatcccagcactttgggaggctgaggcctgcagattgctagagtccaggagtttgagaccagcctggtaatgtagggagaccccatctctacaaaaaaaatacaaaaacttagcctgctggtggcactgcctatagtcccagctactcgggaggctgaggtcggaggattgcttgagcccaggaggtcaaggctgccgtgagccatgatcatgccactgagctccagtctgggcaacagagtgagaccctgcccctaaacaaacaagcaaaaccccaagttctttttttggataaaccaatcttaaacatatttgttcatttaaaagtcattagtgccttgctgatcagataggaaatttatgtagagaattttcttacacttaaaagtatacaaaaagctggccgggcgcggtggctcacgcctgtaatcccagcactttgggaggccgaggcgggtggatcatgaggtcaggagatcgagaccatcctggctaacatggtgaaaccccgtctctactgaaaatacacaaaattagctggcttggtggcgggcgcctgtagtcccagctactcgggaggctgaggcggatggcgtaagcagacccgggaggcggagcttgtagtgagcctagatcgcgccactgcactccagcctgggcgacagagtgagactccgtctcaaaaaaaaaaaaaaaaagtatacaaaaagtttttcatatattttgaggaaacttcatacatgtttcacttattaggtgcttaacatgtaccctagagtatttaaaatgctgcgatagactgagaagtttggaataatttgatttaaagtaatagatattgaattagtaggaagtcatctgattgtgtttatatataatattttaaataaaaatacatttatattcacagggtaaaccagacttgaatacaacattgccaattagacaaacagcatcaattttcaaacaaccggtaaccaaagtcacaaatcatcctagtaataaagtgaaatcagacccacaacgaatgaatgaacagccacgtcaggtaaggatctaattcgttctccaatcttatttttcagaaaaatgctggtatttttaccagaaataattcaaataaattctggttaaaatggagtatatttggaaagaaaattattttatgtcctaggctattacatgaatgctgaagtatgcaaaatttaggtaaaatatttttaagaaaaaatttaagaagttaataatgaatctaattcataatatggactaaatttttatgcttttcgtgtggtaatatacatcagacttggttctgctaatcttagttttttaaagattatctttccaaggataatatttcatagaagaatgaagcatgtagtttgtgttgcttagtttaaaaatattttgtattatttggaagctaaaactactttttattctgatttcttgttttgtgaaatctgtcccaccccttttgaaaaacagaattagataaactttgtcaatatggtatattgtcctgtgacttccatttttgtaccaattcaatttatttttctctttctttattgcttcaagctgtattccaccagaatcttttcttagaaaaaaagcattacctgaaaggcctccctgctgcctgttaatgccatatagcccggggagggagactggacaaaatgctgaaaccttccacgtaaccttacttattcactccctaattgtggtcaaaaagcctaggtagttcatgaatttttagtagcaattggggtgagggagtggagggagaaacatctgtgcgtttttttttctctcctttctctgcctcctcccacctgagtccacctaaggattagaaacactgatttacctacgacggttatcttttgctctcgtattccccttttagatgtctcactctaccttttcatttgaattttgtttttcactagtccttcaagtgtctcatctccagacttcataaaggattgggccaaaactttcagacagttgctctagaagaaactacataaagaaattcagttcccacatcctctgtagtgttttttcctcttcaggtgagccaggaaaacagaagatatttggagccacattggatcagcatcttgctatagatgtctcaagatttgaagttctaaacttgctttactgttggtccccaagagattcaacaggggccatgtaagtgtatcacatccaacataaaagatgcgtacctgcatgtgcctttaggctcttgtcaccacttaggttttctttgggccattcagctttctgtgtgaggcttttcccttctgttttactaccacacccagtgatagtcacgaaaccacaggaggttgcagtatattcattacaacagggaaggaattctggcattctgaactttgcccaccttgataaagccgttccctggttgtattctttctcagatactgtctaaagtcttgaacatcttgtcctttgactttttggtgatttaaaaatcatttccccaaaaatatatttattaattgagaattttgaaagtatataattgggtaaaacagatttgcttcaaaaattctgaaagataaagaaggtggaatgtaatctttaattagtaatatcattccacgttggaaatttgagtttccttatgagatcagatagtatttaatagattttatcctcatcttttctttgccaaatcattctcaatgtagtctgtaaacccaaatgttttatttaaagatgaattgattagcaaattctggccgttttaacagtaatttaattattttctgcacctaaattcagtcacagttttaaaaacctctagtaattatttactgggtgtttacctggctatagagatattggtaacttagagttttaaagttgaaataaccagactagttgctccttgttctttggtatgttgaatagttttaagttttccttcttttattatggtgtatgagattattctcaaatgaaaggtatgtgtccaaagagcaaagttctatctcctccatctctccccaaaaaacttacgtcatttcaacccagatcttttgagggtttaatcttccttttagcttgcatagacaggaagtgtttaaaattatttagcaggccacttctccaaaagctttggctgttttttactttatccttatggtacctgacaatttttgctggatgcttttgattgtgctaagatattagttgtctttcctctttctttatcatcaatgtaagaattgaggtaatatttgaccactgtctcaccaataggactgtgcattgggcagaatattggaaaatagtaaaaagacaattttcatgttaatgttttaaaaatcatgatctgttatcccaagtattccagtttagattcagtttgttagtaaaggaaagatgttggttttaattctattttgatatacatatggtagatgactgctaatcagctatttgtaattgaggagatagttggcaaaatatacataggcagaaatgattcttccaattttgctatccattcttagattcattgaattcagttgataatataaattgccaaatattccaattggagaagttatttttattagagagtaaatgaattagacaatgaggtttctatttttgaggttcccatagatataaatgtttttattctttgtatcacattcttttaataagatgttcaagatagtgatattgtaattccttttaaagtgttgaattttgaggcctataactaggattaggcttctgaatattaactaggctttactgtgagaagatctgaaatgtttaatttagatgagaagcaatcattaaaaataataattctgtcttttataaccaacatcctatgcccaggtcatttatatggcagcctaatttgaattctataaaatatataaattatgaatttttaatgtattgactccttgaaaatgccttagctttaaaagtgcaaattagggtatgaaaagaaaagcattaaacagaattcagtagtgatttctacttataattaaaattttaaggtagtgatggaatttgtaaaacctagttataatagggtagtagccagccatttttgtatatagcatcagtgtatttgatgattgcttgtcttttctttagattaaaaagacccctgtagtggggaggagggaactctgccagttatcagactattatcccaaacagtaatcactgaaatatccttattcagctagatgcataaaacacatctcaaggtctttttagtctaattgagttgtaatttttgctggtaacaatgcctttcctagtttacccccttcataatgtgaagaactaccatttctatttcttatttctttgctgctgtcatctttgatactatctggtctcttgattgcttctttttctcttttagcctcaaaccaaagaagcttcatctttgaactattacttcttccttttaattattagattatagagggctaaaaggcttttgtgtttttgacagtctttgaatagtaatttcatttcttatagaatattcacttttttgtaggggtaattgtttaacagtaaagaagcagatttgaatcttccacttgatcttagatttttttccttttatttcattttgccaattcccctttcaaggatatgaaactttcctttacctacttccagaagccagccttttcttttagaaggaatgttttaaattgtattagaagaaactttcctgataaaagataaattttgtaaatgtgcagtttaaagtcactgtgtatgaaaagtgtgtaaaatagatcagctttcagttgctaaaacccagagggttactatttcaggcattctagcagcattttcttgtttctaatctctaacagttatttctagtatagtctcattataatgttcttaatgactgacaaatagataagctaaagcagagtctcatggtggatatattcctttgctctggacagaaaaattgactgtctgggcagggaaaatagaggatgtgtcctataacacttaaaaatattactctgggtactgttgggaagatgccatatacaaagtgccaaatgaatagtagagtagtacaggcaagtgctataggtgtttaagaaaagtgaggttactgttgctaggaggcttgaggaaatctttagaacaggcatgaaacatatgctggacatatttttaaaatgtaaaaaatattttctaacaatattttataatgtttccttgggctagattcccagaaatataattagtgtgaatatttacatttttggtacatactagcaaattgattccaaagggttgtaccaaattaaaagactatcaataagttagatactttccagtttcagcttaccttctatagcagcagtccccaacctttttggcatcagggactggtttggtggcagacaatttttccatggaccaggtgagggcgagggggatggttttgggatgaaaccattccacctcagatcattaggcattagatttttataaggagcatgcaacctagattcctcacatgcgcagagcacaatggggttcgcgcctctgtgagaatttaatgctgcctctgattgggcaggaggtggagcccaggtggtaatgcttacctcctgctgtgccgcccagctcccaacaggccacagaccgctacccgtctgtggcctgggggttggggactctttttctatagctttgagtattattagtactttttttttgggtggggggaagtaattcagtagtttaaaagggcattttattttaaatttatatttatttcaatatgtataaagttaaatagactgaggcatttgtgttaaattttaaaaatgagaaacatttagagcttttttaactagggagtagcttttatattacccatctgaactgaacttgaaggaatatcctggtggcctaaagctaattccaacacctgtactctgcagatacacttcctccttccttctcagagaccccatccagtggaatatgtcacttaccttttatcttccaactgtctctaaactggcttcttcccaaagcatttaaatatactcaaatccaccccatcttaaaaaaaattatccacttcactgctccccttttagcatttgttccctttcttttcttgttaaagtcaaacttcttggcattgtgtgtgtttactatctgctttacctcttactcagtatgtttatgtctctgaaataatagcttttgttctcactgaaactgttcttttcagaattgctgatgttccttgttaaactgaatggacaagtttcggtctttaaatttcttgccctgctttaacgttaaacaatatgactacctctctttctgaaacatttgctttcattctttgactctacactttctttgttttccttcatacttttttttctgaatccccttcttaggttctttctctatctgtcttttaaaatgttgaggtttcccggggaatactatgcattcttttttgtatgtaaaccctccatgggtaatttcactcattctcatggcttcagttatcatccatatgttaatgatttccaaatttatatcttcatcctgagcttcagtcgtttgtgtcaattctcctactaacattgttcacttggaagtctcatcagcacctgtaatctattgctttatctctatgaactcctttgtcatccaatcaaatctgccttttattagatgtgctttatctcagtgaaaggaccactgtccgcttggctgcctaagctggaaacttgagcatcatccttgattcttcctatctttcaccccaagcgtctatttagccagcaagtcctatcgatcctacctcctgaatgttctcttgctccgttctgagactaagtaactattattcatttcatctaatctctctgctttttgtcttttttttttttggagacagggacttgcttagctacccaggctggagtgcaggagtgcaatcacgactcattgcagcttcaacctcctgggctcaagtgatgctcccacctcagcctcctgagtagccgggaccacaggtgcacaccaccatgcctggctaattttgtgtttttcatagagatgggatttcactatgttgcccagggtggtcttgaactcctgggtgcaagtgcttcctgtcttgttcccttacttcactcttcatattgcaggcaggtgttcctctggcatgatggtctgatagtgttaatagtgttatactgctgaaaaccctgcagtgctttctggtagcttttagggtaaattcagaacactttaacatgactgccaagcccttttgcttacctctctggcctcaccttcttctcttgttctacattcaaatcatatggaacatttttcaggtttttgcatatgctattcatcccctacccctgacccttacataccttgatcagatttcatgctgtttcctttctctccttcagcggctgtttcttactcatctctcaagtgacatcaagaacttagatgtcacttctgttcagaaaacccctgatttaccaagtttggatttagagacattccttagtgtttcttctttcttcttttctgatcacaactatattaggttattcattgctttatccccaatttctctattatgtaagtgcttaatatgtaaattagttgaattagtgaattaaattattcattcattcaaaaattatttattgagccttcaccttgtacttttctaaacaatgggatactgcagtgaacaagacaaagtccctgctgtcatggaactttccatctagtgtgagaataggaagtgagtcagacaaatacatgtatagataatgtatcatgttgtgttaagtgcaatgaaaaaaacaccagaagagtgagagagcatgtggtcttcaaaagcagagaaatatggagggaacattctagacagaagtctgtcaattgtatatagtatgaggactgacagggttaggagatcactgaagaaactcttacagaagttagggcataagcgataaggtgtgttttatgctggtcatacaataactgatggccgggcacagtggcccacacctgtaatcccagcactttgggaggccgaggcgggtggatcacgtggtcaggagttcaagaccagcctggccaagatgcgaaaccctgtctctactaaaaatacaaaaaaaattagctgggtgtggtggcaggtgcctgtaatcccagctacttgggaggctgaggcagagaattgcctgaacctgggaggtggaggttgtagtgagccgagatcgcaccgctgcactccagcctgggcgacagagcaagaatccgtcttaaaaaaaagaataaaataaataattgacaaaatttattgacttatcagctctgcctatatgaagaatcttagaataaagtgggagaatgatatctttgacagaaatatggacataataaagggtagctcaatattttttaaaaataataaaatatgaatttgagtggtagaaaatttatactcttaaagtaattgttgcatgttgagctagtaaaagatgatgggctagagcccaagagagtctggagatatggtcagtctttatgcagggaagaattgcaattgagacattacatgtgaatttttaaaaattaaggaatgaggctagatgcagtggctcaacatctgtaatcccagcactttgggaggctgaggcaggcacatttcttgaggccaggagttcaaaaccaacctggccaacatggtgaaaacgcatctctactaaaaatgccaaaaattagccgagcatggtggcgcgtgcctgtagtcccagcttgggaagctgacgcatgagaattgcttgaacccaggaggcagtggttgcagtgagccgagatcaggccactgcactccagaatgagaccctgtctcaaaaaaaaaaaaaaaaaaaaaaagaaaaagaaaaaattaaggaatacataggctgttggttcatagttaccaataattgtgtatttttctagttcattttaaaaacatgacaactgtcatgagggaggatctgtgaactttttttatttctctaagtaacataggaatacagatgaaaaaatcgaatagtgtttttaaaaactacttctcaaaacagtagtttactactccagttaagtcttctagtctctgccagaaacatttattcttaattcttatcatatctctttataattatcttcatatttctaattaatatacttgttaggctgtctttgttaattttagccattatttctttactttccccaaggataggtgactacatagttctctctctctgccgtcatgctcccaacctagatgtatcacaattttaggtaaataggttaaatagtcagggtttacgttattatgaatgaaaatttttctgggtagggtaagtaatgccctgccactcctttctgtcataattctttgttgtttttaatcttaataactctatgttaggttttctaatataattatagttaaccttttctgattttaaaatttctgccacatgctcatcaaaaatattttctttatgctgctaggatgtaaatctgtggggagaattaatatttttataatattaagtgttacagtccacgaatcttaggtattcctccagtaagcttttatagttttcagtctagtgatcttatatatctttaattgattcttagatatttgaggttactgtaaatggtgtcatttataaaatttttattttctaattatcttttgctaatattagaaatgaattgattttgtgtattgactctgatttcagttatccttctaaattattaagtcacctatgattcttttggactttacatgtgaataaacatgtcatctgtcaatgagagtttttctttctttccttctttccctttcttaacaatatttaaacctttgattttttgtcctttttctattttattagttagaacttccaatacaatgttgaatagaattgatggtaacagatattctagtctcattcgtgatgtcagggaacatttttaatgtttctccattaaatgtgatacttgctctaggcttttttgtaaatattctttgtcagattaaggaaatttgcttctctttctgttttactaagaatatttcttatgaatggatattaaattctatcaattattttcctctacctagttaagtgatcaaataatgtttatttattctgttaataaagtgtatcatattgattggtttatgtgattaatttcactgtttgatgtttttgaatgttaaacagatctagaattcctggagtaagcccaatgtggttgtaatgtattatcattgttatcactgtttagagttgctgttattaggtttaggatgttttgcctttatattcatgattgaaattgacttgtacttttcttttcttgtaatttgcttctcaagctttagtatcaaggttttctggctttataaaatgagcttggaggtgatccttcttatattctctggaagagtttctataaaattggcatttttaaaaaacaaaattttctttttggaataattaattgggaggtcatctcagcctattttttttatggaaaagttttaacttacagattcattttttttctttgtttttgagacaaggtctcgctgtatcgctcaggctggagtgtaatggtgtgatcacagctcactgcagccttgccctcctgggctcaagtgagcctcacacctcagcctctagagtagctgggactacaggtgcacaccaccacgcctggctagtttttaaaaattttgttactttttgtagggatggggtctcactatgttgctcaggcttcaatttttaaaatagatacatggaagaatattcattttttctttctagtttttttcatgtgattttctaggaatttgtgcattttataattttcaaagttagtggcaaaagattgtttatatatttctagtaatatttttaatgtttacagtatctattgtgatattcttttctctgatattggtagtatccaaatgaaaagtggaatgaggtattggggagacctttcctaacaagttttgaactcagtctgtatatgagcttttcctcattgaaattcaaatccaattctatcaaatttctttttataagaaaacatttcttttatagaagttatttctttataatggattatgccttgtcttatttgacactgttgccttgaagtaatcttatagtactattgggatctttgtttttttttatgcctgtatttgtttgctatttctttgcactttctttttatttccagctttctgagtctctttatttttaaatctgtctcttgcataaacatacagttgagtttttaaatttgttttaaaatatgatctgaaggtctttttcataattggtgagattacccttacatttattgttttacagatatgtttagtcctaattctgtcactgtgtttatatactgtttttaatattttgtgattattttttggtatttctgtttttgttctgtggtctgggtttttcatttaaatttatacttctggtaattttgaggatttataacctgattttaattctagtggttgattaatgtcatattctaaatagtgcatatgtacttctatttctcgatgtattggtattaaaaaggaagaacggctgggcatggtggcttatgcctgtaatccaagcactttgggaggctgagatgggaggactgcttgaggccatgagtttgagagcagcctgccaagaaagtgagactccatctctacaggaaattttttaagaaactagctggcgcagtggtgtgggcctgtagttccagttactccggtggctgaggcaggaggattccttgagccccggagttgcaggttgcagcgagctatgatcatacccactgcatccctgactcctgcttgggcaacagagtgatactctgtctcaaaaaaaaaaaaaaaaaaaaagagaggaaaaaaaaaatagtgcctgttagtgtcctacagaaagaataggaattaatttggcagtggctcacgcctgtaatcccagcatcttgggaggctgaggcgggcggataacgagtcaggagattgagatcatcctggctaacacagtgaaacccccgtccctactaaaattacaaaaaattagccgggcgtggtggcgggcgcctgtagtcccagctactccggaggccgaggcaggagaatggcgtgaacgcgggaggcggagcttgcagtgagccgagatcgcgccactgcactccagccagggcgacagagcgagactccgtctcgaaaaaaaaaaaaggaattaatttacactaccgagattagtttcaagaaagcttttcttaagcgcacatcttcttataaagaactaatgatagatccttatctattagagatcaaagttcctgcagtcgagtgggttttgaaatcatcagtttattcatttcacagcagatattgctgattaacaggtgctatataaacaaaaaagtcgaacatgcccccatcttcataaaactttgaatctgaaaatcaacactgagcaaataattccaagtatactgacatgtgacaaatatgtgaaaagtagtgaaggagcacatctaagttcctatatgaacttgcgtatcaataagaaaatgattgtagctttttctgtgggaggagcacatgaaaaatctaggcaccacgaatgatactcttattccatggtcatcttaggataattgtaccttttcaggcacttgacaagtattgtatacccactgtgtgtaagttagagagtattcatggcaaaatttagtcaaacaactacagcaaacgcttactgcacctctgtcttcatcagccctaaaatttgccctttggtttattcatctatcctgtttagcccaaattatcttttgccttaacgagagatcacattgtagtttgcacagccacacgaagtaaccttctccttggtttatgcaataattttcttgtcattatctagctctttcttcttaggccaccctgacaaaataagagggtagctcatacttgatctttgatgtttgcaggccatggtatttaagttgtttttgctgaccataactagacaattcagatactatatggggctgattggaaataaagcagtttagaaactggacagtgaatttcttcttggcaggaaacaccattcatccacgtagccctaacccagtgtcttgtatatttagccttttgagagtgactagaaagtacacactttctggattttgctttaatcgacaattatgtgacaagagtctctattatgtgattagatttagtaactgtcttatgaaagtaagatattcattcaattgatggaatcctaacattagaaaaaaattctgagcaatttgataaaagatttgtattctcaaagaactttctcatattttattagtgttttgataacctgagatagatctgacagttactaagacttctagtttactagtgaaaatatatgcaaagagtttaagtactttgcccaagcaaatctatttagtgtttgagccaggattaaagcatttagctgccaaaccagcgctttctatcaccctgtcctccctctacttagccaaatattcatcccacaaacatctgagtgcgaattttgtgtctagcatcatgctcttgacagatgtagattgcagataaaactctaaaaatggtgagatttttaaggtaacttttgcttcttctgttttataaggcattaacactgttgtcctcatatactttaaaaagtatatcacatatcttacgcatttaaatttttttcattagaaaaaagaaaagaaatgcttgtagtctaaatctttgacaattaatgttagacattttaatttgttgctgaatagttgtaaagaatacagaaacatacagagaaccatcacaaaaggtcttcagtcccctgacggcaggcgaatgtatcagtgaagtaggacaggggaggcttgagctaggaattggatttggtaattaggtgactgtgaccttgggcaaggtcagtgttcatataaataagaggggcagagcctgggttagaaggaaaagaatgaatagaatgtgaggaaataagacacaagttctctctactagtgggaggggaagataaagatggcttgagggggaagcagtgtgaataaggacatgttttaagttgtcagtgttcaagtgcatctgtcacttaaaagaagaagtcccaggggaggaggggaaaaatggaaaatgtgagaagagaagttgggcaaattgatggggcaagatgaggaggaggtagaagatgtgatcaggagcacaggtggtgggataaccttaggagggcagcaggattcttatttctctaaaataggaggagatctgaggtggaaaggacgatgttcatagaggctctagaccttcaggcttcacgcctggcttttctagtcagtctgaagttgctctgtaggcttcttggcttgggggttaatattcagctatggtgtctaaaataaacaataaaaaacaggagtttggatatgtaggaattttagatgaacttcccttagtttcattattgaagttcagcatgttcctctggtcagttcactttgttctaatagagattataatttcaaaagggaagatgctttttaagacaatacatgagagctaaaataagttttaggtttttgtgtggctcagtttggtgaattttctccagttttcatgtaagaataagccagacctactgatagctacctgctaatttatggaaattaacatgttccaaataaacctgtctgttctattttgctgctgtacctacatttgaacacttaaagtcattctaaatggagccgtgcctttctcagtagtcagtgacagattcacacatgtgtgggaaccccgatcctgtggtaaataagagagccccttctaaaatctaaaatctctctgtacagacactttctagtttataggttgtgatataaaatttcatgtttcatttatttggaactctacatcttccaatagaaatgatattataaatggctctagtgtcccagaccgacccataaaataccatttaacctaaagtatatctgaattgttaaaaataattacaaccacatttctagcagcaaatacattgactatcaactttctgaggtaagaaatgtttctcccagttgtgctttatcttactttccagaatgactggattctccaccactcctagttgtctggcagtaaaaaaaaagaggcacccacctccaagccatttagattggttcttctaaggcccatgaatgaggagctgggagagacactactgagaactgagagaggagcttgcagtgatggtgcatgctggcaggggcccttctttctgtttctgctgtgagatctgggcacctgcctttataaacctcctatttccctatcctttttctctttctctggaccagtggttctcaactagacatgattttgcttcctccatttcctcttactgcctcacttcccacctacctgggtacatttggtatatccagagatatttttcggttgtcacaactagggtgtttctactgacatcttgtgggtgtataaaccaagcaagctgataatcatctacccccaaatgtcaagaatgccaagactgagaaattctgctccagacagttgctactggttaaggttgtttttgccttttttgattcattgcagcatagaaatatagtctgtgttccctgattctctcccaccttctattcttgaaacaagctcacagctcttttgaggtttttctaagggctttaccatcatcataacatgaaactagatggactaaaaataacaagaagattacagttttaggaaatcttaattaaaagctatccatgctctccactgggctttaaatagagcaaaattctgatccttttctaggcttcagtcctttcctccccgtgatactggtttcctcattccctggtcttccaatcttccttactaatactgctccaccatggagagccttagtagtgattctgttcctcccaatgagaaacaacagggatgaaaaatccttgcattattttaatgaggagttaaggaaaggttcccttccttattgcatagattgtattgcatagatctggccagaactgttttctgttgttctccttcttttaagaaagtttcaggatgagattacatcccagcctttccttacgtactgctgcacagcacagggacctcctttctctactcttctctccttctttctactgctgcgtcatacttgccaccaatgccagctttgtggacatgtgacctgtgcagttacacagggccttgtgcttaaaagagcccctcacttagaaggaagggccatgcctggtttaatgctctgctgccatacccttgaaattcttaatttttttttaacaagaggcctcacatttttaatttgttctgggcccagtaaattatatagccagtactgcttaccaaagtactcccaactgaccttaggtccaggtgagaggcagtctggcctggaggaggggaggaagaggaataattttaaaatattcgtagtagcaagaaatccccaactgaaagggaagggaagggaagattcatattcatgtgctcagactcttcatttgctaatacttacctttcagaattgattatttttgctttgtttatacttcctaattttaataaaatgaccaactacttattaagtgctattgtatgatcagcaatgtgctacaagccacaggtgaaacgaaatagtaaaatgatagttgctgtgtactgggcatgttcaagtgtttataacgcttcctcattttgttcccataaccctttgagattgcttatattgtcccattcgatatagtatgaaaccgatatttagagaggtcaattgtccaatttataaagctagtgaaaaagcaagtttgaacattggttgttcagattctaaaacccaatcccattcactctgctaataagttagatattcccgtcctcagggttgactgtcaagttgaggtcgtgagtatacagggaaagtcagtttcattttgtctagtgaatttttttttttaacacaacagagacacatcagtacttttcaaattggatataatgattaatgaaaatcgtgctaggatatatgatgtagatgcttttcagtgtggtcatgagaagtagctattagtataattaatctgaaacagtattcttaagaaaaaattcaaaagccttcagttatatatgcaaatcactccctttctttttccattttttgaaatacttgctcccataccatcgttagtgtcgcttatctggaagtgttttcttggagtggggtctctttaatttctatccaccaaataacaatttcatgttctatgtgattgatatttgtaattgtggtctaagaacgctaatttgcagagaaaatatgttacaccaattctttattttttaccatgtgagctacttctcatgacaatttgatatccccataaaactctatgctggttttagcttcaatatattataagcctgtcttctcaattctgcctaaggaagaggcagcatcaggcacagatcacctacaattgagacttatacagtatctattacttaggagttaaatggattaagagtaatttgatagttctcttaaagtttactgatctattattatcagcctttgatggcatgagtagaagtgtctgaggcttgtactatataacctaacaagagccaaacatgtaaatgctctttcagagcttttgttaagagaaggactgtttaatcacactgacctgagttttaattccagctgcaccactgattaattgtgtaagttatttaagttccccatgcttccgtttctttatctgtaaatgggagtaatatcttctccaaaatgctgcaggaaagtttaactgaatttctgtacagaaggtgcttagcacagtgccaggcctatggaaaggtgttgatggctaagtggtagttttcctcctcttcctctccctatttcatcaagacagtatgactgggcatagtttcactgggtaagacagaacattgggtaagccctttcttcatttaacctaaacaattagctctacttttaaataaacttatctgcttttaaataaacatatctcctcctgcaatgaaataataggaaggcaaatgtcttcctcttgttgtctgcaaggaagaggatggaataatattttttaaaatctttcagcatagtgaagaataatacttggagatcttggtggtcactacacccccactacatgcatgcttttttttttgagatggagttttactctgtcacccaggctggagtgcaatggtgcgatcccagctcactgcaacctccacctcctgggttcaagtgattctcctgcctcagcttcctgagtagcattacaggcatgcgccaccacgcccagctaattttgtatttttaggagagatggggtttcaccatcttggtcaggctggtctcgaactcctgacctcagatgatctgcccgcctcggcctcccaaagtgctgggattacaggtgtgagccaccacacctggctactaccactctttcaacacaaaccaaaccagtctttctcataactcgaacctgcatcagaatcaccttaagtatttgtaaaaaaaaaaataaaactagctttctaatcccagatctattgaatagaatctctggggatgaggccttggaatatatttttaaaataagccaccttggttattgttctttataagatctttagaaacactgacctgcactctgttacctccttgcccatacaatttcttgggttggaatagtcttttctcttctacatgcttatagaattcttacacaattttcaagggctacctcttcctagaagcctttccaggtcttcccaaattgaagttagttttggatcttcattattgcagtcggccttgtagagttttgcatgttttccaccaaacacctcctggagggcagcgattgccgattatcctaccaagcatccccagtgcaagaaaaacacattgcatatcatgggcattcaaagagtatttgttgaatattgttgatcctcaaattcctttttcctagtaagccatctcttttgttcttcactaaagagtacaaatctcttagagtaatattaataaactcggagtgatgaaggtaaataataatcaacattatcagcctcggttcccagagcatcagaatagggatcggtgtctgtgaatggtggcgaggagttgtttgtgatccctgtttctttctcatcctctttagatattcttcataaggcaagttgaacaaatccctcaaagtccaagttaaatatataacaattatgaaaagaaaatgctatcgtgggttcattttactttcagtaaacagatttgatcattgacctcactaaagaagcagtttttgtaatacaccttcatgtttgttctttgggacactaagtggggtaaagtacatgcaactatgcttccgttgatgtccttactaggagaactgtgtggagaaaatgtgtagagatgaactgcagtgactactaagatggtttctccaaagatgctctgcactgtcagttaaattttaggcacttttgtggctttaagtgacttttaattccatcccatgtttctccctcaatcagctggtttcctggataggacattgcccagaccattagtgttataaggtgataggcatgtggagctagccaatgttctaatatactggaaggtaacaaagagaacaagatattagatgtactcagagcgtctggttagtgaggattagagggaggtgtaataactgagggtgatagcacattttgggagtttctccaaatattaaatcactgttccttatacctattctatttattggttatttggcctcacaccaggcagcaagattaagctgagaaaaccactggatttggcaggggaaatcagattttcagtgagtagtttaggatttatgacagcagtagtgcttatgaagtgtagtgcaagagactaggtagccatcatagagggggagtccttacatatgttttgaatattttgaatattactcaccttttgaatattactgtctttggacttctaatggttgagaaagtaatagagtggggagacctccaagtgaacagaatcgccaaagaaaaacctactcacccaagtgagtacatcaggaaatgttaaacttaggcaaaggaagaccttttccttccctgctccctctgaagcactgaggcccatagtggccaaagataatgagaaaagatcatggaatttggtgagaggagctgactgactattggagtacgtttagtgcaagttggctagaaagggggtgggctaataaagttgcagtagacttgggaaagggcgatagtgcacattgggccattccttgaggaacaggcttggaaagaaaagaacatggtcattatataagctggataaagtctcagtgtattaaaaaccagaaagtacagtcctagcaccccaaagaagttgcttgtgctgagcctttgttgtcagactcccctccatcccaatctggggcaaccttccctataggttttccttttctgggtatcataggagtggaatcacacagagtgggaaagactggcttctttcacttagcataatgcctactgtatatacctttaaaatgcattttaaaatgcaaagaatccttgccctcgtcccccgcccaaacaaataaaacagggatctgagaagatggatgtacagaaaaggtgagttaggaacatactgagatgtaaacagacatttaccgcctgaggactgtttcagttttcagtgaaattaggtgagcttcttagctttgagtgagtgttggaaaggttggagaggaagtgaccttgaccagttaagtgttttctttttttaaactagcttcctttccttctctgacctttttcactccccatttctcccctgggttgcggatgggagaagatacacacacacacacacacacacacacacaaatatgcatacataaatatatatatatgtatctccattttcatggcataacaattttattatttttgctcctggactctggaaatggtgcttttactattgaaagagcatacacaaaatcttagtttcttatgtcctctcttataaagagggcatccacacatatcagattctaacttcagctgtagttgcggggtatcagatgacatgtggtggtaccaggatgtgatataagctagagccatatacttgtatttcagtccaggatttatttttactaattttttctttataaattttttgtattgttttccttgttactgatagaagtttgaaagttgagaattaaaaatgatagaataaaacaaattattttttaatatctggaattggaacttttagatgtaaaatataaacaatgtatctgttcataattcccatgcttttatgtggtagtgttgatttatttttacaaatcagtgactatgagattaataagtgcttttataattgtatatatatatacacatatatataaagtttaattatatttaattataaaagcacttactaatcttatcctcactaattctcctagatgctttgtcattagaaatttaactgggttttgttttccttttttttttttttctatagctgtgatattcaaaacacagatgatgttattccaccagagagcaaatagaaagcaggcagggcaggttttcttgggacatttattgcattcatcaattattacctccaccttactacttttcatccatgatgattaatatatttatatcctcatattgttgacctgcttatattgacaacatattctactgataatgtgattagcagggagatgtaaggaaatgttaccatataccaaaggccttccttggtgctagcgttgtgcttattacaaattcagcatattgctcttctgacataaatagaattacactactttatcttctcatttgtctggaggacaattatctgatacttcacatatatccagaagtcggaatgtaagccccaaaagccctcagagtggccacagtttgctaaaagcaaatgcgataaatcttgtgcccagtatataatggatactttatacatattgccttatttaactcccacagtaatcttttgtgatagccattgttgccatatttatagaagagaaaataaattgaagattctgaagaggttatagaccttgtccaaggtcgtctatctagagatggagagtgttgcagctgagatttcagcatgggtttagaccttgtccaaggttgtctatctggagatagtgttgcagctgagatttcagtatgggtttgtgtgtcccccagatcctcacgctgagtccagttgctcccattttcagtcattcccacaaatattttttcagtaccaactatgtgacaggccctggtatccaggattaaagacagttatacagagtcctatagaattcctttatctgtttttttttggctgcagtaaatgtgaaacagactagaaaagagatgaggcatgaggacagtgacattgtctctcttactgactgtcacatctgcagggtgagcacagcacctagtaggagctcaataaagatatgttgaatggatgagtgatattagtgaaaagtaataactaggagagagaatcaaatatgaaaaggatataaaataaaaactataattgccttggaccatttagtgtttgaataagcaaaaggctccatagcccctagggcacgaggagccactcagtgtactcactgatgcccgtaatgatgacctggggctactaagtgaccatggtgacccaggccctgtgcagcagggaaagagtcactcatgaatgtgacatccagtttaaaaataaaggaggcatctaaaacattttagaaaacttttcattgaaaatggtcttttctcccttaaagtgtgctaaagggctaaacttcattgtactggaaaaatcccatattggagtagctctttctctaatgatattggataaagggggataacacatcacataatttgttttcttttccttaataagtcgtagcattaaaatttcatgccaggtgaatctttaaaaaattcaaattattttctttggaagataccttataagaaactatacatagtatacagcatataaccatctatagtattgtaacaagtgaataggttatgtaaaacaaccttttttgagcaatgccatctgagaggattatgatgtgtggaaataattcatgtttggaatatcatttagctttttataaggaaaaaatgaggaaattataggaaactattgaaatgatttaaatttcattattcaacagcatcgatgcgctactttcttgtttcaaaaatgtatctattaacagtgatattttgccttacagcttttctgggagaagaggctacaaggacttagtgcatcagatgtaacagaacaaattataaaaaccatggaactacccaaaggtcttcaaggtattatctaagttcagttgagcagacatttatcaagtacctactgcatgccaggcactctgttagatgctgtggattcagcaatgactgacaggaggcctttgctttgggaggtcatatgccttgctggatgacgtacctcttgtgttttagtaaagccaggaagaaggtacatgagaaacttgtatgttgcagggatgctgcagtgtagtatattatcttagatttttttctttgtaaaaattttggctttaggttaggttcatcatagaagctaacccatgtgctgcttttagcactggatgcggatgagtaacagaatttctcaaagcttcctgcttatagcaacatctggccctaccacctgctctttctctcatcctcttcccaaaagaacaaccaacagctctccttctgcccctccctccacaaactggtgctctaagtagaagtgggaacagatgcactttggtccagcaacagcagccagtgggatctggggtggaaaactcagtcactagtctacatttcatgctgtatgagaactccaagttctagagaagagttatttttcaagtattaaaactttggcttctaaagcttgatatattgtggattgctcaaaaatcctcataattcatggttagattattgccttatccctttatgttcttggaaatgttggccttaactagttaaacaggtttaggactttaagcattgcatttaaatgtgaccatggtaccagtatcttacaagtaatcaaagtgtgcagttattaattctctgattttggatattttgttaggtttatgaaaaaagctgttaaagccacagatacagcttgcttgcattggctttttctttgaatcctgagacaaagaagataattgttgagatattgctggaaattaatgttaaaagctacaaggagagactataccagtactctaggaatacattaaaagggatacttgagtatagtcgcttcacaaagtcttacctcattaaaataattaacattgcttgaggaaatatagccaactttttaaaagtttagtaccttggaaaatgcattttaaagttctggtaaagtattattaaaatgctcagctataagcttacagcaagcatgaggatttgttttttaaagtaagaaaaaatgctcagctattttgttactatttctttagtgtgaattctttagtgtgtcatatctattaagtagatatattatcttttgctgctttgtcttatgtcagttttacatatatgatcccaaatgaatataaaaatatcagttgttttatgtcacataaagtttgctcagcacattgagacatttcctttaactagtacttgtttctcattgcaggagttggtccaggtagcaatgatgagacccttttatctgctgttgccagtgctttgcacacaagctctgcgccaatcacagggcaagtctccgctgctgtggaaaagaaccctgctgtttggcttaacacatctcaacccctctgcaaagcttttattgtcacagatgaagacatcaggtaatgcagtttaacatgacttcataaacttgggtttttacgtttgggtaaattttttactgttcattaggttcagtggcatatctagtaagtgatatatcacctagaaagttatacttttcttttttaacagagtttttcagaaactgatagaaggtgaaaaaagaccattataacaaatacatgcttgaaacgggtataaatgctgcatgccaggggtatcgtcatggtcctgtccaaaggacagacaccagatcagttatattccctaagcatcatttttacagtgtcttttgcaatttgggattctgactttctattctaaagaacctctttctgccagacacagtggctcatgcctataatcccagcactttgggaggccgaggtgggaggattgcttgagcccaggagtttgagaccagcctgggcaacacagtgagaccccatctccacaaaaaatttttaacaattagtgaggcatggtagtatgtaactgtagtcccagctacttgggagattgaggtgggaggactgcttgagcatgggaggtcgaggctccagtgagctgtcgtcacatccctgcactccagccgtggtgacagagctagatcctgtcttagaaaaataaaaatacagaacccctttcactcagttatgccttttctgattgcctccttcactggtttgtctggaaaccaatctctctttaaatcagatgatagtgatgctgctcttaaacttacttgtgacacggtagagcaagaagagaagcaagtaagaaagaagaagccacaggtaaagcaataaaacagagccaggaatgagacaagacacaaactatgtctactgacatctttcactctttctaaggctgactcacaagttagggtttcagcagcaaatggtaaaaggaaaacatccagctcagattggtagaacccagaaagtagaagcaaaccattgcacaggaaaagcaaaagtactccagttagtaagaccacagagcaattcttatgtgggttttatgacctcaatatcattattttatagtgatactgtactatattgcatttatattatattatagtatattaaaaatatgaccttgtgtatacttcactatttctgtcccctgaatgtaaatcagtttaatttgagtattattcctagacaaaatcagcagatgacactttcgaatcatataattttaagatgttttatatttgttcttttgtttgtttgttttttgagacagagttttgctctgttgcccaggctggagtggagtggcacaaactcagctcactgcaacctctgcctcccgggttcaagcaattctcctgcctcagccgcccgagtagctgggactacaggcgagcgccactatacccagctaatttttttatttttagtagagacagggtttcaccatattggccaggctggtcttgaactcctgacatcatgatccgcctgcctcagccttccaaagtgctgggatacaggtgttacaggtgtgagccaccacgcccagcctatatttgtattttttaaaaaaatccatacaaagttgacatgaaagtttttttaaatgggtaagtctagctaggtttataatgggaaagcccttcttgggtcttaaagtaattattttgcaaagataaaaagtggtgcaaagttgtattcatatgccttgattgcatatgaatatgaatgaagtttcttaaaaactttattttttaagaaaacaaaatgtaaaatcaatgaaaggaatcaacttgctcattggattgttcttacccttgaggaagaaaattactccagagacaagttcttttccatcttggaatgaatgctgaattaatcagcagggattctgccaggtccttatatgtgttgacggaggttctctgagttatatcacaggaatgttgatggcttcaacaccagttcttttgatagttgaggaaactatctcaaagccaattctggatgatttcctttttgggtaaatttgtctaacaaattgctcatttgatttaattgtcatgacggaaattaggaagaaaatactccttgttgaattagtacatgttcaaaataaattactgcaaatggaactgttactctttacctaattgggtatccaatagtctgtctacattaaacctccagctgaagaccccaacaagatatatctcaagtatttttagcgtattttataatgtttgcattgatgagtactttcgttttttaatactttgtaacaaattctcacaagctttgcagcttaaaacaatacccatttattagcttaaagttctgtggggtcagaagtctgggcctggtatgactggcttctgtgtttgggtcttaaaagtgtcaccggactgtgttcccttctgaagcttggggttctctttcaagctcatatggtggttgcagaattcatgccttgtgttttagggctaaggcccctgttctcttcttggctatgggatggtggctgtcttagctcctggaagctgcctgtagttccttgtctcgtggctcctccgtgtgcccctttatgcttctgtcaggaagatcccagctccactaaggggtcctattaggtcaggcccactacaataatctctctcttgattgactcaaaatcagttgattggtaacctaatcatggagagatatcccatcatattcacaagttctgctcacccttaagaggagagaattatataaagagtgcacgtaagggtggttttggggaagagggactgttggggaccatcttacaattctgcctacagcaatgggcaaatgattaaatttcagctctcacaaatgtggaaagtaatgctcaagagagaagaaaatcaatggcaaatgttagagtttaagataaaattctccatccaaattactgcatatggtgccatttgctccattttctccttcttcctaatgaggttactctaggacagctgtgaagattcttgtactcttattagtgagagactgccagtgaaaccaatatgtcatttgtcataaactttgagtcactgacccagaggtgagactaactgtataagaaataaacaaatgtgttctgcttgaccctgccccatgacatgaaaatctgtcaaattccggtttcttttaatatgacagaggctatagagctaagactgacccagtgacagcttccctctttttgaaaattcatttaataagtggaagtctataccttttaactctttgtggtgttttggagtttaataaagatatccaaagtttttgtgggaagcagtacatatatgttaccttgactaccttggacatagtcttatttggtcaaaggggtgtgatcttgagtagactgaatataacttggcagctggttgagcccctatggagtgaatactcagggacccttagggcaatcttctatagcattgctcctctacctctctgctgccccagttttgggaattgctgcaatctgtcttcctcggttattggtagagaaaattactttttttttttcagtagaaccctttgtatattccttgttgcatcttcatctccctgtctgcatctttccttatctcctttcttctggtctcaagagctttgcccccttttctgttctgctgaccctccctcctctgccattgccttctgttcttgttcccactggaatcttttcctaccagtcttctctcttctcttgtctttcttcaacctttgcttctctacttggttctggatgtcaatttctatttaccgagctttgtttgctagacacgtattaggaatttatctcttaccatctgggggatctactttcttttcttttttttttttttttactttttaaaggtaagtgtatactgatagcctttcttcctgtgctctaatggttcagagcctttttaatgacttggagttattaaccctcacttttgaggttcctttgtaatcaccgagacacagagaaactcatggcatgttcttaagtaactcactttcttatttgaagagaggcttttcagtgtctgtcctcggtgtgcaggatcatgtagtcttggctccttcatgctgacctgttgcctgcagacctgggaacccaggagagagctctctcctaactaacctagccgcagaatgtcaatcaaaccccagcttatcacgcctctgcttcctccatctttctcagtgcttctatgaacaagtcacttttcctttgttatttatgttccctccatcttttattcctgcttctaagttatttctaattgtccttataggaataaacccaaatcttgacacagttgacattttcaaagttgaagaaaaggtcactgacgtcaatctgctctttctagaatttcatgtgtgatgagggataactgcctctgtgaacattcctctttttggcaaggctcattggtgaggtttgatttgtgtgtagaagcaacctctgcaaaaatctgaaaaggaagtctattcttcttaggaatttaattattttgaagtaaggatgaacttctgtagcagattcatattgtcattacttgccaaattctcagtgcctttttattctgtttttaaaaaggaaacaggaagagcgagtacagcaagtacgcaagaaattggaagaagcactgatggcagacatcttgtcgcgagctgctgatacagaagagatggatattgaaatggacagtggagatgaagcctaagaatatgatcaggtaaactgacaccagagagagtgacttggaacttaaggtgtgttttcttggccggacatagtgcttctgcctgtaatcccagcacttgggtggctgaggcgggcgatcagttgagctcagtagttcgagaccagcttgagcaacatggcaaaaccccatctctacccaaaatacaaaaaattaactgggtgtggtgttgtgtgtgtgtggttccagctactcaggaggctgaggtgggaggatcactcgagcctgggaggcagaaatttcagtgagccaaaattgtgctactgttctccaacctgggtgacagagtgaaaccccatctcagaaaaaaaaaaaaaggcgtcgctgtattttcttgttattttccctttagcttcctcagcagtgaatgaaaaagctactcctctgctcgggttctgcatgtgctgttgtttgtttcttctctctggattgaaggaccatataagttattgcattcttttgttctcatactgggaggacattcacacccctgcagtcacttgcaagggatctagtctccttcattaagaccaggtggaaagcctctaaggtgtcactagagaagagcagcagcagaagaaaaggactttgtcatgtagggaggaacggccccagaagaagaaggtgactgtcatctccatcacagtagcatccagggcatattgcttcctctttaaaattatggtggcaaagcaggcaaaatctctttctttttcttagattctccctagcacagatttgatgcagggagaacaagaaggacactaaaaagtataataaatactttaccttaaaaaatacacatttttaggctgggtttggtggctcatgcctgtaatctcagcgctttggcatgccaaggcaggcggatcacttgaggtcaggagtttgagactagcttggccaacatggtgaaaccttgtctctactaaaaatataaaaattagctgggcgtggtagaatagctggaattttgtaattctagctactcgggaggctgagacatgagaattgcttgaacccgggaggcagaggttgcagtgagccgagattgtgccactacactccagcctgggatggagtaagactctgactcaaaaaacagcaacaaaaatgcacattttgatcttatctcaaactcacattccaggctcatggctctgtgccatgggcataccttgtcttcagaggagcacgtgcagatcttaaggctttctgtgacgtcttgcttcccggcttccatcctgctttgtttcagcaggccatgtcttcctttttggcaccccaaaaccaattatttactagtttcctttgaagccaaaacagagggagggatggggtgctaatatgatgtcaagggtcaacagagcctctctgagaaagtgacatttatgttgagcctgaaagatatataggagtgagccaggagaggtttgggtaaaagtgttcccattagaaggaacagcaaggagaaacttggtttctttaaggaatgaagaaattatccacgtggttggaatgcagtatgtctggggaggggtggggggaatgtgtgggtggtgaacctagtcacgtaggacctgtgggttgttagggagattgatgaccacttgagattgatcatgaaaattagcaggaatcactgaagagtcagtagcatgatcagatttgcttctttacaagagccctatggctgctgcatgaatacaaggattggagtagggaaagcttggaagcaaggagaccagttgggatgttgctgcggtagtctcgcaagagatgatggtggctttaggaggatgttgacatgccaataggttgggagaagaagagatgggtagatctgagatatagctggagaaagaatcacgtgaccaggtgactgcctggaagtgcgggtgagagagtggcgaggatgcctcagggttttcacttgagccatcacttgagctgggtgggagggaactctgtttggtaggggaacaggctaagggtagggattgcagggagggtgagttgaattgttaacacaattatccccttccatagtgcctttatctttcatgccacagcaagaccaaaatccaataatacatataatgtcttacatttacatgtccatccatggcagcactcacttctgggtcacagtttcctgaccatacagaatcatttcaggctgggtgtggtggctcacgcctataatcccagcactttgggaggctgaggtggatggatgtcctgaggtcaggagtttgagaccagcctggccaacatgacgaaaccctgtctctactaaaaatacaaaaattagctgggcatggtggcgggcacctgtaatcccaactacttgagaggctgaggcaggagaatcgcttgaacctgggaggcggaggttgcagtgagccgagatcgcgccactgcactacagcctgggtgatagagtgagactctgtctcaaaaaaaaaaaaaaatcatttcaatccagttcagtgctgttttagctcttttctcttcccttattgaagacatgaagatgctgtgttgatacttggattttgttttccaagctggcaaggatgtatttatgggctttgatgagtatacttaatatgctggaagtctttcagagggaagtctgaagtgtgtttctactgtccacggctgcagccacaccgtctctggagcacagagggatctggatctcacctgatccagattctgcactgttgcttcggaatggactctcagaaagcccttctcttctgtcagggctttttggtttttttctagacttttctcatgaaatcatttcagataatcaagggtcacctaattgaggttttactagacttctgtttcctttttttttattattatttttgagatggagtttcgctcttgtcatccaggctggagtacaggggtgcaatctcagctcactgcaacctctgcctcccgggttcaagcgattctcctgcctcagtctcccaagtagctggaattacaggtgcctgacaccatgcccagttaattttttgtattttttctagagacggttttcgccatgttgggcaggttggtcttgaactcttgaactcctgacctcaggtgatccacccgtctcagcctcccaaagtgctgggattacagcatgagccactggccgacttttgcttcctttacagattactttgcagattgacatccaggctatacccttgtttatgtgagcgaggctgtgttgtaggcactggcactatacttacacagaagttggcaacttctcattgccttgcacaaatgtggataatagtaataacaaactaatgttgaatgattagaattttaatcagttctttaaaagtagccattattttggcatgttaggtagggagagattcaaattatttatgttatcttcccaacttgagaatggcattattagatcaagccattagacttatagattgcggaagatttagatgtacttcttaattatgaaaattacatttaccttactcaaataaccccatatatacctaaaagttttaataaactaaagcatgaccacatgactcaatcagctgtccgtaataacctgtggtataggtaggacttagttgggcaaagggtgagacgtggccatcttcacgggctcataagagataaccaaggtcccttcaggtcggccagcctcatcatgcctcagctctttctaatcctgcttattagtaaggtggatgtttattcatttatttatttggttagttaaataacaggccgcaatttactgtgttacttaaattttacttaagtaaaatttaagaagaagaagaagatgatgactgtaaaaacaaaggtgtgaatatatttagctatacatgagataggatatcaaatacataaatagttcaatttgcagttgcacagtgccatttcacccaggttaaacaataggaagactcgatgcatacgtgtcatctgtaaatgctctcatgtgaaagaaattgtgaagtaaaataaagtatcttgagtagaaatttttctacattttctcaaaatatatttggattggtctgtatctgttctgctttttcatttgtatgccctttgaattctctttttatgctgatgtagttaattgtagttagaaaatatttgcataaacatagaagaatacatatgatttctttggaaaattaacaggatagtaaaggttatcatcaaaataaaacgaaacaatgaggggatatgttgagcactttttatttatgaagtgctgtaactacatgttcatcaaggctgtaaaagcatggttcttaagtggaattcaatctctaattcttttttgagtattgctgacctctcacctgataaatcactggattacttaagtttgttcttttttttttttttttaacaggtaactttcgaccgactttccccaagagaaaattcctagaaattgaacaaaaatgtttccactggcttttgcctgtaagaaaaaaaatgtacccgagcacatagagctttttaatagcactaaccaatgcctttttagatgtatttttgatgtatatatctattattcaaaaaatcatgtttattttgagtcctaggacttaaaattagtcttttgtaatatcaagcaggaccctaagatgaagctgagcttttgatgccaggtgcaatctactggaaatgtagcacttacgtaaaacatttgtttcccccacagttttaataagaacagatcaggaattctaaataaatttcccagttaaagattattgtgacttcactgtatataaacatatttttatactttattgaaaggggacacctgtacattcttccatcatcactgtaaagacaaataaatgattatattcacagactgattggaattctttctgttgaaaagcacacacaataaagaacccctcgttagccttcctctgatttacattcaactctgatccctgggccttaggtttgacatggaggtggaggaagatagcgcatatatttgcagtatgaactattgcctctggacgttgtgagaattgtgctttcaccagaatttctaagaatttctgctaaatatcacctagcatgtgtaattttttttccttgcctgtgacttggacttttgatagttctataagaataaggctttttcttcccttgggcatgagtcagatacacaaggacccttcaggtgttactagaaggcgtccatgtttattgttttttaaagaatgtttggcactctctaacgtccactagcttactgagttatcaggtgcaggtcagactcttggctacagtgagaggcagcttctagacagagttgcttaatgaaagggtttgtaatactttacaaaccattacctgtacctggcctggcctccaaaatattaacattctttttctgttgaaactcgcgagtgtaactttcataccacttgaatttattgatatttaattatgaaaactagcattacattattaaacgatttctaaaatcaaaacatacttaatctgataccaaggaagggagggagtggttataagcaaatgaaaacaaattttgagagacagagcaaaagtaaaatcattctatagaaaaggtgtgtttatttcttaactcttgagttcttttaaaattagaacctaaatgatgcagtcaggggtatgaccaattccacatgagtgtcacctgtacattttattaccactacctccagtttccaaggcagggaagaagaggggaatagtcaaagcaatatgactagctaggtttgggctgctgtttgggctgctgtttttcctggacttttatgccaaactacataaatacttcttggaattcctgatttacgctcaactttgatccctggaccctagggccattagtttccttgaagcagtcctgctggtggatgagcagggaaacttgtagaccctgggaagccaattggtagagggtgcctgcccgccccatcagactgtcccaactggggtgggggtgaggatcatagtgatttctttttaaaagctagtatgactagtgagaatggatgtccaagggcttttctcttcctcccccgagtccacgattcttcatttgtgatcagggttggggtaacttcaccttggtgatcatatattctttttacaaaccaatccagccaagatatatgtgcttttctaaacagcttgtaaaagcaaaaacacaatgtatacacatataaaactgatttttttttttttgcttatatactttgctcaggtggagaacaaggtatgaaagccattatatggtgtcccttggggaccatcccataagtccagggtgttcccaatatacccacaagacaacatgttcaaaacttcatcacctggtccccacaaacctaccaccctcttccattccctcactctggtaaaagcaagccatcttctccagttacgcaaggcagaagcccaggagtgagcacaatgctgccctttcccttgcttctgacttctcatcaatcctattagaactactgactgcaccccacctctcctccatccccacgatcactgccttcatatgaactgcctttcctgtcctctggactttcagtggcttccttttttgctcacctgtccactttcttccccttccctctctccatccctccacatagtcatcagaaagatcatcaaaacaggcaaatgtgactgtattatttccctcacttatctttgtatgcagtttagagtgatttttaagagcacacactttgaaattaggagaacctgtgtctgaatcctgatttttgccatttgtgtgacttgtcaggttatttaatctctttgagcctgtccctcctcagtgaaataggaataataatacctacctcatagagttgttgtgaggattcagtgagatagactgtttctaaagtgtgtagcacagtgcctggcacatagtgggtgctcacattggagcacactattgtcgctatccctgcaggtgtgagttttacatcctttccaagaggcatttgctaataaccctaactaccgcctatccctgtgacactattttctgcctcagcaccctatttcttttgtagacattttctaagtctgtattttatttatttgttggctttttgtctatttctctactagaatgtaagctccatgagagcaaggatgtgtttgtctgatttcccgttacagccccagcacttagctgagtgactggcacctagtaagcactcagtaactgtttgctgaataaatggaagaatggtcaaaaggctcttcttgatctgatccctgcttgtctgtctggcctcatgctgccactattcctcactgcaccttcagctcaagaaaaacctctttacttgcttctttgaagtgccccttgggcctctgtgtctttgtacctgttgttccctttgcctgaaacaccctttgcctgcccgtctacatggtgaattcctaatcattgatgaagtctcagct

SEQ ID NO: 12311 - DNA, 10445 bp, Human
tttcccataagggatacttttagttaatttaatatctatagaaacaatgctaatgactggtttgctgttaataaatacgtgggtaaatctctgttcggggctctcagctctaaaagctctaaaggaaatcagacccctgatttcccacttcacacctctatatttctgtgtgtgtgtctttaattcctctagcaccactgggttagggtctccccaacagagctggtcttgacagaatatcactgatcagagataaagaacaaataaagtgaagatagatctttgacaccaaggacaattcactaaagagtttatcgaatgattgactcagagaccaagaatcaggccttaggaaatacttagcgggaaatgggatggagagaaacctgaaagaaaaagataatcatcagagaagtacggggatgacaaagaaagaacagcgtcatagaaggcataagggaaacaaatgtcaaggagtggtcaactatgtcaaaacgaataagaacagagaaaactggatccttaaagatgagtagcttgaactaacctcctgtacctgggtaacgaacattctgggcaaaatatattgtgaaccatgctgatgttctttcgccacaaaacataagtgatagcctctctatcaagagacctagatttcctagtgtctggtcctgggctgttttcccatggccccgctggttctcttcctctattcctagaaaagtatagaaaatggagctctctttgcttgccattgagctcatgtcctgccaacttctacccaagtgacaggtaggtcagtaaagttacaggctgagaaattaaaattatttgccaaacactagttttatgattatctattaacaacagccacaacaaatcaagaaggagtcccagtgtatttcaattagcttctagctcaagtgatacatgagtagtatggctagaataggcattgtagaagtatgaatggagaactgtctcttgttttctgtccatctttattgttattgctggatattaaatgctgtaatttttggcataggttttttccaaagactggtctcttgggtcaagttttcctgaacttgcctggtattgggcaagttcacacagaaaatatgagtcatttcacaaagtcctgggcttgtctatctacttgaaggaataggaaatggacttcacttggagcatgatggatgaggcttgggcttttactaatgaaataagtttcaatcttaactcagttaaacctttaaagacaggagaaaactatctggggatggattcaggccagtgagatcacgttgcacaaatctccccttaagggatctttactgacctagaattgtttcaaaataagattccaaactgtcgagggagtttgaagccttgaaacttggtgtaggtttgcttaaaacaaaataacgaatatactacatttcccaggaggcttcgcggtgagcctccgcactcggctggttctctttaccgcgaggaaagctgggaaatgtagtgccacaggcaaccctgcacgtgacgcttgcggaggaaggggagagagaggcgcgcgggagggcgtctagggaatcgaggtgccggctgctccttcctcacaatttggtttgtgctgcaaggggagggtccccatcatctggccccagtggtgtaaggagctgactgggattcagtcactgacttggagccgctcgggggaagtcccggtgggtgaggttccgcggcgcctggtccagtttctcggcagtcaggccaggagggggtggggaaggtgcgaacagccgggggctcggagctcgcgccctgcgccccacccaggttgcggccgcccggggaggaagcgcgtataggttgagtgcaaagtttccttttttgctttctcgtcagagcagcccagacaggcggtgggtgggaatgcctcacttcagtttgaagagggtccggatccaaaggggttaaaacgagcgacccccgatccccgaccacacttcccgcctccctaaaacgcacaccccgctagccatgggcagccgcgaccacctgttcaaagtgctggtggtgggggacgccgcagtgggcaagacgtcgctggtgcagcgatattcccaggacagcttcagcaaacactacaagtccacggtgggaggtgagacgtctcgggggtggggagggggagggggaggaggaggccccgaccgcggactcgagctggggacccaagtggggtggggatttgctgtcggttgttgggtccttcttcgggtcaggaagtactgtctgggaacctagatggtgtaattgccgggtgtttggtttacacgcctctcttgagtttcccgttagattttcccaaactgagcccactgccaggagaaaggtaagagcaaaggcgtgaagatgagaaatagggaagggaggatgaggatgagcaattgctgtttattgcaggcgtactgtgaacttaagtctccagcctttcagctgtccggcaaatctctccaatcagcagaagcagctgagatcctctgtggggcctcctggttaggtgccggctggggctgtagtcctgcccctctgttgagggaggaaccgcaaggtgtttaacctggcttcagtgggagaacgcaggaagcggaactggtctgaaggactgtagctttgttgtggggctgtgggtgggatggaagacacaaaatccccgaacgagccccttggctacgcagtcagatgcccatgagggctgatgagctgtgtttttgtccgttgattgcttaaataaaggtaaccaaggaattcttccaagaatgtgaaatataccacttctctgacctatcttcccaccacttttttcctcaaactggagaaggtagggaggaaggggacaccgagttcattcatttctttcccgggtgtggcctttggactcaactattttttcagaggcagaaatgccttattgttaattagaaggtatttagctaggaagagctggtgatgggggagagtaacttaaaattttatttctctctgttaaaagaacttgtttcaaggggggaaaactcgtaccaatggaaaaattgaaaatgtgtgctcctgttcatatggaagtttaaaaagaaattaacaaacatttacattgcaattaaaacattctccttaagaacccccagtagggcccagtaccgtggttcatacttgcaatcccagcactttaggaggctgaggcgggaggattgcttgagcccaggagttcgagaccagccatgggaaacatggcaagacccccacctctacaaaaattaaagaagaaagtagccgtggtcccagctactcgggaaactgagacgagaggattgcttgaactggggaggtcgaggcttcagtgagccccgttcgcaccactcactgcactgtagcctgggcaacagagtgagaccctgtctcaaaaacaaaggaacaaaaaatttaagtctggcaaaattaaaggttcaaagtttcagacactctatcctgaccgctctgccctcccactcctaaataatataagggtccctatttcacggatttgggttaaaagtggcctgctattaatagttaatttttaacaattgctgtagttttcctttagcaaagaatataattggctaattttttttcagtgtttagtctaaatttcccttagctttgattcctgtcacagatgtgaaagataatatttccaaacctcagaaattactctgtttctctccttagccaaaaggctttccccatggaatacttactcagccttaaggagtctcagcacctgcagacttggtggtagattccagcaggactcttcagcaacatccacacagtgtcttcttcttgggactcctctgggaccttttccatttattccattcttgcccaagataatacctgcaaccttatggtggatgtagagttccccagggtgtgttcttttcataatacaatttgattagaaaccaacagtgaaattgaatgtggaagatacgaaagcaaccacacttgtctcatttcccccttctcccccatcaccccttccctgagaaaaccccctaaatctcccagaaactatttaacctgagaatgagaattgttttcatagttactcccacccccagtcttggagacaaacagtagcaaataaatgagcttgacagtagagtaaaagctggaaacccctttggagagtgagtatgaatcatccatctcacactaaatacacgcatgtggactcatctcagtgaattgagggcttaaagataaacatatgggattggagttgtgtgtccatagggtttcactgcctatttgatttgagtttatccctattaattttttacagtgaaattttattaaagtataatgtacatatattttcagtggattttgctctgaaggttctccagtggtctgactacgagatagtgcggcttcagctgtgggatattgcaggtaaagtgggagggctagataggaacaagggaagaaattttgatttaactagaaagctctgaggaaaaaatggggcagcaaagccagaaattgtttttctgaagctggaatgattgagctgctctgaggacacatgagctgaataggtgcagagcttttgtagatgttttgccctgaatagatctggagcagtctctatgtggatggaggggctggcaaggtggtggattgtccagactataggtggacactcccacagcaggggagggtgctttttctaggtttaaggctgaccttggtgaaaaacaagatccccagaaaatagatacagtaaaaatagtgaatccttactatgtgccaagcattcttctaagtattttaaattcactgactcattaatcctcacatcaaccctatcataaaagctactgcttttggagaattgcttgaacctgggaggtggaggttgcagtgagcctagatggcaccactgcactccagcctgggcaacaggagtgcaggaaactgtttcaaaaaaaaaaaaaaaagcgactgcttttatcttcactttacaaatgagaaatctgaagcactgagagcttgatttgcccgaagtcaaatagtatgcagcagagcagggatttggactggagcaatctgggtgcggaatctgccttggaaataattgggcttcattatccctttatgggatagaaaaccaagagtcagagggggaaagtgagtggccccatctgacacatatgcttactgccctcttctacaaggaatggggagaggccggctcttgggtcaccttgagaactctcccctttctccccagggcaggagcgcttcacctctatgacacgattgtattatcgggatgcctctgcctgtgttattatgtttgacgttaccaatgccactaccttcagcaacagccagaggtggaaacaggacctagacagcaagctcacactacccaatggagagccggtgccctgcctgctcttggccaacaaggtatgtggccaatctcagaaaatggtccctagcctctatctgtggttagaaaggaagtaaaatgctctctgattctgggcatccatttccccttcttaagttggcaaaatcatctctacctccttcaaaggatgttgagggtgagtgagactttctttcttttttttttttttgagacggagtctcgctctgttgcccaggctggagtgcagtggcgcgatctcggctcactgccagctctgcctcccaggttcacgccattctcttgcctcagcctcccgagtagctgggactacaggtgcccaccaccacacccagctaatttttttgtatttttagtagagactgggtttcattgtgttagccaggatggtctcgctctcctgacctcatgatctgcccgcctcagcctcccaaagtgctgggattacaggcgtgagccactgcgcccagccaagggtgagactttctttgggaagaatgttgattatagatttccgatgctggtgttcttatccattggtggaaatatgtttaaaatccacagtatctgagccatattctttcttagttgcaggaagtttatgatactgccttttattttttctctttgctagtgtgatctgtccccttgggcagtgagccgggaccagattgaccggttcagtaaagagaacggtttcacaggttggacagaaacatcagtcaaggagaacaaaaatattaatgaggctatgaggtaagtagctcatgctgataggcatgcagatgtatccatcttccactgtggccctgtggaccctcttttcttatttctgagccaacaatgacagactgagccattggaatgctagcccctaaaggtcagggatactgtctttcctgagataactggggacaaaggggcatttaaaccttctggctttaccaaatactctctgatgataagtcagactacatctgccatttctgcttttcctccaaaataagcttctcaggcttattttttgtcttttagagtcctcattgaaaagatgatgagaaattccacagaagatatcatgtctttgtccacccaaggggactacatcaatctacaaaccaagtcctccagctggtcctgctgctagtagtgtttggcttattttccatcccagttctgggaggtcttttaagtctcttccctttggttgcccacctgaccattttattaagtacatttgaattgtctcctgactactgtccagtaaggaggcccattgtcacttagaaaagacacctggaacccatgtgcatttctgcatctcctggattagcctttcacatgttgctggctcacattagtgccagttagtgccttcggtgtaagatcttctcatcagccctcaatttgtgatccggaattttatgagaaggattagaaatcagcacctgcgttttagagatcataattctcacctacttctgagcttatttttccatttgatattcattgatatcatgacttccaattgagaggaaaatgagatcaaatgtcatttcccaaatttcttgtaggccgttgtttcagattctttctgtcttggaatgtaaacatctgattctggaatgcagaaggagggggtctgggcatctgtggatttttggctactagaagtgtcccagaagtcactgtatttttgaaacttctaacgtcataattaagtttctcttgtcttggcatcaagaatagtcaagttttttggccgggcatggtggctcatgcctgtaatcccagcacttggggaggccaaggcaggcggatcacatgaggccaggaattcgagaccaacctggtcagcatggcaaaaccccgtctctactaaaagtacaaaaattagccaggcgtgatggcacgtgtctgtaatcccagctactctggagactgaggtgggagaatcgcttgagactgggaggcagaggttgcagtgaaccgagatcatgccaccgcacttcagcctgggtgacagagaaggactccgtctcaaaaaaaaaagaaaaaagaatagtcatttttaaactacctatctcatgcaatgaaagcattttcttccacaaagagcttaatcctcatgataggattgcctagtgtctcccatttgcaggtttctgggttgatgtcttaatgcataatactgcaagtgacatcagctggctgtgatgcttcgaaataggtctgctcctcacagctttgggaatctgaatggaagaagaaaagagagaagttaacaacctccactggggcaactttgtgaacatgtaggcacttagtcataggaaacatattatgtgcaggtcctagcctggggtaggaaagtagatagacagaaaatcattaggtaatttaagtactaaattgggcagggctttttagtatcaaatcactactagaccgtttaatttgttaaattatctctaggatggtgatttataacctacccaaagttatcgatattcttactaaactctgaggcctgaagttctgtgatagaccttaaataagtgtcctaagtcagtggttcccaaatctggctggtcgggaatacctgggaagtttgttaaaattttttaaaaatgttttaagatttttgggtcctgagccaggcgtggtggctcacacctgtaatcccagcactttgggaggctgaggcaggtggatcgcctgaggtcaggagttcaagatcaacctggccaacatactgaaaccccgtctctactaaaaataagaaaaattagctgggcgtggtggcgggcacctgtaatcccagctacttgggaggctgaggcaggagaatcacttgaacctgggagttagaggttgcagtgagctgagatcacaccattgcgcttcagcctgggcaacaagagtgaaactccatctccaaaaaaaaaaaaacaaaaagaaaaagatttttgggtcccgacctcaaacctactgaatcagaatttctagggatgaagcctaggaatgtgttgttgttttcagagcttccctggtgattgtgataagcctggtttggaaaccattgctggagaactttgtaaagatacagagacccagaccttttgtatttacatttaaatacaaatacaaatcctgggtttctatatgttctgttagcttttcaggtgattctgctacacagacgttgaaaaccactgccctaagaaagagatcagaggccacatatcagagagaaaagggaccaaaccttcggtggtttgttgtgtgtcgttttaatgccaattattttaacttgcacagtcttctgaaaccttgtattaatagttctcttttgtattaccattttcaggtagggttttgatcactatgattctgaagataatagtgaaatagtgaatttcattgatatgaagagataattgattttcattcattggtttgaacacctgcaaaatcacaaataaatgagaactaagtcttgtattcatggtggttattggcctttaatgtgagtttgtcaaagtgctgttttatactgatagctcaagaggattgcggaaatggagactttattttttaaatacctttttctaaattttcaattcaaggggtacgtgtgcaagtttgttacatggatatattgtgtgatgctaaagcttgggtttctgcttagcctgtctcccaagtagtgaacatagcacccagtcggcactttttcaacgcttactccctctctccccacttttgggagtctccagtgtctgttgttcccatctttatgtgtgtgcccaatgtttacctcccacttacaagtgagaaatgtggttaaataccttcttttaaaatgaaggtaaatattattctgtttacctgttaacttactaataccaattgcttagatccatctgcctagtaccaattcagtacttgatggaacatgccaaatactacttggaaacgtgacctttttgaaaaactgaatgtgcttgcttttcccatttgctgactcaggatttacctgccttttcaagcattgttagaggctggccagccagccagcccttctggatattctctcccaactggtgaacattataggcctgaaactaattaaagaaggaactgaaatatacctaattcctcttcgtgcccctatccataagagaaaagcaattatgattaggaaaaataaaatatttacatgaatggaaatgcgatgctactaaaaataattaggtcttatcactcggatgctacctctttggtgcattcaaaagaggtagcgtccaaaattgtttggaacgtagatatcgtagcccctccctagaggaggtcctacatttgagacaagatgcctctccaaccactcaggtggcttttggtcaaaaaagaaaacagttcccccagagtgttctcagaaaccctaagggagggctgagaacacagctgtggggtagtgtctgccctgactttcttctttgaacagaagaaatttggtcacttagctgagtgaccaaataagtggagcagaggagattgtaggtcagggaaggccctttagcagtaaagaatggtctgctgctttatcactactattgcgccagaattaccccaaggtgtttccctaattcactttctccaggtagggtccctcactgtttcctgttatctccagatttaactttttctgtaggtggtctctcttcggtcctcaggatactatctcatctaacgtgaggcctgtcttgcctgatacttttgtaggcagtggctaaggccatggttagaggatgtaaaaatttccatggaattctgtaaaatctagtaaccagattgcccaaggaaactaaactcaatgtacttttccccttcaaccttctttttgtttgtttgtttgtttgtttgtttgtttgagatg

SEQ ID NO: 12312 - DNA, 16073 bp, Human
tgcgcccggccaattcttgtatttttttgtagcgaaagggttttgccatgttgcccaggttggcctcaaattcctgggctcaagcaattcaccctcctaagcctcccaaagtgctgggattataggtgtgagccacagcgcctagccttctttctgttttcattttgttacctctcgttatttcctcactcctctttggtctctctcaccccctctaccaagaccgctctttttttttttttttttttttttttgagacaagtcttgctctgttgcccaggctggagtgcagtggtgcaatctcggctcactgaaacttctgcctcctgggttcaagcaattcccctgcctcagccttccaagtagctgggcttacaggcttgttccaccacaccgagctaatttttgtattttagtagagatggggtttcactatgttggctgggttggtctcaaactcctgacctcaggtgatccacctgccttggcttcccagagtgctaggattacaggtgtgagccactgtgcctggccccgcaagaccgctcttgccgaggccatgaccccagctcaccaaggttgcccatgaccccagtttgccaagctgagtctctgtcctcagtctttgcctggcccaacagcaccacccaacacaggtggccactctctacatgaaacattttctttactttctaggacccaactttcctggttttcctctacttcactgccccactcatcccagtcttcctttgatgcctcctcttcttctttctgccctctgaatcctagggggttagtcctgggcgctcttacctgtcttctctcagtctcttggggatctcaccagtctcatagctttaaatggtcatcaaagaacaatgactcctacatttaaatctccagcccggtctctcccctacattcagatttatacatctaattgtctacccaacatttccagtaggatacttaaaaaaaaagtattctatttatttatttattttgaggggtaggctcgctctgtagccccagctggaatgcattggcacaatttcggttcactgcaacctctaccttccaggttcaagcaattctcctgcctcagcctcttgagtagctgggactacaggcacacgccaccatgcttggctaatttttgtatttttagtagagacagggtttcaccaggtggccaggcttgtctggaactcctgacctcaggtgattcgcctgccccggcctcccaaagtgctgggattacaggcgtgagccactgcgcccggctacagggagacttttaagaggcgtctcccaaggagaacaggggttcgccagcatggcaagaggagggcaaagcgaattaaggttggaggtgaagaacagttaatccaatcaaatggaagacgtcgagtggcgcgagcactggggtgtgagcgcgagggtcagggttgcagcgccaggcagggttgcagcgccaggcagggttgcagcgccaggcagggttgcagcgccaggcagggttgcagcacgttggaagcgcactggagtttggaatgtctctcccagtcaaccgggaaagacgcagcgctgccctaatgcactggccaccccagaccgtatgcacaacgttgggttggcagcttctacaccagggaaggcacccgaaaccccggcgcggcagctggggaggggctgcccccagccagggacccgcgagtgctggggcagccgcggctttgggcagaaccattctccggagatggagagggcagaaaaaatctttcgctcccatcccaactcggagccatccggaacttgcactcgcccttcttgccctgcttttcttactgtgctctgttccgtcaccactagctcccctcccgcgcggctctgagtcccgcttgccactagttgcttctcggcagcccccacccctacgcgtggtccggcccggcggctggcgcaggttataaaggtcccgccgcagcagcggacggcagactcgagatgcgcccgaggaggttgggccggtgctgcgcggggagccggctcggacccggggacccagcagcactcacctgtgcaccttcgccctcagccagtcccgctccggagccctctgcgcagccgcaggcacggggcactggacagagagtaggatcccgagccacctctggaacccagttcctctcggaagcccgcaccggagctcgcccggcctcggaggctggagccaaggcaggagcccggcgcccgtccgcattctcggccatccaaggggatgtccggtctatgcccgacaattcggacgcgccgtggacccgcttcgtattccaagggccgtttggttcccgggccactggccgggggactggaaaggcagcgggcatctggaagacgccagccgcctacgttggccggcgacccggggtgtccggccctgagcgcgccgcctttattcgggagctggaggaaggtaaatcgggcccccggggtcctggaccgggtggggactggggcaactccagggaggaagtggccccatcgggtccaggcaccccgccccctctagcactcagtgtcacccgtccaccacccccgcgatgtcactgcggtgtctgtctggtcgccccttctccatctcctcctctgctcttgtcccctggtttgtgcccgtgagtcaggttctggggcctgcacgctcgcccacccacctccacgcgcctcttgctgcggcagatctgcaccccctcagcgcccctctcctgggtctaccgcagtgccaggagaggggcggggggctgcgggagggcgctgtcccgcgcgctctgagcctgcgctggccgaccgggcttgcgtgcgatggaggggtgggtgggcgggcggagggggaagttttgcccactttttggttgcgggtatgggggcaaagtcgcgctcttttcctgccccttgtctctcctatcctcctgcgggtcgggggagatctctggattgggcctagaggctcgagtgtctcctaatctggtgaagtcttcctcctgtcctctgcacacgcaacaggtgcagggtgagtggctgcgtctgtttgtatgacccaggagactccattgcactgcctcctgggtagggggtgataagccagtctgaggctgtacttcccctggctgtctccattctaggcgccagggacccaggtgtccggagagcccagtttctgagcctggaggactgtgacccccttacctcaggctcctccaggggtaaaaaaaaaaaaaaaaaaaaaaaaaagccgggcgcggtggctgacgcctgtaatcccagccagcactttggcaggccgaggcgggcggatcactaggtcaggagttcgagaccagcctggccaacatggtgaaaccccgtctctactaaaaatacaaaaataagctgggcgtggtggcgggcgtgtataaccccagctactcgggaggttgaggcaggagaattgcttgaatctgggaggcagacgttgcagtgagctgagatctcgccatcgcactccagcctggaggacaagagcaaggctttgtctaaaaaaaaaaaaaaaaaccaaaaaaaaaaaaaaaaccaaaaaaaaccccaaaaacctaaaaaccctgtccacttggccctgggagcagggaagggagtgttgagtgccgaggggtaaggggaggatgtggggggcaggaggggagcccagtcttctctcccgatgacccttgttggagaactgacgataggacgggaaacagctgtttgctggtagcatctgctcctttttcctgacctggctgggccttttctccccacctgccgcctcctgcagcactgtgtcctaacctacctccgccagtcaaaaagatcacccaggaagacgtcaaagtgatgttatatttgctggaggaggtgtgtactgccttcctgatccaggcaagcccttattctagttttgtcctgtaggggtgggggtcttgtttatttcctgattggcagtctctctggggccccaggttagggtccttcttatggaagacaggtcgatgtgggatgttcaggctggaagagctctcagagccaatctggtctgatcttctttttccatgaggggaaactgagccaggttccacagtgggttaatggcagactctggtctggtaccctagagaactaggggatggggaaggttctcttaggggcctagcctctctctgacccctgtgtcccccccagcttctcccacctgtctgggagagcgttacctatgggatggtcctgcagagagagagggacctgaacactgcagctcgcatcggccagtccctggtgaaacagaacagtgttttgatggaggagaacagcaagctggaagccctgctgggctcagccaaggaggaggtaaccgggtggggaggagaggatagggggccaatctacacctgcctcatgccaggaccctctcctgtccctgcccactcccaacccatggctcctctctcttcctgccagattttatacctcagacaccaggtgaacttgcgggatgagctcctccagctctactcagattctgatgaggaggatgaggatgaagaagaggaggaggaagaaaaggaggcagaagaggaacaggaagaagaagaagcagaggaagacctgcagtgtgctcatccctgtgatgcccctaagctgtgagttcctgcctttgcacctgcaagtcctttctctgagcctcaatttcctcatttgttaagagggacacaggtgatgtgcttgccggcagggttgctggaactaattgagaacactgcccttagccctggtgggctgggaactgggaagccccactccctgcaccctgactcccattcctccctcccctaggatttcgcaggaggcattgctgcaccagcaccactgcccacagctggaagccttgcaggagaagctgaggctgctggaggaggagaatcatcagctgagagaagaggtgagaatgggggaggagggcgtccctgctagcagggggtgttgacttccctgtcccttcctctttgtctccctccaggcctctcaactcgacactcttgaggatgaggaacagatgctcattctggagtgtgtggagcagttttgtacgtaatgttgtcactcggggtggggggttgtcccaaggagcagagaaaagaactcaagatgtggagtatggagatccaagttcaagtcccagatctggcactcctagctgtgtgaacttggatacattccttgacctctctgaacctttgtctttagaatggggattaattttctcagccccactgatctctccagggtttatgaagattaagagtgtcaacagctgaggaagtactttgtgcaaactataaagagctatacagaaattgtgggtctcaggccaggcacggtggctcatgcctgtaatcccaacagtttgggaggctgaggccggcggatcacctgaggtcaggagtttgagaccagcctaaccaacttagagaaaccctatctctactaaaaatacaaaaattagccagatgcagtggcacaagcctgtagtcccagctccttgggaggctgaggtgggagaattgcttgaacctgggagacagagtttgcagtgagcctagatcacgccactgcaccccagcctgggcgacagagcaagactccatctcaaaaaaaaaaaaggtgggtctcctccaagcctgtcttctcttatttggggcaggcaagagggagccatgagctgccagagaccaggcacccagggctgggacagttcagagtcatgcacggggcagtggctgtgcctggcatcgtcctaggcactgtgtgtttatgaagatgagtgaggagcagtgtttgtgcctgaggagttcaagtgtagctggtgagatgcaaacgcaaagtggcaacagctgaactcctgctgttccctttaccccagaactgaccttccttcctgctgggttctgcaactccctgaatggccccactggtccccaggctactggagtaggaaccagtccccaagctctgctgcttttacctcctaggaatggcttaagtctttttccccctccccactcgggctgcctctagcccaagatacctcttaactggtcgcactgcctctactcgcgccctaccaggaacttctgcacacagccttaatgagttttctaaaaccaaacctggccaggtgcaggggctcccacctgtggtcccagctactcaggaggctgaggtgggaggattgcttgagcctgtgaattctgggctgtagtacactatgccgacagggtcagtatggtccagggagtggagtaccactgggttgcctgaggaggggtgaactggctcaggtcagaaacagagcaggtcaaaactcccatgctgatcagtaataggatcgcacctatgaatagccactgtactccagccccagcctgggaacctggcaagacctcattttctttctttctttctttctttctttctttctttctttctttctttctttctttctttctttctttcttttctttcttttctttctttcttcttttctttcttttctttcttttctttcttttctttcttttctttctttccttctctctctctctctctctctctctctctttctttctttctttttttttttgagatggagtacagtgttgcagtcttggctcactgcaacccctgcctcctgggttcaagtgattctcctgcctcagcttcctgagtagctgggactactggtgtgtgccatcacgcctggcaaattttttttttttttttttttgacggagtctcactgtcgcccagctagagcaatgtcatgatctcagctcactgcaacctccgcctcccaggttcaagtgattctcctgcctcagcctcctgagtagctgggattacaggcctgtgctaccgtgcccagctaatttttgtatttttagtagagatggggtttcaccatgttggccaggttggtcttgaattcctgacctcaagtgatcctcccgccttggcctcccacaagtgctaggattacaggtgtgagccaccacgcccggccaagaccgcatttcctttttttttttttttttttgagatggaggctcgctctgtaacccaggctggagtgcagtggtgtggtctttgctcactgcaacctccacctcccgagtttaagcgattctcctgcctcagcctcccgagtagctgggattacaggcatgcgccaccatgcacagctaattttggtatttttagtagagatggggtttcaccatgttggccaggctggtgttgaactcctgacctcaagcgatccatccccctcggcctcccaaagtgctgagattacaggcatgagccactgtgcctgtcccaagacctcatttcttaaaaaacaagtagccgggtgcagtggctcacccctgtaatcccagcactttgggaggcagaggcaggtggatctcttgaggtcaggagtttgagaccagcctggccaacatggtgaaaccccgtctctactaaaaatacaaaaattaactgggcgtggtggcgcatgcctgtaatcccaagtactcgggaggctgaggcaggaaaatcgcttggactcgggcggcagttacagtgagccaagattgcaccattgcactcctgcctggacgacagagattcggtctcaaataaataaataaaccaacaaacccaagtctgaccacgtcattactgtgcctaaaactcccaaatagctttccattggccaaaggataaaccccacccccttgcccactactgtggtctggcctgtgtgcactgttctgggccctccccctcccagtgtcttatgatggcctctgggcctttccagtcagcttggacccatgtttttccttctttgcctgggtgagcttcacttgccctgtggtcttagcttagtggttcctttttccaggaatccttccttaccttgcaggtcgggttgggtgctgtagctgtgatgcccctgccctgtacacccttgacatttgcccatcatggcctgtatgatgtgtgactgtggtctgtctccccaccaactttacctcagtgtggcggctgggtcttactgaccactcaccctggtgccctgctcagtatcagtcaatgaacatttcttgaatggaagacctgagtgaggaatgcaaagccctgcaggacccactggcacagcacagcagccgagggtgggggagacagaggcatctgggagggccagagctggtccctgaaggccaggggagccagggctgacctgtcctctgccctccccagtggaggccagccaacagatggctgagctgtcggaggtgctggtgctcaggctggaaaactatgaacggcagcagcaggaggtcgctcggctgcaggcccaggtgctgaagctgcagcagcgctgccggatggtgagtcgggtgtgtgtggaaccctcttgtcgtagccccatgggaccctagcttccttcttcctgcctccactcggctccaccaggcctgaggtccctttctgtgtcagagtcagagacctcagagagccccttatcttgaccccttgttatcttgaggagaccaaggcccagagagggtcctggagtcttctaggaaccaggctgtgtgactcccctgccttctttgccctccttccgtgtgacttgtcatttcatgggctgccaaggactcactgatgtgcctgggaagacttgctggaagcagggggtgccctgagtgggtaggcctcagatgggggttcactggttttgggtccttcgagtatggggctgagactgaaaagttgcagaagcagctggcttcggagaaggaaatccagatgcagctccaggaagaggtgagtctcgctgccggcttctgcccccaccctggagagccactggcccagagtggggaccccaggcccttggcagctacctgactctggagaggactagcaggaactgagtcttgtccgtttccaccccctccatgcctggcacagcccagcaggtgacagttccatcaaggtctgagtggtgtggagtgcagggacctgccctgggtcccccacatgacactcggagtccagaacctgggcctctggcctcagcctgagagcagataggcaggagtgctggactgggtgtgcctgggtcccagcagagcgtgtgggtgggttcccagctgcaggacctgcgggagaagtacatggattgtgggggcatgctgattgagatgcaggaggaggtgaagaccctccgccagcaacccccggtgtccactgggtctgccacccattacccatacagcgtgcctctggtgaggaccctcccctggctgcccactttcctacgtctgtgcctgtgtctcagccttggtggctgattgagatcccagttcccttctgtgcctgagcctatgggtgggggttctgtgggggtcctctggtaacgtctgttctctccaccataggagactcttcctggtttccaggagacgctggctgaggagctcagaacgtctctaaggaggatgatctcagaccctgtgtattttatggagaggtgcgtggctggggccctcccttgccccataggccatggcctttcctgtagtggggagggggtttgccctcacactctgaccttccacgcttccctatacccgcctcgttcactgcatcagcccctccactcattgcttctctatgaatatggacccatcacttccccctgaggtattttttttttttttgagatggagtcttgctctgtcacccaagctggagtgcaatggtatgatcttggctcactgcaacctctgcctcccaggttcaagcaattctcctgcttcagccttccgagtagctgggattacaggcatgtgccatcacgcccggctactttttgtatttttagtagagacacagtttcaccctgttggccaggctggtctcaagctcctgacctcaggtgatctgcccgcctcagcctcccaaagtgctgggattacaggcgtgagccatcatgcccagcctgaggtttttttttttttttgagacgagtctcactctgtcacctggactggagtgcagtggcgagatcttggctcactgcaacctccatctcctgggttcaagcgagtctcctgcctcagccttccaagtagttgggactacaggcacgagcctggctaattttttttttttttttttgagatggagtcttgttttgttgtccaggttggcgtgatctcggcttactgcaacctccgcctcctgggttcaagcgattctcctacctcagcctcctgagtagctgggactacaggtggccatcaccacgcccggctaatttttgtatttttagtagagatgggccagtagagatgttggccaggctagtcttgaactcctgaccttgtgatccacccgcctgggcctctcaaagtgttgggattataggcgtgagccactgcacctggccaagcccagctaatttttgtagttttagtagagacggggttttaccatgttggctaggctggtcttgaactcctgacctcaggtgacctgcccacctcggcctcccaaagtgctgggattacaggcgtgagccactgctcatggccactacctaaggttcttcagcttgaccaagccccagggactgcagtttcggcttccattgtctcataatgaaggtccttttctctttgaaggaattatgagatgcccagaggggacacatccagcctaaggtaagcctgccaggggctcccctacaacctgccctcagctttcagcagccagacagcccacctgcctctggttctgccaccctgcaactccggagaaggccctgctatctcggctggctgaactgagaactgttctgggaaggagctgccccacttttccttcaaatcttgccccctgggtggccgtctgattccaggcagctctgagtggggactgaagctttcttttcaactgactatgggctgagaggtgacaggcactggcttaggagctgggaacacctgggactaaggcccagcgtggtccctttcctgactgtgtgtccttgggcaagtcatttgacctgtctgagcctgtctagaatggatttgttcctatgtcaagtagctgtggggtgggctatgaaggttaaatcatgcaggagggaggcagaagtgggtgttaaccctgttggtgtattccgtgcagggtcagggacataaaagaagatggggcctatgcagtgttggtgaccattcttcctccctcccaccagggggatgggctgggtatttgaagccttggagctggtacctagctcccctctcccctggctgggacagaaccaggaggaaccatcagggtctgtgtggagacgggtgggggtgggcctggggggttggactttccagcccctcaaaagatgtcgctatctcccgcccaggtatgattttcgctacagtgaggatcgagagcaggtgcgggggtttgaggctgaggaagggttgatgctggcagcggatatcatgcggggggaagatttcacgcctgcggaggagttggtgccccaggaggagctgggggctgccaagaaggtgccggctgaggaaggggtgatggaagaggcagagctggtgtcagaggagaccgagggctgggaggaggtggaactggagctggatgaggcaacgcggatgaacgtggtgacatcagccctggaggccagcggcttgggcccttcacacctggacatgaattatgtcctccagcagctggccaactggcaagatgcccattacaggcggcagctgaggtggaagatgctccagaaaggtgagtgcccccacggggccctccctgccgccagccggacaagctgcagatcgtcgtgccgatgaaaagagagggtggataagctccccgagtgctcacctgccccagcctggctctacctgctgtgcttatttgcatggactttgcatatcatttgcatagacacctctgatccccttcagtgggaaccgtagtgtcagtgctcatttatgtggcatttgcttaggattccagatctccatccacttttctcctgggggctgggctgggggttagggctgggactgtgcccccacactgcgcctcagcttcccatctctgcccgcttgcttcccctacccccaacccctgcctcctctataccccaggctctccaactctgcagcagtggcagcagcagtcaaaacaaacacggggggcggtgggtgggatggtggagcagcctgggggctgacccaggctggaggacaggaccagccaccctcccacggcctgggaggaagagaggccttctgggactgcccaggctatggggacaaaggccttcaccagcaagggccacagttggaacagtcccctgggtgtcagaaggtgggctagggcctcctgcagggttgtggggtggaacagggtctcctctccccagccagaaaccccaaagtctgggagctgcacctgccgagtgcaggccatgtgagccctgcctctttaaggagccgcaggacatgaaagatgaccttgtgacactcatgcacagcagccattgcacgtgcatcagctcccatcagcctcattccgtggcaggtgatgtgtccccattggttaggtgaggagggtgaggctcagagagctaaggacacttgtttggggccacacagccggggtagatctgagcccgtcctctctactcctgtgctgtagcaccttcactggcccatccctcccctctagtgctgtcctggtacccgtcccagcctgtccccattctcatggccctttggtcactgccgggtggaatagcactggcttcagcaggcgtgtcatgtaagcttgtgcaggttataaactgaaccatgacctttatggcgcatgcagggggcaacctgcataattatcaatggcgactttccgtgtccttctgatacagttgatcagacccctgcccaccgcccaggccaggcctgtggtcatcaatgccccagttcacatccacctgcttctcttccaggctttgctgttccccagcagcctgcagaggccccacagacagcttgaggcccctcctgctgcctggccaagccccacacccgcagaccctccttcccatcctctgaaatgggaccctgtgtctgtcaccagcccaccctctgtgttcatgaacctgggctggagcttggggacccctccctgcccctggcttcctcttccatgttctgccctttcccacatgttggaggcttttccaacgtcttcagggacaggcggtaggaaccccggccctcgctctgcagctggtgcaaaagctgtggctgccaggcctgggccacatggcagcccagggggcaggagaagcccgggagaggcccgctggctaccagactcagccctgagcagggaacagggcccagcttccaccggcagggagttgtgagcgccttcccaacaatgtgcccctcaccccttgatgcccatgctaatggtagccaccctggttcttgttgacttgagggacctggctgtcttccctgttcttcatcctttcttctcagtccctacctactgtttgtaaccacaagtgtctctgtgtgtgggtgggtgagggcccctctgcccagtggtgtgtctcctctccctccctccctcttctgccagtggcctgggggtgtccaggctcccatccatggcccagcccctctcccctctgtcttgatccccccctccctgcccctggcttcctcttccatgttctgccctttcccacacctttgttcctcaatagctgggggctgggactgaggcctcctgcaggtacctgccccccttcacacagcacctctcaatctcctattgcttgtcagcctgtgtgcgtgtggtgcaggaaataaaggatctataccctcctggcccagcctccagctgtctctctagggagtgtgtgtgtgcacttggcagggcgaagttgtagagaaagggtggatgctaatattgaagtatgtgccgaggactcctattaaatacgccgtttaatcatagcagcagctcctagagggcggtgggtgatgtcataagtgtctgttggatggagaaactcaggccagagtaggttaagtgatgccctcaccagcagatcatggctagtgtggagctgggatttgagctcatgcttccctgatcctttcaccccagagactgactcagtggcctggctgtgaaagataggatgggagagagtcacccactgtcttagggtgaagtccccagagcagacctggaacagggtttaggaacaagtatagtcgccctccgtatcctcaggctctgcatccgtggagtcaactaaccacagatagaaaatatttgggggaggctgggtgcagtggctcatgcctgtaatcctagcactttgggaggccgaggtgggtggatcatttgaggtcaggagttcgagaccagcctggccaacatggtgaaaccccgtctccactaaaaatacaaaaattagctgggcgtggtggtgggtgcctgtaatcccagctacttgggaggctgaggcaggaggatcacttgaacccaggaggcagaggttgcagtgagcggagatcatgccactgcactccagtctgggcaacaacagcgagactccatttgaaaacacaagaaaatatctgggggaggccaggcgcggtggctcatgcctgtaatcccagcactttgggaggctgaggtgggtggatcacttgaggtcaggagttcgagaccagcctggtcaacatggtgaaaccccgtctctactaaaaatacaaaaaaaattagctgggcatggtggcagcccctgtaatcccagctacttgggaggctgaggtgagaggatcacttgagcttggaaggttgaggttgcagtgagctgaggttgcaccactgtactccaacctgggtgacagagtaagaccctgtctcaaaaaaagagaaaagaaaatgacagacaaaccagacatgggggaaattgccagctttgataaagctttgaaggaaacggagatgcaggagaacaccttgtggaccagagaccactgagcaggagaagcagtgaaatttcctaaaatctggaggattccctgcccctgttatcttcaagtccccagtggtgatgtggaagaaaagcaacctgcaaggtggatgcaagccacaagctgctctgtgaacctgggcacctcacacagatgccactggcctgtgggtctctgaggggacccgcgaatgggactgccaaattctctggtttgctccaggttattatagaaaattatttatatgaatagtaaaaataaaacacactttgtggcccccctgccaaaagaatatcattgagaagattattgctgtggctaaccgggtctcagtcctgctgggaactctgggggacagtagaatatatctcagagtagcctgggtgaggtggctcacacctgtaatcccagcacattgggagggcgaggcaggtggatcacctgaggtcaggagttcgagaccagcctgaccaatggagaaaccccgtctccactaaagatacaaaattaactgggcatggtggcacacatgcctgtaatcccagctactcgggaggctgagacaggagaatcgcttgaatccaggaggtggaggttgcggtgagctgagattgcaccattacaccccagcctgggcaataagagtgaaactccgtctcaaggaaaaaaaaaaaaaagaatatatctcagagttatcccaccccttgggtgggggagctggggtatttatcctctaactgtcatctgacactgtctgagagatgcttctggaggcatttaactgccctgcacttggccctgaaggaaattagaatgtgttacctccaaatatgccac

SEQ ID NO: 12313 - DNA, 14551 bp, Human
gcagcacagtttgcaattgcaaagatatgaaaccaacctaagtgcccatcaaccaatgagtggataaagaaaatgtggtatatctgcatcatggaatactactcagccaaaaaaagaacgaaataatgtcttttgcagtatcttggttggagctggaggccattattctaagtggagtaactcaggaatggaaaatcaaatatcgtatgttctcacttattagtgggagctaagctatgaggacacaaaggcatgagagtgatataagggaatttggggacttggggggaaggttgggtgaggaataaaaggttacatattggggacagtgtacactgcttgggtgccaggtgcattaaaatctcagaaatcaccactaggtaacttatccatgtagccaaaacccaaccgtaccccaaaaattattaaaaatttagagcatgtttttaaaagcaaaaaaacagtacacaattttttaaaaaacagtaagtcttggcaagtccatctcccccatctgacatcttgaaacaaagttttttttttcctctctgggttctcagtaccaagaacagtgcatagcacatagtcatgaacctttggcctaaatcacagtgaaattagtgaaaggaagtctaccttctagtcccagcactcacaccaacttctcagacactgaaagaccctggccaaggcactcctctgagcttctggtaaatggggataatgttcctgtccccttcttagtttgtgaagataaattcagagagaaatgggattggtcctttggtatggtgggaagtctaagcacattgaaagtttaagacattaacactggccagtgcagtggctcacgcctgtaatcccaacactttgggaggccgaggtgggtggatcacttgacgccaggagttcaagaccagcctggccaacacggtgaaaccctgtctctactaaaaatacaaaaattagccaggcatggtggtacaagcctgtaatcccagctactcgggaggctgaggcacaagaatcccttgaacctgggaggtggaagttgcagtgagctgagattgtgccactgcagtccagcctgggtgacagagctagactctgtctcaaaaaaaaaaaaaaaaaagatgtcaacactgatgttattaatgacaactgctgatagtgttgatactaatgatgacctgcttagctggaggaattctctttccttcctccaatattgcctggttttgccctaactcagctccattatctgctgaatgatggaagccaggccccctcctctctaaccccttgtcttatagatttctttattattattactattattattattattttaaaaatagtgatgggctctcactatgttacccagggctgatcatgaactcctgggctcaagcgattctctcgcctgagcctcccaaagtactgggattacaagcatgagccaccatgcccagactcatagatttcacatgtcctcaaaaagtccttccagaagtctgacccacatccttcctgttgcagccctgccccctcccttcctcatgtctcctcaaagcatgatccataagcaccttgtgtggcttatccttgaggttgacatccccattcccactgctcagaacaggccaagaggcagagtgggagattttccagagagaaagaaatagaagccaagagagatgagagagagagagagagagagagagagagagagagagagagagagagaaagggaagttctagtttggggtgagggggcagagaaagaatctggagggatgaaggtcaggcagcagtaagggcttcctaacacctaaacacagagtgacacagataccccccaccgctataccaccgctatctacagctgcgtggcttccgggggtgggacaatcgtcttaaggctttccatgacgtgagtcctcgccagaactaaggctgtgggtaaggcgacatttcctgcccccggggccagggtgagaggagagatgatgagttgctgagtgtgcacacctttccggaacacatacacacaccctgctctgggatcccttgtgaggctgccctcatggagttccccctggcccagatatgtccccaaggtaagtgtgaagttgaaggatatgggtgggagggggcacaaagacccccatccccctgccctccctcctgggcttgagctcccacttcagggatgaggggccccaccctaagccagagctggcaaagctgattggcagggtgaccacaaccctgcctggggctccatgcccactcatccctgaggataaaggtgacagggtttgttgagggcttctcagagaggagagaggagggagcaggaggatgaagggagaaggaggcagaagatcctggaccagaagaagggcctgccctgaagtgatctgcctccctgaccatccgaaggccagcctgactcccagcctctccttctaggcacctggtgtccctcacaacctcctctggcagcattagccccccatgccgccttggctacttaacctcatgcctgagaaactcccctgctgcccttctgcgtttttcctgtcgttaagactgtcccagccctccagatcccctgagcctgggaggaggggtgggaggcagagacagacatagttcctctctgagaaaccccggcagccctctttgtgctcacagggagtcacgaagcccccatcccaaccttcagcaccttccagatcacagacatgacccgcaggagctgccagaacctgggctacactgcggtgagtggaaacctggggtggcagcgcggtgcagtccctcatctctcccaccctcccatggggaaggacttgcagatggacaaaggccactccaagagaaggcaggaatgatccgggtctgccaacgggctggggcacagagagagagaacgaaaatgaggagtacctccttcatgcgccgagttgcccactcactcccttactgctcctaggccctctggaagctcaggctgagtccgcagatgaccagggtgcagtgcattgagtcccagaagcaggcatctgcactctgtgtcagtgaccatttgcccagtgcattccacattcccgtctcagtccttctctcctgcccagtcaataattttccctgcgaactaggtcagtccctcatattatgaagtaagccctccctcattctggcctctagggtgacttcctgcgtcatgtttcttcatcctccaggccagggaatgactctgtccatctggaaggctgtgctgcctttcccgcccctcctagagcacagtgtgacagctcactgctgctggattaaaagccctcaggacccagagggcaaaggaaggagagtctctggaagccagaacagctggagctgaagaagggatttaagttagactttaggaaggactttctgggcaattgtaccctaaaatagacaggagaggctgggtatgaggaaaagaaggtggcaggtggatcaaagtcaggagaaggcccactcatcatgctgcttccccctccttgaactcttccctgatccaggcatctccccaggccccggaggctgcctccagcacagggaatgctgagagggcagaggaggtgcctggagaaggaagcctgttcctgcaggccgagacccgggcttggttccagaagacccaggcccactggctcctgcagcacggggcagcccctgcctggttccatggcttcatcacccggaggtgagtcatggaggaggaaattggcccagacaggggcagggcaagtcctgggtctgggtcctgccacctgccaggaatagatgaaggctcccacttctaccagtctggagtagatggaggcgcccactccaggctcccactcccagagttttcctagcctttcactgaggcatctctccaggggagatcattggagaggctccagtccagccctctgtgtacctcagcttcccctctctaggccccattatcctcctgtccctaaggcctcgaatgctggtattttccacctctctctccctccaggcttactccatctttatctcccagccctctcttcttccacccttgcagaatctccctcctccatttctcagcctcatttctccctaactctttgttcacctcctcagttcagctttgacttctgaaatctggaagtccaactactttcccatccctgtagctgcagtagcagcccctgcaggctgccctttcaggatgaggccaggggaggatgcgggggtctcctgaatgggacccctggcccctgtccacgcctaatccctgcagcgggagagcagcgcccacgtgctctctctccccatctccgccctagcctttctctagccgctccagcatgcttgcttgggggtaggggttcctcgtgagagccggggagacagaggcgaggctggaagtgtcagagcagggttcggccccctctctccgtcacccacagggaggcagagaggctgctggagcccaagcctcaggggtgctacttggtgcggttcagcgagagcgcggtgaccttcgtgctgacttacaggtgaggggcgaggccccgcgccgggcgacacaaggcggggctcgggaggggcggggcttgggtctgatcccgtgaggagccgggctcttagctcattccccgggctgctgaaggtggggatcacgcctctcgctggtgaccctggccgaggagcgggagatagtctgatccctaacggcgccctccaggagccggacttgctgccgccacttcctgctggcccagctcagggacgggcgccacgtggtgctgggcgaggacagcgcccacgcgcggctgcaggacctgctgctgcactacaccgcgcacccgctcagcccctacggggagacgctcaccgagcccctcgcccgacaggtacgcgccccagaccctgaccagagagcccagggtctcgggccagcgcccctcccgctcagagcccaggcgcaggacgcggcaccaggcactttctcatcccgaaacaccactcgggcatgcctcccttacccaggcatcttcatcttcatgggagggtggcaggcccttcgagaaatatgagtgctgggggaccgtccttaagagaccagcccagccacacggagtcagaggggcaaggagaggccaggggcacacagagtcatttggggttttgttttttgttttcttttgctttgttttagacagagtctcgctctgtcgcgcaggctggagtgcagtggcgcaatcttctctccctgcaaactccacctcccgggttcaagtgattctcctgcctcagcctcctgagtcagcttcccccctctaggccccattatcctcctatccctaaggcctcgaatgctggtattttccacctggtattttcagctttgacttctgaaatctggaagtccaactacttactttcccatccctgttgctgcagtagcagcccctgcaggctgcccttccaggatgaggccaggggaggatgcgggggtctcctgaatgggacccctgagtagctgggattacaggcgtgagccactgcgcccagcctagtcatttgttttttaatgtaagagatacttacggagtacttagggcctaccaactgctggcaggccctgagaacagacccatgaacaagacagacagatggatctcaaactcacaaagcctactttccagcagcaaaaacagacaagtaatagaaatccagggtggagactgtgattcaagaagaaatacagggtaccatttagcctagcaggcagcggtgcacaagttcaggcagtgctgagggaccactgtgtgccacgcaactttctgcgcactggaaaaacaggagtgaatgtaaatgacctgaatatctctgccttcaagagcttccattctagaaggaggagacagacgagtgagtaatatggataacaagcaaagaagacagagtctgtctagtaatgatgagtacacactgacaagaaaaccaaagagctccaccagcagctccaccttccaagcagacccagcctccaccctcctcatgcctcctggaggcacctgcctctgctacactggcccaggctgccatcatttcatgtgaaatattgttgaagagtgacaggattggggctgttctacacagggtgtcagggaaggccactcgggtaagcggacatctgaatagaggcctgtatgaaataggagaagagccatgcagacaactggaggaaaagcattctcggcagcaggcacagcaggtgcaaaggccctgaggcaggaggagacttggtgtgtctgaggaatgatgggagcagagaggaagttagcatgggtggatccggtgactgagggatagagaggtaggagatgagatcagaggggtgagggaggggggccctgtagactcttgtatgcatttgaagttttattctgagcgagacgaggtggcactggagacttacaagctgaggggtgacatggcctggcaagtttcgggaggagcaatatttcacatgaaatgatggcagcctgggtcagggtagcagaggtgggtgcctccaggaggcatgaggagggtggaagtctcctcagaaggtggagctgctgggtttttgtgggattggatgaggagtgtgaaaagatggacttgtcattgactgagttgagaaaagttctaggaggaacacatccaggcaggaggcaggtgatcaggagttctgttttctacacgtgcagttcagcatggagatgtcaagtaggcagctggaattcagagtctggggactgggacaaagggatgggctgcagacaaatattgagagtcaccagcacttagatggactctaaaacctttaggaggggagaaatctcactcggaagtcagtgtaggtgggaaggaaatgaagcccaggtctccagcatttagagtttgcagaaatgagggggaactgacaaagaaaacagagcagagcgctcagaaagaggagaaaagccagaagagtgtgatgctctggaagccaagcgaagaaagtgagtgaaggcgggtgagggcagagggtggaattgacactaggtttgacagagaggaggtcattggtgacctagacaagaagagtttcacagaacttgatttgggtcagttaaaacaagtggggacagtgcctgtggtcactgccttttctgtgaggaacaggcagagacctgagattcacagggcgtagggaagtctgggggtgaggaggagccagcctgacctgagaagcctgaaggcagagctgtagaagtctgagatcacacagagtcttgtcactcaagctctcaggagtctgacttattctggggcaatgggctgccacccaaggattgctaggggagtttctgtaagattgctctgctcgaagactggagagtggattggaagggcaagacgatgcagggggaggagtcaggaggcctgaactagggtgctggccatgtgcatggagaaaagtactcagatgtgaacgatatttagacagtggaaggagcaggacttgtgtttgatttcatgtcaagagggaggaggtggaggcatcaaggatgactcctaaggtgctgtttcggcagcagggtggaggtgctactttttattccggaaggagatgctgagagaggagggggttagggcaggaaaaagaattctttgatttccacagtatatctgcagtacacctcccgatggagacatgcacttggtggattgcaggagcacaagaaaagccctgtgaccttagcctacagtggcagcaggcatggggacagcattcatggaccaagggctaacacggagctaaaagcagaccctctgtgagacggaaccatcccacatggggctcctctctcctgaggtggtctctgcccttaaaaatgttagcttatggccgggcgcagtggctcacacctgtaatcccagcactttgggaggccaaagtggcggatcacctgagatcaggatttcgagaccagcctggccaacgtggcaaaactccatctctactaaaaaatacaaacattagctgggtgtggtggtgggcgcctgtaatcttagctacttgggaggctgaggcaggagaatgtcttgaacccaggaggcggaggttgcagtgagccgagattgcgccactgcactccagcctggatgacagaatgagacttggtctcaaaaaaaaaaaaatagcttatatttccataaagtaaccggcagtacagaaataaacacaagcacagctgtcatggagattggtccccatgtcaataatttttcagttaaagacgtgtaaagccatgttgcattttcagaaccacaggcacaaatggaatctggcctggccctgtgttccagaagaaattaagtttaatgcagccaagtgtggtggcttacgcctgtaatcctaagacgcaagaaggctgaggtgggaggatcacttgaacccaagagttcaagaccaagcctgggcaacatagtgagacctcatctctacaagaaatgaaaacacaattagccggtgtggtggcacatgcctgtagtcccagctacttgggaggctgaggcaagaggatagcttgagcccaggaggtcaaggctgcagtgagctgagactgcaccaccacacttcagcctgggcaacagagtgagactctatcttaaaaaagaaaaactttaatgctagatatggcctgtgaccagagcttaccactgcctccatccaaccctgggtctccctgccgtcaccaccccctcttcctcatccagggaacccagcccaggccaaatttctgtgctcctcccccttcccccatcctccacttagactggattattttgtcctcctgatcacctcccccaccccaacgctccaccgagtgcctcagacctccttctttcccagcagactcctgagcctgcaggactttccctgaggaccgaagaatcaaactttggaagcaaaagccaggacccaaacccccagtacagcccaatcatcaaacaggggcaagccccagtcccgatgcagaaagagggggccggggagaaggaggtattgggctgcaggggctgagggagtgggaggacaggcctgcgagggggtgcaggcagcggggaggaggaggggcctagcgggggcagaggctcaggctgggagttaggctggggctttaaccctgcctccctcaccccactcctccctggcctcaccttctctcccagccctcccagctgctcaggcccaagcctcccatccccgccaaacctcagctgcccccagaagtctacacaatccctgttccacgacaccgcccggccccacgccccaagccctccaatcctatctacaatgagcctgatgaacccatagctttctatgccatgggccggggcagccctggggaagcccccagcaacatctatgtggaagtggaagatgagggcctacccgccacccttgggcaccctgtcctacggaagagctggtccaggcctgtcccaggaggccaggtaaatgggtatgcagggaaaggtaggtgcaagaaggtctccctgcaggtagatgggggaaggtgaagaaggtgttcagagtggatgcctggggcagggtaaggggcagaggtgtgaggtgatgtgggaagaacagaatgatccaggcaccagcctcccttctccaggcccagaggctgccccctcttctccccagagtcgctcagacctcatctttgtcaagcccccatgccctcctatctcacacagaaaacagaggcccccaggcagggtgcccctccacctcccacatcgaggcttttttgatctgcgtccatcttgtcctgcaggccctcttcagacgcacctggggctgaccccaccccgtgcctctctggctctctcccttggccttcacggccctgctgtcctggagaaaaagagcacttgggttcccttatgtcatctcagtgagctcaggggagggggaccctgctctcccagcctgcttctgtgtactccctgtctccctcttccttctccccagccctaagtcttcttgcctacccttcaagtcagtacctcatgccatgggttagccccagcagccatcccaccctctccctcggcctctgcggccctcccaaagcccttccccagcctccctcctcagacccttccccatcctccctccttgctggtgccccaggctccctgctcagcctgagcctgctcgcgctcacccacacccctgccaacgtctgctgtcctagagctaacgtcacctgtccatatctccgtccaaacttttttccaagcttctggtcagttccccccagcatccctgagcccctcaaactcaacacggccaacagcgctctcacccttgccctccaaacagctcggtcccatgttcactgtcctgattgctaactctccagctacccagctagccaagccagaatcccagggctccctcagcacagctccctctttactcccccagtaagccactcattcctgctggatctcttcctaagtatatttttccttcccccagctccagcccccatcattggggtctggctttgtcacccaggctggagtgcagtggcacaatcatagctcactgcaaacttgaactcctgggtgcaagtgatcctcccacctcagctgagattacaggctcgagccacctcacctggctcccaagagcttcttaactggtttcctaaccaccattcttgccacttctgatccactctgcaccaaagagccagaatggtcttgctgaagcagctgcctggcccatgaagcactctagacttgggttgggtggggggtctcacctccttagccttaccaccagccactcccattctcctagaatgattcacatttctctaaactcaccaagtggtttcaagcctcctggggtttgcacccgccagtatctctgcctatagcaacttcctgcaacctcatcctcccgctgcctggcaactttctaatcatccttcaagaccagctttcccttctcagaggccaccccctgtgccttacacacacctgccatgccactgatcacctgagacatccatctcctcccatctccttctctctgtcccttccctagtttagagtgtgagttccctgaagggaggggctgggacttacccatctgtttccaaagcacccagcccagtgcctggcacagagcaggtgctcaggagatgtttgttgaattaatgaatgagaggagtttagataccctctctggaagccaaagtctgttcagatcagatgtcttgagactgcaagtacacctaggaggcagagggtagagggtgtgacctagaactgtccttctctctgcagaatacaggtggctcccagctgcattctgagaactctgtgattgggcaaggccctcccctgccccaccagcccccacccgcctggagacacaccctcccccacaatctttctagacaggtgcttcaggacagaggacaggcatggcttccccttgggcctcctcagtaggcggtaagtctgagcttggtgaggataacttggagcatcaggtccagagaccttcacacacacctggcacacttctcaagaaatgtggatggaataaaccataggtgttcaaagctggaaaggagctcagccatcatctattgcaaggatggcaaagaggtgtcatcttgcatgccaactccaatccattggtcgtggctgcctagagtgctgcattggaaaggatgttaaggtcatatctgaactcagcagaaaaaaagcacatgattgattagtgatgtctgccacgggtaagagcgggaggatgagcagcattacatttgtccttagtgatcaaattcagctccctcactatgcggagaagaaaacatagcctgagagggacagtgacttggccaaggtcaaggactagaaccaggcttcctgattccctgtttagtgctttgttccttaccacacatccacaaactcaagtccataggaaacatcagagatttcctcaaacaggaagtctggccactttccagagttctactgcatggaggcctgggtgcttcattggtcccctcctgtggatcctggcttaactctgtccccctgacaggtctggcctgacccccaacaaagaagcctggaggtcagagaagcaaatgcggagcctgctccctcctaagaagatcccaagaatccaatggctcagtccttggtgatctaagacagcaaagaagtgtgcaaggagggccctgttagctcccactgtcctggtttctcctcctggagtctaatttccttggccctctgagccttttgagtctgggccctggtccaatgctgctgttgtctgaggaatggtttggtgagaacagatgttagaacttgtttgttgattcttgtctggctaataaatcatcaccaactgccttctcctacagggattcaagtcctccaggctccttctgtttctgtctctgactttctctctctcatactgtggaaggcaaggagttgaactgccactgcagtgagggtggaggggcttgaggattgacagacaccaaggccaggaatacagacctctgcaaactattccttctttagctgggatgggttgagtaggcagccagggacataggggtggctataccacctgaggcataaagaaagaggggcagagaggtgagcagttgagggacagccccttcacctcctctgcaaccgccctgccaagtacaggactcgggaggaggaagatgtgtgtgtgagccccttagaggacaggaatcccctcggaactggctccaggcctctcatcttcccagcctcttgggcttaggccctttgcctcaatcaggaccccattctctcccctatccctcttgcttccccattctctgcccagacccacttcagagccagcctcctgttcccgtgcaaagctctacactctggggctctggcatatgccctgggtcttacttttgtctcagactggggactttttttttttttttagacagggtcttgccctgtcgcccaggctggactatagtggcacgatcatagctcagtgcagccttagcctcccaagttgctgggactacaggtgcccaccaccaagcccagctaattaaaataaaaaatttttttttggctgggtgtggtagctcacgcctgcaatcccagcactttgggaggccgaggtgggcagatcacctgaggtcaggagtttgagaacagcctggccaatttggtgaaaccccatccatctctactaaaaatacaaaagtcagccgggcatggtggcacatacctgtaatcccagctactcgggaggctgaggcaggagaattgcgtgaacctgggaggcggaggttgcagggagccaagatcgcaccactgtactccagcctgggcgacagagcaagactccgtcttgggggaaaaaaattatagagacagggtctcactgtgttgccagagctggtctcaaacccgtggcctcaagctatattcctgtcacagcctccccaagtgctgggattacaggtgtgagccaccatgcccagccagacagggggctttctaaggcagggctgtgtctgcccctggattatcctcagggctcagagcagagacgacccctccagagctgcccaggcctggggactcctgtggtcccatctgtgcagcctgttcttttcacactcattcctacaagaggctagtccaggcaatcagcgccagtcagggcccctgtacctacctgaggcacaagaatcttccagaccctttccttaagccacagtccctaggcctgggcactgccaccaccataccacccccagcctggcccaggcgccagctccagtgactggccaattcccctctttccactccagtgctaatcagcttaaggagaaatatggttgctgagtcaacagagttggagttccacttccctttgtttagacctcagatctaaatgtcctcctgagcaagaggagaggtggggagggaggcagaggggcagggagggaggagcagatggctttgctgaaatcagagaggaggctcaaagtgccagaaaggtctcagattagacgcagggagtcagttacctcgtggctgattccttggggcaggggaggaggcagaaaagagtggcatatttattgtacagcaagagacagaaattagaaagtcagaaaatagatttctccagactttggggtgtaacagaatgggcaggtgtggggaagggaccagaaatgcccagtgacccacttgatgtttctggaggagaaagcctggagcagaacaggggcaggagcaaagccaggggcagagcaggacctagggaccctcttcttccttctgtggctccacagagcatggggtggacacaccaaaggggtggtggagctcagatgaagct

SEQ ID NO: 12314 - DNA, 26238 bp, Human
tgtggctggtccacactgacaggtgctttaaatataaaagacacactgggtttttgaggatatagttggaaaccaaagaagtaaaatagccccttaatatttttaaaaatattgattacatgttgaaatgatcatatttgggatcatatttgggtaaaaaatatacagtgttattaaaattaattttcctgtttctttgtacttcttttaatgtggctagaaatttaacatgacatatgtgggccaggtgtggtggctcccacctgtaatcctagcactttggaaggccaaggctggaggatggcatgaacccaggagtttgagaccagcatgtgcaacacagcgagaccttgtctctataaataataaaaagaattacttgggaggctgaggcgggaagactgcttgagcctgggaggtaaaggcttacagtgagccatgatggtatcactgcaccccagcctgggtgacaaagtgagagtgtctcaaacaagaaacaaacaaaaaaattagccaggtgtggtaatgcacacatgtggtcctgggtgcttgggaggctgaggtggaaggatagcttgagcctgggtgattgaggctgcagtgagccgattgtgccattgtactccagcctgggtgacggcgagaccttgtctaaaaaagaaaaaacacacaaaaaataaaaaacaaatgtggcttatgtttgtggcttgaattatagttctattgtacaatggtagtctagttcaacttcttgaacagacgagaacgctggggtccggagagaagccctgacttagcggatggcacacactataaagcactgtcatttgcagtcccaccagtctctcagtacccacccccactctgccacacacacccctgggagtcttaggtgtgaaatgggtggactcacagacccctgggctgcatacctcaaagtgttccaacactcaaggcactgcctgtggttttttgggagtgaaataaaaacctaacaatggtggggtcacagtctccagtaggtcacattttaaaagcactttaggctctggagacttggggtgtggggagaagtgaagagaaagctggggagccctgggccttcccccatttcttcatatgcagaataatccagattagtttaccaagcgcgctgataaccactttaaaaacagagtccctcctgcctccccgtggcatggggtagaacctggcttgagccccgacacaggcgggcagccactccaggatcgttccacacgtaaacaaagacgagtttcggtccgattggcttgatcctggaagaggagtgggcagtggagggaggggaaaccaggcaccaaagcaaattccttcatttcataatttcatctggcgcccccgttcaatcagcctgcattgtcgaggctttaggagaggcagttaggaaaggagagatactgatctctcagccccagggcagcactaatggtgcctgtctagactctgacaggtggagctgctgagctaactacggacctggtgggggaagttttccttggctttcacgtggctttggctggggagccctgagaaggtggctgcctcctttttctgaagcctggcttcccatacggcagtggctgggggagagtgatggagagaaaggctaagctaaggtcaaagaaagtggaggaaggctggcttgtcccgctggacttgacggcggagctgctgcaatctcgcgggctgggcccttgccccgggtggacccgagtgcctgcggggaggcgggtgtggctcccccgggaggtgacagctggcggggcccgtaaggagctggtctgctccggctcccctctcgtagccggcgccctgggaccagcgcgtgagcacgtctcggaggagtccgatgcgctgggcagggccgggtggtcacccccgcccagcttccaggggtgactgtgcctctgacgtcagacggtttttgggtcattccctggcacggggactttattttcataacagcatgaagtgccgtggaactggaataggcgtgtcctctccctcgaccctccccctccttgtccctctgctcacccctcgctcgttccctccctccggcgagggccgcctttataacaactgctcagagtgcgagggcgggatagctgtccaaggtctcccccagcactgaggagctcgcctgctgccctcttgcgcgcgggaagcagcaccaagttcacggccaacgccttggcactagggtaagtgaggcgccaggagcccagagcgctggggcctccggatttaaatcgtctggggagagcggggcgttgggaggggtgggatagaagaggagagaaatcctggtaatggaatacagttggctatgagaaaaaaattccctaggaaacagttcctctagtttaacaactcagatttttttttttttttttcccctttgcgggtttcctaggctaagatagaggcagagagcaaagagataatcagggtaatagtttctgctcggacacattctacaaactttgagtagatggaatccggccaggcaggaggtgagcagctctgggatcactctgcaggaaaagaatagagggagaaagatctcagaggacccgaaggtactgggagtggagggggagtgggaaacaaggggcaggggcaggagggaggacacggtgacagctactattttacccagatgctgcaaaaagcccttctgagttttgggaattagatctagaagcccatcccttttctcttgatgtgtgggcggtcagttccactctggtgtgccttgagttgctcagaaacctgggacagatgaaagttgaatgtgcactgagagtgcaccttccactaccgactttatggataggatttgggaatagcatagatgctgttccatctggtcccttaaacatccatggggaaggctggcaaatagctttattttattttttgagatggagtttcactcttgttgcccaggctggagtacaatgttgcgatctcagctcaccgcgacctccacctcccgggttcaagcgattctcctgcctcagactcccgagtagctgggattacaggcatgcaccaccactcctggttaattttgtatttttagtagagacggggtttccccatgttggtcaggttggtctcaaactcccgacctaaggtgatctgcccgcctcagcctcccaaagtgctgggattacaggtgtgagcccccgcgcccggccacagatagctttaaacatccatgggaaaggctagctaacagctgaaacctgctcagaatcaaggaatttgaaggactttccattcctgacttctttccattcctgattgtctcctcagaggcttgtgtaaacaccacacctgttgaagggttcggccgaatcagccactgctgtgggttcattcctgaaggggaacacttcagctacttcagacacaatgggctagggaccacgggaggggtgagggcggagggggcacacaccctccaggtttgcatgccggtgtctgctaggtgagggaaggaatgaggggaaggaagggccgggagaggcgctacgtgggaaacaagggacctctccaagggcgtggagaggtgagtgcctcaagggcagaatggaatgagcagaaccctttggtttcccgggaagagctctcaaccttgagtcaggaagactgatttctcctcccagctccgcaggaacatggaactgtgatcaggcaaggggctgggcctgagttcctcataggggtcttggggaggcccccagtttcccctcctgtgtttcgattctggcccctctccatctgcacacgtcgccttggaagttccctttagaactggcttttttgtattctagtcttgaatggtaatcgaagacaacagggtatgaagaacaattttgacggcgtgattttattcttctcattctgggtccactactatttaaagtcccaagattaagctgaggaattaatatggtggtatagtaaacaataaattgaggagtatttttgcttgaggaatctttgacttcctgagtagttcagggtgtttgcttcttttattctcatttttattgcactgtggtcagactatatggtctgcacatttcttattttctaattccagatttgtctttgtattctaaatatgctcatttttggcaaatgttccatttggaccatggaccatagttcctattaagcaatcataatagagtagagatggcaaactatggtccatggaccaaatatggcctatagcctctttctgtaaataaagtgatttttgttttgttttgttttgtttttgttttcgtttttttgagatggagtctcgctcttgcccaggctggagcgcagtgacgcgatctcggctcactgaaacctctgcctcccggtttcaaggtttcaagccattctcctgcctcaggctcccaagtagctgggattacaggcgcccgctaccacgcctgggtaatttttgtatttttagtagagacagggtttcaccatgttggccagactggtctcaaactcctgacctcaggtgatctgcctgcctcggcctcccaaagtgctgggatcataggcatgagccacaacctgtaatccactattttactaaaacacagcaatgctcatatgtttatgtatcatctatgctgctttcatgctacaaatgtgtggcttgcagagtcttaaattgcttataacctggccctttatagaaaatctatgctgatcactgatatagaggatctgaattatatgattagtaatggagatctaataagatatgaagatagagaatatttctatttaagtatccatagaacatttacacaattttaccatgttcttattcatattgtatattttatctgccaaggactggtaaagaagtatgaaagtctcatgcaactatagtattgcctttgggttctccttgtattttcagcagttatttatttattttgagacagggtcttgctctgttgccctggctggagtgcagtggcacaatcttggctgactgtaacctccacctcccaagctcaagtgatcctcttgcctcagactcttgagtagctgggtctacaggcacccaccactacacctggctaatttttaaattttttgtagagatggggttttgccatgtagcctaggcttgactcaaactcctgggctcaagcaatcttcctgccttcacttcccaaagtgctgggattataggtgtaagcctctgtacccagccttcagtactttttgttttacgtattttggtgctatattagttggtgcataaaagtctaggatggttttttttttttttttttttttttttgagacagagtctcgctctgtcacccaggctggggtgcagtggtgcgatcacggctcactgcaagctctgcctcccgggttcacgccattctcctgcctcagcctcttgagtagctgggactacaggtgcccgccaccatgcccggctaattttttgtatttttagcagagacagggtttcaccgtgttagccaggatggtcttgatctcctgacctcgtgatctgcccgcctcagcctcccaaagtgctgggattacaggcgtgagccaccgtgcccggcccaggatggttttatcttcagtgtagagcatccctaattattataaaacaagccttttggtcaatataatatctttttgctttgattacaactttgtatgatattaaaaccttaacttctacttaattattttaccttgaacaacttacttaactttgtgtctgacacataatacttgttaaataaatattatgttagtatttctttttattttcatttctttctgttcttttgcttttaactcttgtgtatctttttgttttaggttaggttcttctaggtatgatatagtttagtctttttttttttcaaaatagttaccatttacatttcttgtaataatagttacttgttattgtcatctaattttaggctatatggtttggttgtctccatctccttctgcattagacagtatatatcatatcatatttttagatctactagcaactgagtagatggtagtgccattctcagggctttgaaagataggcttgtaaggagaggtgatcagtttagctttgaacttgttggatccagtgaatattacccttatgtatcagaataagatatttaaatgaagggatctttgagagccttaagatagtatactagtagagggccggcgcggtggctcacacctgtaatcccagcactttgggaggctgaggcgggcagatcacgaggtcaggagttcaagaccatcctgactaacacagtgaaactctgtctctactaaaaatacaaaaaaaaaaaaaaaaaaaaaattagccgggcgtggtggtgggtgcctgtagtcccagctactcgggaggctgaggcaggagaatggtgtgaacccaggaggtggagcttgcagtgagccgagatcacgccactgcactccagcctgggcaacatagtgagactctgtctcacaaaaaaaaaaaaaaaaaaaaaagatagtatactagtagaggacttcactttattttcctattttctggaaatttcatttctttgaattcgggcataagagatttagaagcttcactcaaatattaagctttatttaaaaagatgatttccagtatttcattttatattcacattaatcaagtctacatgtttcgtttagagtaacaggaagatggtaatacgcccagggaactatctggaagtgtagaaattgggatgaacaccgtggttatacttgttttgatctgcctgtggtgctatgatgacttattttctctcattattgcatagaaactcaattcagtgatgttattcagatgttattcataagttattgccatgattcatcacttttatgtcatcagagttgggatggctacccagaataggggatcctggagatttccctgtagacgctttgcatttataaataatcctttatcaagggcagagggatttctgtaggacttctcccttagaagaactcagcctgggtagaaatacgaggattaacatcagcacatattcatctccaaaaaattttcctccccattactcacacttgccaataaataacttgctttgggtaaatattcagcactcagtcttagtccaaagcatttgctcagcaatcactgtgtagagtacagagtaagggggataccaacaaatagaagtttgctctattttcttaagaagcttgttgtctggccaggcacggtgcctcacgccaccttcctatcttcctaggagatagatgccacaaagaagcttgttgtctgataggcagctcagcagtgatattaatttgtaatatataacaaagatatggaaaaacttgagtgccaagaaatatttaattgtaaaaaccatgaagagatcgacacatttagagtgcaataggatttcaagtccaggtgtgatggcttacgcctgtaatcctagcactgtgagaggctgaggtaggtggatcacttgagcccaggagttcgagaccagcttggccaacatagcaaaaccctgcgtctactaaaaatataataattagctggatgtggtggcgcatgcttgtaatccaagctacttaggaggctgaggcacaagaatcgctttaacctgagaggcagaggctgcagtgagctgagatcatgccactgtactcccaggctggagtacagagcaagaccctgtcttaaaaaaaaaaaaaaaaaaaaggccataggattaatagtaataatgataataatttaaaaaactcatgatagaggttaaatcttgggcaaagttttgcagaaatatggtaagtggatcataaataggagggagaggatctttctggttaggagaataattcatgtgttgaggcaaagagcatgagaagaccttaaatgaacccaaattcccttccagatggaaaatacagaactctaggaagatttgcttgccttgcacggaggtggagacgggagttagggaggaaggaggagataggtgggaggactaattggagaaaggccttgaagctcaaactggggctggatctgccgtgacagacaaaaaggagcgaatacgcttctttttttttttttttttgagaccatgtctcactctgttgcctaggctggagtgtagtggcgtgatctcagctcattgcagcctctgcctcctgggttcaagcggtttttgtgcctcagccttctgagtagctgggactacaggcgtgagccaccatgcctggttcatttttgtatttgtagtagagatggagtttcaccatgctggccaggctggtctcttaacgcctgacctcaggtgatctacccgcctcggcctcccaaagttctgggctcacaggtgtgagccactgcgcccggccgataatttctttttaacctcctttgcggactcctacctagatgagatggtgctccacatggttctgtccttggcttcccatgtgatcttgtctcctcttgaggcttcagataccactctaggtgatgactgccagtctgtgcttacagcccaaacctctcctgagcaccaacccatatgcccacggtgcagagacagcacaacccagtgtcaaggagcctggcttttaagagtcatgtaatcttgggcaagttatgtaatttctctgtgcctcagtttcctcagctgttaaaggaaggcataataatagggttgttgtgaggattaaataacaccatatatggccaggagcagtggcttgtgcctgtaatcccagtactttgggaggccgaggcgggcagatcacctgagcctcaggagttgaagagctgcctgggcaacatagcgagaccccacctctacaaaaaatacaaaaagtagctagatgtggtggtgcgcacctgtcccagctattcaggaggctgaggtaggaggatcacctgagcccaggaagtcgaagctgccgtgagctgtgattgtgccattgcatcactccagcctgggcgacagagagactttgtctcaaaagaaaaaaaaaaagaaaaaagaaaggaaaccatatatggctcagaggaaactctcaagaggacttgggtcttttgacttgttattcctggatagctccacgtgcaggtcgcatatttatcaaagagccaacaaagctacacttagcatctctcctttcaagcctgtatttctaggctctgacagtggtgccactcagttgcctaagccagaaatctgggagttaacctgggcttttccattcccaaagccctgtctcttctaccttcataaaaatctcctaccatttcctgttcatctttcatgtttcatctccctgctttcttccctaaagcattaaacattaaaaataattattttaaaaccccactaggtagaatgggtcactgttttccatgtgccctcagcattcctaatgtattccataacttcttagttgtatgtcagtgtgattattattcattccaagggcagtggccacaattttatatttatttatttagttttttgttttgagacagggtctcactctgttgcccaggctggagtgcaatggcatgatcatagttcactgcagcctcgagttcctgggctcaagcaatcctcttgcttcaccctccgagtagggggatcacaggtgtgatcctggctaaattagcacccggctaatttttaatttctttttgtacagcgggggtctcactatgctgcccaggttggtctcaaactcctgggctcgagtggtcctcccatctctcggcctctcaaagtactgggattacaggcgtaagctactgcccccggccagggttgcttgttttggagacttctcagcaagccaatgcttgaatatatggtggtttaaatggagagaggttggggtcagggagaaaagctctagagatgatgacagtgatttagaggtgaaaaggaggattgaattatgattatgactacttataaagagctattctttctgaccatgtgacactggacatgtaccttcctcactctgttaggtttctcacctataaaatgggctgtaggaatgttaaatgaggtaatggatgtaaaagcatgtaaatgagagaatatgtgtaaaaatacataactactcagcatagtgcctgactcataataggactcaggaggtgacagtagctgtcattattcttactcataattacatcatgactgttattactactgattgaatgtagcaattcgagaatagagaaaaaatgaaaatgctagaaagtcacacattttcagggctgggctggcgcgaagacacattttgacagaatgagagaaatctcataggaaggaagacaaagtcagtttgtctttgcaaggttctgggccccagatgattcattctcagatgctctgggaaggactgcgtagaataagcatgggcaaacttccaggcctagtcacaagcaactctacacactttccccatctctctggttgcgaagaggagtctcaggttagaaacccaaagcgggagactcatcacatgttcacgtttttccctgcacagtggtcagtgctgtgtgtcagtcaaggccatgtctagggtcagcgctgctccaggagcctctggctttgtccttcaggtgggcagtcccttgctgtgtctcttcttcagacccttcaaccttacctctagccctggcttttagtttgggtaggagtttgtggcacatactcttttaatgacaggagatggggcaagaatgaggatgagggggagaaagaaagacatctggaagttttgtacatgaagctccccaggtgggtgaacggtggagctgaacatgagttcagaccacgtagttcagcagcgtgtcctgcattttatagatgagaggaggctttgagaggtcaagtgacttacttgttcacacagcctggcagctgaaaccccttctccctaaaggggaggaggaacagagggcttggagttgacccaagaaatgacttcgccctcctcttcctttcctccctcttcctcttgttcttattcttcccttccctctccctcttccccactggtttttctaaacctttcttttggggccgggcacagtggctcacgcctgtaatcccagcactttgggaggccgaggcgggcctgaggtcgggaggtcgagaccagcctgaccaacatggagaaaccccatctctactaaaaatacaaaattagccgggtgtggtggcacatgcctgtaatcccagccactcgggaggctgaggcaggagaatcacttgaacctgggagatggtggttgcagtgagctgagatcatgccattgcactccagcctgggcaacaagagtaaaaactccgtctcaaaaaaaaaaaaaaaaaaaaaacaaaaaaaaaacaacccagaaaaacccaaaaaacaaacaaacaaaagaaccaaaaacccctttctttcatgcctagattcattccaaaaaggtttaagacagcaacaagtgattccaggatctcagctgtgggcatccttgtgttactggatggctgtgtgttaattgttagcagctggaataagtgaagagggtctcgtcctcatactcaaagtcctttgctcatgcccaaggccagaggctactcatgctgaaacattaccatctccctccaaagtgcagggtttagtcactgagtactgggtggagcacatgactggatcccagttaatccctcccagcttaccagtaaaacctcaggattcatgctttcctgggagccacctgcggccactaagataggagcggggttcagacatggccaggcgctcctaatctcagacccaaagtgcaatttttggcagcctgcatgagaaggagggtgggaggaaaggtggctagaaccaagggtagcagcctgggggcttgagaggaaaccaggcacagcccatcctaccctgtctcacgagcagcccgtcctcctcctgactccccttaccccacacaccgagcgccattctcttgctgcctcatctattctggttaggtacttactgagcatcaggtgctaggcaagtggctggggagagacaacgtttaatgactcagtctccgcctgcacagagcctttgagtctagagggagacacagacttactgacaggctgggttgtgtaataagtgctacgggaggaaaagctgagagtgtctgagaatttatgagatgtgtgtctcatcagacttgggcatcaaaaaaaaaaaaaaaaaaaaaccatcctggaggaaaggacctctacgtcaagtgaagggtggggtccatttggtttttataggagcaagttctttgttggctggactctagatctcccgtcctttgactttggttacaaataatatccaaaccaccgctagtctcattctcttttctctttcctgctctagccctttgctcctctcccaggctgtttctctagctccagacagttcatattcctaaatgctgatcacttctcttttccctctcaaatgctgctttctagaaatcattttcagtttttcagaaccctgtccatctcttccaatcccctggtgtctttcccttacctgggtcattctctgggcaacatggcaccctttcagtgcagacttgtttattaataactccagtgagttttattttcctcttactaaattcaaagtactcagaacattttagacttgttgagcaatccctatcagcttagggatggggtgggggaggctaacagaggtgaattaagaatgataattccaaactaattagtcatccagattaaaaaaaatagactaagatggttttttttttttaaagacatttgtgagagaattgggaaatatgaatcctaactagatagttgataataaaggattcttgttagttattaaagtgtggttaagaaggagtttttatcttttagagagacgttctagactggacatgggggctcacacctgtaatcccagcactttgggaggccgagagggggaggatcctttgaagccaggagttcaagaccagcctggggaacatagcaagactccatctctaaaaaaataaagattaaaaaaattagccaggtgtggtggcatgcgcttgtagtttcagcttcttgtgggtgctgaggtgggaagataccttgagcccaggaagtcaaggctccagtgagccacagtcacaccactgcactccaccctgggtgacagagtgagaatctatctcaaaaagaaaaaaaagggctgggcacggtggctcacgcctgtaatcccagcactttgggatgctgaggtgggtggatcagctgaggtcgggtatttgagaccagcctgatcaacatggagaaaccctgtctctactaaaaatacaaaattagccgggcatggtggcgcatgcctgtaatcccagctactcgggaggctgaggtaggagaaccgcttgaacctgggaggtggaggttgccgggcgccgatatcgcgccattgcactccagcctgggcaacgggagtgaaactccgtctcaaacaaaaaagaaaaaagaaaaaaaaatacacatactatttatagataaaattacatgatgtctgagacttgcttaaaaatagtctagggagtggggtggggaatgcagacgaagcaaaattggccatatagtaataattttttgaaatgaagtgctggatacatgggactccattataaaactttctataatgaaaacaagtttttttttaatttttaattttttaaaaatagacacggtcttattctatctcccaggcagaattgcggtgacgtgatcacagctcactgcagcttcgaaatcctgggctcaagcaattctcctatctaagtctctcgagtagctgggactacaagtgtgcccctccgcacctggctaatttttacatttttatttttctagagacagtggtctcaccatcttgcccagactgctcttgaattcctgggctcaaacgatcagcccgcttcggcctcccaaagtgctaggattaaaggcctgagccactgcggctggcctaaataatgtttaaaaggaacttcaagaactatttctccattccctgttgcatgattgggaggtgggaggtggaggtgacatttggggaaactggttttttcttctctttacacccactgccattacttttgttggatcctggtctgtgggttctataaggccctgagactcagcaccctcctgcgcagctgcgctggaagaggagcctataggttctagatgggggctctgccttccctcctgtctgtccagtaccagaactgttcttgaggcaaacaccacatcaatctctgtcaagatttagagtcatcaggttcaaagtccctcataacgatcctgtccctcataacaatcaggtaattatgaaaacaactacttgtccacaaacagtaatacctgatgggtggggaaggagcaattggcagagaggggcagggagagggagagatcaaagggaagagggaaatacctttcctgctagacaacaccctggtgattaatctgccggggtgtggagagacacagtgaagtgcacagggcctgagttccttccgctcgccgcccttgaaggaaatagggtcttcctcttccacattcacggtgtagcctgggagagccctcatacttcctctttcttatgtcaaagaggggaccaaagaggggacatttgtaggcaagacggatcagacttgggtgcttggattgcaggggctgtctatatctgaacctcatttgcctttttcttcctatttctcattctgcactgccctgtagaggtatagcccattctttgtgctctgcttgtggtagcgatggctgtggtgtagcttccaggagggtagagtgtttaggtgacagacccactgtgagggaaggcggtgggaggcccatggccatagtgacaggtgccatccgtctctctcttctactgtggtagaagtggaaacgtgtctgtttctggctttaccatggagtgcttagagcagtgatcagcacatagtggtgctcggtaaatatttgttgaatgaatgactacataaaataaagttgagattggagagccaaattttattaaaattcgggaagatcgatttaagctatatctggtgtcactttaacacactatacataatatcgtgataatatatattcacatgatattcacatatgtatcatacatatgtatgtatatgtatatattgcatatatacatatgtacaatcttcctacttgctatatgaattaaataattttggtaagatgactatctcttctagtggaaaagaaaattttgtggtttttttttttttttttttgagatggaatctctctctgtcacccagcctggagtgcagtggcatgatccccgctcactgcacctctgcctcccgggttcaagcaattcttctgcctcagcctcccgagtagctgggattacaggtgcgtgccactatgcctggctaatttttgtatttttagtagagacagggtttcgccatgttggccaggctggtctcaaactcctgacctcaggtgatctgcccgccttggcctcccaaagtgctggaatggcataagccactgtgcccggccaagaaggttgttttttccgagctgttttttctgctctaaggaaagaggcaggattcaggggatgctttgtatcttttcctgcttcccaacccgagtccttcctcttgttttggatttcttgctgcatcatctctgtccttctttagggctggaggtgacctctgcgagccttcccttcctctaactctggcctctttcctgctgcaacatagttctcttctagtccgttcaaaactttttattgccacgtgaacaatctcattgggaaacaaaaaactcaagaaaaaaaatcccatgcccaaaaagcatggaacacaacaaaaagaatagtgtagaagacacttaaataagcaataaaataatttgaatgaaattgttgacaaactggactatagttatgtctagccttgttgaatctcaacatcttattcgacattgactttggaatttgtgagccacctgttttgaggaaatggggacactcctttctctttttcgatttcccaatttatcttcccacttgtgccctgaatcctgaggacttagatttcctaggggtatggtcaaggagctgggtctaaaattcacacgaagattgtaggggcagagaaagaagcctttctcctgacaaaggacagatatatgggaagtaaactgtaatacagctagtggcttcctgattatccgaatgagtaagtagatttctcactttgtggatggtccgttacctgggatctcctatcctcctggggctgaactaggagagtggaaccagagtcataatgaggcatctgatgaggggaggggtagggagagagagaaagagacgtagagaggaggagagagagaaggatatctcagatctcattttaaggctaatttgagaggagacacgtagagtacttgagaacctgggtcctggcaccagacaacctggattcagatcctggctgtgccatttcctggttgtatgatgttgggcatgtaacttgacttctctgcctcagtttcctcatctgtaaaataggataatagttttacctcatagggttgctatgaaatgaagtaagtaatgtatatatagagtgattagaagtaaaaattcgaggctgggcggggtgactcaacacctataatcccagcactttgggagggcaaggcaagaggattaattgagcccaggaatttgcgaccagcctgggcaacatggtgaaaccccatctctacaaaaatacaaaaattagcggggtgtggtggcacacgcctgtaatcccagctactcaggaggctgaggtcgggggaggatggcttgagcccaggaggtggaggttgcagtgggtcgagatccagcctgggtgacagagcgaggctctgttccccccatccccccaaaaaggagtaaaaattggagcaatactaaaaatgaacatgttagctatgaagattattttttgttggattacccgctatttatgtgccatccaggacgttcctctttacaggtagccaatttagagctggttatgacagacaagacccctttcataacttttcggaattagtggagccatctttacacatcttaaggaggaggccgggcacggtggctcacacctgtaatcccagcactttgggaggctgaaggagtttgagatcaacctgaggtcgggagtttgagaccagcttgaccaacatgcagaaaccccatctctactaaaaatacaaaattagctgggcatgttggcgcgtgcctgtaatctcagctactcaggaggctgaggcagaattgcttgaacccaggaggcggaggttgcggtgagccaagattgtgccattgcactccagcctgggcaaaaagagcgaaactccgtctaaaaaaaaaaaaacaaaaactcaaaaacaaatcttaaggaggaggggcagaataattctgaaccacagagcctaagaagaggacccagccgctggctcagaagggaatgctcggccttctgtagaaaaatctgctattcagagaccatcatgggtaacacggtgaaaccccgtctctactaaaaatacaaaaaaaaaattagccgggcatggtggcacatgcctgtagtaccagctactctggaggctgaggcaggagaatcacttgagcccgggaggcggagcttgcagtgagccgagattgtgccactgcactccagcctgggcgacagagcgagactctgtctcaaaaaaaaaaaaaaagagagagaaagaaaaatctaccattcagataactcctcttatccatgagagaataggatgcttacaaatgataactgtatcagggccaaaggtagaggctgcaacgttatgattaaagtgttaacttcaagtttagatagttccatgttcactaattcctaagaaaacactagtaaaaaaatatcaggaaccctggcaggttatttgtaatatatacacgtatatatatttcaagagacagggtcttgctctgttgcccaggctggggtgcagtgacgtgatcatagctcactgcatccttgaactcctggactccagcgatattcccacctcagccttttgagtagctgggactacaggtgcgtgccaccatgcccagctaattttttaatataaagatggagtcttgctatgttgccctgtctggtctcaaacttcagagagcaaatgatcctcctgcttcagactcctgaagtgctgggattataggcatgagccaacacgtccagccctgtgaagttttttgagattaggcttcaaaatacctcttcagagtgttaggttctctggctttaaggtaaatattaatatagttaaactgggggaagggacatatgggatttcttcctggttcttcaacaggttttagaatttactacaggaggtagaggaaagttagtagctttacttaatgtagtaagctcaaagtcaaaaccctggctaaacatgcaaaattggtttcctaatccttttttagtcttctgtgtctgaggactgtgttaggagattcaataccttctccccactccaacattccttttctgcaggtccagaatggctacaacagtccctgatggttgccgcaatggcctgaaatccaagtactacagactttgtgataaggctgaagcttggggcatcgtcctagaaacggtggccacagccggggttgtgacctcggtggccttcatgctcactctcccgatcctcgtctgcaaggtgcaggactccaacaggcgaaaaatgctgcctactcagtttctcttcctcctgggtgtgttgggcatctttggcctcaccttcgccttcatcatcggactggacgggagcacagggcccacacgcttcttcctctttgggatcctcttttccatctgcttctcctgcctgctggctcatgctgtcagtctgaccaagctcgtccgggggaggaagcccctttccctgttggtgattctgggtctggccgtgggcttcagcctagtccaggatgttatcgctattgaatatattgtcctgaccatgaataggaccaacgtcaatgtcttttctgagctttccgctcctcgtcgcaatgaagactttgtcctcctgctcacctacgtcctcttcttgatggcgctgaccttcctcatgtcctccttcaccttctgtggttccttcacgggctggaagagacatggggcccacatctacctcacgatgctcctctccattgccatctgggtggcctggatcaccctgctcatgcttcctgactttgaccgcaggtgggatgacaccatcctcagctccgccttggctgccaatggctgggtgttcctgttggcttatgttagtcccgagttttggctgctcacaaagcaacgaaaccccatggattatcctgttgaggatgctttctgtaaacctcaactcgtgaagaagagctatggtgtggagaacagagcctactctcaagaggaaatcactcaaggtacagatgcagcctggctaggcagagaatcccttgtagaaaggtgggggagaatcataggatattataactgtaaggaacatgcaagattttccagattatacccttgatagaatagataagttccttaaggctcagatcttgcttaaagtcgtccagcctgttagagacaagtagaacacgaagctggcctctggagtctttattgagtactttgtacaattggtgtagactgggagagccctcctcacttcccctttcttgtgctgtaatttcctgtggggcagaacacctcagaggtttctgtgcatcaaaataagatgcagcaaagacatggaaaaaggataacgagacaaattcccagcaataagtagatgaggttgtgttttttataaaagataacgaggcattccttccagaaatgtggagcctttgtagatttcagtgcataaaaccaagccatgatttcctgcagtgatcacagagcagagaagggagaaagcccttttatcacaaaccagcaggaagtctctgtaaaattggtaaggattctggtttagtgtgaagaaccacattttttgtgtatgtttctgggcccatgggaaggaacagatcatatttgacatacaagaatcaaatgattcaggccaggcatggtggctcactcctgtaatcctagccctctgggaggctgaggtgggaggattgcttgagcccagaagtttgagaccagcttgggcaaaatagcaagacttcatctctatttaaaaaaaaaaaaaaaaaaaaaaaaagaatcaagtgattttgctcttatctggagttgagacaagccagatgttctcgtgttgttttcataagcaaaagaggctaaactgatggccagaaagtactcctgctcatagggacctattcattggtctccagggtttacactgacctttaagtctaatcacagggggtgggtggttttgggataggaatgaggaacctccaaggccatgttcttagctccagctaaaaataggtctttcctttgctcttaagcctgaggtgtggaacttcctggtgctactcactgcagctatggtccctgtctagggcacttggaagtctgaagggaggcggaggagggcaggaggggttatttaaccacccagcccctcctgtccgttccgtggcttcactccatcacctcactcctgtacttcctgttctcattcactgatgagtcttccttccttcattcatttcaagggccactgtcagctttctcccttaaaatgcttctctggcctccatgctttgctgctcactttcctccctgggtcccctgagccaccccatcccatcaaatccttcctgagcccttccacagttggaaccaacaacctctgaagctttgctcgcagtccagatgaaccaagtcgctgtgctttcctgcctgtgcctgtgctccaggtgtgtctgtcctctgcctggtgtgaccatctccctcttctgcccttctccaggatcaggcattccccagtttcccctggtaatcactccaccctgtgcatctgtaggactttgaaatgctcttatcagggtctgtctcattgcactgttatttatgtacctgtcatatgttccttactctccagtgtcagctgcaaggagggatcattctggttaatctttatgtgcttcaccatctctctcttttttttttttttttgagacagagtctcgctctgtcacccaggctggagtgcagggacataatcttggctcgccacaagctctgcctcccaggttcaagcaattctcctgcctcagcctcccgagtagctgggattacagacgtgcaccattatgcccaactaatttttttgtgtttttagtagagacggggtttcaccatcttggccaggctggtctcgaactcctgacctcatgatccgcccgcctaggccttccaaagtgctgggattacaggcatgagccaccgtgcccagccacgatctcttaaataaaggcgtttaagtgtttgttcagcaaattgggcccataaatttggtgggaaataaatgaattgctttgaactgcattcatgatgattgcatgtgtttatccttgtttcccaagcctttggttttccccaaatacacagaaaacagttgctcatcaatcctgcctcttcccaatgaaaatgatacaaatatatacatattttccttgtcaggcagttgaaataggtaaatccccagtgagattcactctaggtacacccctggccagatctatatctgaaatgactggtttttatgactttttcttttttttttttttgtttgagacagagtcttgttctgtcgcccaggctggagtgcagtggtgcgatctcggctcactgcaagctccacctcctgggttcacaccattctcctgcctcagcctcccgagtagctgggactacaggtgcccgccaccacgcctggctaattttttgtatttttaatagagatggggtttcaccttgttagccaggatggtctcgatctcctgaccttgtgatctgcccacctcggccgcccaaagttctgggattacaggcgtgagccaccatgcccagcccatgacttttcaaatgtgcttttgaagtggtcctaggatgaggtggggctctggtgaagttctgaaaaggggcgtccctagtcatcatagttattcattcattcaaccaatattgtgtttgctttgtgcctggtcctaggcttgaggacctagtctctgtccctccaagaaacttaaggtctgctggagagacaggcaattaaatgggcaagatgtcacactgtgataagtgatacaatggggtgaacataggtgggggccccagtggtttaatttctcctgttcctccatttcaggttttgaagagacaggggacacgctctatgccccctattccacacattttcagctgcaggtaagtgatttttttctccctcttcatcaaaggcattagcacctcaggaacactgatcctttggaaacagacgatgttacctttctcatggcccctagatggccacttgaaggaatgatgggtcttctttcctctaagcggcctcacggggttagtgggtaagaatgagtgcttggcatagagaggacttgggggtgggaggcctgggagaaagggaaggaaatgagacttctgcccagactggagacctgttgaaatggcaggaactggagtgggtttcacgatatgactgtttccttttcagaaccagcctccccaaaaggaattctccatcccacgggcccacgcttggccgagcccttacaaagactatgaagtaaagaaagagggcagctaactctgtcctgaagagtgggacaaatgcagccgggcggcagatctagcgggagctcaaagggatgtgggcgaaatcttgagtcttctgagaaaactgtacaagacactacgggaacagtttgcctccctcccagcctcaaccacaattcttccatgctggggctgatgtgggctagtaagactccagttcttagaggcgctgtagtatttttttttttttgtctcatcctttggatacttcttttaagtgggagtctcaggcaactcaagtttagacccttactctttttgtttgttttttgaaacaggatcttgctctgtcacccaggcttgagtgcagtggtgcgatcacagcccagtgcagcctcgaccacctgtgctcaagcaatcctcccatctccatctcccaaagtgctgggatgacaggcgtgagccacagctcccagcctaggcccttaatcttgctgttattttccatggactaaaggtctggtcatctgagctcacgctggctcacacagctctaggggcctgctcctctaactcacagtgggttttgtgaggctctgtggcccagagcagacctgcatatctgagcaaaaatagcaaaagcctctctcagcccactggcctgaatctacactggaagccaacttgctggcacccccgctccccaacccttcttgcctgggtaggagaggctaaagatcaccctaaatttactcatctctctagtgctgcctcacattgggcctcagcagctccccagcaccaattcacaggtcacccctctcttcttgcactgtccccaaacttgctgtcaattccgagatctaatctccccctacgctctgccaggaattctttcagacctcactagcacaagcccggttgctccttgtcaggagaatttgtagatcattctcacttcaaattcctggggctgatacttctctcatcttgcaccccaacctctgtaaatagatttaccgcatttacggctgcattctgtaagtgggcatggtctcctaatggaggagtgttcattgtataataagttattcacctgagtatgcaataaagatgtggtggccactctttcatggtggtggcagcagttaccagtaatgagcattagactctgggggatagaacacgggctgccctgagagcttcatgttggagctgaagttcaaggttcacttcctttgggtttgtacttgacccttcttcatgtgtctctcccgttccctctaaaacaagtgtgtttcccctcatttttgaggctgtcaatggtgtgagagccaggatcatcacggggcctgaggttttactccagaaaagcagaggagtggcaaccttggcttggggtttggcagcccaggaaaggcagggaggagagctcaaagccggtttcatgtttcacccaaggtctaattgtgggagaggacaaatccagatcccctgtttgacagaattagttcacaaatgtctcttggcaaaaacatgtgacacctaaccatgataattgacttaatccaagaaagagctctgtagggcagagcaataggaaatctctctttcgttatggaaaaaaaataatccctctacatagaaactgagtgacatgtaaaaatgtgtagctaagtcagggagttacttcctaagagcctgacgctctgcttttcatcaaaaggaaaaaccagcgtgaggcagaggcgagggaggtggaggtgagtggatgatgtgctgagttagggatgtttatatgccgcaaaggtttggttggtaggcttcgcgctaagattagcctggctttgtactgaaaagggggaaggacacatagtgacacagatccttctggtctttcccaggaggtgtgacctaatgaggtttgttgtgagaataaagcaatgtggtttcacatatattatctatcataggctagggactcaagaaatgcatattccccccccactttctttctctctttccttccttccttcctttcttctttctttctttctttctttctttctttctttctttctttctttctctctctctctctctctctctttctttctttctttttgagatagagtctcactctgtcatccaggctggagtgcagtggcatgatctcagctcactgcagcctccgcatcctgggttcaagcgattttcgtgcctcggccttctgagtagctgggattacaggcgtgcgtgcgccaccacgcctggctaatttttgtatttttagtacagacgaggtttcaccatgttgaccaggctggtcttgaactcctgatcttaagtgatctgcccgccttggcctcccaaagtgctgggattacgggtgggaatcaccatgcccagcctcctttccatcttttctttccttctctggtcttcatactaccaaccaagcaagggaggaggagtaaaaggtaaaatcacaaaatactctggatcggcatttttttttttttttttttttgagacagggtctagctctatggcccaggctggagtgcagtggcacaatcatagctcactgcagcctcaactttctgtgctcgagtgattctcctgcctcagtctcctgagtagctgggaccacagacgtgcactaccacacttggctaattttattttttcagagatcacatgtggtttgagggaggatagagaggacagggtgtcaagaacagcatttttaccaagttgatataaaaatgaaacaggatccaggcatgggtctttacactgatagttacagtaagttttaaaatctgagcagcaatttgaatcacttgttgaaaaacacacaaaatatattttttgtagaggtgggggtcttgctctgttgcccaggctggtcttgaactcgagattctcctgctttggcctcccacaagtgctgggattacaggcgtgagctactgcacccggcctgctttctttttagtgaaaaggatctgtgggagcttttattcccatggctgccttcctcaagtcaacctctttccccggaaatggcatcatctctggactgttgtttctccttcttccttctcctccttctcctcctcctcctcctccaccatgcccgg
